United States Patent 8,067,671 (METHODS FOR GENETIC CONTROL OF PLANT PEST INFESTATION AND COMPOSITIONS THEREOF) - sequence listing, part 11

SEQ ID NO: 9759 - DNA, 2950 bp, Heterodera glycines
gaaaagaaggggagcccctcccaagcaaaacaaataaatttatttatttttcggcagaatcagcaggcagggcacacttctcctcccgactccctcactttgctttcccccccccccccccccccgaggggagagtggggtacccgggccccattttcgggaacatttttgttgttgcaccaccaccatcaccacctccacctcgacaacaactgggccaaaaatgcacaaggccgggcaaactttcagcagcgccacccatttacggggggggggaagtaatgggagagggatgggtgactctaatgactgactcttttcttcctcccctcccctctcccctcacattttgccttttcttcccgtcgtctctttggcccataactcacttaaatgtatgtattttttgcaagaatcggaagtttaaacaaacggcggcgacaaaattcatttcttgtctccaaactttcctctttctctttttttatctctttgtaactctttctttcctgtcccttcttaattcccgtttaaactctcttttctttcgctcccttcgctttttttacttcctctccccctctctcttatctctctctccccctctctcttatctctctctccccctctctcttatctttctctctctctctctctctccctttctcttatctctctctctctctcttcccttttatctctctctctctctctctctctccctctccgtctctcttatctctctctccctctccgtctctcttatctctctctctctctccctctctcttatctttctctctctctctccctttctcttatctctctctctctctccctctctcttatctttctctctctctctctctctctccctttctcttatctctctctctctctcttccctcttatctctctctctctctctctctccctctccgtctctcttcccttttatctctctctcccactctctctgttccactttttctcttttaccgcctatcacttctgctttagttttttctttgcttccctcttttcactccctttcccctcattttttgctgctttttgttttcccgtgatttttgcatccaaaaatcccaaattattatgtatgcatgtgtataatttgttatattgttcccataaagacaaatgtcaattttttcttggcaaatccaaaagttggcagacataatttttttttaggtgtatccaaatctggcacataattagtcatttctggcataggtatacaaattatggctcgacgtacgaaatgcaatgaaaaatagcgagatattcatttttggcactttttatgtcctttaggcaaaaaaaattgttataatttatttgaatttatatctttaacagtaaattagtatagtactttcgatccaattttggctgaattcaattccaaattaaaaatagaaaaaattaattatgcacctaaaataaattagcgttttcaagaaacctatattaaatttcatcgcatatatgaggcgatgcaaacggaaactttgtggaaaattgctaattttttgatacttttttccccgaatcgcacactatttctgccaaaaaatttctttttaaccatccttctaaaaaaccgattttgtgccgttaatttattaatttttgtaattttttaccccccccccccccactctctttctctctttctctctctatcttcctatctctcccctcttctcttccgctctctctatgtacctccttctcattttcacaacgctatttctttatcaaagatataaattgccttttttttgttattatcatgttacttttcatttttttcgtcacctcttcatagaaattgccaacaattattctccgccggtaattggatataattgacgtaattaggccgcctacagcaagcagcgaatgaacgaaattgagaatatccctttctctccgataatgccatggggccattaatttacacagcatgaaatattcaaaaagcaaacattggcgccggttgggacggccaaaaagtgcaaaatttgtgaaacaaaagccgaccaaaaattcatttttagtctttattttacattattaaaaatttggatttaaaaatataccctaccaaaaagtatcgccttttgagaaataagcttcggggatttttcaagattgcacggcattggcatggcaaaattctaaaaaccccaaaaaccagggttaattgtaggtaatcaccgattctactgtcactgagaagcatttctctagctatgtatcccccgacaaatgattcccgacattctcttctcgacggtcggtagcaactccaattcatatagattatatttcccgcatatcctattccatttaatggacgaaatttcggtgatggataaagccttctaaaaaattttaacaatattttataaaaattaaaaaatttctctatggttcctattggcgaataaaagcgcattaaaaggcaagcaactatgattcctgcaaaaagaattcataaaataagttacagtataaaaaaaccaacatttttctaatttttgattctgtaggatacagtaagaaatcaatggactctaattgaatttatcattcatctattttagtcacaatttatgcctctctctattattatttcccaaaacaaaacattaacaaaataaacatttgtacatttgcttatttatcgatgcgctttttattttcagtactgaaaactatttttctaaaattggggctttcgagaccgcaaattcaaactcagaaactcgagaaaacaaaacaaaatcttagtcaaaggctaaaaaagttgaaaatctaacccagacgataaaaataagcgggcaaatgataaaagcaagaattctctagttaaaccagggttaccctttgtccttatttgtaagatttgtccttattt

SEQ ID NO: 9760 - DNA, 1568 bp, Heterodera glycines
ctccggcaatgccattcggtactcgtcgtgtgccatttgccaaaatttgtaccgatccgtcagttttgtttggcatgcgctggacaaatgcacttggccgttctgtgccgcgtccacagggcacatgataactgagaaaaggagaaaatcattttcggctgataaaaacttctttagcagtcaaaaaaatctttttataaattattcataatatgagcaagaagaattgtatagttgactttatccgtttacagccttagtgcactaatttgcccaccagggctgggccaaaccaaaaaataaaaagtgaatgaaagttgaaatcgcgaaaaaaggtgaaaatggagaaaaggtaaaatatgaaatttacagcaactttgttcgttaaacatttttttttgacctatcatttttttaaattgggaaataaattaaaaagtttagcaatagtcggtgccaaagtgacccatgccaaagtgacccatgccaaagtgacccatgccaaagtgacacatgccaaagtgacccatgccaaagtgacccatgccaaagtgacacatgccaaagtgacccatgccaaagtgacccatgccaaagtgacccatgccaaagtgacccatgccaaagtgacccatgccaaagtgacacatgccaaagtgacccatgccaaagtgacccatgccaaagtgacccatgccaaagtgacccatgccaaagtgacccatgccaaagtgacacatgccaaagtgacccatgccaaagtgacccatgccaaagtgacccatgccaaagtgacccatgccaaagtgacccatgccaaagtgaccacctatccgtgctcgtcggacctgacaaattcgctccttaaactgattcgtgcgcagttctggaatttgactgatttgctccatggacagcttcatctacagaatggaacagaaaaaaatgattaaaaaaattattgtcttgaaaagttttatgttcatttatttcgtaaaacctcacttgttttcgactcgaaaattcataaaaactttagttaatgctcaattttttttaattatttgaaagttttattttctaaatgagaaaaaataattttcaaataaaatgtttttgtacttttagggcagaattttacatttttgcctctattttctaaatatgccaactttaaatcttgaattcaatttttcgtgaattacgtgataaactctgttttgtagggttttaaattatgcaatttcatttcacataaaaataagaatataagcgatttaaaaaaaaataattcaaattaatttttgatttccttttcttaattaactatacgaaattaatttgttcattcagaaatcagtagggttaaaatttaatttctaacaaaaaacttgtaaactttaaaacgttcttttatattttcagaaaattaaatgtgtacgaaatgaagtaagtaatgagtgaaggaaaattattaattcatattagtcacaatttttccattcgaaaaattgtcaaatgttaaaaattaatatgaataatcgggaagtaaaagtaataataaatat

SEQ ID NO: 9761 - DNA, 1700 bp, Heterodera glycines
tttatgttcatttatttcgtaaaacctcacttgttctcgacttgaaaattcttaaaagtttgattaatgctcaattttttttaaatatttgaaagttttagcgcgccgaaaaaagtgataaaaacaaatctgaatttctaataatattcgatcatttgagtcaaaaaaagattaattgtttgaataattgaagaaaatttgatttgaaaattttcattgatttaatttagtttagttttggatttataaaataaaaaattaattttgtattattttgagtagaaaaagttttaaaatgtgaattttaaaatttccggttggtcccggccctgaagaaaaatctaggtccccggtcccggcttctcaggtcccggcaaatcacggtatcggttttgcccaaaattcctggtcaagcttcactctaatttttaatttgaaagtcaaattatttcttatttcttaattaactatacgaaattaattgttcattcatattaatttctaacaaaaaacttttaaactttgaaacgttcttttatattttcagcaaattccctcttttttcttttttttttaatttgccactcaattagcctccaaatttactaaaataattttattgaaataaatttgtgagataaatagacggtataaacattttaaaatttttatttgtttttttttaatttttaaaaattattttgctggttgttattcataaattgatattaattaaaaatgtttttaaatttatttttgtgcttattcatcttttttcttcattccgacattttattttattttttattttttggttttttcatcttcacatttttaaaactatgaacataaacattttttgctgaattaacagcaaatttctcaaatttctaaagatgaataatttatgaaaatgtttatttttttctatttaaacaaaattataatttcttttataataaaaaattaataaaaatatgaagataaaatttattttaatttaaaatttgttaatttaagttgattatgaattttttatttattaatttcatattttttaccgcactgttcaactccgtcaatagccaatgcttctcccctgaagagtaattttacacttttaatttttaatttgtaattttaaataatgttcaggtcgaatgacactcagttggacaagtgctgtggtgaaaaggtaaattcaataatacagtatcattaagttcggtacggtcatattcatcaatcgattaattaaataacgtatcactaacttttggtacgtcattaatctatcgtttaaattaaataacgtatcattaagttcggtacgggcattcattcatttatcaattgattcatttgccaatatattttgtcaaaatgttcaactttaagctggtctacactttgaacattaacgaatcgtgttcaattcgtggaaaaaaattcaactgttcattggcatggctgttggaacgatacaaactttcggacaaatacacaatcgaagcgaacactgaagtaaaataaatgattatttaataattcaagaaaaataataaaaataaaatattaaaaaaatatatttaattaataatccatttcaactgctatcattgctaataacttttttcttttctttttgacttttcaaaaataagcaaaatatttaaaaaatatattattttactattttt

SEQ ID NO: 9762 - DNA, 977 bp, Heterodera glycines
  misc_feature (88)..(88): n is a, c, g, or t
  misc_feature (156)..(156): n is a, c, g, or t
agttcgaggcaaactttgtcatccttcataagacggaaagtacgcggcaaatgatgaaatggttggtatttatcctcatggagccctntacaaatatctattggcactaaaatacttaatttcatccagaaaatgaataattttttatggtttttntggattagaaaataaaaacccattcttaggattggccgacatttgcggcgcccagtcaaagcgacacttgcggcgctgacacttgctgcgcccagtcaaagcgacacttgcggcgcagacatttgcggcgcccagtcaaagcgacacttgcggcgccgaagtagttacccacgaccttttcaccggattacggtagccccccataggtgtgggaggggtgcatggccaactgagcgccagccatttgagcgccgccaagtgagcgcgggccatctgagcgccagacttttcagtactgaagccaaaacctattgcgcgacttttttttgaaacccaaacctattgcgcgacttttttcttgcaaacccaaacctattgcaggggggtgcgcgacttttttgactgcgcgactttatgcaaattattttaattaaattcatttaattttaaattattttaaacgtcttaaaggtcaaagacgttgaatttaaattcatttaaaattctccaaaaattccccgcaccaagcggatccgaaccccaggggggcggccagactgacgctctaaccactcggccacattggcaatggatgataaacattaatttgctctcataaagggaaaatttgacgtcaccagcggcggtagggggcgagagcgggcggcgagaagggggagggggtcaaataaacaaatcaattaaggaggggcgggggtgttgaaaaggtgccaaataaacaaattaattaattggttgcgtactttgtgttgccgccctccttcccgcatgcccattatgtaatttgacaccttcagaca

SEQ ID NO: 9763 - DNA, 1767 bp, Heterodera glycines
  misc_feature (1314)..(1316): n is a, c, g, or t
  misc_feature (1323)..(1323): n is a, c, g, or t
  misc_feature (1327)..(1327): n is a, c, g, or t
  misc_feature (1333)..(1333): n is a, c, g, or t
  misc_feature (1337)..(1337): n is a, c, g, or t
  misc_feature (1341)..(1341): n is a, c, g, or t
  misc_feature (1350)..(1350): n is a, c, g, or t
  misc_feature (1356)..(1357): n is a, c, g, or t
  misc_feature (1360)..(1361): n is a, c, g, or t
  misc_feature (1372)..(1373): n is a, c, g, or t
  misc_feature (1385)..(1386): n is a, c, g, or t
  misc_feature (1388)..(1388): n is a, c, g, or t
  misc_feature (1390)..(1390): n is a, c, g, or t
  misc_feature (1403)..(1403): n is a, c, g, or t
  misc_feature (1408)..(1408): n is a, c, g, or t
  misc_feature (1410)..(1410): n is a, c, g, or t
  misc_feature (1415)..(1416): n is a, c, g, or t
  misc_feature (1422)..(1422): n is a, c, g, or t
  misc_feature (1426)..(1426): n is a, c, g, or t
  misc_feature (1432)..(1433): n is a, c, g, or t
  misc_feature (1443)..(1444): n is a, c, g, or t
  misc_feature (1446)..(1446): n is a, c, g, or t
  misc_feature (1456)..(1456): n is a, c, g, or t
  misc_feature (1464)..(1464): n is a, c, g, or t
  misc_feature (1470)..(1470): n is a, c, g, or t
  misc_feature (1474)..(1474): n is a, c, g, or t
  misc_feature (1488)..(1488): n is a, c, g, or t
  misc_feature (1493)..(1493): n is a, c, g, or t
  misc_feature (1498)..(1498): n is a, c, g, or t
  misc_feature (1534)..(1534): n is a, c, g, or t
  misc_feature (1550)..(1550): n is a, c, g, or t
  misc_feature (1554)..(1554): n is a, c, g, or t
  misc_feature (1561)..(1562): n is a, c, g, or t
  misc_feature (1572)..(1572): n is a, c, g, or t
  misc_feature (1579)..(1579): n is a, c, g, or t
  misc_feature (1582)..(1584): n is a, c, g, or t
  misc_feature (1586)..(1586): n is a, c, g, or t
  misc_feature (1589)..(1589): n is a, c, g, or t
  misc_feature (1596)..(1596): n is a, c, g, or t
  misc_feature (1607)..(1607): n is a, c, g, or t
  misc_feature (1609)..(1609): n is a, c, g, or t
  misc_feature (1620)..(1620): n is a, c, g, or t
  misc_feature (1630)..(1630): n is a, c, g, or t
  misc_feature (1633)..(1633): n is a, c, g, or t
  misc_feature (1635)..(1635): n is a, c, g, or t
  misc_feature (1646)..(1646): n is a, c, g, or t
  misc_feature (1667)..(1667): n is a, c, g, or t
  misc_feature (1702)..(1702): n is a, c, g, or t
  misc_feature (1711)..(1711): n is a, c, g, or t
  misc_feature (1715)..(1715): n is a, c, g, or t
ttccatggcattgctctgtgccgctgagcctgactgtatagtgccaattggacagacgaaagaatgtctatacacacgaattgcaccaaatctgacttgccatcgccaacatcaaagtttgctagatactctgctctacaacatggaatatcggaaacaaattgcgggttggttggacagatttatgattttgtttaattaaatttatcttttctttttaatgacagatccctcatttttgccacatacaagcgctaagcatccgcgatggtcagccaaattcattggttcttttcgcatcaaacattcccgatcattcgtggggaatgccgaagaatggctgagcaacgtcaaatgttgctgaacagtgatgacccgcaattgtcgggaccaaaacaattaattgacattgactaatttcaccaaaaaaatatgataactttgattggcatattttcactggagataccgtattggagttttgctatatcctcaacgaaacacatatatttatgaaaaattggatttaacaggattaatcatgaaaaagggccaaattctacatttcgatgcctgctgttggattcggaaatgttattatatatatttttttggttatttatcaaaatgctgattcatccttatccgttttccagtccctctcatcctttttcacggatgttcgacagaatgcataaaaaaattccaaaacaattttgataccacacggaaaaacactttcaaatgtaaaataaagaaataaattaaccataaatattattataaatatacataaaaattatattaaatttaatttctgtctatgttattcggtgattttagactaaaaatgacttttttaattgtcaaagtcatttcttttttaaacgttgttttaatgtgcatcatttgtcaattgtcaacaactgatgaagcgtaaatttttttaaattttcaaattaaagtgttcatttgactgatggtggcggcggattcaaacaagtgcaatttagtctattggcacaatgccatgccaacaatgaatattacagaattgaatttcgtctgatggttcaggatgtcggaaattgcgaggatgggtgaaaaaaaaactataaattggatgaaaattagaaatttttttttataaattgttaatctgaattgatagcattctcatctgttacccggccctgcttcaacgagccaaccaattggacaaaagcggaaattcaaaagtaaaagaaaactcatcattagcgctaaaatggtaaattttgggtacctaattaaaattatatattaactctccannnaaattcnattnaaaaanaaantatncaaaatatnccaaannatnncaacaaaaatnntacaatcatttnncncnccattaaaattcncacantnccaanncaaacnaaanacaaannactcattttnnantcatcaattncctctaanaaattntttnaatttttattaatnttaancaaantaaattaaatttttaaatttaaaaattattttatancaaaaaaatattatantaantttattnnaatatttaanctatccnttnnntncanaacaacncaaattttctntnctttttacttnaatcaaactnctncnccattcactcncttttcatcagtggaaaatgntgaaaatccatattttatataagttatattctcgnctttcccancatnccattctccctagtagggggccgtgccatgcaaattgatttctccgttcaaa

SEQ ID NO: 9764 - DNA, 1037 bp, Heterodera glycines
tgtccgtattttcgtctgtcgccgaaatgtccgtattttcgtctgtcgccgaaatgtccgtattttcgtctgtcgccgaaatgtccgtattttcgtctgtcgccgaaatgtccgtattttcgtctgtcgccgaaatgtccgtattttcgtctgtcggagtcggagcctccggagttggaataggtgttgttgtagtcgttgttgttgtggtggtggtggttgacttaaaagaatcgaggcttaagaaaaattgacaccgaaattaaaaaacaaattctttataaaaattttgtaagaaaagtggggccaaatttaaaaaaacaattattttattgagacatttttttgtatattctggtataaaatttagaaaatatttaattgtaataattaatattatgctgattatattttatgtaataaataaaattattattaaatttaaatttaaatagttatttattaaatttaaatttaaaaaattattataattaactaattatatttaagtaataaatattattattaaattttaataatattattattacatttaatttaaataatcatttattaaatttatatttaaaaaattattgtaattaactaattatatttataaaattattattaaattttaatttaaataaaaatttaaacaattattatcttttaatgatggaccaaataaaaaaaatctcggtttactactttgttataaagcaattcggcattgcaattgtcttgcgtgcagtttttacattgcacaacataatcctttggctggaaagcattgttgtgaagtgccgcgcaaaatgtctgcaacgaatctctgcgatggaaatgagagtgtgagtcaactcagtcccggccaactcagtcccgtaaggttttcagggtcccactaatatagaggagggcacttaggggctattgaatggcaccaacaatgtatgttcggtttggttgagaaagaaaaaaaaaagaaagagtccggcggggcccaaacgtgccgagacccaaaactgactctagag

SEQ ID NO: 9765 - DNA, 3285 bp, Heterodera glycines
gcggagcaggacaaaacgtcgtcgtccgaaacgtcgtcggacgaatttttggaccacaacttttttttctttcttaaccaaattaaacaatcttggtatttattcgaaagcttttgaaaaatgctattagcctgcaaattttcaaaattttttattcatacacaaaaaaaccagggcaaaacaaaaaaaaaagttcgaaatactaggtttttgagttccttctggtcataacttgtttgaaacttaacgaaaatttttgaagttttgtgtaataatactacacacacacaaagctatcgaacaacaccaacaatgcttaatttgattgacaatgaacaaagttattgtttaaaaagtcttccgttccgacgacgtttcggccgacgacgttttggggtgcaccggcctccccccccccccgccccccgcccttccgggtccctcatcagacggggcaattaggtttttctttggcaattaaaagtgcaaatttggagaatgtacggaaaattaaagtcgattaggaatggacacaacaaaaactcatctttttttgtttttgcattttgacaaaaaccagctgcttgctgattcctctgcttttatttgctgaattttgccctcttcgacgtcaacaaaaaacaattatttatttatttattttttttgggtgtgccaatgaatggagaacattctcggctccctcatcaagcagataatggttttttttatggacgaacaatgtcaaaaattaacgaaatttaattataaatcttgcgaaattcagcggtacgaatttttttatttttaaattataaaaagaattaaatttatctttgaaatgcacaatattttttaaaccaatttattaaaatttttatggttgaaaataattttgaaaacaaaaaatgcataaaaagaaaattagcaaacataataaatttctttttttttgtcctcaatcattttcttcttccttttttcactttttagcattcttttcactctaaaattgtaaatttattaaaattaaattgttttttaattttaataaaatgccattacatccaattcttatgccaaacaagcaattcattgtttcacatggcttctcatcaacagtttttgcttaatgaatttaaatgatttacttacaaatgcaaagatttaataccaatgaatgatttttctgtttagacaattatttttctaatataaagtgttttaataatacacacacagagctatcgaacaacatcaacaatgcttaatttaattgacaatgaacaaagttatggttcaaaaagtcttccgacgacgttttggggtgcaccggttgccgagcccctaaaaatctcttaaaattttcaaaaattgacttaaaggctgcaagtttccgatgaaaaagcagttaaagatggtaaaacacaaatcgcaaaatttatccaaaaaaagcggtttaaaagcaaagtaaaaaaaattgacgaaaaaaattattttttcagtaaaacagtttatgaaaactcaattcatttccttacaaagttatggttcaaaaagtcttccgttccgacgacgtttcggccgacgacgacagtggaaaatgcgtcagtgataaaaatactttaaaataaagttgtatggcatttgtattgttcatgatgccgttttgaaccaaatatgctaagctccggattttttttttttgattttttatacttttgatttagcttaccaatctcattttgcttcattctctgaattttcttctgctaaaatggccgagaaaatgtaagtccttttttaaattgaatttgttctttgaatagagcccccccctgctttatttttttaacgcacttcggggggggggggtggctttaatggagggggcggggctattgtcgaaaaatgtgatgaattaaaatacaaccgcctcctctcatcttggtgtccttgttctgctgctggtcataatgcgaatttttacacagtatcacaatattaggcctaattaataccgtaatcgcactgtacactgtgtgttcttacagtagtgcctcttcttcttcctcttttgtcatcatcctcactctgttgctgctttttctccatccggcgcttggtggcccggcggcctacggcatatgccaggccggctgctctgcgctggtggtcgcctgttatgcggcggcgggcgctgtgttcggcacggtcacgaccggcattggcactccgccagcaatcattgcatgcaacgcggcatacggaacgtgccaagccgcatgctgggccgcacttcacgcgccgacgctttgatttgatgatggttcccaaaatttgggcaacggaatgattggctctgacgaaagtgccatttaaatgtgaccgattttgaattgccaaattggcaaattttctttctcttttgtcaaatcatttttaaatgaatttctatttttgtaaaatgttttttttgaacttttcagtccacctttgttttggccatataatgttgaaatattatttatttctttttttaattaaatgctccaattttgattgctttaacaaagacttcattttcgatttaattgataaatttgaattttttaccgatgaatgaatgaatgcatttgatcaaaaaaattattggatgtaaaagttgtgcggatgattcatttggcaaatttatttatccgacaaataaatgctaacagaaaatcaaatgaataatttatttttatttatttcaccatcggaacgaataaaataatatgaaatgcattttatttctgttattattccgagaaagaaattttttaaaaattgttttattttttgttaaattttacaaaataattttcaataaaaataggttttttttgaaagagtgtgtctgtcgttttttaaggaatttcgtgcaaaattttcaacttttccccggcggcgtttatcattcaccgccggcggaccataaaatcccttaatgattaatcaaaatttggtgctatgtgctatttcctctaccgatcaccgactttttttctccccgaagatcgcggcacaaccctaatctattcgataataactgacgtcacatttgctcggaggactttaatttttcggcatttagaattggaattcctccgattgtcccttttcaagtgatttttaggcatccaaattcgacacaaaatgactttctccatggaaattgtgcttttcacctcaattgttgctgcacaaatggttctgtgtgcttacggtatgagtgttgatgat

SEQ ID NO: 9766 - DNA, 5927 bp, Heterodera glycines
  misc_feature (3985)..(3985): n is a, c, g, or t
ccgcttgggaaattttgaaaattagagagtacaatttgttaatttttgtcccaaaatgaacaatttttaggaatttgatgctgttttactgtgtttgaaaattgctagagaagatccaaattcataggggtactaaattctgatcactcccgaccaccattatggagagtgatctgatcagggtggtgcactgacttttttggtcagtaccctgttattacttcgctaaactttttcaaatttgtatctagcgcagaaaaatgataaatgtcttcaaagttttagacctatgtttttgttacgccaaatttgggccactttcagggaaaagtcgtaaaactttttttctatactttacaatttattttattatttaattacatgtaaaatattaaaaaattcgtaaatcaatacatgcgttaatattgtatgacgttttgtcatatggccgtcgtccctctgctgtcattataaacatgggagaagggagaaggcaggcaatggcattgtgggggggggggggagaaggccggcaatttctaaaagccaacaatgaaaataggcataatgtggggtgaagacaaaaaaaattatagtttttattgtattctatgaaatttatatggcagagaaaaaaagtaatagcattttgcatataatggaaacagaaataaatgaaaggggtatagaaaaaaatgaaataacacaaaaggaagacgcacacagccgaaagaattaggcaaaatgccacgtttggcaacgtggcaaatttcccttatttaatcagaaaggaaaggcaagaaaatcataattcaatcaacatttgaagcaaaggaatcaacaccagacatggccattctgctgaagtgtgtgctgctcctctcaatcatggcgattttctgcgactgtatggaccccggcaaaaaaggaaagagcaaaggtaaacccaaaaataaaaataatttttataattttattttaagccattcgaaaaaaggctgagcccgatgactattttaaaatgataaattttaatgcaaactaaaacgatgatttcttttcctaaattgatcgtgaagccccatcccgttcatttgataattctattgtctattaattataatgaatttatcaattaataatgtttatttacttaatgctcagatccgatcccaatcccgaaacaggaaggtgagcaattaagcaatgaaaacgaacttaaatagaaataaggatataaaagttatgtttaggttaggatttatagggctagaaaaatgcacaccccaaggattgactttttggccaaaaatgaaaaaaaatttgaggctcatcgaaagttttatggcaaaaattaaaaatctcatttttttttatcattttcgcccgcacaatcgcaaatcaaataatagaagaagtgatttatgaaataaataataaagaaagacaaggcaatttctgcactaaaatccgatgaattttaaggaaagccgagcagcagtgcagcgaatagcccgacagtaacaaaaggcactccgaaacgtggcggtaaattttaaaaatcaaaaattgaaaaagtaaaaaatatatatcagactaaaaacataaaaaaatgaggtccacggaaagttttatggcaaaatttaaaaaagccataatattaatttttaagtaaatatcgaatttttatacaatttaacatttattatgaaaaccaccgtagacagttttaggcaatattttggcaaaatttcatgtatcatttgaattcaagttcaaaggttgcgcgattgcttagtggctatttacatcttttatttttttttaatatatttttattttcattaaagattctgctgaattgaatattttagttacattaaatttattttaatgaaaaaattggtcagaatttttttttctgcaattaggatttaagcaagctttaaatcagagctcgcaagtgtagtgctgaatttttagggttttttaaactaaaaattttttcatttttgaccaggccaaaatctgctaaaatcacctaataaataaagttgccgacagaaattaataaatttttcccaattacataatagatttgcacgaaaaatattgtggatttttaagttgttttttaaattataatcaccatcaaactatttgaaacttcgaataaagttcggaatttagaattccaatcccccaatatctgaattcggtgttcttttatattaaaaaaaaatacctaaaacaattccaaatgtttttggtattttggctttgattttggttatattcctgcttccttccatttaaaatatgaataaaaaatgctttcattaacaaaaaatgcaaaattgctaatagaagaagtgatttatgaaagaaataataaagtaagacaagataatttcagcactaaaatatcaaaatctccgtaattacgaagttagagatttccataatctaaatccaatttatgcaagcccggatttaaaaccaaaatgaaccaatagcaaattaaatttttttatgtgcactgatgtaaaataataaaaagaagaaggtattagttaataaaaaattttaatgcatgcaaaaatggtaatagaatcaattaattgaataaaataatgataaaataagaaactgaggcaaaagcttttttaatcttaatctttttatttggacaattctaatttcaatttttcttttaattttaactcttcctgtttttctctttaagaacttgatacccccgaattttacaaaacgagcccaaagaacaaaattaatagcccgagaaagcccaacaacggctctccgagaaagggtaacagtaaacataaaataattaattaattaataagtcgaataaaactttgcaaatttcgtccggtggccctatgggtgtatccctgaattgtttaaatatgtttctgtaaactttgactattccgttgttttgagtgtgctttactttcgaatttactgacttgtaaaaccaagtgatatgatgaatttaaaaaatcgtgaaatataattaaaaaaatatattcaatgaattaattcctaaaaaaaataagtagaattatatttaaatttcatttcgctaactcttctttataaaaatccaatttttcaatatttaaaaaaatatgtcaaaaatttgaaaataaaaaaatccaaagtctgtatatactatataaaccttgtgcatatttcagaatattttatataaattctgatgccacattaaagttgcaacaaagttaaaatgtgcttacatttttcttaatttattcttagtaaaatgtaaaaccttattgtactatttatgaacattgataaaataagtccctttttattattttagataaaaaagctctacaaaaggaacgtcaagaagaaagaaagcaaaaagaaagagaaagagaaaaccgtttcctgcgaacgaaatcaacagcaggtgctaaaaatggctacccaacatttgaggataaccccgccatttgagcatgtgattggtcgtttgtaaaaactgccaattttatagactcgttagaaatttttgcatctagttttcagaaaattgtggcaatttttctgaggatttttggtcaatttaattggttttgtttaagaaaatttatgcaagtttttcgcgaaaatcgtaaatttgcatttgttatgaaacgacccaacacggctaaggagtagcacaattcaaaaaaaagtaaaaagatttttacacccaataaagacaaaatacctttccaaaggaaacaatatttacaaaaaatcttctcttcatttgtgtttttaaaattagctgagtcaatgggctagtcatatcagcgccaagccaaaataaaaaaacgaattaggggttttaaaggtcggtaaatcagatttgacacccattttcgacccaacgaacccgcattcatttcaaaaacataaaatctgaaaaaattaagctatnaataacatcgggttctgatcaaaaaaaaatcactttgaaaaatggacgacccacaagagttgttttttatatccaatattcttttaattttgtattatgaagcagtaattagaccactaatattttgggtttccattttgattcagattaagggatggttttaggtaatacgactgacgcgactgacgtggaaaccgaaagcgaagtgattccgacatttgttgccgaactcgaaggttcctctttaaaaaataaaaattttaaggtgtcaaaaaccctttacgtttcctgttcttcccaagatttcataagttttaatgagtatgagaatcaaatgatttttattaaagaccctgcacactagaaatcggaattttctgattgtacgggtaagggttacgggtttgacatcgatacgggttacgggctaaaaacccgtaaaaccttaacccgtaaaaacccgtatcggctgaaaaaaatacgggcccgtaaaaacccgtatacgggcccggcccgtatccgatatctgcacattgtcaacaccagccaatcatttttaacagcgttaaaaattatgtaatttccttattaattaagaaaatgcctagattcggtagaaactagggttaaattggactggatcccgtccgggactaatcccgcaatcacaacttttcggctctctgtctcgtggtgaatggaaaattagtaatttgacaaccattttccagattctacggtggaatatccaacagacattgaatgtcatgttgcaacaaaaattgaccttggacggaaatgatcagcagaaagcactgcaagaatgaggaaaaaagaggcacggaaagaatgatttgtgatagattctttcttctgtgcattttcatctgttgcgtaaatgttgagagcattcgacgaatgacgtgttatacaaatcagttattgggattaattttcaaatgcatccatcttttgaaacattacttcgctggccaaaaattacattgtatcaatttcagaggattttttacttaaaaaattggggaaaaccttcatttttgcaatttttaagcctaactatttattataataccatctgagtgggttacaattaacaaattgatgcagatggatatggattagaaatgggaaagtgcaaaaatcacaaaaaaaggtcttttgtcacagtgatttgatgttctggtcttcttaattctaatcatcaaattcatcatcaaataagcctaaagggttaataatttaacaaattaaaaaattcatttgtttttactttcgttttcttccccctccgttagacgtcgcatttgctcttccttttccttccttgacggactaaaggtgtctttgctcgacactctttttgatgattgaacttaataattccgatgattaaaatattttttaataaaaattcatcataattaaggctagtaaaaatattgatatgcaattgcgaaatatggccataaaatatgtgcctaaaatcgcgaaacattgatataaaattgcaaaatatggacataatttttcattgaaaatttttcaaatttcttcaaaatcattaaatttaagtcattaaaaatagatgactacggtattaaaaataattgaagaaaaaaagacaaataaatataaatttagtgaaaactgaacgaaaaaatgaaattttccacttttttacttatttttgacacaaatttccatttttacgaaaaatttaaatttaaacaatattctcgagaaagttttactaaaaaataacggaaatttttctcatctttatgggtcaaaaggccatttttgctgatgagggccgttctaatggaggttttttgttggaaaaatacccaatatggattataaatcgcgaaatatgaaaaaatatggatatagaaatctatcctagaagcttcaaaccaag

SEQ ID NO: 9767 - DNA, 971 bp, Heterodera glycines
tttcagggatctactagcgctgatgcgcgggaaactttaaaaacatcacacaggagttccggaaaacaggatctttaatcctaaaacataatatggatgtagttcagggttaccctttgtccttattttgagggtccaaatcttacaaattttaaatgtccttatttgtaagatttgtccttatttaagctatttgtccttattttcgtcttattttttggatttagggagaaatttagtttttaatgataatttttgaaagaaatgttttttgaagcgaattaatatgcaaaatcttaacaagattcagttaatattcaaatttttctcttccggcagcgtatattagagctgtatcatttattatttctaagaaatgttctgatttggggtagtgtcttattttcatttaaaagaggaaatttctgaaaaatttggctaattcctaacaaaattcattaaaataattttcccccagcggcgcctatcggcaccgccggccccccaaaactcctatttttttttcttaaaattagcccaagatcgcaaattttggtcattttttggacagaacttgttaaaaaattgcattaaattttcaaaaaatttccccgcggcgcctatcgacaccgccggactctcttccctcacctatacccaaaaaatttaaaaaattaaaattgattttcggaaatgtataaatttctcatttctaagccggaattgcgcagaaaaatagttggcggtgagtaatgcttggttttgttgaataaaaatgcatttaaagttttggaagcgtgttttaaaaaatgtccttttttttgaccctaaaatcttatttttgaccagcgatgttcttatttcgggaaattttcaagggtaaccctgctgatatacttgatgaaagaatcgtaaaaatcacattttatccaaataatttctgaattttgttcgccttaaattgttgccaa

SEQ ID NO: 9768 - DNA, 707 bp, Heterodera glycines
tttccttttttgtttaaaaacccgcgaaacgtattgtttgttggtaatttgtactaaaaaaattggtgtcaattttgtcccattattttctgcccgtcgatggtgtcctttttcagcacctgctgtttgttttttgcaacattactgtccatggctttcagattcgcttccgtctcctgctttatctgcgcctcaatgtcgtcgcgtgtgcccaaatagttttgctcaaactcgcgaaaacgctgctccctttccttaacaaaacccaaatttaataaagcattaataaaaaaaatcaaaagtaaaacgaaaagaaaaatgtaaaatgagtggtactttttaagtttaccgggtatttttaatatacattttcagatgcctataaatatgtcatataaattaatgaagaaaagttttaaggggtttttggggtcgctgaccacgaatccgggctcagatcaacgctaccgttcattacgggtgcaccccaaaatctcgccgccgaaatctcgccgccaaaatctcgccgccggaatctcgccgtccggaatctcgccggccgaaatctcgccgagacaaaatatcgccgccgaaatctcgccgaccgaaatctcaccgcagatattacaaaaaaaaagttctaacttaaaaattttttaaggaacatattcttatatagatttatttattagataatttaaataaaa

SEQ ID NO: 9769 - DNA, 3057 bp, Heterodera glycines
  misc_feature (41)..(42): n is a, c, g, or t
  misc_feature (73)..(73): n is a, c, g, or t
  misc_feature (134)..(134): n is a, c, g, or t
  misc_feature (3043)..(3043): n is a, c, g, or t
acaaaaagaaaatttggatgacaaaaaatgaacaatgcatnngcaattccattttagacgggtttttgtgttnaacaaattgtgaaatgttccatctgtttttttgtttgtttgttaattacaacttgtgagcncagatgataatttcaaaataaagttgctatgtgcacaaaaactattaatttggaaagttcattggcattagaatttatactaaatcaatttggttgattgtttgttgatatttggttctcacgaaggtaacttatggcgcaaaatactgcacaaattgaagagttcgttcgtttggtgctcagttcatggccttcatatcaatttgcgattaaaaatcagttggcgggatcattaacaagtgccaaggcaaaaaaattttggcgcaattgcaacagatttatggaaaggcgctatttaaaaagagtaaacttttgaattctatcaaaaacaacaggggggacctttttgttttgcaaaatttttttgaaataaaaatccatgaaaatttgttatccggggttttaaaggtcgctgatcacgaatctgacatccaattcgaggtcatggaccccaagaaccacagggaataaattttcatgactaaatattaaaaaattttcggcatttccttcccggataccaaacagttgaagcaatggcgcatttggcaggaggaggcggccaagcgggaccaccgcaaattgggccgcgaccaggaactgttcatgttccacccgctgagtccgggcactgccttttggtacccgaaggggacgcacatttacaacacactgctcgagttcatgcgacgcgaataccgacgccggggtttccaggaggtcagaacattcaatagtcgaatgttgccttactaccaaaaacaaatgaatgagttgacagaggttttcgattgagcctttcccttgttccaggtaatttctccgaatatttataacgcaaagctgtgggagcagtccgggcattggcaccattatgcggagaatatgttccggtaagtcttttgggagagttaatgtaatttatggagcatgattagagtggaaaagtcggcattccctttaatcatttttaggttcgaaattgagaaggagcagttcggactgaagccgatgaactgtcctggacactgtctgatgttcgactacaaaccgcacgcctacaacgaattacccatccgttatgccgacttcggtgtactccaccggtaaatttaaattttatttttgttcattttcctgtccgttttaagcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaaggttggcaagcggaaactgattgatttatttgcttttagaaatgccaaaaaatcaactaaccaaaaaaaagatttctccgttgttcttttcttttccagtccaagggatggaatacatttacatacattagtagttacacgatgaacaattaagattgacattcaaatcaaagatgcgttgggcagacattggcaatgtgccaccatccaattggacttccaactgccccaacgcttcgacctttcctattacgagtgcgtcgtctcaaaatatgtcaaatatttattatacatttaaaattagtgagaacaaagagcgtcttcgtccggtgatgatccatcgtgcaatttacggttcaatcgaacgaatggtggcaattttggcggaaaattgtggagggaaatggcctttttggctgtcgcctcgtcaggtgggcacattgaattttgttactatttctcctcttatttgccaatccgacaggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtgcagagagggaattgtgaaaagggagtgttagaggcagacatggaaggggtgagaaacactgcatgtgagagaggaggaggaatttcaaaaaagtaaatcatcgaattgagtcaactcaattgacattgctttttcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatgaacaatggcattgcaatttcattttcgacgggtttttgttgttaacaaattgtgaaatgttccatctggttttttgtttgtttgttaattacaacttgtgagcccagatgataatttcaaaataaagttgctatgtgcacaaaaactattaatttggaaagttcattggcattagaatttatactaaatcaatttggttgattgtttgttgatatttggttctcacgaaggtaacttatggcgcaaaatactgcacaaattgaagagttcgttcgtttggtgctcagttcatggccttcatatcaatttgcgattaaaaatcagttggcgggatcattaacaagtgccaaggcaaaaaaattttggcgcaattgcattagatttatggaaaggcgcgctatttaaaaagagtaaacttttgaattctatcaaaaacaacaagggggacccttttgttttgcaaaantttttttgaaataa

SEQ ID NO: 9770 - DNA, 1101 bp, Heterodera glycines
  misc_feature (1039)..(1039): n is a, c, g, or t
  misc_feature (1041)..(1041): n is a, c, g, or t
  misc_feature (1046)..(1046): n is a, c, g, or t
ataatccttttttacattgtatttgccgttgcttttgttcaaaattaccaccaaaatgtcggaaatgtcaatgccaatcctttcgcaaatgagccgttttacgcgctcaacttttgttgtggtcggaaggcgcaattcgtagcgaacaattggaacagttgggtctttcaaaaccactgaaaatggtacaatttgaaaatgaatgcttacaaaagacagcacttgccttggaaggaaagcaaaatggtctcagagacgggaatttgcaactgcaacattgtgaacagctcgaatttgttggacgcatgggcgcaagacggacagcgcaaggaggaaaggaactgaccggcgaacagatccaaaaccttgggaaacaaaatatcccatgaaatcaatggatggaaaacggaattttcttaaaaatgattctttgtttttcctcaattccatgcttacaatgctgccctgccgtgaacagagcacttccttctcccactgctaaaataaaagaaattaacaaaatggtctaatacattcattgaaaaaacccacaataaatttcaaatatctcgtttaaattttcatttcgaagggggtgcccttccttttgctgatttgcaagcccttgccccactctcccaaaatgcaggggaaagtaattggtcttaaacggggttcgaaaagtatacaattccttacattattggcattttgccaaactgtgttcccctcatcagtttcatccatttcatttttggctccttcagtgatgctttttttttgcttggcctttctttgaggaggttggtcagtttctccgtcctcctccgtccctttttctccaattccatcgtccggcgaaagaattcgacgaaaagcggcggacggagaagagggggaggatgaagcacttggacttgggacggtttttaattgctcgtgcaacgcgtccaaaaaaaattgtatgaactcttggctgtcgtgttgcagatggtccgcaaaatgggaacacaaaacggagacactctcctgaaaatgngngaggngattgacaaatcagagaccaataatgctgaacacgtgaagtctactagtaatttt

SEQ ID NO: 9771 - DNA, 3935 bp, Heterodera glycines
tcccaaaagttccaccctcggggaataccttaaactccaccggcgacgccgtctctttcgccaccaaaagggagcggagcatttgcacgtaatgcctcactaatggcaaatgccgaaattgctgctcactgtttggtggtgcaaaaaatgggaaaataaattcaaaaatgagcccaataaaccacttgctgagtaaaaagccgctaagcagcgaaacattggccagcgtttggatggccgcccccaaatagcaagtgttgccaatgtttcgtacgccgcccatccgtcgccgtccccccgggcgttgcttctgttcctgtccgtgttgtcgtcgtcgttgttcgtcatctcctccatccttttggcgttcttttccttcttgttcgtcctctttgtcttcctccgatttatcgtcgtcaacagaaatggcagcatcgttacacgttgtcgatggtgacgaaactgttggcgaactgcttggactcgttgtcagtgcaacccaaagctaaaaggatgccaattaatgaacgcatttttgaagatcaaatacaaacggtttaattgtaagaaagaatttaaacaaagaggaaaaagcgaaattaaataacaagagattagaaaatgccaaattttacttcttttttttttgaaacttatttagcaaagtaattcaaacagattttttcgaattttgttactttgtccgaaaattgcaaaagtgcctctctgactgtcgcacttttgctggccaaacagacaaagtcaaaaatgtgaagaggaacagcgtcccgcgtttgctcttcctcaacgtgaggcactaaaaggtcctaaaaatacgattagtaaaaaagttgtggagttcgccaccattgaaaatccaaaaaaatcagcgatttcattcaaatcattgcacgatagaatgccgtccatgtcggagtcccaaatgccaacaacaacttaaaatttttggttttcctaaagaaattaacagccgaattcgctcacatttcattcgttccgcctccggcccctggcacagactggatagaccgcacacgtactccttgaacccgatggcgctgttacagtgctcggtgaacagccgaaacactctgttggccacctccgaccgtttgatgactgacagaacagtggacacaaatgtactgtccgcgatgctcaacgagcggcggtcgcatcgttcccaaaaacggcgttcgagccacgcaatttgatcaacctcaactaaacgtgccaaaaaagtgttgaccctttctttttgcaaattatgtgatttgaaaaaaatgcacttttaagtacttaaatgcatttgaacatagaatttcagtgatctaataccaggagtattccaacagaagttagagtttggaggtatttgtccacatgaactttcatatttttaacaggcctggaaacgcttaaaaactggaattattgtccccgccctcccccctcgtgaagtttgacatgtatataaagctctaaaataaagagaaaggaaaacatacagtgcgtgacaccggcaatgatttcgttcagtgttccgttgcattcgctgtattttggcacggaaaaaatggcaaatttgtcccacttgacgccgcatggccatccaacagttttgagcgcatcgaaagccaacaaaaattgatcccccgtcaatgtatcgctgccttggaaaacgaagtcacaaatctgcgcgcaacggtggcgcccaatgtccggatgggtcaaaaactccgccacaaactctgccttaacagagggaaatgtgtgccgaaatcagtcaaagctgggctggaaaatggcaaaactgtggcgttccgggccaataaaaagggaggaggggtcattttgagaaataagatgcttttgagcttgaaaatgcccacctttgtcattgtacgccttccggcccaaaattccttagctcgcgaccgttccctttcgtccattccttggaaaagacatttaaaacagttttaactaacaatcgtaaagcgatgaatattttttaggcgaagcaatgacaaatgaaaacacaattatagtacccaaacaaacatacagtatcactttttcattgttaaattgacaatatattacaaaatcacaggagaaaaaaaagtggaggtggaaataggacaaaaaatgggaattaacaagcaatttgcatgcaaagaacgcagacgggggcgtggttgtccatttcgttgttgctatttgctctttttctgatgcaccggtggcaataaatttggccgcaccattggcaatgcacgcggcgctcaatgcgtgacaaaaattcgcgtcggcatttctcattggcacattcgtctgcgttcagcaacggctgccaggcgaacgaaacgcggaggcattcctaaagaatttgagggaaaatgaatttgtttttaggttaaattttcaattttaatttggattaaaatgcctacttacagaatccgtctcgggcatagccatcactttcttcatggattgcatgtgcagtttcgcattggcaaaaatgtcgcttaaatattccctcggctgaattccgacgtcgaagcgattgtacagatttgtccacaccgcaaatgaggacaaactgagctcaatgtcgcacagaaagggctcatttcggtgctgcaaaaaatgtaaaaattcgtggaaaattaattgcacaactcaccgagtcataaaatgggttcaagtaatcgtcgatgtgcaaatccatgtgagcccataacgaattggtcttggacaccgtccgtaaatcctacggaataatgagaaatttgccaatgccaatggatatttctagcgggaaaatacacttttacctttctgtccttgtcgcaattgcccacaaattggccatacacacatgaataggcatgctcgttcaattccaccaaaaagcgttcgttgaactcaaaaaacgcgggtttcttgcgcaacaattggtaaacacagtcgagaaattgggtgaaaattggcgagacctaaaatttaaaaaaacgagtttttcattaatttgtgtctaaaatgtcaaaaataagtaaaatgaataggtcaaataaaaacaaaaatctccaatcgcactcgtaaatttggggtaatttgtaccgattaatttgcttcccacctctttggccatttcttcggcagaagcccccaaatggccgcatctgtcgtcaaatttgaagccaaagccaagccaatccttgtcgacaagaacctaacacgaaaaggagcaaattacacaaaagaaataataatttcgaattattgtacctgaaatcctttcactgttctgtagaaagggtcgatgaccaattgtgccaatgaaactgtttgtgaagtgcggtcccatccatccgagcactgacaatgagtaatgaaacttacaataaaatctaataacatattgaaaatgtttagaattcggttcattaaggctttttactaacgaaatttcggagggaaatgccgttgtcaaacggtggacaacaacccactcacgtgaataacacaagagattccgcgcaaaattgactctgcgatgaacacactgcagtcgatcagtgctggatggagatttaaaaaatgaaaaatagttgaatccccaaagggttcacagtacaaaatcaaagtaaaattaatgcctaaaacttttaaattatacttttcaaatgcctcagccacccgcaagcatcaacaattttcaaatattgggtcattgtttgagtccgttggcatgctaaagtaaaaagtattggtaaaatcattcgtattgtatttaacaaaaacgaacaccttccagcagtttgttgagacttgctcgcatcacatgaatgttctcaatgtcgaaaaaatggaactgaatgttcgtgtaattgcgcgtgtcttca

SEQ ID NO: 9772 - DNA, 1338 bp, Heterodera glycines
acaaattaatgcatgttttgatttaaaatagataatgatttaattaaagttaatctgttgcgttctgtttatcaaagaaaaagaaaagaaaacgaacaaatcgaataaaattaatcagaccattttattttgttccaaagtctctcgtaaatttctttttttttttagtcctaattgtcttccttttcagcttacaatttaaaaagctttaatcaaaatggccatgttggctgcttttcccagaaacgccgttgcctttatgcagcaatgttctcgcttaatgagtgtcaggatgaaaagcagttctattaaggcattaattaaaaacttaccggtttaagtggatttaaaatcgtttttaaggtaactttaatcggcgcaagtggaggcatcggccaaccgctcggattacttttgaagaagaacccttccattgcacacttggcactttacggtgattaaatgtccattatattaattttcgactcattttgtattatagatcttgtcggcacccccggagttgcggccgacctttcccatataaacacccaggcaaaagtgactggccatttgggaccagaccaacttgttgcagcgttggagggtgctgacgttgtcattattcctgccggtgtgccacggaagcccggttggtggcattaatattctgctcacaacaaaatgattaatttcctttgttttgcgaattttaggtatgactcgtgacgaccttttcaccacaaatgccggcattgtgcgggacatggccgaagcagccgcaaaaacttgtcccaaagccttcatgggcattataaccaatccggtgaactcgacccttcccatcgcctgcgaagtctacaaaaacaatgactgtttcgacccgcgacgcattttcggcgtcactcttcttgacattgttcgagcacaggcattcgtttcagaactaaaagtgagtgaacatcattaaaatgagtcaaagttcttcatttcccttctttttaaaggggttggatgtttcccaaacaaaagtgtcggtggtcggtggccattccggagtgaccattgtcccacttctgtccagatgtacgcccaaagtcagtctgagtgacagtgagacgaaggcactcaccgaacgcatccaagaagcagggacggaagttgtgaaagccaaggctggcgcggtgagcctttcatttacagtcaaatgattcatatttaatatctatagagaggccataactgagggttccctccaattttgtcatattttcatttccgaatttcaggggtcggccactctttcgatggcacttgcagctgaatactttgtgtcgg

SEQ ID NO: 9773 - DNA, 2327 bp, Heterodera glycines
gaaacacgaagaccatttacagattttctgacgacgagctttttttctttttttggcctattacactctatgaaatcctatattttcgatattattttcggcatcattcgaaaacactaagaaaaatatataagtttgaacctgaaaaaagtatcgtctaaaaaacgcataatattatagcattgaaattataaattttgagtgaactcataaaatgtaaaataattttttgctgttctcaacaactcatcgagactcggtcgagaaactgtcctattcattcggtgcaaagaaaataattcgagtggttcgaccaacagccacttttctggacttttatccaatcatttggcttacattgtctttttttttattcctattaaatataaatttgttatttttatattagaaaatgcattttctattaaatgtgtcaaccgttttctcttccgctcttaggcggtggcattgtgccgttgcccactgctcgtccgtctcaaattggtgtgggcctccaattccaagccgaacttcccgaaaatgatgacgaacaactgcaaaaggagagaccaaaagcacctgatgaggaggacccttatttcaggtagaccccgaacattattctcattttcctctttttatttcgaaaatttgatcacttaaataatatttttagcattttaaattgaattttcttcccccactgctaattggttacttttctgttttagacccccccagaaattttcaaataaaaaatcatttctagggtaatttgtgacggtgatcaccaatataacctttgttttgcaaaattccgaacccctaatgaactcgaacaaaaattcgattcataaattacaaggaaaacgcattttggtaacagttcagtttgtcctcacattttttaattttattttaaagtcataaaaaacattttaaggggtattcgggatagctgatcacgaatataacatccgttttgaacaatttcgaaccccgaacatgaattcgaacaaaaagtcgaattgaatttcgctttttttagaaaaaaggtttaaatggtattttattccatgagtgttagattttggtttattttcatgaatttcattcgtttttagacgaaaaatgcgaaattcgaaaattttaaatttgcgactttcaaggggtgggtctcaaaacagaaaagtaccgctaattgttgtcaaaattggcacatatttttccatatgatttagccaagccgaccccgacgaatgcctttggaatggctcaaaattcgcctcgccaacgttcatctcttccaaaacgccgccatggttctccaaccagcagctgctgctgaacttgaaggagttggagtcgttctgctccgttgcacggcgacactccaacttggacattgaaagggtgggagaaattttcatttttaaagcattgtttacagtagtacgtttggggattgtgccctggtggcagggatactgtggtccttgtgatgttttgtaaaaaatatttgaattcactgttttcccattgtttttaccaatatctcttatatagtgtgctgctcgagactgaaaatttcccgagactcaagaccgaaaaaaacccgagacttttctcgagccgagacaaatttcttacgcacaaaatttgtttgaggcacaacttgttgcaaatcattaggggtgtacgaaaacccgagaatttctcgagtgtcaagaccgagactctcgagcagcactactgttgtaacttgtagtaaaatgccattgtgaattccaattgcaggccctccacctcttcaacacgtccaacttctgtctccaaaacgcactgcgcgatttggaacaattcgctgccaattgcaccaatgcaactgtgaacacaaaatggacacccgacatggatgaacagttcattgaactgttgaacaaacaccagaaaaattttgggaaaattgcaaaaaatgtaaatcattttgaccgtaattttcgcaaatttctacggtgtctttttctaagctaccgtatgggttgacggtggcccaattggtgcaacggtattacacgctgaaaatggagcgctgtttcacctcaaacgaggctcaatttgtgcgctgttccaaccttaaaatgtgagaaagagagagaaaagaatttgaagaaattttttaagcatttggccccgtaggggtcaactcagtctgcgcaaagttcaaaaagttataacttttttctttgttgaccaaacttaataaacatggtattattcgaagatgcctttaaatgtttagaaaatattctcagctaatttcgtaa

SEQ ID NO: 9774 - DNA, 2587 bp, Heterodera glycines
  misc_feature (2503)..(2503): n is a, c, g, or t
  misc_feature (2523)..(2523): n is a, c, g, or t
  misc_feature (2551)..(2551): n is a, c, g, or t
  misc_feature (2572)..(2572): n is a, c, g, or t
ctacggtgtctttttctaagctaccgtatgggttgacggtagcccaattggtgcaacggtattacacgctgaaaatggagcgctgtttcacctcaaacgaggctcaatttgtgcgctgttccaaccttaaaatgtgagaaagagagagaaaagaatttgaagaaattttttaagcattttggcccctgataggggtcaactcagtctcagcagcaaagttcaaaaagttataacttttttctttgttgaccaaacttaataataaacatggtgttattcgaacatgcctttaaatgtttagaaaatattcttagctaatttgtaagtgattaaatagcttacaaaaaagttgtggtttgaaaaccgcaaaaaaagacagaattttcgaagtttttaatctctatcttttttacattcgacattctcaacagataccttgattattggattcgggcaacaatttagaagatatattgactcaaagttggctcagagggagttggcccgttccgtttggccagctggctttttgggcaaatttttttattgactttttttttggaccatgaatttgtaagactttgatcgtttgaaaaactgaataccgtatatgctctaattatagcccagtctctattaatcccgtagtctccaattatcccccagtctacgaggtgttttgaaaaataatccctctatcataatccccccagtctctaattatccccccttttctgaggaggttgaaaaataatcccccatgggctataattagagcatatacggtaaaaccaaaaaaaaagtagcagttatataattcttttattactagacatgcattaattataatttttttttaaaaatttattcattaaataaaacaaattatttatttttttaggtttaaattttattggttcttttcgttcttttctaaaaaaataattttttgttatattgtattacgtttacagaggggtttttgattagtttttggttatttttatggttttgaaaaccattttttatcccttccaggattttccaattttaactatgggtcattatgaatttttttaaaattattatttattagccttggctctcccaccgatccgcaagaactgtcgcccgtccctcgcactcagtgcgccaactgcatgcgaatgttgtggcgcaacccgtcgaccgctgtcgcggaatggcgcgggcgtcgacggccgcccgtcatgtgccaaccgtgcgaactgtacgcgaggtgtgttttgttacggcacaccattgcattggattttggcatgtgccagaatacgaatttgatcacgttaagaaaactttatgaaattttggtccgtcggggagcagatctttaccccccccccccccccccccccgtatcaattccctccgtgaatttttttttcaaaaacttcaaataaaaaattattaaattttcataaactttgaaaaccttttcagcaattaagatgaattataatgtttttttcaaaaaagctgctgaaaaattcccatttattttgtaatttatgaaaatattttaagtttcaagttttaaaagcacacttttcaggaagcaaaaaaagcaccgtcctgtccaactgttgctggaaaatgacccgaactatgccgacgacctcagcaagcagcgtaatgagcatgacaatgctggcacaactgccgttgttggcgccgacacaacgggcgcaaaggcagcggaggttgcgccgcgacggcactatccgtgccatgacgatcgcaattgcatgttggcatgtgaggcagcaacacgcgtgcgagtgcagcaacagcagcgagcatcatggcacttcaacatcaaagaggaagtgccgatgacgccggaggacaaagcgggcgcggtggcgattgaacaaagtgacgatgaagcagcggacggatcaaatgttgctgagggtgaagcaagaaatgagaatggaggcgttggcattggtgggggtggcgagcagtacaacaacggcgacaaatgtctacagcaggaggaggagcgggagatgaagcagcgctgggcccagggtaaggacgactcatcaaactcattctcaaaacgctcacaaattttggggaaaatgaactcaaaagcattcaaaaaactgtaagaattgattctaaaggcctaaaattgggaaaaatcagaattagttttttctttctcataaaagtggcaagagagtgccactaatttggttttttagttcgggacctatgttaaatatttgtcaatttgtttattaaattagcatttgatttcgatctgttcagtcgtgccatacttcaaaatttaatccttctaagactagcatttattgtgaaaattctttatttttatttttattcaaaattaagcgtttgtggcggaaggaaacaatttctaattgtgctaggtcaataagaattttcgatatttttttctgtttttttttctaacataaaaaaaatttgtggncgccgttttgtcctgctccncactcaaaagcgttcaaaaaaacatccngaccgaacctattcaaaaggnctaaaaacttgggca

SEQ ID NO: 9775 - DNA, 1306 bp, Heterodera glycines
gtcatcagtagggcgtgtaattatatggaaatccatatttttttcctggattattggaggcctgaaacgcacgaaaaacatgtttttagcttggtttgaagcttctaggatggattcctatatccattttttccatatttttccatatttcgcgatttatgtccatttttccatattttggcattttcgtctatattttatgtccatattttgggatttttccaaaaaacctctattagaacggcccccagcagctaaatttgcctttttgagcccaaaaaccggaaaattttacaaaaaattattttttcgctaaattttctcgagaatattgaataaattcaaattttcttagaaattaataaatttatgttaaatataagcaaaaaaacgaaaatttcgcttttcgggttgatttttcgctaaaaataagtaaattttagcttatcgtgtttttttcttctaaaatgatttctaatactatatttagccatttttgaaggttttactttatattttacaaatttaaagaacttttgggaaattataccctcattggaaaaatttatgtccatatttttgccattttatgtccatattttgcgatttttggtccatattttatggccatatttcgcaattttatatccatataattacacgccctagtcatcagcaccttttttcttgtaataaaatgctaattgattttgctaattggtggtttcgtctctaattggcacttcctcgcaatttggcaccggcaaatttgggcaaaattgcacacaattgttcatctcctcaccacactgcttatgatgttggttctgttgttgttccgagaatcccggctggggggcgaaatcgttatttaatggtgttatttaaaaaatatatgaaaattttgaagaaaaattattatataattctgttcaaaagcatattattcgatagctctaactgttctctatcagtctgcaaaatttcaaaaaattttgttaagtttcaaaaaagttatgcctaaaggaactcaaaaaaccttgttttcgaacattttgaccataatttttttgaatgttaacaaatttttttgaaatttttgcaggaaaaataaagaacctttaaggctatcgaaaatatcaaggattaaaaatttgattgctaagagcaaaattataaaatttttaaaatttaatttggtggtttaaataacgacatagcaccccggctggggcctagggctgtgcgaaaagtgatttttaccgggaaccgagaccgagaaatgaccccgggaaagatacgagaa

SEQ ID NO: 9776 - DNA, 2568 bp, Heterodera glycines
tacctatacaatcgctgcttcacattccggatggctctctccgcaattgatgcttttactgtcgaatggacgggttcgtgcttctcaatctcccgctcctcaaagaattccttgagcaatctgttcttgaactcggtgcccttgtcggagaaaactcggtggggcgccatgggcatttgatcgatgagttgcttgaatgcctccagcatttcctcggctctcttgtttctcagcggtacaacaaacagacgtttggataggacatcaaccgcaacgagcagataccgatgaccccgattgtggcgcgaaagagcttgaaaatctgccaaatccacttgaacatcggtcatgaatcccgctgcaatagttttggcccttggaaaacgtaccctgcgggggcgcatcagagtgtaggtgcggtgaccatccaaataatgctgcacgtcctttttccgtaaatgtttaatcttttttcgcgcctctttccacagcgctgtaacacctgcaaacgccgctggggaagatggattattgtacaatttgtcaagagtggtgttgatcagctccattttttcgggcgaaattccttcttgattgcccgtgccgtccgggtggttttgctctgtgatggtctctttggtggagccgtccatgaatacaaaattgggtcctgcctaagcctctcttccaatatagccgctccaggtggcttaatggtggggcggcccgctcttctgtctattatatacctgatgaccattcgcaaattgctatgcgccaacggcttgccgtttgcggtgtgaattgtattccccctaacgcccatacgttcagcataattgttgattttgatgtataatctctcaattctctgtgtcatggtcagttgatttgacggaatggcaaacagctcacgttgttgttgttgttgttgttgttgttgctcatcactttgtgcagatgttgatggacctggctcgggagagtactgtactcttacccttctcggttgcctcactctttttcttatgcgcacctccccgtcaccatcatcatcatttacggggtggcggcgtttggtccctctcctaggaggaggaataagaggcatttcttcgacaatagcagctggaggaggttggcgttgttgttgttgttgtggtgttcgctcaattttaggctctcttttcggaatacggtacggcttgggtctctttgttggatcgtgttttattttaggtgttgagggaggcgggttgtacccagcttgccttgatgtggatggtcgcgggtccagcccaaactccggttctctttttggacgaggcgtaggggtggggtgaccggttttctttgatgtcgacgatttcaattctgcctttgtttgtttttggtgttctctcttggctgttggaggaggtcttggctcagatttccgtggcggagatgggagccgtggaggtgaagggtgataaatcctatttctttttcgctgtaaatcaacttcatcatcatcatcatcatctgccaagtccttttttaatcttcgtctggtggcaatcctgcgctgaacagtgtccatctcctcaatttcgtctgcgttgtcgggtagtacaggcaaatctccatagtactgtgatggtgctggcagcgcgaatccactctccagcatatagtcatattcatcgtcactttcgggcaatggagccgcagctgcttccgccaaaagatcccgcaccacgggccgccgtagttgtatatcatatcgtcttttccgccattgctctatgagaccacctctccgagaaggtgcagcagctctacatggtctagggggacgttgtggacgaggcggtggacttcctggtggagaaggagggctgggtggacgtggaggacgtctcccaggcggtggaggtggtggaggagcgggaggatttggtccacgtggagggcatttacctggcggtggaggtggtggtggtggtggagcgggtggtcgaggtggagtatccacaacctctccatcttcatcttcgccacctctccttaacagtacacttattccttttgacatctcaacttttgtcggcatgtttgttagttccctcctcattttcaaataccgcctaagttgttggttgtagttgacatttttagcagagggatttgttcgttcgcccctggttcggttcaaatcgtgtcgtacagcatccaaattaatgtcacccgtgtccgacattgaggtcaaacccctgtaaatttcttgtgggacaagtaaaaacttattagccatgttttattgaatgaatgatgatgatgaatgcacataaaaacaaagcagttgtgggtatttatgcatgccattaaattctcctaaaaaattgacacacttttagattaaaaaaatgaaaatagcagaaagaaaagataaatatatcttcacaaattggggaaaatttgattaagaaaaccaaataaaaacaatttgcctgattaagttaagtcacattcatttgctttgcgagtgtcggcgccgtctcgaaacgaataattgatcaaaataaa

SEQ ID NO: 9777 - DNA, 1442 bp, Heterodera glycines
ttcgtattttaatttttacttttttgaattttattttaatttatgtaactactttaatcaaatgacaaaaacgtcatatgacaaaaagtctcacatgagaaaaagtatcacattgtcatatgaaaaaaagtgtcacattgtcacagaaagtgtcacattgtcatatgaaaaaagtgtcacattgtcacagaaagtgtcacattgtcatatgaaaaaagtgtcacattgtcacaaaatgtgtcacatgacaaaaaatgtgtcacatgacaaaaaatgtgtcacgtgacacaaaatgtgtcacatgacaaaaaatgtgtcacatgacaaaaaatgtgtcacatgacacaaaatgtgtcacatgacaaaaaatgtgtcacatgacaaaaaatgtgtcacatcactgtgatactttggactataaaaggagctcattttgatcattttgctcattgttggcattcgtctagcaaacgaatgtcgcggagcattactccgcagagtaggcttttctgttcccctcttttaaggaggcaggaacagccatgcccccggaacgggtgatataacgccccgagggaggaaggggtgctcacccatcgcaccaatggtgcgtgtgcgtgactggctcgccgctgactaaagccggcggctggatggacgcgtgcacgtagccgctgtgtgcgcatgtgtggtgcgcgtgtgccgactcatgcaggggcaacgagaagcagcacgcgtgtgctgcatatgtgcatatggcggtcgcgtgtacgtggccacctgacttgctggctggttagacgcatgcacgtggccactgagtgcgcatgtggactgcgcgtatgccgcctcgtgcaggggcaacgagaggcggcatgcatgtgctgtacgtgtgcatgtgacagaggcgtgtgcatggccggtagacgtccgtgagctgttgttcgtgcgttggtggcaagagcaccgtggcaaaactccacacgcattgacgcagcgtgtggtcggttgtaaatggtggcttatcgttgttgtatatataacaactaatcactgttcaatcgttaacgttattgaaagagcaaggagatcagttctggacggcgtttgcgtaaggctttcgtcgtgaccaccttgcaggggcactttaccggtcacgcagagcagcttagtgacaagccggtctgttcaaattgcttgattagataacggtattattacaacagaaaattattttaatataaaagttattttgacattaataaaacagcttaaaactttttgaattattttaaattgctattatttattttgttgtttgtttaagtattggaaaattatttcttacttttatgcctatcaactctatatgtaatttatagggccgcgacttttagtgacgaaaaatcccgaaatagttaactaaaatagtgtcgaaaaag

SEQ ID NO: 9778 - DNA, 2663 bp, Heterodera glycines
ctgtttcgaatgacaacaaccatgggcttaaaatatgaacttattaaccaaaggcaggggtttgttgagaagtgtgacggctgctattttaatgtttttcattctaatgtgcaggtttggatttttcaaacagttttatttattttggtttttatgttattaattttaaaatccagattggtgaaaatttaaatacacaaaaatccattatttttgtcttctaaggaattttatttatattttctatgttcagtttccaccgattgtgtggccaccacctgaaggtgcttctgaagatgttgtaagccaacatttgaaaccttttcatgacgtgctgcgcttcatttctgctaattgccttacaattgttcaacatcctgaattgtatgatcaagcgaaaaagactcttgatgcggttaacctgctcaatggtgtgttggatcagcatcgacgacagcaacaggggcaggggcaacagcagcagtacaccggaatgactgtgttggaaaacagtgacaataaccgccgacaaactaataatggtgatgaagaaatctacatttctgatgctgatgacgatgatgatggcattccatttcttgtgcgtcgcttcttgaacgctaacattgctgatgaacaaactgtaacagcagcagagcaacctgattatgctaatggtgaaacatcaatgttttgtgatgacgttgcggaaatggagtgtcagcagaactagtcttgtactggtaaacctgcttatatatatatatatatatatatatatatatgcaatttattttttagaggcagggtttcacagcgtcagcgtcgtaataattcttttggttgaagctgttttttcgcgtctttttttaccgaaacattgacaatcaactaaaaaaggcaaacagaattttttattatagatttcaattattgttattagtttaatatataattcttttttatcatacaggcaggggctttttgttttattggatgtattggatctactgtgcgtgatttagtgctaagaaatggtggacgaaggaaaattttcattttatggacattaaaccttcgttttatcattgttacacatttaaccttttcattaaaattttcattgttaactgattcgaccttattttgtttatcgaaccaacaaagcatattgaattcttgcttttcgtcggtaaagagagatattaatgttttctgttttcgtaaaaagaaaagcaatgtccgacccgaaaaaatacaatattgaacaagcgcttcaaaatactgaacgtgcaatcgaaccctcactggactggcaggggccaacccaacagcaattggaagagaaatgttagagaattatattaaaaattacgtaataaaatgtgatgttttttggtatagatataaaaaattatgattctctaactcctctttttaaagcaatgcaagaagaaaacagccctactgcaccgtcaccgttccagcatcagctagcgcagcagaagcagcagcccagtcgtctggtaagcaatgttgtatttaatgattcttacatgaaataaccgttgttcattattctcagggacaacataattcttctcagggacaacaccctcaaatgcttccaactccactacatccacctcttgagctgtttgaggaaggtttgcgttacaccgccacctggacttttgctgctatgttcaataagcctttggaagctgaaagaattgccactacgttgagcgatgcttcaatgttgttaaacatgtgtgtgcaaattctgaatcgccgaccacagcgtttgcagcacggattgcaacatccaacgtccagttcgcagcagcactagtaacggcagcagtagccgccgctaagtaattttccatttttatgaacaataatttaatttgaaaatattatttatcatattatttcttatcatttctattccacttgtcacagttcattagtcggcattagttcagcacttcagcatcatgcaacaacaccatatggtcgtcgttaatccgctcgcgggtgtggcaggggcagaaagatacatacacataagagctactgcctgcaaaatttcttaaattttttatttttttatgggaatcggcagtttttaagaaaatttcgaatcatagacgtgtaattttcgcgtttcattaaaaagatcgatttttgaaaatttctacgtggtaaaaaaaattaagaaattttgcagtgcaaagttaactcattctgatcgttctcgaaatgataccttaatttcccaatgtttattcattttgaaagaccagtaagcaaatattttttaatgtcttgataaaatagaaatgttaaaatgcttgtactggatcacatttgaataggatatatggtttaatattgaaaatattgagaaaaagagcctctgaacagaaagaaaaaatatcgtatgtatcgaaaaagcacagtaaacccacggcaacaatttgatttgctattactagggatgatatttttaggcaaaagcctattttttttcctgagctctccgtggcctgaaacgcacgaaaaacatgttaatttgggctgttgttaagctacttttcgagttattagcaattttataggtttttatttttagcacctaaaaaacctaaaaattt

SEQ ID NO: 9779 - DNA, 2560 bp, Heterodera glycines
aaaaatgcacccctaagaatcggcctaatttttttttttcaaaaaatacacccctaagaatcgaccctaaattttttaaaaatatacccctatgaaatgaaaaatttctcaaaaaatcatctccaaaattaattaatttattttattgacgataatttttgattttgaaaattatgtatctcattaatgatttggcataatatttttgtttttgaagaaaattttcgattttacaccccctaaattcggaattttttagagcctattttcccctatttttgggttttttagagcttaaagcctacctattttggcagtttttagggcctaaaaatatcatccctagctattactggcaatcagcggtgacttggaccatcagagatggagttgaattgagaacaataaaatcaaaataaattaagaagaaatcaaatccccttcgctcaccgcacgtcaccgtcaacatctcccaatgcaataacaattcggtgcattttgttgcctacaaaacctctcgacggcattctacagcatttcactgtccctttttttaccccttttattgcgcaaatgaccggtaaaaacccatttcgttttgcccaactcgttttttgtaaatacatttatgtaggagtgcagacagtgagaagttacacagttcatatacatcacgtaaaaaacgagttggataaaaaatgagttggccaaaattcaaattgccatactcaccctccatttcacgtgccacgtccttaactgtgcggtttttggctggctgtctctggagttggtggatgctgctgatttgtgcataatgactgataatgttttctaatcacctaagtatttgggtaagaagttggaaatagcattaaaaaatttccaatttccaattgaaactcgttttaataaaatttcgtcaagtggagttgggtcattaaaaaggcaaatgttaatgtgaagagtaaaaaattttagaatttaaatgtgaataataaaaaatttaaaatttaaatttatccattcatttattattttataagatattcttgaagtaattgcgaacagggctcggctttatatttgctactataaatgcacgaaatatataaatgttatgtttcatctcgtcacaaaaactgaaaattttttactccgacgaaatttttaaatttttaacattatttgaatcttaatgaaaattttccaattcgagggatcatttaaaaaaaacaaattccagacgattcttcggggctgatttttcgtttttattgcttttttcagataataccaaagtaggaacaaaaaatgaatgaattttttttatctcatcagacattttactgtaaatgtttatggtccagtggaagacaaaacccagttttccgtaatttgaccatgactcaaacaaaactcattaaaatcccattttaatgtgcgattaaatttgggtggacgacggacgccctttcataaaataaaattcagtcgcccgggggaaggaaaatgaaaaacaattaaaatgtattattaataaatatctaatttaaacaacaattaattaattttctgttttattgtttttgttattaaatttaatggcctcaaatttatttgtccaaatttgcgatcaaaaacgaaaatcataaaaaataaatgcaataaatttgggagtcagcgtagtgccacaaattcaaatattatattttgttaaataaaaaattgaaaaaacaaaagtacaagttgaaatcagtcgaatgaaaatgatcggccgaaatgcgatttttttttttgaatttccgcgattggcgaattgtcctcccaaatgcccttttccgctggcgagggaatggcacttgctgcaccaaaaaacaactgacagtgccatagtttttttaagaagtagcactcagcgaatggcacaggcgaaaacgaaggcacgaataaaaactaaagtgaaaatataattacaaaaatactgcttttgttcgaatttcccacaattggtggttgaaatgcgtgtcctttgtccagcattgtgatattttgtcaacagtgtcgtcgctttgtcccctgtgcggtctgtgccttgacgatgggcgtcgtccgtgccgatgcgattggctcggtcctccgttggccgtgccgtggcgcgtgcaatgcccgcgcccgacgcgagtcgccgaattgggcggccgccgtgtcgtccacactgatcagaatgtgaatcatttgggcacagagtttcacttttgttttgcttaaccactccttttcaataaaatgaatgccatgaatgcctgttgatgcttttggcctcaatttattccctttggggcggcggataattaaaaagcgataattaatttggcattttccatttgcgcattttgtaactttaattcacgccctcgccaatgtttgcactttgtttgcccaaacgtgaaaaattaattggttgtgaaggtggaaaacaatgccaaattattgcttaattacagtcggactattggaaaaatgtcaacatggaaaaaaataaataataattttttaa

SEQ ID NO: 9780 - DNA, 2470 bp, Heterodera glycines
  misc_feature (346)..(346): n is a, c, g, or t
ataatataaaataaaaagtatagaaaaatgggtccaattctgtcaccccatatgtttccccattcatccaattgtgagtctgactgaccaatttcttccatttcatcaaagtcctcctcatccgaactgctcgatgacgtgcagttattttctctcgtcgcattcgactgtccggtcgctgccgtttccgtcgagtcggcgtaattaaatgcaattgctgcgcgtttagaagccaattttctgtagaagggttaattgaagtgggaagtgaacagggcaaactcgcctcttcttctcaatttccctcctataggcggcgttcgccgattgattggcttgttgttgngcgggccaaaactctttggcggcgatttcgttcagaaattgcttttcgctgactgaaatgacaatgatttgtcagcgtttcgctgattaatgtaaatgccgaaatatcaagatgctctcattgtcagttgaatgattaccttttcgaaactcgttaaataccagaattcggtagcgttcgtaatcgcattgcaattcgatgacatcatcctttggactgaaatttaatccgatggaaattttcccacaaaatgtttcgccaacgcacatgtttttcttggccgaagcattgggcgctgtctcgggaatggtgtcgagataaccacggacatcgaagcggtcgatcagaatgttcgggtcgccctgccactttctcctcaaatattgcatttttaagtggcatcgggtcatgtctcatgcccttccccccttgaacattgcgttgtgcgaatccgttgcaagctctgtagggtcgacatggacgtgcatccgttggccgtgcaattgcataaacccctccggctcctttctctgtttgatttttcatttaaatcagatatttcaattttttaataccctttttttattataactttggtggatattcttctgatacccttaaactgaccacactttcatagaattgtttcctccgctcgtttctcttcgcattgtccaccattttggctctgaccattttctcctgtcttcgcgcctcatgccacattttgttggtctcaaaaacaactaaaaatcggttgaattcaaacagtcggaactcttaacagtgattggcgtgattaaagaaccaaataatatagtaaaatgataaatgataagcgattcatccaagtgataatccaaacattaaggtacaaaattcgaattttctcccgacaaaatttcgtcgtccaatttctgtctgattttacccaacaattgttcttgtcttcggattgagttctcatattcggaaatttcctaaacattattttgcataagtcgggttccgaggattgatgacacggagatgacctgttctgccatttcgtttgggaagttcagttgccaatcgaccgaagtgcgtgtcaattcgctgatcatacccaagcatgcgtcacgaaactgaaaatagcaaagaatgagtaatgaatgtttaaccagatcgagtcccaagaccactcactgcgtttggtcccctcccctccgtcgcatttcgatcacctgtttgacggagaattccgccgtttctttgatgtgctccaggattggctgtgggtggtcaacctctgtgaccacctgcgagagcagtgagttccattgcaccatcatattgttcagtgctgtgccaagcgcggaatcaggcggcgtttgtccaatggaactcggaaatgccgcaatcagagagttgatttccctaagctgaaagaccaaacaattattcatcttaattcaccacaaaaactccactttatctgcgctgaggtcacctcctccctctccttaaccattggataaatcagaaaggaattttatcctacaaaacctctctgagtctgtgttgtgtttccaggtgttatgttagacattaaaactgacaacttaaaaaggtataaacaggcaaaatttgtttatagaaattatttgtatatcggagacaatatttggaataaaccgaataattcgtcggtctcttttttaattgtgattcgatataaacagataaatttctttaaaaagttgtatagagactacacattgcagagaaagaaagttttaagaacaaagcaaaactctatcgtatgcccacacaacgacaaaaagccataaaaaggaccagacaaaattgtgataagtcagaagcgagctttttcccccatgaaactttgaattgaaaaatattcggaaattggcacttatacagccgaatttgttttattaaatattcctgaaaagttgaaatccagtataagtgccacgaaaatgcgggttgtgagaatgacgcatctaagggacgaataatggttcctctatctttggtatccacttgaacatgactgtcggttgtgcgggtcatcctcctcctcatttctgctgctcgtttgcgaatttgtcgaagtgtgac

SEQ ID NO: 9781 - DNA, 1284 bp, Heterodera glycines
ttcgttttctatttagtaaactttttttactcgtaagtctttcctggatgtccaactcctcggcttggctgatcaccggcgtcgccgctccaaacaattcttcatcggcagtctaaaaaataaaaataaaaagcacgtcgattttttattccgagaattgcctttgtaacaagaaacggccgtgcttcatttaggctcaatgcgattgccctttccatgtcattttcaaacttttttgtccgtcgcgtctcattccaaaattctcttggcacagtttccgctgcacaagcgggcaattcgccttcgacaacataaagggaccaacctaaaacaaaattaaacagttcaacatgaaaagattagacaatcagaaggattgttccataattttgaatgtttaccttcggtattaagctgatggacgtacaattcgagaaacgtttcagatacaatgcgcggtgctttgaacagcgaattgaggataaaccaagtcgtcccaattttgcgaattgtgaaccaatggtcctccaggtgacaaatgtaagcatgtgccaaacttaggaagagggagggttattggtctaccgtagtttacaataagcagtaattaaaatgaaatatcgtttttagctaatagaaaacgctatacattttcagctcaatcaaatcaagaaagaatttaatacctgggattttgcaaaaccttcatagcatttgggcttatgataggctccagactcaaattcgcttgacgacgcaaagcttcagttatcacctaaaaagataactaaacctgaataagtttgtgacaagcacctgaattgagaagtatcccgaatcgtcgtaattttgactttgaaactcagattcgtcccttagcatcgcacgttctctttggtccaattcttgagcaattgaagcgagagaatcgggcgtgaagtaatcgccttgcagaagcatgttcagtgcatgttgagcacacatacgtccaacttgctgaaaaacaattcatacataatctcataatatttcgaattctcttgtaggtatgaattcgagattccggtgtttttgctgattgataggttttctactggtaaggcaaaattaggaattttcgataaaccagcatttgttgatagagctttattctcttgttggaccatcaattttatggaaataaaaataccttttcgtggtaaactaaatccatgcaaacgaagaagagattgtatctaaatatccgctttcttaaaaaatagaaaaaaacgatttagtaaaaga

SEQ ID NO: 9782 - DNA, 1617 bp, Heterodera glycines
ttcttaaaaaaaagaaaaaaacgatttttagtaaaaagatatactgtcgcaattgagtacgaaataatattacgattatcgatagctttcaacaatttacttttttcaattcataaaaaaaacaacaacatatcaaaagacgcaacattgtttagcatccgtatcattttgcatatccagaaatttatgcagcattcgagtttggcccacgacggcggcccggtcccgctgcagcgacgttgacgtaacgaccttataacattgtcattcattttaagtgactcaaataaacttacgtttgtactgaatgcgacggaaggcacggccacgcttcttcttctttttctcctgtttctccactttaggtgtttgagcacgaactttccctgcacgcgccaatgatccgtggacctgtcagcatttactttttagaccaagaaatgaatgtcaaatctccaaagctaattttaagtatagttcattaattcctataaaagaacccttgagacggcaaacctttccaccacgaaggcgaagaaccaagtgaagagtggactctttctaaaacaaagattaagcaaactggtaaaacataaaaaaacatctgaatttgagacatacctgaatgttgtaatcagccaaagtgccttaaagtttgagcaaaaattaaaatatttatagtaattgaggaattttacgtccatcctccaattgtttcccggcaaaaatctgcaaagaccattttttaaatagattcgctctattttaattgactcaccaaacgttgctggtccggagggattccttctttgtcctggattttggctttgacattttcgatagtgtcactcgccttagaatgcaaatatacaatcttttcttaaactgttaagttgatacctcgacttccaaagtaattgtttttccggtcaaagttttgacgaaaatttgcatcttcagttacgtattcacttaaaagaaataaattattttctgaattctctgatgtgattgaaaatcaaattgtgcttcattgattcgagcaaataaggaaacaagaatgaaatgaataattcatcaaatgtaatatattgttttatttagtgttttcgtcttgttttcatcattattttagcatttagaaaaaaaaaatttacagaatgactgcccttcatgatcagtggtgatcactcggcattttgcaattttaaaattaaatctcaatgactaatttcaaaacatatttccataattggttcgctttcttttttggcattttaatttggcaccctcacaaaatgtccaagccacgaaatgtccaaaagagtaaaaacccacgaaatgtccaaattttcaaaatttataaacaaaatgagtctaatttggggtttttagggttttcagggtcgctgaatacgaatatagcctttatattaccccttgcctaaccttaggcccatcctaataataaaaaactcaatttcgaaacttgggcatttcgtggcctggacattttgtgggtcagcgtttaattttcagaaataatcaagaaaaaatttcagctcgataggctaacgagaagtaagtgttcgaaaaaatcaaccttaaagcctaaat

SEQ ID NO: 9783 - DNA, 950 bp, Heterodera glycines
ttagacttccaaaaatgcaccggaaggcttcttcggatacggtccggttcccaatttgtggataaaattgaatcgggcactgaaggtgcacttttgttggatcgcacttgcttttatgctgaacaaggcggacaaatttacgacacgggcgttctctccaaaactgacgatgatgtccataattttaaaaagcattagcaaattttatatatatcccttcaggacacgtggttttccgtcacaaatgtgcaagttcgtgccggttacattttcttttttgggatcgctgagggaactttacatgtcggggacgagcttaaccagcaatttgacgaggaccggcggtggctgataatgaagaatcacacgggcactcacgtgctgaactttgctctgcagaaagtgctggtcagcgtcgaccagaagggctctttggtggcgtctgatcgaatgcgattcgatttcacttccaaacaagcacttggtgctgaacaggcaagtgctaacacatgtcctgcctccgttctccccccgctcctctcccgggttggggttttttttaattaattttttgtttttgcaacaaaattcgaatgcattgccaaactttataataacattcgttttaattaaggtgaaaaaggtggaggaagaagcacagaaactgattgacaccaatgaatccgttttctcgcgtccgtgcgtattgaccgaggcgcgtgatatcagtggccttcgcgcagtgtttgaagaagtgacattgccattctcataaacatcgcttcacttacaattagtcatgctttaggcttatcctgatccggttcgggtggtcagtgttggtgttccggttgatcgtttgttggaagacccgaaaagtgagcttggccatggcacttccgtggaaatctgtggcgggacgtacgttagaaatcaaattctaaattttt

SEQ ID NO: 9784 - DNA, 3012 bp, Heterodera glycines
tggaacattgatagaagaggctaaaaaagaccaagacatggcccttaaaactggcgatgaagagcccatcagattattgggcaaaagggtcaacgaatttgaacaggtagggttcggtaaccaaggcttggtttttgattgtttgtgccaggaattgaactcacaattgttgccatattggaggagggacaatttgcgtgagcaagtgaagcaattacggatggcaatgaaaaaactcaaaaaggcattcaaaaaatcgacgaaggacgaagagaatggcactgaaacagctgaagagaaacggagcaagggaaagagcggtgcgaaaaagaaagctgaagcggtggagaattgagatgacaggcgaagtgttgagctgttttcataccttttttgaggttgagggggggggggggggtcggcccccatctttcgtcataaatgctccggaggagggaggcctttgtaatcgggaagaggtcaaagggggaagggtcgacgaaggggggggggagagaaagagtaatacgatattccgggtgcaccccaaaatgtttttccgacggcgcctaaaatccttatttccctaaaaaatgacaaaatcgcaaacattggcctttttggacaaaatctgtaacaaatcccattaaaattacaaaaaaaaaaaaaatcccagcggcacctaccggcactgtcggaccccatatttcccaaaagttttttgaaaaacatgccgcaaaaaaggtggtaagaaaaaaaggccgtttacatggctgacccccttcgcaaagttagccgtcaatcccctcccctttgacccccctccctttttttaacgtatgactgtttttgccagcgattggtgtgacactgtcagtgttattgttggtataatattttgtttatatataatttgacactcaatattataaaccttaataaacaccttcgttgggttcaattgccaaaaactttaaaaaaatttggtatcatttgaaagataagaaattaggtttataattgagattcaatttcttatgcataactagttacctaatttgaactcataagacttgcttttaatgatatcaaagaactgagaagaaaaaatttcttgcaggctatgatcagataatcggtcccaaaaaatccaataaaaataagtgttgcaggaaaattagcacagattttcaaaaaattctccatggggaacaaaaacaggacattggctgataaaacttgaaaagatataacttttgtgttaggcgtgaagtaaatttttgaaatggaacaagaacaacaacaaaatgttcatcacagtgggcgcgaagtgcgtcagatgttcatcgactttttcgtcaaggaaaaggcccacaaatattaccattcctcttccgtggtatgcaacggtcgtttccgctctccctttgaccattggcattttcagattccccacgaggatccgactctgttgttcaccaatgccgggatgaatcaatttaagcccattttccaagagactgtcgacccgaacagtgacatggccaagctgaagcgtgcggtcaacacacagaaatgcataagggcgggtgggaagcacaacgacttggacgacgtggggaaggacgtgtaccaccacacctttttcgaaatgctcggcaattggtccttcggcgattatttcaaggtcagtcgtctcctttttttgctattctgtttttaaatgttttagagggaaatttgtacatgggcttaccagttcctaacagaatggttgcatatttcgtccgaacgcctttacgtctctttttttggcggcgatttggccaataatttgttgccggacgaagagtgtcggtaaattgtaactgtcaaatttaattttattcctgttattcaagccaaatatggttggacatcggtgttcctagtgaacacattcttccctttggaatgaaagacaacttttgggagatgggcgagacgggcccttgcggtccgtgttccgaaattcattatgaccgaattggtggcagagatgcggcccatctggtgaacgccgatgacccaatggtggtggaaatttggaatttggtcttcattcagttcaaccggtgtcttgtgagattggcagccattagcatgactttttaactttagggaggagggcggagtgttgaaatcgttgcccaacaaacacatcgattgtggtctcggctttgaacgtctcgtcgctgtggcgcagcaaaagacttccaactacgacaccgatttgttcaccccaatttttagcgcaattcaggaggttgtaggtggtgaaattttgctattgtaagtttggagcttcaggggaccggagcccgcgagtacactggcaaagttggttccgaggacgtcgacggtgtggacatggcttaccgggtggtcgcagatcacattcgcactttgaccatcgcactgagtgacggggggtcgcctgactcgaccggaagggggtactcacttgggagtttaaaaatcactgatgatgatatgcaatgcttgctttgtttttagttatgtccttcgtcgcattttgcgccgcggagttcgctacgcaactgagaaattgggggccaagcccggcttcttcgcctcgcttgttcccgtggtcatcgacattttagtactttgtttttgtggtctggtgtatgggggtctcttgaaaaccaatttcttaagggcgacacttttcccgagcttcgaaaggacccaagctcagccatggaaattatcaatgaggaggaggcacaatttctgaagacgcttcgtcggggccacgttctgtttgagaaagcggtcaatgctttgccttcgggcaataaaactttccccgggagcatcgcgtggcgcctctacgacacttacggatttccgattgatctcacccaacttatggccgaagagaagggactcactgttcagatggacgagtacgaggacagcaaaaagaaggccagaggaaaaaaataa

SEQ ID NO: 9785 - DNA, 977 bp, Heterodera glycines
tgggaggacgaagaggaggagaaagagacggtggacagcaaattcgcaagggcagcggaggaagcggcactcaaagtgaaagaaaagtgacaaatccgaaccgaaaaggacgaccgatttaggcacagcccgaacggaggcgcaactccaagcgcgagctgagcagggcggaggaggcggaactgctcgcatggaaggcggaggtgcagcggacggcggagacgcggctgagagcgtctgaagagccggacagtgacgcggaggggcggagagagagcagcgaacggcccgaaggagccgcgcaagaagcagacggaccgcaaaaggggaccgaagagcgacaaaagcggcaaaaggaaggggaagaagcggaacgactagcagagacggatcaacaactgatttgggggagggatccgcaactgatcagcggaaaacaaacagcggcgagtgatcaggaacaagtggcatttgaacaaccatcaaatagacaaaaacaacaatctctccctgatcagcaaatacaaacggtgcagaaattgcctgaggcgagaacggcggaattgctggtgccaatgagtgaatgggccaaaacgaagcagtgagtttggccgattgcagtgaaaggtgtcacccgaaatagatcagaaatgctattttaattatgatattgtcgttttttcttctgtttagcagaagcttaatgaataaattaatgctttttgtcacggaatgcctttttttggctttttggttgttggcacttcgtccgatcactgatcgattgtgtggactgatcactcagcttgttctcccttccaaggctgattcgtatcgttcaacaatccgacgactttgctttatcccatccgggcgccactccgccgagcaccccgccgaacggaattggacagaatgaattggcggcacattatcgcgtgaaggcggacgaactgacgcaaaagctgagaaacgaa

SEQ ID NO: 9786 - DNA, 242 bp, Heterodera glycines
gcagagttcccaagtttttttttcaaaataaggacaaacgaggctaaaactaagattttgaccccaaaaataagattttttctacaactaatagtagcgcgaaggaaacgcaatagaatacatgaaaaccgacataaaacaacattttttagtatgaaacaattgaattttttttccgctgaccatttttctcattttgccgcatatgcacttttttgcgtcgcttttttccaataaactta

SEQ ID NO: 9787 - DNA, 2023 bp, Heterodera glycines
acgattagttaacatggcatcataacaaagtctccaactctaagcaatcgccttttaaaatgttcttcaatcagaaaagatttatttaatcatttttttttacaattttaaagttatttttatttttttgtatttttaattttcgttcttttccatttaaaaattttcttctcttattactttgtcttttatgtaattgtcatcaaaatgtaatacattattgtaaagaacataatcgaataaattaataaaatcttaattactgcagagtgggtcaattttattttaatatggcccctaaaacttagaacatttggagaatatatttatacatgttatcgccgaatttgggacttattggcgctgatcatttttagaaaaggcactccagaatccaaaaaagttgtcgatttggagaaaatatgttaataaacatgacaaaattttctaatttcgccgtccgcgattggccccgcgacgcattttatattaatcaaaatgttgtctcaaatccctaacagtcaataatgaattgaaaaacattattttaattatatttaagcggttttagaaattgcgtttacaataagaagtattttgcattaaattttaataaatgaatttacgataaattaaattgtttaattttcatttgtttctttattctttccatcttcttccttcatatgaacttacagaatctaaattatatttattataaatataattttaattgtatttatttattcgtaagttcgtacacattacaaagacatgtcgccacattgcctatgggcttttcgcgcacatttttcccacacatttcgccagtccattctcaccgccctatatgtatgcaaatattgttgtttgaaaaaaatgtaattagacaactcaattaattaaattttacggcatcattaccagtcgaattgcaaacggacacttgtcattgtccttgtggccaatcactcccaatttgccgccctgttgcggaaggccggccaacatgtcataggacagtgcagtgattggctcctccatgcacaacaggtacccccaaaaggaccggttcctaaacaaggccgtcttgttcgttggcacagggccagcaaatccatccaaaatgccaaactctccaagagaaatgtttgcgcatgcctccttatctccaaacaattccacatgggtatgccttaatgagtggaataaaagtgctggtggtttcgtaaaatacggtagttcggggtttttaacaaataatttgataactttgctcaaaaacaacaaatatatatgtattctttgtggtatttattattcgaaatatttttctctttattattctgcaaaatttcaaaaaaataatttttttttctccaatttagaataagattatgacaaacaaagtgcagaaaattggtgtaattatttgaaacttggtgaagcttttaacaaattttttcggcaaattaagaaaacttattgctacctaacaaatagataccgatttgaaaaggtaagatgtttaaatgcaccatttactactttcttcaaaattaatttgctttgatcgcttatataaaatatttggcaagcaaaaatactttgataaaatttgattcatgaattttttagtttctgagtttctcggtctcgacactctcggggtcaattctcggtcttgggtcatgcaaaataatttgtttttttgtccccaatgccagacatgattacttctttttgtgcgttgatgtgtacaagttcattgtttgcttttattccgtggcatccataacaatttggacaccatgcaaaattttgtcctttccaaattccttcgcccatttcgtttcctgcgcctttttgcattgtgacgcaatttcgttgtttttctcataattttccaattcaaattgcgaattcacttggtcatttgcctggtccatttggccaataaagcaaaaaatcagcctaaaattaggagtttttatttcccacaaatatgtttataaatcactaa

SEQ ID NO: 9788 - DNA, 1818 bp, Heterodera glycines
ttaattgatccagcgtgaaataattaatactttgcatcgatttgacactgcccaagtctgcacacggtaatttgcatgtggcggtgatcaatgtcaaggctggtattgaagtgcagcgtaatcgggttgggcataataccgttgattaagctagcttgcagtacacttcaaaatttaatcaccgtaataattttaatttaccgtatttattgagttatagcccccccccgtgaatattagagcccccctctgaaataaagcccccctttcaagggtgttgataactaaagccccccccccccttgaattagagcccccctctgaaataaagccccccttttgagggggggggggggggggttgaaaaatagaggcaccgggggatctatttcaataaatacggtattttaatttttaaaaatttaagatcgtaataatttaaatttatttgcacacatttctccactctccgtgatcactacgggtgcttttctcgactctacactgttcaactgcttcccggtggtccaatcaacaatgccactaccatcaacaatgttgttgctgttttggagaagaactcccaaaagaaatgggaaaatgagtcgattcatcagcgaaggggaagccatttttaatcacctaaatttgattaatgccaattttcgccttttttggcactggacaactaataaatgcataaataaatgttatgtggaatagcagtattaagaaaatgaaaataaaattcatcatctgtcatgcggaagcgaacccatgatgaatagtcattaaatttatgagggaaaagcgcataaattaattaatttttgtttgtattttcacatttgatccattttttctgatcagttgagggttagcgcaaaaaaaaaaataatttacaatagcaaatggaccatgctttacaacgataaatatagttttaaagtgaattagacactgacatttcaaaatatttcccttgtctaaattaaagatgaccgttagaatttcaccaataaatacaaagccagttttgtgatttatacaacagtgaaagaatatgtccatcgttgaatgatagcttcattcagttgaatgatgacgattcattacaaaaacaaattggtagattgtttgctttgattaactttgatttttctcttcgttaaatgaatcattttttatgtaaatataagtaaagtaaaaatatgcattagggtaaatggataaatgaataaatattgtaaaataacaaaataaatgaaaaattgggaatatttaaataaaatttaagaaataaattttatatgtaagggttttttagttggtttttaaatatgcctcaggatattcagtgctaatttcaaagtgtaattcttcgccagaaaatgcaaattttcaagataatttgattgatttgcaactcggagataggtatagtacaatttttttttttattttaatgattaatttaggcaataaattggtaaaattaataaaaacggttaattgtttaattttataaaaaatgcttaaaggaagcaaatttaaatttttcttttcaaagtatttgccattatatttatcaattgcagaaaaatttgcaaaaataaaataaacaaattcaaaaagtcgagctttcatacttccgtgacaatgtttattttaaaccaaactatttttttcgataccgaagaacccttctctattaacccattaaattttcaaaaattatgttaactttcaaaaaaaaattttttttgtcataattccgaatcgcgctttttattttcatttttatttataactttttgg

SEQ ID NO: 9789 - DNA, 2344 bp, Heterodera glycines
ccaataaattccaaagccagttttggtgattttatccaacagggaaagaatatgtccatcgttgaatgatagcttcatccagtgaatggatgacgattcattacaaaaacaaattggtagattgtttgctttgattaactttgatttttctcttcgttaaatgaatcatttttatgtaaataaagtaaaaatatgcattagggtaaatggataaatgaataaatattgtaaaataacaaattaaatgaaaaattggaatatttaaataaaatttaagaaataaattttattttttaaatttaaatgattaatttaggcaataaattggtaaaattaataaaaacggcggttaaattatttaattttataataaatgcttaaagattttaaaccaaactatttttttttcgatgccgaagaattcttctctctctattaagccattaaatttcaaaaattatgttaactttcaaaaaaaattttttttttgtcataattccgaatcgcgctttttattttcatttttatttataactttttggatcatttttcattatcaaattattgagtgccatcgacagtattgcctaaaaaatatacagtaaaataatttcctaaaaaaagaattataaatgtatgttcaaacagtttgtgataaaatttaaaaaatgcaataagctttcatttgatttattctgttttattagactaacaatacgattttaaaaaagcattaagccttgctcctaaattatacatatatttttacaaatataggaaacaacgtttgtgaccgacaatcttctagttttttatggaaaattattccgctgggctgtatgtttagaatttaataaaaaaacaaaaattttttttactaattttcagttatgctttccgtttttcatgccacttttgttgggtgtcatttgaatgctttttgaaatggcggaagaacaaacaaaaaaaaatatttaaccaacaattagctgagagatggtttgcttaaaataagaatgcattaaatgtgatattcttatttttttcatcagtacatttaaaaaatgttttcttgcatttttttatcgaaataaacaagtagcattggccctcccacattcctaatttttgaatatttataaaaataataaaaaaaaagaatttttcttaaatttttttatttatatatacttcggatttttcaattacctattaattttattaatgagcattaaagtctttattggataagtcaatttaatttaaatcaaattatattttgccataaaaatatcataatgccaaaatttatagttcttttgtcccaaaatttgctatagcgggcatttttggttaaagcgtagcagcaggcgtgtcatcttcttttactccattgtacgcgtcgaccttgtaatgttcggccaaaaatggcacaaattcgacattcggcaatgtaaaatttcatatttaataatttgtatgaattagtgatttacaattcccaattccaataaaagaattataagaacataaaaaaaacacaaaagcagaaataatataattaggtcatcttcttaattggccattttttggatttttgattgatatttcttttcgaaaatttttagtctaaattttagtcaatataaacgatatgctttcataaatcactaattatcacagtttatctaaatttttttggttaaagcgtagcagcatgcaggtcatcttcttgtcctccatgtacatctccatcacgttgtgcgcgtcggccttgtactgttcggtcagcaatggcacaacttcatcattcggcaatgttttacgatcataatccgctgttgcttcaccaattttcacagtgtcattgaaccggagcattttttccttcgcattcccacccatcggttttgaagaattctaaaaattttgaaaatttattttcaatgcatactttttcgtagtttaaaaattattattatattagttagaatgggaatggattgaattctatttcaaaaaattgtaaaaaattataaattaaaaaggtaaaatggaagagattttttaaaattgcttaaaaaattattaaaaaaatgttttagtgaaaactaagttttttatagtaaattcaataaaaaaaatgtcgatgatagaaccaaaaatttttttttaatttaataaattttaaggagaaagcatattcgtttaggtattttccaattttgtatttaaataaaaaaatcgtttaacaactatgcaatgattataaaatttaaatataaaattcaaaaaaaatcaattataaaaaaattatgaaaaaacaaaccatttttatttggta

SEQ ID NO: 9790 - DNA, 1027 bp, Heterodera glycines
aactgaaattaaaatttcatttttcgggggggggggggaggagctgctcccaacaattgtcgatgcttgagaatctctgcctcgtgtcgagattaaagcgattattctcataaaaacctaaagactttggcttatttgagtttccttttaggttggaaaaaggctgtccttgtcttcatcggtttatcacttatcgcttgcgctttttcaatgctgtaatcattaaacataaaaataaaattattttattttttaaacgcaagtttgccttattaaggatgggtctgtgtgccccgtgcaccccggcatgcgctattcttcacagcatcgccagcttttttgcttgtgaatggcttatatattaattattccaattttaaatttatattataattattattattatttttattgacaattaaattaatttattagcttgtaacaaattatgtgccctttttttattagtgtccatccccattttaaaccggggggggggggttgttgccaagaaaattccattttatatataaaccatttgaatttcttggtaccgaaccggtttaaaactaggaaatccggtttttgaccattttgaccgaaaccggctcaaatttttctcacaaattttgaaagctgatcaaaaaaattttttgaagcaaatatataagggattattattttttatttatcacaaatgagatttttcttcagccaattttatagggtttttggacactaataaaaatggtatataataatgttacaacctaataatttgctcattcatttgctaatttaccttgctaattaaacaacagatctttttgctgttgtcggcgcctcaattttcttttttgccgagcatcgcgtggacagtcgttttgatcattgactcgtcgaaacttatgaggtgaaaaaacgctgcacaaaaatgataaattgaaaattttaagttctttaattgacaaaaatatattacttatatataaattatatttaatgattttattataaatttcatatt

SEQ ID NO: 9791 - DNA, 3568 bp, Heterodera glycines
gttggttatttgtttgaaatttattttttttttaaattcaggggggtgagaaaaagcgcagaaaaatttggtaattgaaacctatgaaatccccccagttttatgaataaatttcccggtttgtttattacctaacattttaaatggaagttatttttttttgttataaatgtgtcccggttcgcaacctttatatatttgttattttaaatttaaactgctggttgtggactttttttttctttttttttttttcttttcccgttcccaaattggccaaattttggccccttcccattcttttttttatcagttcccttcgaacccttttttttttttcgtttcgctttggttggccgatttcccccgaaggacagtgagtgagccccttgcattgttcccccgttttttccccccccccccccccaatttcgccgccttcgcagcgaatcgatcattttgggcggtgattataaaaaaaataagacaaatacgatgataaatggtattgataataaaaaaataaataaacaattgaataacacaccaccacccccacctaatgagaaggtatttatcatttattcattcattcgttaattcactcgcttttatttaatcactgataattttcggatgattttattttgctcattgcaagcagcagaagagcagcagaagcatcaactgtgttgttgtacatatgtattacatttatttgcctcttcgttggacatttaaatgatttataattttaatttaaaaaataataagattttcaataagtttttgaatttgaataatccctccagaaataatttgccaattaccatttgatgtaatcctttttggtccagcattaatatttttgtaataccctgcaaaacattttcattccatacacatttttgtgtcaccaattcgtgctcacttttcagccatcaactgcaagttttaatactcttccaaaaacacatattatcggtcacgcctatttgagtcatatcgaatttcccaaaattttgcaaaatctcctcatttttaaaatttaatttctgtataagttaatttaatcttaaaatatgaactttaagatcttaaagactagaaatgaaaggaaaatgaattgaaatcatttaaaaaagatacatatgacaaagtgtgtagtaattgctcatctgccgagtgagctgctgttttggtttggagcgcaattatttatttattatttgacgaatgaattaattggctgcgcgaaaattgatcgattgacccggactttttctcaaaaacatcctttattattaatttaatttaaaaatatttattaggatttcttaaatattttttccgccagcagaggaaataaaaatggctttttctttggtttctttgctccgtcgttttcttccgccataccatcaaaatttggtgtatgtcatttgcggtgcgcacattttgtacggctcaattgcattggcagtccgtaagtttatttgttagttttcattttaatattggaaagagagtgatcagcagctgaaaaataaatttttggagatatttgtaattaaaattatctaatgatgatgaaatttgcataaaaatttctgtcccccgtccatttgagatcagactttttgggtgctctcaacgcgcattttccccaccgcttttgacatgttcgacgacacgcgcaacagagtgatggactacgacaccatgtggaattggaccagcaggtgcctccgttccgccaattttttcaatattttatcacccgtttttatgttcagacagcagctggacaggtatcagaaccgactgaccatcagctgggtggtggcgacttttggtagtgattactaatagtattatgtgaaaatttgttttttattttaaaattatataattaataaattaaaatccttttcccttttcagatatttttatggccattttgtgcatcattccccaattttgcaaggtcgaggtgagcgagggcaacagagtgcaggagttggacttggtgagagggggcgggggaggaggcggggaaaaatacgaaacactctattctttttcattttgaatttaatttggaaattatttttatttatttcaatttttattgaaaaaattttatggtctccattttcggcttattatattataaattttacggttgtccaaaagaaaaagcgtttttttaatgtcaaaaaatttttcgcctggcgctaaaaatcgcaaaaatttggcagtttttagtgcaaatctgttaacaaattgcactcgaattttaaaaattttccccggcggcgcctaccggcaccgccggccttcgattccccaaaattttttggaaaaagcgcgccgccaaaaaaatggttttgttaagcagcaaaaaataataagcgataggtttgaatgagttggcaaacatccttgtttcgttggcaaactcaacgtatttttcttttcttggtaaattgaaagcttattaaacggaattttatgcgcatgcgaaaaaaggaaaacttttctgtgatgagcaaaaaaaaaaaaggtcgtcaaaaattttttgacccccccatcgtaaaaaaaattggccctggcgcaccccccctgcgccgatcgtacatcgtatggggtcggccctggcgcaccccttgtacatgtatgatactcatgtcttttatattgtatagctttcgtaattaaggtctgttgaatttttaaaataccctccaaggaacattcgacgaacattatttccttaaaattcaaaattgtccaataaatcccaagatatttggcattgattgtttttatccacctgtccttatttgtccttaataaagccccccccccccttagtgtattcgccgtcccgtcattgccaaactgatggccccgttgcttttgttggccaatttgctgttggccgcctgtttgggtgccgaacgatggtattgcccggctgaggaccgactgtttccactcccttttcgacggtgccatcaaagaggaggtgttcctgaccaacttcgagcgcgagttggaatgtgtcagtgacgaggacaaagaaggtgagtgacaagggtcaattaggcagggcactaattaacagctaatgaagcgaaaacacaaaccaagagtgcattttctaatcccctattagcaacagcgctttttgctaatcagattaagtaaatcatttattcaaaagtcattaggtgtaattaaattgacgcgacaaatttttcttaaatgttaaattccagtgtattaatttagcaaggatttatttatcaaatgcataatgcttagcttccaatggaacgaattttagtgctttaaaattataaaactttattttaaaaatcatatttatttatttttttctgcatattttccccgtctttaggcaccgatgtgtgggtaagtgtcgtcgtttaccgcaacaataatttttcagagtattaaatttggttaattttattttgtttaaatttgaaataaaaacttcagtcccccaattgaatattacagaaaatgtgatgggata

SEQ ID NO: 9792 - DNA, 2798 bp, Heterodera glycines
  misc_feature (27)..(27): n is a, c, g, or t
  misc_feature (32)..(33): n is a, c, g, or t
  misc_feature (42)..(42): n is a, c, g, or t
  misc_feature (57)..(57): n is a, c, g, or t
  misc_feature (127)..(127): n is a, c, g, or t
aaaaacataaaaattttataaaatganttcgnnaattatttntataaaaaatatcgnacactaaattttcaaacggtaccgacaaaaaactggtaatttctgtgttctaatattttttaaagttttntaattaatttacaaacctaaataataatatttattgcgcctctgatatttgcgcctatgcttaaaagcagtctcaaaacttttttttaatagaaaaataaagcaattgttattattaaataaattgtttgaataaatggtatatttacctttttgaaaattttcttaagctttttttaatttccgtgtcaaagcggtaaaataattttttttaatgttaatttttaaataatatttttttaatttatacaatttttgcacttgttgcttttttggccaaaaattgctcatcgccaaatgcttgacactcctcctatttatgagaaatttcagaaaaagccatggagcagattatttgaaagaaaaatatttgctaaaatgtggcatgccatcgaaaaaaaaaattaatttggcgcattatttttttaattctaccgagttttggctttttttaaattcaaaattgtctagaaaccgatgtacggctatgtttttctgaaaaagctttaaaatttcgaattaatttatttattaattcctctttttacagttccgcgtgtgtgccgaaaatgcgtttggccgttccgacccattgaacaccgacgtggaccggcccggcctcccagagggcccgatcacttatccggccacaacaaagtgagaaattttcaaaaatataaaatattttaaaaattttgcaccgaattttggaatggtgccaaaaaaatcggtgccaaattttgcattgcactaatttttttttaatttgactcaaatttaaaaaaaatttcagtgcatctttcttctctttttgatggtgacacaaatttaaaaacatagcaaacgaaaatattgacaattcaattttttccattaaataaaacggaaattgggtcagtggaaaatgcgtcagtgaatcagtatttctttaaattgagatacggtagtaatattactgaattataacttatttttaggaatttgtgaaagttttaattattttgacttttaaaaaattaattgaaaaattcagaacaaaaatattagaaaaattttgaccttttgtaatacaatacttaatgctacagtaactttattataaaaatactgtattactggcaccttttccactgacgcattttccaggagccaaaaatattactattaaattaattttcatttaaatatggcacaaaaattttcagcaaagaagtgtctgtgcaggggccaagtgttgtgccgttgaaatcgcagcgtgccaacgaaaaggaaaaggacgccatgcaaacccgaactcctaaaacggcacaaccttcgtctgcgcatggcatcggaccatccttgggtaagaaatgagtttggatggaaaatcttagataaaaggctttctttaccagttcggcatttagttcaaaaacgattatctgcttgtctctttttcaattttaatttaaaccgtttcattttttataatttttaattagttcaaaaaacagttaaacattttccacggacatttttaatttttaatttaatgataatttaattttaaaatatttgtactttaattatattatttcttcactaaaaaaggaaaataaaatttacttttttatcaaattaatattttcatttatttaaatatatattttttaaattatgtatatatttataatattaaatttatattaattttttaattttttaaaaataattatttcaaactaaagaaaataaattattgttttttttcaaattaaataattatatttcacataattttatatagaatatttttattaaaataatgcattttgtttcagactcatcagaccaaccattgtcctccaccgcccgtcgtcgccagccgcgcagacagaaaagtgccagaaaggatgccactgacatgcagtggttggtttaacaaaaaataataatttaaaaaataataaatttaattcatttattttttagttgtagcaagaatttaccgccacgccacaaaaacacggtgagcaaattcggattttttaaattatttattgggaattttgagaaaaattatttttttaaatttttataatgaactggaaaaaattttttttttaatgatgcatatttttgaatttttataaaatatttacaaatatttttttttgattttttttcaatgattcctcttctgttgatcatgtttccgctaaagcatcaatattcaaaatttttttctaaaattgatcttttttctttgtaaaatttttgctttaaattgtccccataatctaaacaaaacttttaaatatttaatgttttaaaaaatcatgaacaggagcggaccgcgtccggtggcggaaggcaacgcgttggcagcaccgcggcggaccggccggcacaggcggcagcagcggcttacgctggggacgaagaggcaccgaacgaggaggaagtggccgacagtgagggggagcagcagctgctcgacatgacgacggttgaggtgggaataattttgaggcgggagggggtggggccaaattttgcttcttgccactttttttctctgtttttttttaaattttttttggaggggggggggggtggtaagatccaatggtgccaataggcagacgccccgtggaaattttgcaaaaatgaaatgcaatttgctaatt

SEQ ID NO: 9793 - DNA, 3753 bp, Heterodera glycines
  misc_feature (1912)..(1912): n is a, c, g, or t
  misc_feature (1918)..(1918): n is a, c, g, or t
aacattaattaccagcatccataatcatcataaaccaatgcagtgtaatgcaatttgcattccgccatttcgttcaaattccataatgcaccaaaagttggttttcgatttgaagcaaataaagtgtccggacggatgtacggaacagcaaaaaccaaaagaaacaaaaagtgaaagaaagaatcgaaaatgcgatgaacatgaaatgctaacatattttgacctaaaccattaaaaatcgacggtcagccgtaggcggaaactgatcttggaggacaacatccgaaatgggacagcaaatcacaggaacaaaaaaaaaaaattaagctatcttaagacttaagctaaagcaaaaaaaaaaaaatcttctggcgaaatgtattaatttaaaaaaaagttttcaaaattgaaatgcatggcacttaagtgatttaaccagaaattcatctttttattcatgtctgcttttgaattgcattttttagaattctattttattgttttattcgagtttctttggttgttttttgtccatcttttctttttcttccaatggaaaacgcaaagatttcccttttataccaactcgaacaacggaaagtttcgaagttggagagagaaaacagagcattacgggaacgaatcaacggccttttggaaaagcaagacgatgagagaattgaacttttggtagctgacagaacacgggtactaaatatatacaacgaaaattactttaagtactttattttttagcgaaaactcgtccaactccgcgcaataactgaacggaccataaaatccttggaatcaggaatcaacgaatttagagcttttgtaaccgacataaatgaagcgtatgtttattttagttttaacaaaggattgtcgggaagaagtcagctcaaatcgacaaatttgttaagaatggatgaagaagagaataaaggagcgattcaaccgttgaaactcgtcgacattagcaatgaaagcgaccgcattcttcgcaatttctctcctaagcttaagcgaagtctgttttaagcttttgttacttgtgattccattctattctttttttctgtaactaattcagttcccgaatctccgatggttttgtcggcaatttcgacttccaaaagcggctcaaattcgcaatcagagtcattccgtacgggtttggaagaagaggaggaggaaagggcaaacggaatggaagaagttgttaacgaaacgcctcacttggacatgatggagacgagtgggacagggacggaagttgagaacgcgtcgaattccaaagggaagatcgaacagaggaagtcggccatcgcaccaatctgctcaatcactttgcgtcaacgatcgtccgcaatgaaatttgcaccctccgaaatgaagcggactcacagtgggcactatcacataaaagctgggaaaaaacaagagatcgacctgggaaacctgggtttcatggataatattttgacttgttatttcgagtgaccattccaggcctggattcagctcatgataaacctggattcccagaaatccaggcttttttcaaaatatcaagctctaaaaaattattgcacatcatctttttccttcattggaattttaacttttcctcccattttgtttagttgcaacgcccgctttcccccccccccccgaaatgaaaatttttaaaaattttccagcaaataatggaaaatttttccgaattccccccccaaactaaaataataggcaattttcgtaacaaatagcactcaaatttgcaaaaaattttcccggcggcgcctatcggcaccgccggacctccactttccactatttttacaagttttgtgccttaaaacgcccaaaattgggtcatttttagtaaagaaatcccactttttanttattnattaaatacaaaaaaaaaaaaaaagtcttcaggtcgggtccccccccccccgaaaaatgtttctagatacgcccctgtacccgctcattttgtctgcaaaatctcggcattttatagacgtgttgcttttgttgactgtttttttcccttttgcatagaatgtttgacgacaacccaaaagatgacatcaacggagtgatcactggcgatctgctgattgtcatggcgcaaatcattgttgccatccaaatggtacggattttttgaataaatattttttcttagggggctcgacagcttgaaaaaaaattcctggtcctatccttgacttggggactaactaagacatggactttatttgacaaaaaagaatcacggtccataaaaaaaaccctggaggtagtctcaatttgtacataatcaagtcgatgaattttcattttttttttgcattcatttatacccaaaattctattaatttcagtgttttcacacttatattaacttttttatgtttttcaatttgtaataggcttaagaaaaattagtttgacgactccggctataattcgacatttttaaaataatttttttttctggggtttgaccaaaaaaagcaaaaaaaaaaagataatttattttattccaaattcctaggtttgggagcagaaatatctgatgcaatacgacgtgcctccactgctcgcggtcggactggagggtgggttttgcaattaaaatttttgaaatttcatttttttgttcatcaacaggcctttttggtatgattgtgctcggctctctgatggtgccaatgtattacatccgcgtgccggccaccttttccagagacccagaacatcgtaaaaaccgacaaaaaaattttccgaaatttaaaaaaaaaattttccaaggcctcgaagacgtcttccacgcatttgcccaaatccatcagaggccgatcattttggcaccacttttcctgacaattacgaggtggtgtggcttggttcacagcttgtctttgtgtttaccctgttttgagtgctttaaatttctttttccaagcctgcaaaatttcgaaaatttacattttgtttttcaaaaaagtggccacaaattttcataaacctgctttccctactgattgcgaacatttttgccatctttttgaaatttcgagagatgtcaaatgatttcgaattcgttcaattacacccagcataaattctaatatatatatataatattatatttactttccacagtattgcgttcttcaactttgccggtgttacggtcaccaaacgcctttcggccaccacgcgaatggcgcgttttttttataattaattttagagggcgggacataatttcgccaccgatatattttgccggtcgaaatttcgccgccgtattttttcttgaaatttatgatgaattagtaagttttttcaaatttttttaaaaaattgctaaaaaatttaattttcatataaaaaaattcttaggcgaaattatgtcccggcgaaatttgggatgcatccttaattttattcatccatttttgtttaatcaaatttggcttatctcgtcgcctattattgcaacaggtgcttgacagtgtgcgaacattgctcatttgggccttttccatcccattctttggcgagcggttcatccctctccaggtgtgctaattgtttcggaattttctggtgaatttgttgatgattaattttgggttaggcactgtcaatcttggagccaccaggaaataaaaataaaatttcgataatttttttgaaaattactgctccctgttccaactcccc

SEQ ID NO: 9794 - DNA, 2609 bp, Heterodera glycines
caatttcatttcatttgctgtgagtgccatttaaacattcccttaattgttccaattatttatgatcaattaaggaactgatggatccgagcaaaggcttttacgaccaaagcgaggacaaagtgacattggccattgatgtcagtgtgaaataagcataaatggagaacaaatcataaattattcatatgctctgggaaatctcgtccttgaattatcatcctatggacttttttttatcatatttcttactgtttaaatttttttgattttataaaaatggattggattaaatcatagattaaatgttgtatcagcgcaattgtaaatgcaaaaagacgttgtcctttttcttgccatgttttttacaataacaaattcgcatgggatgtccgccaagcatactgtacccaccaatttccaagtcggaaagaatgttgacatttgtaacacacttttgttggttttttaaattttttctatgctaatatcatgcaatgtattatttgtatccttacaaggctcagtcggctgaagatttcaaattttatacgtttaaatcgaattagacgggtcttgaaatttagagttcaaatagccctgtatagagtttagagccgaaactagtaaacatctgacaccacgtttaaacagctgtacaattgactaaataataaaattgtcacttttccatattttaatttttaattttgtagtaaatataaatttttaagcgcatcttggattattaaagaatgaaatcatagcgtaattagtaatagtttttcaatttttaatttaataagcccaaacttcccggttcccaaatttctggtcccaaaaaattctgcttaaataaaaggaaaaaatgatcagtcaattaggaatggtttcaatttaaaaaaaaagtttaaaaaaatgtttacgtaaatcctaacaaaattaatgcaataaatccaagtccaaaaaattgtaaacattgacctaaaatggtaaaatttgaattgggtttatgactaaaatgtttatcattgaaattcggtactcaaaaatgagagtctgctaaaacagctccgacaattaattaattcatatatcagcagttttgaaagtataatcaagaaaaattaataaataaaaaaacaggttcatcataggatggaggatattcaatggcatttttccccaaatcatattgggcatttatgtttcgtcttccgttttgcttctttcactgtgacatcaatggccaatgtcactttgtcctcgctttggtcgtaaaagcctttgcttgggtccatcagttccttaattaccccataattggtcaattaagggaatgtttaattgtcactcacagcaaatgaaatgaaattgaatccccagttgttctctttgttgtcaaaaacatggtcatttaattctaatttaaaatccggcactccgttcttttgcgaaacaattcgaaagtttgccgaacatttgcggctccaattttctgctcaatatcaattaattaattgttgttaatatatatattaattattagtaattttacaccttcttttggagcatcgcacaaaagtaaaaagcccatccatttctcatttttctcagtgctttcatttttcttttctattcctgcccatattttccatggcaatcctttgatgtgcacagtttcgcttttacgttcacttccaattatttctcgcgcaaattccgacactttttcaatttccataaagagtgtgcctttcgaattgctttgatccaaattgaatttgtccacttttggttcatcaacagttgtgagatcgatggtcaatttcactttgtcctcttctctgtcgtaaaaaccattgttaaggtccatcaattccttaatttaaatcatctaatttaatttttgtttatgcgtggtcaattggttatgttttagaaattaatttattttgttatgatttctttacaccaggcaaataaataaatgaacttcaatattggctggtccacgaatgtcaaattaaaatatttgtttgaattggcacttaccgcaaacgaaacgaaattagggaatcccaaattatttgattttttgtcaaaaacatgatcacaaaatgtcccaatcgaattctccgtcccaattttttgcgagataattcgaaaagttgccgaacgaacgcagcagcgccaaagcgaatcttaatgattattactcatcgttgttaattagcatttaataacagttaatttgcacctttttcagtagcatcacacaatagataaatgctcaaccatttctcactgtcaacgagtccatttagttctgcttcaattttccatggaagtccatttatgtacactttttcgctgtaccgactgctcccaacctcctctcgtgcaaattccgacactttttcaatgtccatcaaaagtgtgcccttttttcgatcagaaatccgtccattagtcgaaaatggcattgggaaaattccgtcggaaatcccatgacaatttggaagggatttgaactgataaacggcgatcacttcatcttttgataaaacaccgaagggaactataaatatgtattaacttatgaaaaa

SEQ ID NO: 9795 - DNA, 2558 bp, Heterodera glycines
  misc_feature (4)..(4): n is a, c, g, or t
  misc_feature (20)..(21): n is a, c, g, or t
  misc_feature (23)..(23): n is a, c, g, or t
  misc_feature (67)..(67): n is a, c, g, or t
cgancgcagcagcgcaagcnngnatctaatgggagtattaattatgctgttaattagtactaataancaattaattgttgttaatatatatattaactattagtaattttgcaccttttttcgaagtatcgcaacaaatgaaaatgcccaaccatttctcattgtcagtgcctccatttttcgtttttatttttgccaatatattccatggtaatccatttatgtacactttttcgctgtaccgactgctctcaacctcctctcgtgcaaattccgacacttttttaatgtccatcaaaactgtgcccttttttcgatcggaaatccgtccattagtcggaaattgcattgggaaaattccgtcggaaatcccatgacaatttggaagggatttgaactgataaacgctgatcacttcatcttttgacaaaacaccgaagggaactgtaaatatgtattaacttattgaaaaataaattttaaaaaacatttttaaaaatcgccacaaaaatatgaattttttacggcatctcatcagagaacgagtttgaaattttgacttattttttaccaattttcttcgtaaattcctcatttgacaaaagcggaaagcgaattttgaacagtgccgggccaagcatttgacggcgattctctgctgaacaatcaatgccattttcacggcatttttcatcggcccaacggagtgcctttaaaaaaatttaatggaaataattaaatgactaataaaatttagtttttaaatttaattgttaaaattaccgcattccaaattgaaatttctccacggatttgcaattcgtcacactccaaaatttcgcacaacaatttttggtcaatttgcaaaaaagcatccgatttgagcaaagtgtccgcatttttgccaatgtaagccaaacaacaattggcaaaattctaaaattcaaaggaaaaataatctttaaaatgtagtctttctctgagagtgccaaagcgagaaaagaatcgagtttttcttgtctaggttttcgagtttagaagaccgagatttctttaagccctctaatgattgtttggcttttgacaaacttaaaaaaacattcattttttgaggaacatattttacaaaaaaaaagtctaaagtcaagggtttttcggtctcacaatcagacagcagtaattaatggcgtcaaaacggaacattgcctcaaaaacatcggaaacgctcttcaaaataagctgatgtgctggcaaaacctttaaaaaacgtggataattaatgaaattgcaattgaaaaataaaattaaatttttatttttaattaaactcgcctcttttgcgtctccgtcccccaccaaaaagtgcacatccgaatgctcacccgtgctcaacaaatgcttcatccgatccattgacattagctctgaaatgaggcgcatttataaaagggataaaaataaaaatttaaaaaaaacgaattttagttttaccataatttttgatattttttgaaagccttttcaaattttgaaaaatcgttggccaaaaatttgctgaaacttccatattgtttaaaaaggtatttgccaaatttatggatctatgccaatttttccctctatttttatgagttttttccccggtggtgccggtcaaaaaaatgaaaaacaaaacaatgatttttttaaaagttgcgaaattattagcaatatttgttttatgaatattgttttcgttttgtttttgtgtttgtgtaggagtggagacagcgagaagtcagacagttcacatcgaaagcattaaaaataatcgatacacaacaaaaaaatttagaccgcagggggagggttagagggaaaattcagcaggtaaataaaacagagtttccatgttttttttcaaaataagacaaaatggctcaaaaactaaaattcggaccccaaaaataagatttttctaaaactaatagtagcgtgaaggaaacgcaataaaaacatgaaaaatcgacttaaaacaatattttattagcggaaaaaccagggctgccaactgaaaattttcaaaatcagcatttgccgacaaaaaatcagcattttgaaaaattttattcaaaatatgacaatttttggtcaatttttatgaaaaaataagttttggaaggcccggcggtgccgatagacgccgccggaggaaaaatagaaatgttgaccatttttaacaaaattttcactgaaatttagagcattttacactcaagaaaacgaaataaaaacgcaatttttttttcaaaatcgaattaattcaaatatttgcttccataaaaaatgatacatatataattcaaaacagttattcgtttttgtaattttattttcaaatccaagaataagcacaaaataaggaggtcgtgccaaataaaggacaaatcttagaaaaaaggactctgaaataagaagaatttttttattcaaaaaaacttcatttttataaactaacaaataaacagcaatcattaattattagggtttccttttttaggcacaaaaaatcgcaaaat

SEQ ID NO: 9796 - DNA, 4579 bp, Heterodera glycines
ttttcatttctgcgcatatgataatacatatgtgaagaaaaaagggctcaaaacttcgttctgcgctgcaattgttgttttggtgaaggttcttggtgcatatacatgcctctttcctccatgccctccgtatgtgtaccatagccgccctctcggggcagggagtgtcacgtaccctgcccgagcttgctgccgcctcacggctacgggcttggtttgcccgaaaaaaacagaaaacaatgacgatggagctgtgcatgttgatgggcgctgaacgtgtcgatgagtggtggccgggtgctggtggacgatttggtgatgtcagcacgtcgtcgtcgctgtgccgtcgtggtcgttgtgccgtcgtcgtcactgtgccatagttgtcgctgtttcctcgtcttcattgtgtcgtcgttgtcctcatggtcatgtagtcgtcatcctccttattttgtctaaaagtgaccaaatttttattttcatttacccttttgaatttattcgttttaatatttcttcggatagccgtatttttgtttgtttttttgtttttaatttatctttttttggatagctatcgaaaatagaaaaatgctcacaaaccaatattataaatcaattaatttgttattttaatcgcttttacaaaataaaatccattgatattggataagcaatcaaatcattgccaaagtctcaaaatttcttggacagatcgtattggaagttgggaccgaagttgacctcgaccgcggccaactgatcggccaatgtaacggttgggtaaaggtccgatgtttcctcgtcaacatacaaattggtgatgtcttaattaggtaattaggcaattagccagtttatgtaaattgccatcataaacacaaactcaagcgttgtccattcttcgtgaaaaaactacgatcattatttgtgtaatgttactcattaatgggggcggacacaacacaattaattggccgatgagttgggactgcaggccaatgatcaaaaaattcaccagcaggcgaacattttcacagttctacgaaggcatatttgtgctgaaaatgaaaggatttgagaaaagcatttcgccagtgttcagcacagctgccgctaattatagttaattaattaattatcagcccggcacagcgcctaatttgaaggtgtgtcagggggttcttggcttgtcattttagcatgtcaacaacccctgacacgccgatcaaattaggcgctgtgatcgtctgcctgctaattattaacgtcagctgttgctgcacatttgcgagatgtgctgctttcctcaatgttttcaattttcaataatataaagccataattaaacatcgttaaagcaacaactgctgcttgcctttgattactgctgctggtcagcgaccctatttaatgggcctttgagtgcggaaccgctcaatttgggcgccggcaaaatgatgcaaaatcagtgattgcccaaaatcattgcataaccctggggtgggggggtggactcatagtgctgcttgagaccgaagatttcctgagactcgagaccgagacctaaaaaaacccgagacttttctcgagtcgagaccgagactctcgagcagcactagcgactcagttccgtctgattgtgggccaaactttttcgggccataacttttttttagaatcagtcaaatttttacaaaatttgttgttatttgaaagttttaatatttagaatttcgtgtattgtgacaataaaatgtgctcgtatacaatgtttctggcgatgtgtctgctgttcgcagcggtgactttggcaacttcaaatggcagcgaagaaataattgccgacgcaaataacggagacttggcgatgactgtaagggttgttgttgatctttggctgagctttttttggccatggttattatccatattaaaaaacgacaaaattttgcttgtatacaaaatcaaaattggcggtaattgcccaattaaaatataattacaaaacacaaataaattttctttaatttaacatacctacataaatgttttgagtttaaacaaaaaaataaaaattttattttttattttttcaggctgtgaatgcaactcgtggaatgcgcttgaagagatatgcttcgtgcaacacccatttgagcttgtgcaaccagttcatgtgcaaccaatgctgcaatggatgtaacagttttggatgtttcggttttatgtgcagcgattgctgcgcataaaggggatcaaagccggcgggctcggaaatccgctgctgagcaacagagatgaaaacgcaatgacggattacagtgttttttggcccccctcctcataattatggactttacggattgtctccatctttaaaaaaatcgtccctaatttcggattacagtatttccgttcttgaaaacccaataataacaaatgacaccaaaaggtccataatttttggtgaatttaataaactccccctcgaccacccgcctccccgctcattgtcaactcaaaaaattcttgctaacatgcgaataattgcaattttcttgcacgaataaatttgttggcttcagtaagtaaggcttggaatatttgcataaaaaagagtaaaatatgaactaaacaccaaaatatgtgcgaaaaataaattttgccgattaattttttccgtcaaaaaacaaattttttttttcattttgattataaattattaatcaaaatttttcaccaaaagactgaaaaatatatgaaataaaataaaataattttaattatttaacttaaagatgggacataattcagaggtgtcacgaacaatgttcgaaatcggaacttcgggatcaaaaaatcagatttttgggtcaaaaactgtgttattttacaatttattcaatcaaaaaatcaaatattatttttcagattttttaagaaaaattaggagtttttggaaaaagtctttgctttatttggtgccatctttttgactggagaatatttcgcttaaatttgtctccattcgcttcgtgtaactcaaattatgataggaataacaaaaaacaaaaaactgatcgaaacgcattcgcccaatttgtttacccaaatgtaattaaaaaatcataaaaatttgaaattgagaattatgggagccaaaaatatttcaacgcttatttgttttaaaaaaattttcgagttttcatcacttccatttttttacaattttatgcaaattttagtccaccacattttttttcctaaagtgatcagagaaccgcaaacaattcattagggatactcaccggtacgggactaatttatcctcaaaatatattcaacgcttacaaatatgaaaggtgccgacagcgccgccggggatttttttttggaaatttgggtgcttttgttaacagattttgtctaaaagtgaccaaatttttattttcatttacccttttgaatttattcgttttaatatttcttcggatagccgtatttttgtttgtttttttgtttttaatttatctttttttggatagctatcgaaaatagaaaaatgctcacaaaccaatattataaatcaattaatttgttattttaatcgcttttacaaaataaaatccattgatattggagatcagctgctgctggtgtaaagacgtcatttgtcgaaccattcgaaattgacatttgaattttattaatgatttttttataaaaataatatttcaatttgattgaaaatttgaagcaaattatttgataatgcaatttgagtgcattagaggtcattaaacgaaactaattatatcagaaatgaggaggaggctaaatgatgacctgaccccaataaaaaggaaaagaacagacggaccaaaaaaaacgctgagatttatatattttagcttctgctcctttaaactttgtgctttcgaatgataccaaaaagataggatttgtattgtataaaaagcaggtattgtcaattgattggactcataaaatacctttggattcataaactcgataaaagtgccgaaaaacctttcatttaaaaatttctcacatttttttccttaaacgtcggttcattttgcggcaattaacagcacaattattgtcgtaagttgtgattgcgatgcgaaaaatgatgttaactaaactaaaaaaactttatttatgttgtgaaaaaataagcaaaaaggatcaaatatttattatttttccatttgatcgctacaaaatataatttttaataatgctcgcgagtttcggtctcaatctcgactcgataaaagtctcctatcagcgtgccggacctcaaaatctttttttaacactcttaaagacaattatgatttcaaaaaattaaggtgatgcgggaccgggacctggttgcggacaactgagtaccaaggtcccggttttgaccggggccggactagtcccggttttttcccggtttttcaaaacagactttcaccaaaaaagggcaaacttgcgatttttaaccatttcatgaatttcgttgacaaatattcataaaaaatatctataattttgaaaa

SEQ ID NO: 9797 - DNA, 3481 bp, Heterodera glycines
atttttttcaattcgctgaaggcagtgttactgtgtttgaaacggccaacaatatgacgagttttggccaataaactgctgattgattcatctctcttcaacgcctcctgtacagccaaattcaataaatgagcagcgcaaggtccgttcggcattggcaaaatgcgattttcgttttcatccctctcgacgaaagcctgcaaataaaaacaaatggaaagaaaaattaattaatttatcactcatttcatatttgctgcggaatccgatataatcgcatgcacattttctttaacaatgccccatttgagcagtaaatcctcaattttgagagcgatatttttccctgtatgtgattctgaaaattccgtaattgccaaaacacgtgacatatacttccattttgaaattgaatgcgcagttaagctgttattgaaccaatcataattaaaaagaaaaacacaaattgtaccacaaaaggttgcatgtgcttccactccaacaatcagttgtcagtgtaataaatgcggattcttttaattcatctttaattttctgtctgacacgttggtatacaattggcaaggcagtttttctgaaaaaattgaaaaattaattttatttaacttttaatgtaattcatcacctataaaaacattcactttttgatggggaaacaaagaatgaaaagtttggtcatccacagcgccgaagggaatggttttttgcaccaaaaaatgaagaattttcttatcaaacgaagagagttgtgctgaaaaaagatacaaactattaagctaattaaaaagaattacagtctgaaataggcggtctgctggaagactgaaagtctgagattgtcttctgtttttgttttgtccttttcggctttcgattcaagagaattcagcttttcagtgaattcggagttttcgtgaatggcgtgaagatgagtatgcaaagttttaactgttcctttggcaagctggtattcatatttgagctttccatttgcttgacattcaagacaaattgctgtagctttgacgtttttttaaataggccaatttgccaaataagactcattttcttaaaattaaaaagaactaaattatcatttcaataaagtagaatttttcgaatgaaatgaaaaatttaccagaaaattgacaaaaaaatatttataaacattatgccaaagagatttttgaaggaaaaagaacaaatttttgttaaatcataacccggtaaaacccggtcaaaaatgccgggttccgggccgggttgcattttcaaaaacgaccgggttccgggcccgacctctcaaaacccggtcaacccggttaacccggtcaacccggattttcccaaaaatcgccgggccgggttgccgggcccgggaaaacccggtaccgggcccggcccggttcggtctctactgaatagtgacgaaacgatcagtgacgaaatgatcggccactgttttcattgcaagtatgttttagtaccacattatcaatggcaatgaatatcaattacttaattaatgcattttcgatatttgattcgaactattgatcattttttatttcaacaatttgacaataacaaaccaagcaaaaaattcaagggtccatagaacaattgtgtgagacacctgcaagaaaattaataatagtatgtaggttgtaattatcaacgttgagacgatcgggatcaccaatattcaatagatggtaattgcgtgtcaatgtgagaattctacggtctgcttcgcgatatctttttgctttttgcggtggatcgaatccagcaaggcacttggacacttcggaatctcgtagcttctgttgtttctgcaatgtctcaatgaaacgccatactgatggatgagagcagtaaaagccctctgcagtcgcctgtgtgcggcctctgcgaaattgttcgtgcgatcttctccgttgatcgtccgagagtagacattccataattgggggaaaacattggtacgttcgagtcccgtcagcacgccgaacacgtccagtgtagtttgtggcgaacctataaatatgtcgacttcaatctataacaaaaaataatcaaaagagaattggtcgaagctcaggtaacagatgcatttccagtgcgattagagcgtacgttaagtctccgattggcataaatgtcattgatgtgatccagcgtgactgagttgcgaaaattggatcagtttgataacgataaaaacatattgattattaaatcacattcattcgtgagagacctgcgaaagattattttctgtgagttttttcttcatatttttcactagatgaaataaacatccacgagtttcggcttccggaaaattgttacgaattgaattgattgcagccatctcaaagtcgactgaaaacgtccggggtgaaaattcaggccaggcttcttttagtacggcccacatcctggaatacgtcccctcacttttgttcgtaagtagtgcatatacaacgtggaaagacccatcgttctctacgccgaaataagtgcgataatttattaagtttgacggaatactgctaactccaacttgccaaaacagcgtaaacttggtaaaacaacggtggagcaatgacgaacgtgccgtgccatctacgaaaacatcagtaatttgtgccgcccattcactgtgtgacgctctcccaaaaataagaatcctataaacaattgtgcacaccgattgcctaaaaattgacatatttaacattattattgaatagttgcacctccaaaacattgtcattcatatctgtgtgcaaacgacttttgcatttgatgtctttggttccgaaaaattcacatttccagaacttgacgtcaccgcgtgcgtttggtttttcgaagacatacaaaaaaccttcatgcaataatttttttcttccacgctttgttaggatttcagtagccataaaagttgacaaaaaacaaattagatacctgcttaaacatactggcaatgaaaccgctggcaaaatgaaacagcggcaatgaaactgcggcaatgaaccctcccctaccggaagaatataatatttgataactagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcgttttggcgttttcggataaatattttcgtcttttttttgcgaccttttcttttttttt

SEQ ID NO: 9798 - DNA, 1893 bp, Heterodera glycines
ttgcgaacatttctttttttttaatgagaattttttccaaatttggaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgctttttttagtccatataatttacaaccctattgataactagggactccatttttaggcacaaaaaatcgcgaaataggcacctaaaaaggcagaaaaaaccgcaaaataggcactaaataggcacaaaaatcctcaaataggcaaataaaatttttattaacgcttattaggtagcaaaaaatataaaaattttcaattataaatgaaattattaaatattttaaagtttttatcgaaaagaacaaaattttaaaccaaaaatttttattaagaaaaaaatattaaatttttgtggatcaatttttgtgaaaatttttcaattcttagaggtgtattttttgaaaaatttttcgggtcattttttaggggtgtgttttccgtttttattgcatttttgttaaggattttttcaaaaaatctaaaataggcacattaggcacaaaaaccccgaaataggcaaaaatagcattataaaagtcatcgtagacaccgcaccgcaaaccaagtggaaaatgcgttttttgtgcttatctgtgcgtattaagtgcgcaaaaattttaggcatttgcctaaaaattgagtccctattgataacactttgattgaataaattgtaaataacataattttgcaaaatgttctgtttttgactcctaaatacagcgagtcaattttagactcctaatgtaataagtagggttataaattatatggattaacatatttttctgcgcatatgctatgaagaaaggggctcaaaaatagcatttcaacgttaaaattttggtacttccgggttttaccacccccctgaaattttttttctaataatttttatgtcaaaacttctaatttttctagtttcgcatttttggttcaaaaccggcttaaatataaggaaacaagctaaaagcaatcaataatgagcttttacgaaatattgttgccttatgccaaccattaaaatttttgttttcaaattttgaactttttgcacctaaaatttcacgtaactcacgtaaaatacgatgtagctaaaattaaacgtcagattctggcccaggcccatcctttcttcactttttcccctcattgccttaagcaaattggaccaaaagtgttgagaagggcaaaaaagatttcatccaattccccaacccatttccaacgcattttgtcagctaatacattaagcatatttaaaatgggagggggacggaggagtcccgaatttcttggcatattatggggaagtgaatgatgagagaatggcaaaatccaagcaaagaaaaactattggaaacagattaaagagaaggacaactctcattaatttaaagaaagtaagatcttttcagctaattattaaaaatctttgagtttttgattactagggttgtaaattatatggattaacatattttttctgcgcatataaatcaatattttgggtgttttcgggaataaatccatatttagacatttttgcgtttttagtccatattttggccatttttggcaaattttcacaagaaaaatgcaaaaaaagtgaaaaatacaccctaaagatcgatctttttg

SEQ ID NO: 9799 - DNA, 1703 bp, Heterodera glycines
tgatgccaagaaagatcgggttgggccagcaggattgttggaagaggtcccgacgcctttctgtgtctgcgttgccgtgccgccacctgtgcttaacaagccacggtttgtgcccttgttatccttcgacggcatttcaaattgtgaggagtcgtcctgctcgcgcactgtgctgtcggcatctgttccatcatttgctcgttcgagatcgtcgattcggtcaaccaatgtttcaatttgggccttgactatctcaaaatttgagttggcatttgagacaacctccgagacccattttgtctttttgtccatgcaacggttaagagccctaatggaacggttcattccgtcttccaatttgaccaattcgttatgggcggcctctaagtcagagactttcactgccgtctttcccgaccaaaatttcctattaatgaccgaaattgtcatttcactcatctcctcctcatttctcaactcatatactgtattgtgcccgcaggcggaagtggtgcgacgaacccctttagggttgtcgggaatatccattgctttagttgggaagagagtacaattacttgttttcgattgcttaacaacaaaaaaaaaatatattcgtttctaattgaaaatgtggtaaatcataaaatgaatggccaataaaaacagtggaaaaatttccgcgaatgtcgctctattttaatgaatgtgtaatgaacatcgccaatgttctcacgtaaattatgtgaactgatcgcatctccgctaaatgaagagcgctgccgcggcctccgttctcacggccaagtaatgaatggcgaataacaagaaaatttttcgcaatctttgaactttgaaatgggcactaattggacgaacattgaactcattaaaaataactcaaaaaatcattgaaatttaatttggccgtaatgtaaattaataaacatccgctagtatttaattcatagagcacttatttcacaattttctgaattatcatgtttctctaatgacgcattttgaactttggcacactgctcataagttatgtaaattttctgctgattaactcaaattaaaattctgatcattagcacttttaaagtatttgtaaattgttctttatcttcaacttaaattcaaattctgatcagtctcatttaaaagtgatcactaagcgcttgactgtattgtgcccgcaggcgggtaccctaaacattctctcctccggcgccattactttgcccgcaggcactgcagctgctgtcgtcgtcgatcactcctcattgtcgtcgtcgatgaaccgtttgccggaatggcaaaacaaaccatccggtgctaccagtgagggaggcgcgtgggtcccccagacgactcaccgcttccgaataaatggggaggacgatttgggaggatggatcccgggccctgggatcgatgttaaatcccccaaattgcctcgatgttaaaagactaatttattctccggataaaatatatgatcgaaatattccatggacggacgatatgagaaaaagtgaattaattgatcgatggtaaaatccgatgactccgacgactaactgatcgctggggaaaggaaaagtgtgaagggaacggaaaaggggcggggatgaaagagataagaaaagcgataatggaaagtggaaagtccgactgctgagggaaaatgaaaattg

SEQ ID NO: 9800 - DNA, 2190 bp, Heterodera glycines
  misc_feature (2143)..(2144): n is a, c, g, or t
aaaaaatggggtgagaaaggacagtacaaagtacctgcttttcaatgaaaatgaaaaaacaaggggaaaatgaataaaaaaggaaaaaaagagtggaaaataaaaatattttaaagagggaaagcaaaaataattaaaatttggaaaaaaaaagcggaaaattaataaaaataatttttaaatttgagaaaaacagaatgccaagatgtgaaaataattttttaatttgagaaaacagaacgccaataatttagataaattttaaatttgaaaaaaacagaatgccaagaattgaaataaattttaaatttgaaaaacagaacgccaagattttaaataattttttaatttgagaaaacagaacgccaagaatttaaataatttttaaatttaaaaaacagaacgccaagattttaaatttaaaaaacagaacgccaagattttaaataatttttaaatttgagaaaacagaacgccaagaatttaaataatttttaaatttaaaaaacagaacgccaagattttaaatttaaaaaacagaacgccaaaattttaaataatttttaaatttgaaaaaacagaacgccataatttaattttgaaaaaaaagaatgccaagaatttaaatattttttaaatgagaaaatggggaaaacaaatgcaagaaattggcaagaaataaatagggaaatttggcacaaaaatgtgcaaaaatttggtaagaaataaataggaaaatttggcacaaaaatgtgtaaaaattggcaaaagatagtgttaaaaattgtggcaaaataatgccaaaaattggcaagaaataaataggaaaatttggcacaaaaatgtgcaaaaatttggtaagaaataaatagggaaatttggcacaaaaatgtgtaaaaattggcaaaatccaggtttaaaaatttgggcaaaacaataccaaaaattggcaagaaataaattgggaaataagggggcaaaacaatgccaaaaaattgcggcaaaatggcacaaaaaacgttaccataataatgccaatctggcacataaataataaatggcaaaaagtaatgggtaaatgggtaaacaaatgccaaagaaggaaaaaattaaggcataaataaatgataagggattattgattggcttttccttccgtaaagtgaattaaattaaatgaaaatgaccaaatggacaaaaaatgagttagaccataaatttcgacttttatataccttcccccatcccatgcccattaccccgtctttattcactacaggtattttctccatattataaaatggtccctcatgtttgtcgtttgagtgatggaccaagccaactaaaagtaggacattgctcgagaacggaaaacattatgtatgatatcactccagcgtcattcttatttgtttttcctctcttttctacctttttttcttaatttagcaatggcacgacaaatgagccttcctctgtttaaacgcaccaaaccgactgtaagcattttcacgttggccaggtacataatattttaatatttttttcaacctttagttttttttaatatttcagttgattctttttgaaaccaaacattcagcaacggggatttggtgtgccgttttgctgatgatgttttttctagtgtggttcctctggtgagtttaagcattcattttatttaaacattttctatttattttattttaaagatggccaatggaacggatgtaccctggcacttcgtcaatgaaacgaaggacggatgaggatggtaaacaaaaattttgataaattatccgccaatttatcttctgcttatcgataataaataaataaagaaattttccatatttatgaaaattaaaatacaaaatttttatataaaattttgaagtaaataaattttaaatgaattattgtttggactcgtttctaataaaataactaattttttaccccaaaatattttattgatcagagaaaaaattaaaataaaatttgaaagccttttgctccattctaccgcccattcatttacattggacatctgcagcacaatcggtccgtgtccacagctttgtccattcgattgtcctccgatcaaattgccatccttttcttgctttgtccacaattnntttggccgtgttccacctcacccccccccccgtccccaattccccc

SEQ ID NO: 9801 - DNA, 2193 bp, Heterodera glycines
  misc_feature (69)..(69): n is a, c, g, or t
tcaaattgccatccttttcttgctttgtcacaattctttgggcgttgtccacctcacccccccccccgnccccaattccttcttacaaccctttcacatataagttgctgttttctgttttgcatttttccagtgaataagagacagtgcagaaaacggagattagtaagaccaacacattattcgagacacagcgcgagaagagaaagagagaaggagagagattgcttgcatttactccactccttcatctcttgccactcccccacccatcaagtacacagcaaagaaagggggatgggtttagcgcaagggaaaggcaaaatgaaatgaagtgaagagataagtcctaacaaaaaatagcaaaaaaaattttttaccgcacaaaccccgaccccgaacaaacaccggtaatgcacgaaaacacatgttttcacgccccgggaaaacaccggcaaggtgtgaaaacacatgttttcacaaacacatgttttcacaccggacaaacaccggaaaccgaccggtctttaactactaacatcataccttactatttgttagtgtgcaagtccatttagcaaaatggtaatgaattcacataacaaacccgggattaggctagcctcccaacgagtcatcccgaaactccaggacattctgggcccgtttttagtaaggcaattggaaaatgaagccatgagaacaaaccctaggccacacgagcaattgaagaaaattttaaaatgaaacattaatgtttttttctaaaatgttcccttttttccggtttctataaataattttgacccagacccaccatttttgtttttagaaccggactaactaggtcggttccagttttggatttttttaaaaacatgtccgggtattgaaaaagtcgcgtctatcaatgtctgggtccgatggggtacccggaaccgtgcgacaaaccaggatttttatttgaacagggtcctaaaatcttctaaatcattttttgctcaaagcaataacagtctctattatttaggcgaaaattggggtggaaggccggatttgaaccgccgctcggggccccttacgtggatccgttgtcttagccactaaaccacatccaccactggagggatggggccatctttcattcattttggtccctgttgcttttgctcctacagcctttttctgctcccgcagctattttcgatcagccattacagtctctaacaaattttcaaaaattccgactgtgccttcggaaccagcggcatctcttttaggcaaaaaatcatttttttaaaattcgaattgatgacgtgtaaaattttctttacccattatatttctcaatataatattgataaatcaattaaatttattttatccacgaaaaatgatcatttttaggtgatacaattttaaggatataagaaaagaaaattgaaaacattttatgatgaaaaatgatcattttttcttaaattcgttctcaaatttcttttttatattagtatttttagttattttacaaaatttctctatttaatggaaaaaatataacctaatccaatattgctaatataaaaagtgaaaaaaattttacaaactgtgagcataaataagctgatttcattattttacaaaattatttttaataaaaaataattgatttctttgcgcttcattcctgcattaggagaagtatttcatttttccgcgctcatttttaaacttttcatcaatgtgcctcaggaacagtcagctaaggacaactcggagatggccaattcagccgatggacaaccaaagttagtattttaaatttttttaaactattttaaagggaattttcaattttttccagccgagtcgtctcctctgccgaattgccctcagctgacaggtcctgacggtgctatgacgttactcaacaccatcaaaatgggcgttactcaaaaaccatcaaataaatttttttgatataactttgctcagaggcaaccaaattttttattcgtgatttcattcgatagccttaagtgttttctattatcttgcaaaatttgaaaaaaaattcattaacaagtaagtttaaataaagttatgaccaaaaatgctcaagaaagcttgcttttttgagtttctcaggtcataacttttttgaaacttgatgaattttttgaaattttgcat

SEQ ID NO: 9802 - DNA, 1485 bp, Heterodera glycines
  misc_feature (1418)..(1418): n is a, c, g, or t
ttcaaagggtcagtcggcttttggggagcgtcatttttgccccttcggaatgcattttgcctacgccacgcaacaatgcacggccaattctcttccggccgaagtgatcagagacagcaacgaattgttccaaattggtaaggcatacatcgatagtttcagtggagtttatgcttggtctggttaagcaattcttaatgggtcgtgtgccaacggggaacggtgcattgggggtacggtatgcgaccggacggaaaggcgttgcctttgtccgtttgggacaatggccgtgttggagaatttattttgcgcggcaattccaacagttaaacagccgcagaaggaagtgagtgcctaaaaagtataaaatgcaaaggaaaagccacggcttaaaagtcaaggtgtccgtcccttttcaggcaaatcattggcacggccaatggcagcagaaaatgctcgccaattccctttttcaactgcgaacggcacaaaatggagacgaaattgggaaaaacaatgctcaaaaaacaaaagaatttgagaggaccaccgaagagaaattcaaaaaaggttttgaaaaagcagcgaataacagagtgaagcattctgattggtttaagcgtcgcttggcgaaaaatgcaacgatttcctcggagaattttgtgccgaccaaaatgcccgctgtgaagagagccgttgtcgttgtgttgtgccaatggttgaacagaatgggaagtgccaacaactgactataaaagaagcaggtgagaagagacggggggagaaatgccaaaaaatattaatcaaaacaaaaaagggcctggcgaactgtgcaacggagggcaacaatgtgctgggggaacaaaatgccatccgaaaacggccatttgtgtgtgcagcggggacaccgaactaaaaaaagggcggtgtgagcggagaggagaagcggaggaaagcgatgccgaaaaagggagggctaacgaagaaaccgcgaaaggagggcaagcagaagcagaaacagacccaacaccaccagcagagatggtcagtggggggcagggcaattcatttgcaaaaaacaaacggcgcattgactcatccccaaaaaacatttgaatttatttttttactttttgcaataattcctaaattcatctttctgttttttctgcctcatttggttcgtttccatttttaaaggtgccaacttcttccgctgaagggaaatcgccaaagggcagcagaaaaaagacgaaaaaggcatcagtgggagagaaatgttcacttaacgccgaatgtttggtgggccatcggaagaaagtttaatttaccaccgtagtccgaatttcacagagcggggcatactgtaacgggaatacgcaaccgccgacttgtcaatgtctgtccactcatgtganagtaaacgacagatgcgagaaaggtaaacggaaagtgacgatggcgaacattatctaatttacagtc

SEQ ID NO: 9803 - DNA, 7311 bp, Heterodera glycines
  misc_feature (76)..(76): n is a, c, g, or t
taaagtatttgtcacgctttcccttctgaagcactttcccggcaaacacgtgccgaccttacgcaccatcggttcncaatgcaccgaaagtgccgatcgatgtgtgggcggttccgtctgtcgcaattcgacttgcatttgcgccgatggttcacttcccaatgcggagaaaatgctctgccgacagagccccggaggcatatgttcccatggccaaatatgctcagggcaatcggaatgcagactcggcacatgccattgtcgtacgggaatgagattggcactgcaagaagacggcaaaaggcgcaaatgcactccaacattggcattaccaagaaaaagctgccgaaagggagaaagatgtatctcaaaaagcatcgatggaagcaggaaactgatgggcccagggaagggagacgatgaaaactggccgaaaaggaggagccgtcgaagggagggacaacgcgggagaaagtcgaagccgggcgaaaggttggaccatttgcgaagataatactcaaaagtcaaactcagctgtgccgaggacgaattgtgcacgggcggctcattttgtggcgaaaactctatttgtatgtgcgccccgggggaaagcgttcaaatagaaaacggaaaagcgaagaaatgcatgttgcaattggaggaaaaggcgcgggacagcagccaaccggtcaaggcggagccgggccaactttgcgtggagggcggcatggaatgttccggaggggccaagtgccagaatggcatttgcagttgccctgagggtacgtctgcttttggcacgaccattggccattcatctgtcgtcccgttgccttttctatcctccctttttttcttcaggccacactctcttccgcaatgagtgccttccgcctcgggcattgccaataagcattgagaaaattcacactcattctgccctttttgcgccccaatcagcagtgatggacagtccatcttcagtcggcacaaatttcgaccccaatttacaggatccaatcccatccaaaaccgtttcgcccggggcaatgtgtcggttggtatttagtctgccgatgtttcacgtttattttcctccctttttgtctgtcattggagtgtccctatcgtacggaatgtgtccgtggcgtgtgccgttgtcagaaggatgaaaccatcgtaaatggaatgtgtcggaagaccatacacgaggtaatgggcaaatccattcactaccaacatcgatcactgctgatcggtcaccctcgccaccaggtgttgcccggggcgagatgcgacactcaaaaagggttggactgtgtgggcgagtcgcactgcttctacggcatttgcgtgtgtctgtacggcttggtgaacatcggcaacgaatgtgccaatgcgaacgtattggagaaagtggcacccggcaaaaggtgtctgccagggcagcattgcctgggcatgtcaaagtgtgtaaagagcaaatgccaatgcgaaaagtgagcataatgccgccataaccttatgaacggttcaactcccaggggacaaaagttagactcgaaattgcgccggtgcatcaaagtggcaaatgcagcaactgttacaacgccattgttggcatttccttcgggagcggaagtggtcgtagggccaacgtcaatcgtcgaaattcctctgggcaattcggcggatggcatttcgcaaagcgatggcgcgagagaaaggccgaccaaattcatttacgccatccctgcagctttagcagcagcggctgaggaggggaaattccaacagattttgacggctaatcaaatgtcaataaatttgatggacggcgaaatgcgatcactgatcagtaaactgatcgaacagcaaaagcagagcaatgaaacggttgtgaagagacaaaacatttgtggcggagaaaggtcggcggaagggcgacgaacggaggaaaggcccagttttggtttcatttcagtggtccaacaaattgtcagcattttcctccaattgtcacttcaaagcttccattcagtaaaccaatccagcaacaattcttccaatccgtccctaaatcggcttcatcccttcaaaatcccttccaatccatccaattggccgcttctttcaattcgccacaccttcaaggccagcctggctttttttgtgctgctggcaatgtttgctatggcggtgccatttgcttagctaacctttgcatttgccggcccgggttcagacccattgatgggttctgccaaattgccaaggttaatttgggcgaacagtgctttctggacgaacaatgcaaggcgaatggcttttgcatcgatggggtaagcttcacaatcgcttgtcattcggtgcctttctccgctttctgttatgccattgccgtgcccaattcggtgccatgcgtcgcactttccttcgcaatgttttccatcggcaccgttgcccaacgcggcccgtcgctgccgtgggcgaagactgttccaaagcgcaagcgtgcggatggaactcaatctgcggaacattcagtggagtgtgcgaatgtgcaattggcatggaaagtgatcaggtggggacaaccggcactttggaggtgcgaaagggcatccaaatgatcactaattaccgcaattagcgaggacgctcactcccctttagggcgcgtgtgtcgttgctcgccgtcctcgaggaaccgaatgtatgaacaaatggcgaaacaaaatgtttcaggtctttaggccttagcagttccgactgccacaaatttgccttctgcgacaacggattctgctcgtgcaaaattggctttgaacgtatcgccggtttttgtctgccgcccgctcgccccgtcgtcgacgacccaaaagcgtactttgacccggaaaagatgaacaaaaatgccaaccatttggacgtggaaaaggacaactcagaaggccaattttggccgagcaagcgaatttcgccaatcgaagttttccaagcggagaatcgacgggaaaaggctggcggaagttggacggatgagcagagaatggacgactcgccgaatttgggagacaatggacggaactcggcagaaactgcttttgccaatgccgagaatgcttctccatttccgtcccaacaaagcaaaaccttcgctttttcccgccactttccctttgccaattcccaacttcgctttgtttcctcagaaggaaatgagtttttgtcgccaaattcaaaaggacaatttcaacaattaatgcttcttcctccaacaattggtgcttctttccaacattttcctgcgcattcgaaaggaaaaaaagcgacggaaaaagcgaaaagaaaaagcgcaaaagataaagccaaggagaagcagaaaagtggcaaacagaagcaaaacggggggaacgaagtggcgaagccgggcgaatattgcggcactaacgaaaagcaatgcgcaggcaattcgaagtgtttgagtgggtggtgccaatgcggggagggagcccacgttcagacagagggaatgtgcgtggaagagccgggaaaatcgctggtaggctcatgaaccgttcttgaagggcattccctgtcctctgtccttgagaaggaatgtccggttctgtctttgaatgggttatcctgttctgctagggctgtcctgcccatcgtctttttcctcctccgcttccgttcagcgtttgccctccgcttcttccgagttgctcccccataagcttcacctccccttcgactcgtgcttctcaaatagaccttgcatccacggcgcctcttgtgtccgatcagctgccctgcttttcgttcaaaagttgggtatgcttttcctttgcttttattttgtccccgtcccattgactcatttcctcccccaaaggtcccttctgtcaatgcaatcctggactcgttttcctgcataaccaatgcattccccgtcgtcccgagcttaaagttgccaaggtttgtccgtgcaaccataaaaaaacattttgcaaatttagcccggcgagcggtgccgtcccccctcagtcatttgcgattttggcgcaatttgtggcgaagaaagcatttgcaaatgtcctgcgcatcggaaattactcagttagctttacataaatgcaaagttaaaaagcattgttcgttttttcagccggcctttgcgtccgtttggcattgcccggcgagtcgtgcgcaaacggcgaattttgtgccgacgcggcgatttgtgctcctggactaaatgcatgtgtatgccaagtgggatggaacgtacggaatgggaaatgccaaaagggagagacattgaggaaattgatgaccgaagggggagagacttggaatgggcagagagaaggccaaattaggcccaagtcacacatggcatcatcggtggccaaactgtcgcttctgctgtacgggcaggtacttaggcattcgagctgagttggacagattggccaattcagcactgccaattcgactcagactgtgcccaccttcgcaacgcccattgtgcgcctgtcacacggaaatgcgcctgtgaagacggcttttcccagttgtattcgtccatttgtgttcctgagaacaaaatcaaactgccgggcgatgagtgcctttcggtaattcgaattttggcaaattaaacaatgaaaaacaatgccttgcgcagagtgcccacttttgtggtgggaagtcgtggtgcaaaaacggacgatgtgcttgcattgggagggactctcaagctgtggaagggcgatgtgtgcgcaaagcgagcaaaaagaggacaattcggagaaatcccccgaggggacagtcaatggcaaaggcattggactgctcaaaggacgggaaaagtgagttgttttggagaacttcatggaaaagtacaaaagcagataatgggacaaagggacaatgcgccacggagagggaatgccccgaggggacgcattgcgcgcgggagaaatgccattgccgggaagaagccgaaaggggagcgaaattggcttatggagtgacttcgaaattggcaccaaagcaggcaaaatgagaaaaagggaggaaaatgaaaaaatgatttaaaagcaggagaagaaagagcagaaaatggagaggaggaggagaaaagaagggaccgaagcagaagttggagaggaagaagcagaaggagaagcggatttggaaagggattacgcgttgggagagccaaagtcggtggcggcgcccaaaacggaggccatcgtcggcggagcggcactcatcaccgccgccgccaacagcagcgcaatgccatgccatttttgccgggcactttttgtgactcgtttagtcagtgcggagaaggggccgaatgctttttcggcaaatgccagtgcatttttctaggccagcgattggcatttttgaacggagttacaaaatgtgtggcagaggaagagaaaaaagggaaaggagcagagaaaaagacggagagacgaaagagaggtgaaatgattggagagacagaagtaaatgagacagcagattaattaagaattttggggagggcatttagggagtgggaaaggaaagacaaaagaattcactaattgtcagaggaaaagcattcgatcagaaagtaaaagctttcgattagaaagggaaaagctttcgattagaaagggaaaagcattcgatcagaaagtaaaagctttcgatcagaaaaggaaaagctgcactccgtccgaaattttgcactttttaactttttgcggtgtttttgtatttcttcacatttttcaatttctttcactttaactaacctttttacctctgaatttgtccttttattctcaaattctcatcccaaatttttcttcccaacagatggaaaatcggacgcaaattgtacgaattgttctgtgcttcccaataaaagttcgaccagtgaattacagcgaaaagttcttttggatattaaataattattttcgttgttaattttagccaaatggaccattcgctaagctttaccatcaaaaaaattcaaaaggaagcaaaacgtccattcccggcgaattgtgtggtaaattttttcattttgcattgttttcttttgacattgaatccaacaaatccaaaaattggccttaactgatctctcatccattcgcttggcattggcactttcacaggaccatttgattcttgcgccggtggttcgtcgtgcgtggagggcttttgcttgtgtccggccggcactcgtccgtcccccgtgagcggcaactgcgaaacttttgcgcaacaacgcaaaatgacaaaaacactggcggaagggagggaaagcggaagaaatggcacggagacagagaaaggcacagcaccaaaagcaattggtaagtgttgagaatgagaagaagatgaagaggggggggggggggatgggagatcattaacggatagccaaaaacaactcattaactaataacagcggagagacggactaaccaaacaccgaacgaaccgacaaatgtgccaactgctgatccgctcaaaaacgtatcaaagtctgaaccgacaccaaatgtgccaattgctgctgacccccgcagcccattaaccgatgtccgttcactgcgaatattcaaccaaaatttaacggggagagaaacggtttctcacgcatgcaatgttgattttgtataaataactcttctcattactaataaagcgcatactgtcaacggatgccaaaatgattgggaatatcgttccaaattcacttcaaaatgccacagaaataaatgtcaaaggtaaacgagacggatggacggactaatggcactaacaaacatttggagggaggacgaaatgggcaaaagaagaaagcaatcagcaaaaaagagaaatgccgaattcattttctaatcgaaaggctttagaaagagcttatgcccgtccatccgaaagctgttccaacggtgaaatatgcaccgggggctcaatatgtgatcagaaaaataaggtagcaccagttaagttttaagtaaaatcagcgattgagatttgcgagtgcccttccgccaaacgcatgctgcgaaaccacatttgcatccgatccaacgaattgccaatgatcgaagcgaaggtcgtaaaaccgggcgaattgtgtgactccgagacaaaatgtgtgggaaattcggtgtaagtacaaaaggcgatcaaagcgattgcatttacatgcagcaaattcacaaattcagctgtgtcgaagggtcttgccactgtcggaagagagggctc

SEQ ID NO: 9804 - DNA, 3616 bp, Heterodera glycines
  misc_feature (3575)..(3575): n is a, c, g, or t
ttttaatttaaaaatttttgtagtaatctttatatatatatttttttgacatatctatatgatttatttaagataacttttttttattaatgaatccaaaaataaaaccctcttaagaatcagcaaaaagttattctcagtaattgaataaattaaaataatacaaaaacaaaaattagtaattataagataaattttaaattgcaaaaaacataattattttataaagtttataagtaaaaatatagggcaaaaagcaacaattaataatccaaaataaatatttttaaaagattgtcgattcttctaaatattctttggtttatagtagggttccaccccgacccctcgtggggcaaaatgtcgggggtcggggaccccgatcgggtagtgatcaacgaaattttttaacgaaaaaagcaaattttcttttaaattctcataaataaagttttcaaaagtcaaaaatcgtctttttcttcactttcattatctgattcaaaaattttagtgaaaaaattcttagtgtttgggtaaaatgtaaatattattgaaataactctttaaatttttacaaggctcgcagtcctaaatcccccgaattagtgtcggggggtcggggggcaaaaagtcgggggccggggacctcggggggcgacatgtcgggggtcgtgtcgtaaatattttaaaagattgcctattctttctaatattctttggtttatagataacaaaaagaataataaaattttaaataagattagtttattttcttcttccaaaaaagtgctataattacttttgaaatttaataaaatcgagaaaaaaaaatgtaaaatatttcattaatttataaaaatccaccatttatatatcccaccaaaatattggagaaattcaaaatttaaaatgaattagaacctaagtaaaacaaagctgcgaagtacacttttaaattatgcaaaataaataaaagcaattatacttaatgtgttacacaaaataagccttaaatgcaaatatagactttctctccggtgttatgggaattttattttgatttcacttaaatcgtgtataataaatatttataaactatttcttttactaataattaaaaccaacctaaaaaattcttttattttaaaaatataattttgtatcatttaataaaaataaattgattattgaaatttaaagttattcttaaacattattcatttttctttttatttgaatttagttaattttttttaaattaaatccgttatatatttgttattatttttttctttccgcaatccaaaaattattattattattcaattgccaattatattaaaataataagagtaataataattataaataattgcagttgaaaataacatttaatgcttcgcatcaattctagcataaatgcaataaaatgtctatttttaatttgtttattttttaggttttcacttggcgaatgctaaatttttcacttggtttgatgtcgacggtttctaatgacatgtattttttaattagcaattttctatcgtaataattttaaaatatttgttaaaatttaggtatgataaatataataacattatgattttaaattattaatttaatgcaaattcagatagattatttattagtattttttccaataaaaattttttaataaataaaaattactccattcattagtatttgtatttttttatcttttttataaacatttttattcaaaataaaaaatctttttttaaaaatacaataataaatattagcgactaatttaataaaaacagtctgcaataaaatgaagaatttgcttatgaaatttctttttttttccaaatatttattgctttaattacctttaaatgttttatttatttctattattcttagcaaaagtttgttaattctgaatgataattaattcttcaattttaaactgggttcatatatttaaaacatttacatttataaattttctctgctgaatattctgtctttttagctgacatgaaagataaagaacaaagataaacaataatttcaattttatattttaattttaatataaaaaaacaacttattattctttgattattaatcatttaattcaaatcttccaaattcatagagttttcttacttaaatatttacaaatagttttttatcgttatgaataaattatatggcctttaattttctaatatatttaaaaaatcattaatttttgtttattgtcatcatatgtataatgataaatatttaatctatttttgtaatattctttatttaataatgctttatgaaataatataaataaaaataatatttatttataattaaaaaaagatgttttgtaaatttcttatattattgagttcacaaattattttttattaattatattttatttttcaaaaatacattaataatattaattttttcaaacggtcttaaaaataaccgaatgttttctttcacgtttcaagcagttaaattaaatttttgtgtagcacatctcttttatgagatgccttaactattttgttttacttattgtaaaatataatttaatgaataacgctaaaataatttatcattaaattttattaatttttcaagccataattttattttaatcattttataatttagttttcttattcttaataagtaaataaaataaaagctaatttttaaagaaaaggtatatatttttcttttttgtcctcgctttattgggaagaattgatacatagattattaggaaaaaacattaataaattgtctttatttgctaattatataattagtagaatataatcaatcaaactcagtttttttttaaaaggatatagttaatttttcgaattttttaaatctattatttctatattatatatcttagattattattgcattatataattattattttcatttttttcgatatagtgaaattcttcctatatcaaaaactttaatataaattttaaaatttgtcctatcaaatttaagaacatttttagaattacaattttaacaaaatttaatcttattaatatttatttatttatgcaatttctttattatttatttactttatttttgtaaaaatttattagcaattattgatattaaccatatttctcttacggacgctggaaattttctctactttcatagcgttacgtcattttttttttaaatattttgtttttttgctttaggcattttcattgataagtaattaattattgattaataagtataattaaaatcatcgataatcaatatacgtttgaaaaaataaataatattagaaattttcaaataaaattctctatttttcactatttggcgtcgcatattttaacatgtaaaatcattacatggtttattgttaattaatgtaaatgtaaatatttggttaaatattgctagttaaatatttaatttttaaaatcattttcattagaaccaattttatgtgcacttttgaaattttcatttgtcggttttcattttcactgaattttatactgaaagtcaattanaatacaattaagtcaaaatgaatttatatattcgatagtcc

SEQ ID NO: 9805 - DNA, 939 bp, Heterodera glycines
  misc_feature (121)..(121): n is a, c, g, or t
attttatctctccgatagggctcctcccatcccgaggggcgcttaaaaggcaacggataaccagccaaagggacaatcggagttcagtcgggagtcattcagtggaatggctaatcgatcnccgcctgggaggtacccccaggcatccatcaacatcccttcccttccaagccctgcggggcctaattacggacgcgtaagagggctcctctggactatttccctcataagcactgggtatgggacatcacggctttactggtagcaccggatggttccaaccctatgcttacagggcttgggccatgggaagagggggattcgagtggtagaccgacttttcaggggatgtctttgtgttgcgcaagtcgccaatcaattttagagtcctgatcaggccccagcaaccccctgggaatcaaaaaaaaaatccaaaattatcccacgcgtggttcgataatgtttcacagacaaaatgaaaaatatactcaagcatggttcgaattatctgcagcagcagtcaaaaaaaaaatcaaaattccatgcatggttttcgaaaattccaattaaaaaaaaatgttaaaaattgtccatgcatggtttcaaaaaaaaatgaacttcaaaaatacccatgcttggtttcggaaattttacagttcaaaaaaaaatcccatacgtggttcaaaaatcattacagtcaaaaaaaaaggggaatttaattaaccccggtaacggaaaaaagagaaaattacgggtgaaaatcattattaggggccctaaaaatgagggtgaatttaattaaccccacggggtctaaaaaataaatgtgttttgctcttttcgcagaaaattaaaatctgctcaattttaacggaattctattaaccctgaggggatcaattaatttgaaatgcgataattataaataaataactaaat

SEQ ID NO: 9806 - DNA, 2002 bp, Heterodera glycines
cagaatccaggttgaaactcgttccagtccggtatttcccttgtttttcaggttttccctaatgaccggtcactctctctctcgtaataaatcaaatgaaaaatgtccatcaattgttgacaaatcaaaccccataaataagtattgaaaatgctcaaattagcaattttccaaaatctgacaaaaaaactttctagtaaggctgtgatttctagacattttgtctgcgaattttaaatcccaggcattataaagcccatcttggactgaacgccgatttgaccctggaagttttgcatttagcaaatcccagcctttctcattagtagggctgggatttttagggttttacctatttttttgcggcttagttatgatgagagaagcccaaaaatagcagtttctcctaacaattttcgatttagagcgactttttagcacctaaaaacacctattttggcgttttggcacctaaaatagtttacaacctattttggcatttttcgaatttttagcacctattttggcatttttgagaaaaattcttaaggaaaatacaaaaaattgaaaaatagacccctaaatttcgactttctttccacttcttacagcatttccttatttctttattaatttgaatgccgaaagaggccaaatcaaacgctgcattaagcacaaagtttgacaaagtcatcgaaaacaatccgggactttacaaattgattgatatcgccaaaattttgactggcggtcgggcggatgttgatatggaaccggacgtattggcatctatgaaatatgcgccggtgacttcttgtgacgttgaacgcagtttttcaatttacaaatcaattttggccgataatcgaatgagttttacccccgaacacctcgaaatgtatctgatttgcaattgttttcgcgaaattgataaagactgttaataaatttggattttttcgtataaacacacttgatttcttgaatttttaatacctatttttgcacctattttggccttttggggggtttttagcacctattttgcacttttttagcacctattttagtacctattttgggatttttagcacctaaaaatcccagccctactcattagcttatccctccatttgccatgggaggacaaaacgaacccaaagaggaggaacatttgtgctgttgcacagtgccgccgcccttttctcgtccatttgccgccaccgccgccgaattcgacgtcgtttcattagccgctattggaaaatgagaaaatatttaacttaattagcctgttaaggttttaattggttcaaaatcaattattttgtaattggagcatttaggcaacttaagaatgccgagcagaatgatcccaacagttcgtgctattattgcagggataagatgcttttgaaccaataataaattgccaaatttagagacagtgattaattaggaattctcttggattaaacaaaattccaaatcattaaagtataaaataagtatgaaagaaaaaaagtttcaaaaatttttatgtttttcgctttttaccaaaactttttttacatgacaaaattctttttaaatctgtgaacaaagaaaatcaaagagatttaaaaaaaggtttagattaaaaatgagagtaattaccaattgctctaagcctggactcaatttatgcacttaattgaccgatttcgcccaataatttatattttctaattgttttccgttttccgctaattcaaactttgatttgtttgcgattgcgcagtttcgctgccgacgcctgccgtgcgagcatttcgcagcgaatttttgaccgccgcattcgtcggcaaatggccaatgcttttcgaattcttttgccgaaccgcggccgttgcgcgtgtgccaccaccgcccgaaatttcgtgcagcagcaccaactgttggcaggtgcgtggcgaccaccgccagcagggcaacgccgcccccgccaatttgggaggccgaa

SEQ ID NO: 9807 - DNA, 2518 bp, Heterodera glycines
  misc_feature (144)..(144): n is a, c, g, or t
  misc_feature (2443)..(2443): n is a, c, g, or t
aaaatagccccctaatttcgacttctttccacttcttacagcatttcctattttctttattaatttgaatgccgaaagaggccaaatcaaacgctgcattaagcacaaagtttgacaaagtcatcgaaaacaatccgggacttnacaaattgattgatatcgccaaaattttgactggcggtcgggcggatgttgatatggaaccggacgtattggcatctatgaaatatgcgccggtgacttcttgtgacgttgaacgcagtttttcaatttacaaatcaattttggccgataatcgaatgagttttactcccgaacacctcgaaatgtatctgatttgcaattgttttcgcgaaattgataaagactgttaataaatttggattttttcgtataaacacacttgatttcttgaatttttaatacctattttcgcacctattttggcctttttgggggtttttagcacctgttttgcacttttttagcacctattttagtacctattttgggatttttagcacctaaaaatcccagccctacgcattagcttatccctccatttgccatgggaggacaaaacgaacccaaagaggaggaacatttatgctgttgcacagtgccgccgcccttttctcgtccatttgccgccaccgccgccgaattcgacgtcgtttcattagccgctattggaaaatgagaaaatatttaacttaattagcctgttaaggttttaattggttcaaaatcaattattttgtaattggagcatttaggcaacttaagaatgccgagcagaatgatcccaacagttcgtgctattattgcagggataagatgcttttgaaccaataataaattgtcaaatttagaggcagtgattaattaggaattctcttggattaaacaaaattccaaatcattaaagtataaaataagtatgaaagaaaaaaagtttcaaaaatttttatgtttttcgctttttaccaaaactttttttacatgacaaaattctttttaaatctgtgaacaaagaaaatcaaagagatttaaaaaaaggtttagattaaaaatgagagtaattaccaattgctctaagcctggactcaatttatgcacttaattgaccgatttcgcccaataatttatattttctaattgttttccgttttccgctaattcaaactttgatttgtttgcgattgcgcagtttcgctgccgacgcctgccgtgcgagcatttcgcagcgaatttttgaccgccgcattcgtcggcaaatggccaatgcttttcgaattcttttgccgaaccgcggccgttgcgcgtgtgccaccaccgcccgaaatttcgtgcagcagcaccaaactgttggcagttgcgtggcgaccaccgccagcagtgccaccgccgcccccgccaatttgggaggccgaattggcagaagaagcagcctaagagggaaatgcaaacgcatgcaattgaaccaatgaaatttattttgtgaatttgctcgaatcgaacttattgaaataattgggtggccaaaaaataataataaaaacattggggatggggtgggacgtgccgcaacttcgctccccttggatacgagcatgattttcttaaaaattgaaaaaaacataaaaactccaaaaaaaaatccctcagaaattatcaaaagagctaaaaatagcaaagccgcattttcaaaaatcattcgtccctcatcagcagataggcagcttatcagtgaattttttgatgtgggaataaactcggcaatggccaattgtcggaaaggctaaaatcggctttctcaagtttttaaattcctgcccattagtttttttgtaaattaattgcaatttgatgaaacagaaaaatgcggagatttcactttcaaaatttgttcacaaagtgccattgtccgtcccttctcctattttccctgctccaaatttggtccgaatatctttttaaattaatttctaccattccttattcatttggcatttatttcacatttaattcattgctttttttaaacatttgccataattttatgaacgtaccgcataaaactctttcaaactttgcgcacgcgaacgcactgaaaatgggaaattaattaattcatgacacaaaacataattgttttttgtttgttttttgtatcgtaaagccaagccaaaataggggtatattttgccaattaaaacaaattaaattcatatgtttttcatatggaaattttgctcgaaattgcataattaacaatttgtaccgctaaacaaaacctcaaaaccctccctgctgatcattgataaaccaaagaatgattcccaaaataccggcacaaaccatttttaacgcgggacggaagcggttgggacgggaacagcttcatctccttggctaaaggcaaaaataagcaccaatgatncatttgcaaattttaattaagtttattccctcttaatatttaaactaaataatattttatatttcattagctttt

SEQ ID NO: 9808 - DNA, 1453 bp, Heterodera glycines
aaacttggatttccttgaaaaagttttagaaatggtgttttcaagttttcaaaaaatgaataactccatataaaatcggcttatcctccccccccccccgccgccgtcagtggggggggggagaacagctgatgcagcaaaagcgagccgcactgctcccaccgatgcggcggccgccgggcgggcggagggcggaggcaaatgaaaaatgacggcggcggaacggaaggagaacgccgcccgcccgccccacggcgacggcggcggcggcggaaagaatgtttcagcgcaacgatcacatcgtttgcacagcacaacagcgggtcaaagtgtttgcgctgtcgactcaaatgcacttatttccatttgcgtgtcattagcataaaaatgatgatgacattttgaaaaattatgtgggactaaaaagaaattataaatttaaaaaaaaacattatccatgtttttgctaaatcagttatctgtttaaaatttgacaaatcgcttcatcttgattaacaagctcaagcggcaccaaaaattcattaagttttaattgttaaactgaaaacgattcaaatgcatttaaatattttcgcaagaaaaaaaggatttttcttttattaatgggcgcttaaaaagcatcaaaaaattttaaagtttaacacgttgaatttaacataattagcaatgtaagacagaaagattttccagaagaggattttctagcatataattaaaaataaaattaaaaaatttaatgagaatttagtgaaaattgtttatatgaaaatgataaatcaatttttcgattaattatataaaaagtggtatctgacaatcagagaagtaatggaaaaaataaaccggcttttacgggtgaaataaaaaaaccgtcgctcaattttttaaaagttgataaaattttgttggccattcaccaaataattggacgttttccaaggctttctccgtcaattaaacgggcgacggacacaacacaacgagagagttcagtgcttatcagttgataaattaattgacaatgcgattcggtgctcattcttttttgttattaatgggtcagatgactggcactaattgccatttccttagattttcaaaataaaattcaaataaaataataatggctaacaataagtaatgcgattgagacattttcacgcccacaattgtttaataaaaaaattatgttaaaaatgcacatttattaaaatttttctttaataaaaaaagaaattaaatttcacccagtgatataaattgatcagcaaggaaagaggagaacattagaaaagttaagttttaagcgtaatccgaacaaaaaatgtaataaaaaggaaaaaaacaaattaaattagggaaaaatccccaaaaaatttccgtttttaaataagcaaaaaaaggaaatattattaaattggagaaaaattag

SEQ ID NO: 9809 - DNA, 4116 bp, Heterodera glycines
cctggcaggtcctacacctcaagattttaaaaagttccacattcactaagttatgcgcaaaaccgaaaaggtccttaatcgctacgctaatttatgctatggggatggaacgtttaaattgtctcttaagcgtgctctttgttgattttttatttttattttgaggtgtaggcccaaaatggaaaagtaccaaaattataacaaatgtttggacagacagaccgagttatgctcagtacgccaagcgttcgtccgtggaaagacccgttaaaccctgaaaaactattgaaaataagccaaaaacgccacaacacatgccaagaacagagagttgtggcgtgccgggcgcctcgttgcgcatgcaactggacaaatgttgcgctgtcggcggactgccaccccttagacgagtttggtaatgaataaaggccgttttgatggcattttcgttggccgatgagccgcaaagcatcgtctgaacatggcgaagtccgcgcggtgcaaccgaatgaagcgaacgggcgaccaactgggcaaaatcgctgcgcggaaaagcaccgagggcaggccgactcaccgcggtggtctgaggacgataaagcattaattttaaaatagtaaatgaagcataacgagtgagcattgttatttttgagtaaattgaaaaactcacaattagtcgtgcatcagtggccaatttgatcagttcaggatggttgtagcccagcggtaatgacgaaatttgagtgaacaagtcctaaagaatggaaaaaaaggaattaatttgtcaaattctcgtcctcgtactagtagtgcgttgccatccgcgtcaatcaaataattgccaaaggaacgctcgtagtccgcgaagaaattgatggacgttgtttgctgaattgtaacttttccattagagtgatgacactttgggcaccggtcaatcaaattaaaaggaaattgaaaattcaaaaaaattacaattgtttttttataatcctcctacatggacttgctccatttcttctttcagtgccttcgacttcgggcccgggatttgtgtcagcattgagggcgcatcaggttcagaagaagcaatagaagacaacgaatgagcgaagcgattgacgattgattgacaaccggagccaaaacgaaaagaggcagcagcaaaggaaactcggaaatttatcattgttacttaaacaattatgtataattttcatgggtttagaaattatgtttttataaacacaggcaaaccagcatttggcttttgcgattttcagctgattttctagttacattcttttaccaatcgtaccacaaaaaatttacaagaattaagcaaaacaatcgatttttcatcaataaagcaaaaatcagcatctcaaaaaaataaacctggaccccttgaaatcgtgatgtccgagaccaaaaatttcacgagtcttgaccacgagaccgaaaatcccagaacccaaaaacctgcttttttcaagaaagattaccaaaaggatgattttattcttcgacataaatcgaggttctagagcatcattactggaaaggcagaataggtaatgctgataaatcagcagttggctatcctatttaacatgtagaatgaattctgtttttctctattagcagagataataaatagtaggttaaaatcagaggcgtattttccccctatactctctatttattaattcatctatcgtattttcggatgctgtgtatacttttttactgtccatggctggcttttgataaaaggcaaaaacgaagacacaaaacaacaacaacaacaaaaattggcacaacagtgaaaacaaagcgaaaatggaaccgagaatcagtttgacttgagcaagaaaactaaacataaatgaatcatacggtaaaaagggccaaaatggaaaagaaatttgggggcgagtgggatggaggcacaattactttggtccaccacttttgatctccaccacaaaattggaaagaagtaataatttattggtggtgatcaacaatttcattccatgacaaaaagcatttgggatttaagagagagacaaacagacaaaaaataataaataacaacactggtttttaaaaccaacatataacacaaaattggggaatgaaaagatcaccggattcaatccacctcaaagacttcttccgtcaaataatttttagagcaatgagccttttgggagtcgtttaagcagccgttgaactgacgaagtgccaggatgacgtcattgtgtgataattcgacctccctgacgcattttcccctgtaatggctgtgttgttatttattataattctccgtcactcctttcacccaccgtccgcccgatatgaacagttccttgacgacgctccgatagctcgacagaaaggagagacggacgacctccttcaggtcggccccactccgctggtcagacgcttgtgcaattttttcgaagtcgaaattgtcctccaaattctcatctttcaggatgacacgaaggatctgctcgcgagcattcacatcgggcaatgggacgtgaattttgagcgaaagacgacgcaaaatggcattatctgaaaaaatttattgtaaatgcagccacactcaatggattaaggggagggagtatagaaaaaatgagcactttgaatgggtgaggattatgaaaatattattgacgaaaaaggagcaaacttatgattcagacagcgtcaccgagacaactttttgatttaattaacaaataatcccttaccaacgtcctgcggccgattcgtggcaccgataatgatcactgcggagtttgagctgagaaagccgtcccaaagcgccatgaactgggttttcatcacagcggtgacttcgtggtcaagtttgtgacgatcgcgcagcacagaatctaaggaacaaacaaataaccgaacggaattaatcgttgaaacatattgagtaccaatttcatcgatgaatatgacacatggctgaatctttccggcctgaaaaatgaaatcccattcaagtccacaatctgtcgcacttaagaaaccaaccaaagtgaacaatgccttggtgagtttggcagtctctccgtaccacatatctgaaaaagtatgaatagcaataattgtgagtggttcaatttccacaaaccgctgagcaaagaaatgtcgaaattgatgaaaaacgcgtcgatttccttggcaattgcgcgcgcaatgagtgtcttgccacagccaggcggaccatgcaaaagaacacctaaaagcagaaattcaaagcaaacgaaaacattgttgcttaaaaaaccttttggcggactgtacagcgaagatggaattttgatgttcgcggagatgagacggagagggaggatgaggttctcctccaaaaggtccaagagtgaggcgcagccgccgacctggccaagggcgattccatcctcgggcattgcttaaacggaagtgttggaaaaacacaatcaatgccagcaaaaacatactgatgagtgtggcgatgcgaacctaaacatacgaaaatatagtgaacaaatctaaaatattccaacctcatgcgaattgagctttattttgtttgggtccaatttcagtgctttcgtgatctcagccacctgtaaatgatgaaatgcatcaattgtcaatgctcaaccattacttgcggcacaaaccctttttttcgcgtttttttttatctcgtattgcggatccattcgctgcaacattttgtacataacgaaccccaaaaaggcggtcgaagcgcacatacaaactgatttagcaattagcaacgaaacactcatctgctcagtagacattactgcttgatatagtgcaaatagataatttatgacaatcatgaagaggggtctaatttaacttttttgttttgggttcaaaatcagttttccggaatttccaaggttgctgattacgaacctgaactcgggtttgcctaatttcgaaccccggacccgaactcgaacaagagttgaatttttcaccaaatttgctgtgaaatcaaaatgatatagagtcttgcaccaaaatggcctgcgccaaagtggccggttccct

SEQ ID NO: 9810 - DNA, 2490 bp, Heterodera glycines
aaaaatgtaaatgtcaaataaacatacccaaacttcttcgatatccaaagtcttccgtagctccactaatctctcctgagtctcatcgttcaattcctgggccgtccttcctccaatcagttccgccgccgggtcataacaattcaaacatccatgtatgtaacatcccataacctcgatgcatttttccctagctccgttattcgcaataaatccatccaatttgtaagtcccaaatttaacttctcgtccgttccccgcgtgccgtatctcaattccatcccgttggctccgccactccaaatactttattgccatcacactggcgcgatcacaccgctcatatcccttctccggcacaatcgataactactccgtcaataaaaacattgccttaaaaatattcatcgcaacccccgcattcgtacaactcctcggtagtgggtcaaatcccttagtaatgtcgttaatcaatatcctttgaaactcaataatcgacaacaataaaatctccgtgtcgtttctgcaataatttctcaattcttcatccaaataaaagggcgtctccttgttctcattgtacctgaaaaaaaagaattttattcaaaaatttttctattttcctaccatttttcgaattttataaatttagccttgttcatagatcccggcgaatagtcctccatcggtggcagatgttccaatcgtattccataattttctttcttattgtaataataggggaaaaagggcttgtcctcacagtccaaattaaatgtcgccttcagcgactcaagcttcaccggcatcaataaacatgagtctctccaaatcagcatcgaatgtttcttcgagttttgcactttaaattcataaattttcaatcaatacagaacttcctcccacggttgaaaaagcaaacatatttctttaatccatcccagtgaccattctccaaaaatatcggcactacattttcacggcccatagggcccttccacaaaactcggatcgacttccgcggatctgcggacttctcaaatgcaatttcgtttccatcaattccacaattacgtaaaagttcaacagccgcttccttttgtcttgctaagttcttcataaaacgaataaacgaatatttatccatagttaaataattaattgacgacatcctcgcgtaaaaaaggcaaaatttatcagtattcataatcctaaaatttacttaatttttattttttgcctaattaaattatttaaaaataaatattttaaactcattttattttactttctttattttttattttttctgttttttttgtatcattaaattttattttttatttatttaatattttttaattaattattttttactttctttatttttaattttattctgttttttttgtttcattaaattattattttttcaattttttctttaaaaattttttttttgcttcattaaataaatttaatgtatttatttattgatttttttattttaatttttttctattttaattttattttattaaaaacacttatcttatccgttggtgttccttaaatccgaaatcaaatttatgtacattcctcggcccttctccactgggcagtgtgacgaaagtaattttcatcataataggctccgacaacaaaagcgttttcttattttcatctccgtccccactctgccccaacttattaatctcctgcataataacatccgcattgttctgcgggtacgccctgtatggtacccaaaccggggaagcaagcccagcacccgtaattgccactccaaacatccgcacttttcgcttcattttttcttccgtagtttttaaagccatcttaatcattgtgtcgattgcgtccctcatcgctacgtcagggcgtctcacatccgaattgatccgaaattccgtaatgttcttcgtgaatccaaatttttcgcaaatcatcgaccgttcgtcaattaatttataattttccatttcttcagtaaaattgttcctgaaaaattattgaataaaattatctcttaaatatattattaaaaattacttacccgattgatctaaaatcccattttttggtcgacggcccggcttgttccgtatttcgttgaaaatagggaaccaatcaatcaattttgattgacaggttaacaatttggtcaatatttcgaaatcgtaaagtcacggcggattgcgaaataatggaagaaaaataaaagaccatcaattatttcagaaaaattcaatttcattatttaaatgaatttttatttattcaactattgtccaattaatattcctatatcttacaattaattcgaatttcattgacaattttggtgcttatcgatttttttcacgactcggaatcgcggcgcatcgacggagcggatgagagtgcggcctcattatcgattaattttatcgatttttttttgcgcggcggcgacatcgatggggaggg

SEQ ID NO: 9811 - DNA, 2122 bp, Heterodera glycines
  misc_feature (2069)..(2069): n is a, c, g, or t
cattttattgacagttgacctaattaatggggccacactcgttaaagtaattggaacaaaaagtcacgtgcagattgcgaaatattggaagagaaataaaaacacatcaatcaattttggttgacaggtgacctacttttgaaaattttttcatcccgatttatttattcattttcgatttttatttttaaataatcaattttattgtgcaattcaataattattcatggcattgtttgctgctaatatcaattaattcacacttcttccaaattccattatcgattactttgcgcggcggcggcatcgcgtcgccggacgggcggggagggaggggagaggtgataaaaaccgcacggttttgactaattttcaaaaagaatttttaatttcaggatccgaaaaacccatcataaaaaatctcaggatttgagaaaataaaaccggcccaaaaggtttgttttcttcacctgtcacattgtcacaggtggatgattgatgaccttcccgcggcgctgcgcggccgggtgaaaaaacccgcaacaatttggggaaattttcaaaaagaatttttaatttcaggatcagaaaaatcatcataaaaattcaggattgagaaaataatacagccccaaaaggtttgggatttaatttgcaaaagaaaaaattgaatttccttcacctgtcacttttggtgacaggtggatgattgatgaccttcccgcggcgctgcgcggcgcgggtgaaaaaaacacccgcaacaatttggggaaattttaaatccacaaggcggcagagttcaaagaaaatcccataggctcaggatgtgagcgggcggcaacttcaaagggctgcacccctcccataggttttggctcttggctgcatcttcaaaaggtccacccctcacataggcacgggtttgtgcggtaaacacccgcaaccaacccgcaaccttttgacattatatactactcatgtacaagaaattttaaggagtttgccaatgtcaaaaaaaatatgaaaattttctcaaaaaatgggtgtcactcaagccgcctaggaatttgttccaaaatatccccggttttaagccatttttctggttctcagaccactctgaaggagtgttctgattatcgcagcgcaactgacttttctgtttagcataaaagttactcttacatgaattttttcagattttttgtggtttctaggaaatttgtgagttatcaaaaaagagtaattggaacacccatttttttggaaaaattcataatttttttttgtcatttccaatctcctaaattttcgtgttcacaacagccttgttttatcgatacaagtgtcgctacggatttactgttgttataatcttcttcatacaagtgaagtttatgcggttatgctttgcgattcaaatgctgatattccccctgcgagaattattgtttatccgaaaaccgaataaaaaaattaacagatttatacccactagataaatttgtagagccaatgacatatcattactgtatccatgtggtcgaaaaggatatcattttggatttaaagaccaaataggaaaaagagttacaatttgtgatagctaaaaacttgtttttttccgtgaaaatagaacatttaagattttcattaaaaataaagctgaaaaagttggcacagaaatcaaaaaaggtaatattgccaccaacgtttactgatgtgccacgaaatatgcatgaatatttaatggatctaatggatcgcaatggcaattgttaataaaactggaaaacccggtctttttgttacttttacatgcaatcctaatgaccctgatttaaaaacgggtcaaacaactttagatagacctcagacatagttgcaagagatttggaattaaaaaagaattagttattttatttttgaggaaaaagatgtcaacagaattgtagtttgggtaagttctacaaataaaatcaacaaaactaagtcattaaactccaggattcggagacttcgcaggattctcttctcctcgatcggtataatatagcaactccgcttgnggtcgtgactcatactacaaaagtggcaatacgtctctccacattcgtgcatc

SEQ ID NO: 9812 - DNA, 4582 bp, Heterodera glycines
  misc_feature (4489)..(4489): n is a, c, g, or t
tgtgagcagattttctgcgaagccgtaaaatgggcgcccggcctaaccaacagtcacttgctcgaatttattcgctccaccgattcggctacggacaaaagtttgcggatgacaataaacgctgtgctcagctgcacggaacgggaaacggtcaactcgctgatccatgtcactggcggttcagcaaccaatttgcaagttttgcacgctgctgccgacacgggttcagtcggtagtctggcgggtgctgccttttggaggcattcgaggcaaacatttatgcatttcagggtcggatttgtcttccgccaccagtccattagacatttcgacttatttgtcggcaattaatctccgcgcgggttatttgggtcaaatcaaaggaatgttcgaaatgttgcgtgatacgcataacagtgaagaaattgcgcatcagcttctgtcggatcacttggaaaaacttttggactctgccatcaaatcttctgacccggacagcatcagcaaaccgttgcatctgatgacagcttattgcaatttttgttcacgtatcatcatttttagaatttttggagataaaaaaaagtattatttaattttaatcgcagaaatcaatcagagaattttgcacgcggtcatttgggctccattacgaagcttcacggaacagacaatgcgcaattgcataatttgttggaattggattttggtttcaatgaaagacattcaaattgatgttagtgaaattgataaattaggtaaaaattactgaaaatttcttttagtttttacaacaaatgaccagctgttggaggattgtgtcacagcaaaatttgggtcttttcagcagagagtacgactcttttgcttgtccactttcctctcaaaactgtgggcaaaggccgacgccaaatgccattccgcataatatttggatcaacgtacgttttcttggagccggtgacttcattagtattccctcttaataaatttagaaatatgaatatttcgaacatttttgacaaaagttagaaaaactaaactaaaaataataacccataaaaatgcaattcattttaaaattcaaatttccctatactcatttctcagtatcttttgctttttgagttgtttttattctcccacagtttttggctgaaagagtgagcctcgcgcggtattgcggccgagaacaaatcgacttgttggagatgatgttcattcagtccttctctctgagcattggcgagagtgtgccttcgtctaattcggcgtctcctgaccaatttttgttcattcccgaacaaaacaaagtggcagataacactcgtaacttctttcttcgcaatatctattcatggattttccgttttttagctcttatttcccgtaatattgtcgctgtcggtccccgtttccgcttactttcgtccgcactgacgatggtccagggcgagacaagcggatgccgcatttcgaagaacattctccgccatcggatttatgccgtggcattcgattacttttctatcggtccccaaacgccattatatggaggggcatctcttcagaatgacattcgcagcattgtcacattttggcaagcactttatgccgattcaaaatacattcggaaggagtcattctccaccaatggtctttccacttccttttatgactttttctgtaaaattgttaagataatgaaattcttttcaacggtcttccgccacaattttacggaggtcaacacacaagcgaagctgcgaagtttaattacgggaaaaacatcacattaatacggttgtgattaaggaaccaaacttggcatggttcgactccgatctccggcggttggatgacttcgacagcaattgcaaacagaacactgatggggacagtaggacaaaacccactttctaatttacgcatccaagcgaaaatcaacgaggagaatgctcaaatgattgatcgacaaatgaagaacattttacggaaacgacaacttctgctgatccttttggtgattggaatcagcttttattattatgattagtatggctttgattagatgaatgaaatagagcggctttatgcttggcttttccctcgtgctgacttgcttgagcctggcgaagtggaattcgatcatttcctcaaaaatgcgctcggaggagaaatgcagacacgcccggaccaaaagcaaatgcgcgaaaacacgaaatttgcatgggaaatttcgcctcaaatagctgtccatatgggaacgaggtacaaaaaaaaagaagaataaagcggactcagcttttcgaattcaaaatgtacaggtttcgaatgtatcctgtgaccatcaacgcactgcaagaacttattcgttctcggcctgacagtgtttcgcatattcccgaggcattgccctattttatcggggactccacggcaacttacgaacgaattgatgtaatttttatttaatttaagaaacccttcctaattctttttcccattagcttactcaacttttcacatggaaaaagtgttctcccgtccaagcaatcgccctcctttgtcctcgactccacagttttcatccgctcactttgcaatatgctgtccgagtgctcgagtcgtactcaagtgatgttctgcttcattacatcccgcaaatcgttcaagccgttcggtgggattcggttggtttattaatttctattatttctgttgctatttgtttgttttttctttagatgggttacacttccaaattgattttgagtctttccgcccattctcaacttcttgctcatcaattgctatggaatataagagcaaatatgtacacagatgaggaggcaaaaattgaggacccagtgctttacaaaccgttgaaagagattctggacaaagtgagtaatttttgtcagcaatttatttgtcgttctttctctttttagattaccggacagtttgaaaatacaactcgcattttttatgaaagtgaatttaattttgtcgacaaaataacaaatatttcgggaacaataaagtcaatcccgaagggcgatgctcgaaaaagggcgtgtctaaaagcactcgccgaaatacagcttggaggcgtcagttacttgccatcaaatcccgaatcgattctgttggaaattgattatgccagcgcaagtcctatgcaaaggtattttaaagggtaatataaaataaaggatttatttagtgcggctaaggcgccatttttggtacggtttaaagttcgacattgcggcgtcgaaagagttgaaaagatagcattgaacgcatatcaaaacatgtcaaattatctccaaaaagaatcgaatgtgtccgcagtccatcaaaaggggcaccatcgccgaacatcaaagtccaagggtttaaccaccaccaacacatccccagcacattccgcctcatcattcggaacaccgcagattttggtggcattggccaatgaaaattttgacggcattgggcgaccgaattcatcggacacgatttcatggaaagctgcaatatttaaagtccgaaaataggatctttaaaggaagtgaatgttttatattttgctaattgtaaggttggcgacgatgttcggcaggacgttttggcccttcaactgatgcagctgataaaggacatttgcagcactgtcaacttggacattcagctgttcccttaccatgttgtcgccacaaacccgggctgtggcgtaattgaatgtgttcctgactcaaagtcccgtgaccaacttggacgtcaaactgattacggttggacaactttatttttgatccactaaatcggtttttaaggcttattcgaattttttgtcaccaaatatggagaagaaaatagcaaaggttttcagttggcgaggtatttacctttttggattaaaaatacaaccgaagtaatttcaggcgaaattttgtccggagtatggccgcttacagtgttttcagttttcttctgcaggttaaagacagacacaatgggaatataatgctcaactcggctggttctatcattcacattggtcagattgttgtgccgttcaattggacatgacgctaatgtttttcttcttcaattttagattttgggttcatgttcgagagtagtcctggcggaaacttgggttttgagcctgacttcaaactttcgcaagaaatggttgacataatgggccacaaaatggagtcggcgccttttcgtgaatttgcagacaaatgcatccaagtgtatttagccgcgcgccattactacaacgtgagtggttgtttcagttgaatgtgactccataaaatggcagagcgagtcaattttggtctttgcaaatatctctccccctcacatacccttttaatcagtttccgaaattatcagtgtttttcgacctttaggagtttatttcacttgtttctattatgttggacactaaattgccgtgtttccgtgngaaaacgattcagcaaatgcgcagtcggttttcgcccgaactgagcgaacgggaagcagccaaatatatgatgagcatcattaacaattgcta

SEQ ID NO: 9813 - DNA, 1298 bp, Heterodera glycines
gcatttggattttgtcattttggagaattatttcgcgaataggacttttcaaaagcaactaacacctctttttcgaatcccaaaacaaccctaacagtctcatatcaacaaaagtaaacaaaaatactcagcggcgccaagagcgtagcgcttggcttcgggggggggggggctttagcccctatttgaacggcaccatttgtgagaaaaaagtggaccccagaaagagcaaaagacacggaaaaccgttggccctattaaaagggttaggaaagaatggagctaattccctgtaaaacaattattgctctcggaaatggcttttacaattaaaatcatttctaaatttagtgcagcgaaagaccaaaggccatttttggtttttcggtttgtgtattttgtatgagttcatcaaagtaaagggtaatgttgccaaattcattttgtacgccgcaaaaagcacagacggcggacgcggcgccgaatcgccggcagttcggtcatttgccgtggcgttccccggcagaaaggggcgccgccttcggtgggagggcgccgtggccatccctcgcgcattatcaggacgaccatcagcggaggaagaaatcgtatcggcgacaaaatcaaaataatttacgggaggaggtgaaaaaagaaaagaaaaagaggggggggggggagaaatgtcattttacacattcattaattataattggaaaattatctctcattttacatagttagtcgagttcttctgctgttttcggttgcctaagggggcgggggagggaaagagttcactttcccttagaaatttaatattttacatttgggatcaattaataattacctaattaataattacaaattcaattaagtggacaccgaaacaaggcagattattgtggtgataatttggggttttgggagtcaattttttgggtgggcaattgcacaaaatcccatccattccttctttggcattggcatctccaattgttgtcatttcactattatcctcaaaatttttgaccgttctaactagagtagagcgggaccgggaccaaaacacggacaactgagtaccgaggtcccggttttgaccgggaccgggaccagtcccgggttttttcccggttttcccagccaaaaattcccggtttttcaacccgaaaaggtcccggtcccgggtttgcccaaaattcccgatcccgctctactctagttctaaccatgtaacgccgagtaaaaaaggcaaagataaaagtgccataaaaatgtactgttgtccccctcat

SEQ ID NO: 9814 - DNA, 2305 bp, Heterodera glycines
attcatacgttttctcgaaaactgacactcaacattgatactctcaataccgagacctaaaatgtgggggggggggtgctcaatccatgtgcttctcgagactgtggcctaaaaatccaaagcctttttcgagctaagactttcgtgaagaactagagtaaaatgcttccgcctctaaaatctttaaaaggatcaaatattaaaaaaaacaatttttgatgtaattttttttattgtaagccgaaatcacaaaagatgccaaagaaataaaccaaaaaaagggacgatgaagccgacatttttaattttaaaatttaaacaataataaaataggaaaattttatatcgaaattattaaaatgcaaaaaaagagaagtgctttagcctaaaattaaaaaaaaaaattattcacatattttataaaaatgaatcaaccggttgggaaaatcattaataattgggacgtaacagaaggaatttagtaaattaattatgattcattcattcatttgtgaaaatgtaaaaaaattattaattaagaaatttaaaaaaaatagttttttttattacgaaaattatgaaaaattatcaaataaaaaaatatgtttttttagttttgaaaataatagaaaattgagaaaacattatttaataaggggacattgctttctagtcaccgaattgtcgattaagaaatattaaaattgttcaaaaggtttaaaatatttttatttttgacaaatcaattaacaaattgatattatggttcattgcaaaaattttatatacaaatgaagtttaattgtgcattcatttcataaattaattatggtaatcactattaaatttaaatattataaaagaaaaatttttttattgtaattctaattaaaaatgattttttcttttgctgaaaattattattttttcacttttctttctttgcccattttgcatttttttcttttcttttttttttgctttgtattaataaaaagacatttttgttattcgttaatttttaattaaaatttttgaccggaaaataaaaatgcctagaaattttcgtttccttaagtgaagcaaactgtgcttgcgcaaaggtttttttttggcaaaattttttaaaaaagatttttgattaaagactagagtaggtcgggaccgggaccaaaacacggacaactgagtaccgaagtcccggttttgaccagttttgaccggaaccgggaaattcccggttttttccctcaggtttttcaacccgaaaagtcccggtcccggttttgcccaaaattcccggtcccgacctaccctattaaaaacatattttttaggaatttaaagcattcctcaaaggaagtccacggcacctaaaaagcgctgttaattaaaatgtttaggtgaaattttcaattaaacaattcggcacaaatacaaaaattcagagaagcgcgatgaaagcagaaacaaagttatggatgtgatgaagacgaaaaatggaaaataaattaagtaattaattattggacaaaaattgttaaggatgatgatttatttttttatatgactagatagattatcaatcaaaagttcgaataaaacgatgaaaaattaaaattgctattaaattacaaaaattagcattacaaatgtaaaattaataattatctttaattatcaaaagaatttgtgcaaataatcttcgaattccttgcgtaattattgtccagtaatccgattggttcttccagtagcatgaacattgacataccgtatttggctactgtactggtttgagtcggctaccgtttgcagtgctcttgttgatattgttgttcctgctgcattgcccttccaaaagaaccgcaccgttttgtgaatggttcgcataaattgggcacgcatatccttggagagagccatcaaaaacacctgcattttgttttttatgtaattgaaaatttttaaaataataaatagaaaaaatcttatccaaaatgcaataaaacacaaaaaatatacccttaagaaatggctcaaaaaattttcaaaaatacacccctaagaaaattgacaaattttttcattgatcgccaaatttatttttttttccttgataaaaattacgtatgtattttattaacactggcttcgggcttaggcctttgcctttaagcttaggcctagaccctaggcatataggcctttgcttaggcttgcttaggcctagattcttagaaacttcagcttcactttttcttggggggcggataaatgtcaaaatgaaaaaggaaattattct

SEQ ID NO: 9815 - DNA, 4166 bp, Heterodera glycines
gccttaatcatttcaaaaaaattattttttcaaaaaaaacttaggttttcttaagaacaaccaaaataaattcaaatttttgactatttaaaccagtcccgggtcccgccccgatcatattgacttggctaacaccgacttaaatttaaccagtgaaactgcgccaaattaaaaaattcaataattattttggcgttatgtcttaattcaaagttttaaagatagaacaaaagcccgaactcaatggatttttggaaatttgtacaatttcaactgctaaaataaaaaaaaattttctctgcgaagcctgtcggcattgctggtctccgcatttcattgtttccaacaaaaagaaattagactcaaaaatggatttttttaaatgcaattaaaaaaaaattcttttggtgtgccgtggcggtattgaactttcattgccaaaaacggaaatgtaaagcactaaccacttggccaaaacaccacaggatttgatcttgttaattaaccccgtatccatgccaagcgaagtgcaattgcaacacaacatgcgaatgtaagaatccaatagaccgacatgaagcagacagcaggggtgggtcaaatgagctttgcattttacatacaaaaatcgacagtaaattttttgaatcatagaaaaactaagactagaaaaaaaattcgctaaaatttccaatttttcccgagaaaagcataaattgaccggaaaatatttgccaatatttttttcttcaaagtctcgacagaatcaagaatttacttcatataggttccagtgacgcttaggtaagcatctccgaaattttttttttaaaggctttacttttaaagcgccatagaattttatgccattccatttttcggggtatagcccgaccccacactcaaaccccaaagaatggcatttttgtgagggaaagagaaaaaaattttgttcgaattttgggtgttcattaacttttaccaaaattaaaaaatatagtaattttgtcagattattttgatgtttttttcgcaaaatatcgttatcatatgcaaatcatgcataaaatgcctacaaattcgggttttagcgaaaaaaatgtattttaaaatctcttgggattagaaaattgccatttgacccacccttggtatcggttaaaatctaaaaataaccaaaattgtttcaaagttgaaaatgaatttaccattataaaatggaactgaaatgatggccatcagatgaatgagtatacattgaataaatacagtccttaatttaggttttaaaactacacactaaaaaaccgaaaatttttggaaaataccaaaatgtaaaaatctttcatgtgcaaaattcgcgtaaaaggaattttttttgtattaatttactaatttttgcatttttttaagttcaatattttataagtaaaaaataaataggaggcctcgattaagtatatatattccatgttttaaattttttccttcttgataaaatttttggacttactaatttttttttcataaattaaaaccgcttttcagaaatttttgtctataatttcgatttttaagtctgtaaggccatttagtatatactttggcatatttttggatttctagcatatatttctgttattcctgtttttacatagcatatttaactcaatttcctcttacacacttagacctctaaataataactaaaactgagcaaattaaaaatattaatattataattactagagctcgcattttgaggcatatgcctttttttctgcgcactagtttcgatatataagcataaaaaacacattttcccactggttttaggcttctacgttcacttttattatgccttttttttttgccttttttgaaattttcgtgcattaaatgccttttttggcattttgccgttttggtgccttttttggcgctttttaccgaaaaatccattaaaatgcaataaaattgggaaaatacacacctaagaactgaccagaaaaaaatttcagaaaatacacccctaagaacttaaaaattttctcaaaaaataattttttttttcttggtaaaaattttagttttaaaaattttcctttttcgaaaacattataaaatatttaataatcatttaaattagggttgctccccgtccccgagctgcccggtccgaccccgatccccgacttttttgggcctattccccgcccgaacccccgacatgtcgctccccgaggtccccggcccccgactttttgccccccgactccccgacactaattcggggaattgggaactccgagcattgtaaaaatttaaaaagttaattcaacaacgaaggggggaaaggttgaaaatttatgaaattttgaacaattttcttaatattaattaattaaaaattccgaaaaacttttggtcggcacctatcggcaccacggccccccaaaatccaatttttttttttgcaaaaaattgttccaaaattgcaaaaattattattttttaggataaatctgttagggcaccgccgggaaaaaattgatatttgaatacaatacattgtcagattttgtccaaaaatgaccaatttttgcaattttttgagccagtttttttaagaaaattaaggattttaaggatccggcggttccgataggcgccgccgggaaaatttttgaaactttggctatatatttagcagattttgaataaaaattattaattttgctaaaaaaaactcaattcataccagtgcatttttactcacgttttttttagtatcaaaatatgaacattttacaacattttttcaaacatttgggaccaaaagatcaaaaaaatttaaaatttcttgataaaatagtgacattatgcaataaaattttaaaattataaatatatttaagaaatcggaataattttagtcgtctcaaaattataaattcttataaataagaacaatgtaagccctggtttaaaggccagcttctaacgaaatcagattattccccgatcggggtccctgacccccaacaattgagctcctccccgccccgacccccgacaattgagctcctcccgccccgacccccgacaattgagctcctccccgccccggcccccgacatgtcgccccccgaggggtcggggagcaaccctaatttaaatgaccaaaattaagttttttggttaagttttacgtgtttttctccctaaaaacccttaataaaaaactttaaatgccaattttcatgcctctttcgggatgttcgtgccttttcatgccttttttcaattttttggtgcctattatagtgcctttttcgcgttttttggtgccttttttgcgagctctaataatgaaaaagaaaaaatgacaaaaatttataaatttattgaaaaataaaaagagaaaacccaaaaattagtgatcgggaaaaattgcttaaattttggaaattggcaaaaagatcatttttaaatggaagaaacaatttggggacaaaagcaggaggaatgaaatcattagcaaattactgtacatttgttttcacgctttctttttgtcatcataataattggaggcatttattttcaaaatacataaaaatgaaaattgttttaaaattaaataattggcgaaaaaccaaaataaaattaaaaactaaaaaattgaatgttacaacagggcacgggatcgaaaatttttaaaaatcagattatgtggtcgaacatcagaacattttgcaaaattgcttctaatctattattttacaatttaaccaattaaaaaggaccatgtccaagtcgaaatttgtttattttatgtatttaattaatgataaaattgatttcggttaatacccattttattagccaacaaattaaaattttcgtgtggggtcctttttaatttcagaattttttttgtcagtttttttttagttttatagccagtataaccgagatgttaatttgttaattaattaagtaattgaatgatgttattttaatcagtggaaatgcatttattattatgttactttttgcgaatattttagtcattagaaaataaattgttcacaaaattttttttatttttctttgcaattaagcaggagtttcttattttttcttaaaattagtaaagctta

SEQ ID NO: 9816 - DNA, 3201 bp, Heterodera glycines
tccaccaaaggtgtggtttattgggaaaaacgtgatttctttatggagtaacacgaccacttcaaaagcgctgccaacctctaaagaggagtgcaagtgcatgtggtcactgaatcattgccaatacggggaaatcaaacctgtaggaggctctaggtgacctttcagccattcgagcccagcattgactacagctacttctcctcaaaggaagcggaaaggacgaactgcttcctcaccgaaagcgttgtcttctacgacacccatgaaaaacgcatgcattcgccactcggggatatgacaagctgtaaattgaacgacgaatggtgtgtccttcgcgatggagcagtgatggtttggtcaacactcgccgatgccgaatgccaattcgagcacatgaaaacatgggatggccaattccacccataggagaacgtttggacgcacaaggaaatctcactgtcatttgccggaaaggcgcaaaaaatcaaggactgcggtcggacactcgtcacgacagaccagggatttgcagtggatgccggcaatgttcctcaacatgatcaacaatcgatggtcccagcggagtgcccaaaaaaggccaattaccgggaggcgctcaaaagcggtgctactaccggtggaccaattcagcatcgacactaacatgagactggagatgatgaagtaaaatgccaatcaaacaaaagccatcatcccaaaccggacgcagcggctccaaaaacggaagcaccaaaaccggcagtgcctcgccccacagttggcccagcaaaaccggagcagccgagccgaaaggcccaattgcaaccggttaaattgccaacaccaaacaagcagcaccgatccaaaaagtgatcaaaccaaaaacggtgacgactagagaccggaaatttcaaatttgcggatcctgttgcaggattggagttcaaaattttttacaggacaggatccggcaggattaatcctgcaaatcctgcaatcctgcaaatcctgcatttaaaatctgcaggatcctgcgcaggattgcggatttttggaaattttgaaaaaattctgtattaataaaaaagtctttcaaagtataaaaaagtattcaaatatatttttaaaccaaaaaatgatgaagatgaaaattaataacgtttttttgcttacactccaagcaatcgactgaatcttctttaatgcgtttaaaaagaccgatttgccaaattgggtggctcataataatagcttaaattaaagtaaaataatttgtatttaaatttctttgcaaaaaagccataatccataatgtatagggatgggatttttaggcacaaaaaatcgcgaaataggcacttaaaaaggcagaaaaatcctaaaataggcacgaaaatagtaaaaaaaaattattaacgctttttaggtaacaaaacacataaaaaattcaattgtataaacttttttcgaataaggataagtttttaaacgaaaaatttttattaataaaaaaatttttgaaaaaagaaagtttctgaatatttggcattctatttttaagaattttcaaaaaatcaatgcatgatcctgctgaatcctgcataaaaatcaaatttgcgggtcctgttgcaggattggaattcaaaattttttacaggacaggatccggcaggattaatcctgcaaatcctgtaaatcctgtattttccaaaatatgcaggattgcggactgggatcctgcaaaatcctgcgcaggatcctgtcctgcgccggtctctagtgacgactacgctgaagtaccagccaccgaggccaacgacttctccaaaagctgaaccgccaaagccaatcgtcgtagccccaaaggtcacaagcccggtgaccacgcaaacggtacaaccaacctctccgccagaaggacaaccgaaaagtcggaaccgaggaagattccgaacgcgatacgttatgcacagaaaccaaagcgaacctgaaaaggtaagagtttacgacaattcgagacgaaagagagcgacggtccacacggagcaaaagtgggcactgttcccgtactacaacaccccaatacagggagcggaaagagccaacccgtggtgcgctatgaacgcgcaagacgagcgagactaaaaccagggctggagcaatcactggaggaagcaacgcggcagttggaagaatacggacgagtgacaatttcgaatccgagggcagtgtgttgaaagcaacaaggggaatgatcacaagggatcaatgatcaagggggaacgatcgggaaacgataagggattgaaccaagccaatcccgcccagagcggctcgattcagaattggagcgcattcttcaaggcaaaaaagagtaagcgcccagcagtctcgaggtcccgctacagcaatttgtcgaagcacgggcccaccaagccgaagaggtgaacaccaacgtgctcaacgtcaacacgacagagtcactggtcgtggtcgcagcttgcacatcagtagtgcagcagccgattgaacacctgaagtacaggtcgcagctactcaagcggaagatctcctggacttgggcaacgaagcgttatttcgttaacgacgccaagttcagcgagacaaaaaagacggagctggacgaagcactggaagctctgatcctgtcccaagtaccgccaccggaagaaagggagctgaagcagaagaccttcgatgccatcggacgcatttcgcgaaggaacctggaaggaattcgaaatttgcatcgctgggtccacgcgggcaaacactgccctaagaaatggggatttgcacatcgttctgaagcccaagtccagtgagccattgagccaagagcgaaggcttcgcgagctccaattcctggtcagggaattccgactgatgaagcgtgagtacatttactgccactgtgtcttcatcgccaaaataaaggcaccgcttatcaatcaggacaacggaagttatcgacatcacgatcgacaacatcgaagccacatgaaacagtgattggctggccgagcagatgaacgacagtaaattgtggcgactctacatggccatgaaaatcttcaccaagcacaacggcatcggcgatgcgagctgcgggggcctcaactcgctgtcatgggcaatcatgacgaagcacttcgcggcctctcgcgtacaggagcg

SEQ ID NO: 9817 - DNA, 5386 bp, Heterodera glycines
tttaattcgtttaggtggacatcttcatgcttaagtctccctttttcatttaaaatatgcatacttctgggttttccttcgatgcatatgcaaatgactcttgccaatttggcaaaatctaaaaaaatccatttaattaaggtattttaagaaaattttaagttttcgatattttcagttttatttgactttttgaagttgccattttcaaagaccaaaaattagtattttatttcgtcttactgttcttagaatatattttttcagataaacaaaaattcagagggaatcctaagtttttagtttcagaaacccacataattttcggtgtaaaaattagaaaaactcaaaaataaaaattataaattttcaacttttttttattgattctgtaaataaaatatttttttaaaatgaggcttttaaaaaaaattcatcagtgaaccttggtctaataattttatatttgaaaagaatggtaaaggaaacatataagattgtaaattcaaaaatagaaaaagcactaataaaataattagataaaataattttgtaaaaattaattgccaattaacagatgtagatttgattttttggctaatttaatcatgtttaactttgaattttttcaatcctcgagctcaaaacagcattaatagaaagtgattatgtccgatataatgttacaaataaataaaacattgttttcttaactttaaaaaagaacaaatcttttaagaaatacagattccatgtccgaatgtatcaacctaaaatttgctttttcgcaacaaaaaaaaaagtcaaattgaagaagtaatttgatttaagactcgatttttttgcaaatttattttattttattgactactcgccttaggctctctgggagccggcgttggagtcgtcgttgttgtggttgtggttgtcgtcgtcgttgttgtggtcgaaaacatcgcctcaaccttaaattttgtagatacaagcatttaacttttgtattttttaggtttccccaaattcgccttgttcttatgttagcagggctgggcgaagaaatttttaatgggatttactcaaatcgcaaaaattaatcattttttaagcggtcgaactttcaatgaaaaagaaatattcacagcatcaaattgtacagaaaaattttaaaaaatagctgaaaatcagaaattgaaataatacatcgtaaaagggtaattaaaagcaggaaaaaagcaatgcgaaaacatcccttccgaaacaggttttagggtcaaacaaatattatctatataatttatgaaaaataaaaatgaattaaaagaaaataactgataaaaaattagataattaatattatacatttaaataattatgagtgtaaaattctctttctcgaaactaaatttcgtatgagaaaattcaaattgtaattctcgagaccgagaattcatagagagtcgagatagacccaaaacccgagaaatttgtgctttgtaaggaatatccaaattaattcaatatttagccaccttttttgtacatacacaattgttcaattacccatatgggattgattgatctttggaaatttttaaaaattactccacaaaaacaaaaaatataaattaacgggtgcaccccaaaattccgccgcccgaaatttgcctgtcgaaatttcgccggggacataatttcgcaaaagaaatttttttaaaaatttcaaatttctaaaaaaatgttagaaaattttttttagactaattcatcataaatttcaagaaaaatcgttgaaaatttcggcggcgtaatttggtcccgtccccaaattaacattgattttaaaatgttaataataataagaaatgggaaaaatgttaaaccacgggtgggaatcgaacccactcatgcaccctttccgtgggcagttctaccattaagctaccgaggctcatccgcccttccttttatggatcttatcaaccccgctttccgcgttttaaccgcccagtcagctttttccttacataattttcatttttttaacaattaacattgatttaaaattttaaacaattttcattatttgtcaacacttttttacctcggcaaaatccttgacacattcccgtttgtaacgcttcttacagcataagtatgaatcaggactgtcatagtaaacgcatgcggtacgtgccggacatttgtccttaaaggaaatatcaatttcagttcacaaacactctctcaaaaatgcacaaaaactcattaaaaaagattaagcatttggtgtctatactgtatgtcattatttaaaatccatcaaaatttgtcgtatttaaaaaagcccaaaataaaaatttttttcttataattttgctataaagcaactaaatttttatcattgatacattcgaagattcaagaaagttatgaccaagaatgttcgaaaaacaaggccttttgagttcctctagccacaactttttacattttcacattgatgggtttttgtttaaataacgactctgtcccaaagcattttgtttaatccacaatgcttctcttttatctctgattcctctccattcctacataattcacatcaatatattatttaatttttacatttgaaatgaaccgataatttttttctcatattttttgatccttttggagaacgacttttcgccatccctacttacatagcagacgatgtctttggctgcttgaataattcctccaacaaatactccaactgcagcgccaacaagtgtaccgattgccccaccgactgcaaaaccgattgacgcaccagctgctgttccaaggagaggaaaagctgttgagccaatgaatccaccaacgagtacaccaattggtgcaccaactgctgcgcctattgttgcagttgtgccaacaaggcttccaaattctggcctatccacagcattattggttggcattgggtcataagccaataatttacggtcccgctccagagtccagtagtcgtattcctcataaagattcagaccctcggatcaaacacgatccattttataagggaaacatgaaccaattttttaccaaaaactaaaactttaatcaataaaaatataaagaagaaaatattcgaagattccgagggtgatgaaaaaattggaaaaaagataaagcccttgaaagaatataaaattccatggcgttttgggatggtggccctatgaatttgtgagatgttaactacggtgcaaaattcttaacccaaaaaagtaatctttttaataaaaattttcccgttttagcgatattttgacagtttgtgatcaaaaaaataggaaaaaataaccaaataaaaagaaactgatatgagaagcgctgatcacacaactgatcattatgctaggttttcgatccagtgattttccgatccagggattagtgattcatggatcatgtgtggttcgagggtccgattctcaacttctgatcaattggtgggaaattcataataatgatgaggaatgggaagcagacgaggagagctcggcgaagcgcaaccattttaaagcagtacaaagcagggggttcgatctgaaaagtttctaaatgagaatattaagttaaaaaaaactaacgatttcggtgataattagaagatttataaaaaatgattgcacttcaattggaaagaaatttgttaaaaaaaaattcgaaaaaattatattttttattttcagtatttggtcgtatcttattatttaacactacccaaaaataaccaaattcggaattagaaatgtgataaattagaaaatttttagcaattactcctaaaaggaatctttctgaaaaacctaaacatatccgaaccatagtataaagaatatgagctgtaaaagtaataagctgtttaaaaaaaaccgaataattaatatcgaaaaagtaaaaaaatataaaattatttaattggataaaaatgatgaaaatgtactcagtaaatcatattcaaaagggtgtgcttttgctatgttctgctgctgattgcttatggcttccaaggatgacggatccaaacaatttatttggatttcaaatggaactgctgaaaaaaaagtaaagctaatcatcactttccccggaaaacgtataagcactgctgctattccatatgtattaagatgaatcatcacaaaatgggaaaatttattcagcacaaaaataaaacaaaaaaacgtactttttagcgtaaatttattagtagggatggcaaaaaaaaatatataaaaagtggttaaaatatttacataaatattttttaaaaaagaaatatgtacaaaaacccagaacaggtactcaaaataggtaaatacaatttttaaataaatcatttttcgaaaaaattcttcgtaaatggtgaaattggtacaaaataccataaaaaattatctatatgcttagaatcatactttttattttggaacattttggtgcatattttatgatttagtacatattctaaatttgttcgacctttttaaaatacacggacacgtgcttaccgacatgggttacgggccaaaaacctgttccgtacacgggcacggattttttgaaaacaaccaaaattcacttcaaattcaaactacaaaatttgttgaaatttgattaaattttatgaattaaaatggttattatggatcccgaacattttggaaaaacgatcgggacggatcccgggtcgggatcccgaccgaatcccgatcccgatcaatcccgaagatttttttcgggatcccgtgggattatcgggatttgctaaaacccaatttttttactttttgtgccaagttttgttcatatgcttatctaatatttataattgatcaattcgattgaagaaaaaaagagatgtgaattatatcagatttttatagaaatttttcaaaattagaatatcatataattagcacatttatcaacatagtgtttaatttaatcaagtaatatcaatttgtgtacagtcgtctcagtcgatcatttttagcaattgtgggaatcggaatcaaaaaaaaaaagattttcaagatagatctggaaaattttgttcaaacactataggggaacaaggggaggccgccggtgccgatagagcgcttccgggaaaattttgaatttgaaatgtcatttgttaccagaatttatcataaaattgtccatattttgtgattttgatcttataagaaaatagagtagtgggtttttgggtctgacagagccgagtggcacagaaggaaaaacacgcttgcaataatttttattcggtcagtttctagcaattcctagaacacgttggccataaagctccataataacgatctagaag

SEQ ID NO: 9818 - DNA, 1007 bp, Heterodera glycines
tttttcataatgttccttttttcacttatttttattctcaatcgagccaattttttttaatactttattttcattcaaatttagaattttgccggccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttacaaatttatttttaaaataagtctgaatctttttttaatcactaaattgttttgaataaaaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttccaaattgggtttaaaagcggaaattatcgcatcgattttttccataatgttccttttttcacttatttttattctcaatcgagccaattttttttaatactttattttcattcaaatttagaattttgccggccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttacaaatttatttttaaaataagtctgaatctttttttaatcactaaattgttttgaataaaaaaaaataaaattttctcttcaatttccttactattttctcttctctgactcgtcgctgctaccatttttagcggcgggcagagaagagaaaatagtaaggaaatttgagagaaaaacttctctcaatttaacttgatatttccaaattgggtttaaagcggaaatatcgcatcga

SEQ ID NO: 9819 - DNA, 2326 bp, Heterodera glycines
ttgtacctcttttaatcacttttgtacgttttttaatcacttttgaacctcttctaatcacttttctatcactttttcactgttgtacctcttcaaatcactgttgaacctcttcaaatcactgttgaacctcttctaatcactgttgtacctcttataatcactgttgtacctcttataatcacttttatacctcttttcacttttgtacctcttttaatcactgatgtacctctttgaatcacttttgtacctcttttaatcacttttgtacgttttttaatcacttttgtaccgcttctaatcactgtctgtaccttttttaatcactaaattgttttgaataaaaaaataaaattttctcttcaatttccttactaatttctcttctctgactcgtcgctgctaccatttttagcggcgggcagagaagagaaaaatagtaaggaaatttgagagaaaaacttctctcaatttaacttgatatttccaaattgggtttaaaagcggaaattatcgcatcgattttttccataatgttcattttttcacttatttttattctcaatcgagccaattttttttaatactttattttcattcaaatttagaattttgcctgccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttacaaatttatttttaaaataagtctgaatctttttttaatcactaaattgttttgaataaaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttccaaattgggtttaaaagcggaaattatcgcatcgattttttccataatgttccttttttcacttatttttattctcaatcgagccaattttttttaatactttattttcattcaaatttagaattttgcctgccattgtttattttacattgacgaaaatgccgacactttgatcgaatcggagggatttttgcaaattgaccaaaaaatgttgtgcgaaattttggaatgcgacgaattgcaaatccgtgaagaaatttcaatgtggaatgcagtaaatttttttaaatttaaaaatgttacaaatttatttttaaaataagtccgaatctttttcggactattttataaaattattatattcaccagcctttccatatttacagttttcaactctccctcaaattggcactgtttcggcccgtttcgaagcgctggtggacaaacattttgatgacaggacgattttttttataattccggcaagttttttttgttttttttgtttttttctgttcttttttgtttttgtttttgggttatggtcccaaaagccttaacagccccaaattttcaaaattcttaataaaataaaaatttttggaaattcaagaaagtttatttgtaaaagtgaatagttttttatgtgtttttttgaaggattttatgcgtaaaatatttaatggcctccaagtaggcaagtttttttgtttttttttgtgtgtaaaaatgagaatgtttcaattttttaaattatttttttaggatttttttccaaaaaacgaacttcaattttcagaatatcaaagtggtggacattctaccctttttgaccgtccatatcttaagagaacattttttcttaaaattaaaaaatcttttttttttggaaattttacatttttaatttaattttttggccctttttattcattaaaaaatcttttttttggaaattttacatttttaatttaattttttggccctttttattcaattaagcctaaaaatgcattttctatgaacaaatttacatatttaactaacattttttcaaaatttcagctgggtttgcatggtgtttggatggacattctcctcttttgaccgtcctcaactcggcctcaaattggcactgtttcggcccgtttcgaagcgctggtggacaaacatttcaacggctgaaggcgtaagtttcagtttcaaattggccattaaaatttttctaatctctacttttgtttggattcggtatttaaaaaatttaatttgaaaattttttttgagaaagtttttagaatcccctgtgtgatttgtacctcttctaatca

SEQ ID NO: 9820 - DNA, 1172 bp, Heterodera glycines
tttgtccaaaatgatcaaaatttgcgattttgggctaattttttaagaaaaaagtgactttatgcaataaaatttcaaaaaattctcaatcatgagaaaaaaattacattttattcaagaaagattcctaataccatattaataataataataataaataataattctcaactatgagcaaaaaaattgacataatgccataatataatcaaaatatcgttgaaaattacaaagatttctcaaatttctttgaatttttttaaaacttttctaaatgttcattttcaaggacgtccttggcatccaaggacattttttatttgcaagaaagagggcccaatttcaaggacgtccttgccattcaaggacggatgggagccctgccttaaataggcacttttagcttttgaggttgtgatgcaaaaaaaatcttccggttcgatctttttctcagataaaaaatgacaaattctacccattttgtggttaaaatttcaaaaattaaggtaaaatgaacgtccggcgttgccgataagcgccgccggaaaattttttggaaattgtaataaaatatggtaggaaaagttgcaaaattttcaaaaaaataaatcgcaaaaaaggcaaaaaaatgcaccaaaaagttcaagataaaagcttcaagccaagttaaaaactcgttttcgtgcatattaggctatagcaagttagcaaaaaaaggtaattattagagttgaacgggaccgggaattttgacaaaaaccgggaccgggacttaccgggaccagaaaagtcgggaccgggacctcgattttcgtccgggactggaaccaaccgggaattttcccaagtgaaattttttgaaaaaaaattgaaaatttgagtgcactttgttacgaaaaattgcctatattcaaaaatgtacccataaaattttttaattctcgtttgtggggagaaattcgaagaatttttccattatgcaattttgagtgtaatatgttaacagaaaataataaactgaagcattcgttttaaaaattaaattttcaaatatattcatttcttaggggtggaaatttcgcatttcgcgccaaaaagcgaaatgcgaaatgcgaaacgccaaaaaatgcgaataatgcgaaaggcgaaatgcgaaaagcaaaaccctgctc

SEQ ID NO: 9821 - DNA, 2013 bp, Heterodera glycines
tttcgcgccaaaagcgaaaagcgaaatgcgaaactttcttattatgcgaataatgcgaaaggcgaaatgcgaaacctcggcccatccctggtgcttatctatgcgtatcaagtgcgcgaaaattttaggcatttgcctaaaaaaggaagccctaggaattagtagggattccatttttatgtaagaaaaatcgcaaaatatgtaaataaaatatgtataaaaaatgctaaaatatgtatgaaatatgtacaaaaaccccccaaatatgtactaaaatatgtaaataaaattttttaaatggttattttttggaaaaaattcttcttaaaaagtgaaataggcacaaaatgccataaaaatgaccaaaattgacttagaatcaccttttagcattttaaaattaatttttgatatctcattttggaaaaaaccgcttttttggagtacattttcaaataaaaatttttttatttgttagaagatgtttttctaaatttacaaaatatgaaaaaaaaatgcaaaattttcgacttttttggggcatctaaaaaattttccttaaaaaatcctcaaaaattggaaataaaagtcccaacttttgttcacaaacacaaaaaagaaagtgtttttcctactaattaggctatggagaatccaggaaacaaatatgtatttacataaaaatggaatccctagtaattagcgtaaaaggcgcaccttttttagcacaatgcgctgctgcagctgaagcaaggctacggttcctatgagtacgaccgaattgcctttttacattcggactccagcaaaatgcccggggcccatggcggcccgactttcatttgttggcacagggaatacctgaaaaggtggcacagaaataaaattatattacgattatttttgtgcccttttgtccgttagattggaaattgctcttcgtgctgtcgacccaacagtttgtcttccgttttgggactcgtccttggactggcgacttgagaatccggcaattcattttagaacatttttaaatatgtaattttgtttttattcaggctgattccatcctgcacagtgaattgctaatgggctccccagacagcaataattacataaagaacggctttttggccaattggataactgtgtgtgaattaattatatcttgtataattaggtaattaatcattccacaggcaagaggagacccaattatacggacattaggcaccgacggatggggcggcgaattgttccgtttgcctaagtaaagaacgaatgctggcatttacacacatatattcttgtcatttagtcgtgattacatcataaacacgaaccaatcctacaacattttctcactctcttacgatccggtacattttctttctttccttttttagtaaatttcatttttgaaattatttttaaatttcatttcaaattatctttttccagtcagatacccaatgcagtggtcaaaattatgacaatttgcttgagagtaaccacgacggtgtgcacgtttgggtgggcggacatatggtacgaatgggcggggggcggcagcagcagatagagcagggcacagggatttgttagtccaaaaagtgccatgaaacggagccaaattgccgaattcgcagtgcttttcatggcccgggtttcgggagtttatgagctcatctaaattaatgaccatcattatgctgccattgcgcatttatttatttttgttcagagtatgcttgagactgcgccaatggatccaatcttttttatgcaccattgcttcatggattatgtaagcctatccgaataaatgaacagcaattaaaatatattttttaacaaatatgaattgatataaaaatatgacagttaatcaaaatatgcagacaattaaatttaaaactaaaacattttttgcacttcaaaattaaaattggtcagatttgggagcaatggagactgaagtggcaaagtcgagaacagcgcgaaaagcaattc

SEQ ID NO: 9822 - DNA, 421 bp, Heterodera glycines
tcaattctctggcattccaatctctcgggactctcttctccggcattccaatctctgggactcaactcttcggcattccaaacactgggactcaaatccggcattccaaacactgggactcaaatctgcggcattctaaacattgggactcaactcaccaactttcaatgacattccaatcactgaaacttaacccaccagcatttcaatctctgggactcaattctcaggctttccaatcactgggactcaattctcaagctttccaatctctgggactcaattctccggcattccaatctctgggactcaaatctccttttctttttgtgtgacttgggatgttcgcggcctcgtacgggaacaacaattttctgcgccaaaagtactcggcctcgaagcggccgagtacgggggactt

SEQ ID NO: 9823 - DNA, 2249 bp, Heterodera glycines
tcgtgtatatttgcttggtagttagaccatattctaatgacataacaaaggaaaaaaatatttattatagaaaaaaacaattttttgttaaaaaaaaaatttgaagcaatatttttgcaaggatattatatagtaaaatattatctcactttcgaatataattgcgaaaatccattttccttggacaatatttagggtagaaaagcacttaaatatattgttgaacacaaataagaaatcaaataagaaaaaaagatcataggagaagacggacctttcttattttttagttggggctttaacctcaaaggaaaagtttttggcaaatcagtccccctcaccaatttccgactgcggcttggctttttcaaactaattctcattcattcatttaagtgcacgccataagcaaaatttcttatcatttacataaacaaaacaatagctttttacactaaactgaccaaacaaaaaagcaaaacaaacatttcattttacaaatcattattcaacaatgtgctatctctaaaacatgaaagacacagtagtgtgcatctcaaaccaatacattttttaaaaaacttgacaaatttcagttctgtgtctcatggatgagaggcacaatagtgtacatctcaaacaatatattttaaaaacttggacaaaatttcacacttctgtgggtttacaaaacttttagtgtacatcgcaaaacaattcactaacaaagaattcttttgacaaaagttcacactcttgggtttctaaaacttggtaggcacattagtgtggatctcaaaacaattctaataattacatataacaggtaatgtgattgactaacataagccacacaccacactaatgaattttctaaccaataataacaaataattcatttaataaattcaacatttttctgacaaatcaacaattttaaagcgcaattacaaaatggaaattatatccgtatttgataatgtgtgaggatcacaaatataattaaataacaataacgaacaaaatatcaaaaatcaaacataaaatacgtaatcgaaaaggtatgagtcacaaatcaaatctaagcaacggacaacaaacgaaatactacccatttttttgcgacttcttaattggctccaaagtttccgaactacgacgtttaattggtgtcgtcaaaatcgcctcaagattaacgcgcccagcaccaattttaacggatgaaatctcgcaatggagctgaaggcattcatctatgataataaaaaaaaacttgaaaactcaaattaaaaccaaaggtaatgccgacacaattacaattaccttcaactttcacaaaaaaattttgaagttcgatctgtgtgttctaacgcatgaaccaagacgttctaccaattcttcgccattgacgtacaaatcagccctcattcctttcttgtccgcaacgactgcagcgaaatgtttcccgactggcgaaaacgatgaagcgagagcacaattcattgctttaaaaaattaaaagtcaaaaacatttatttatctctcacacaaaagtcacagaacaaaccactaatgttttatcaaaaacatgacgcacattattgtgtcacacgaaagtcatacaacaaacactaatgttttatcaaaaacatgacgcacattattgtgtcacacgaaagtcatacaacaaacactaatgttttatcaaaagcatgacacgcattagtgtctcacacgaaagtcatacaacaaacactaatgttttatcaaaaacatgacgcacattattgtgtcacacgaaagtcatacaacaaacactaatgttttatcaaaaacatgacgcacattattgtgtcacacgaaagtcatacaacaaaccctaatgttttatcaaaaacatgacgcacattattgtgtcacacgaaagtcatacaacaaacactaatgttttatcaaaaacatgacgcacattattgtgtcacacgaaagtcatacaacaaacactaatgttttatcaaaaacatgacgcacattattgtgtcacacgaaagtcatacaacaaacactaattttttatcaaaaacatgacccacattattgtgtcacacgaaagtcatacaacaaacactaatgttttatcaaaaacatgacccacattattgtgtcacacgaaagtcatacaacaaacactaattttttatcaaaaagatgacccacattattgtgtcacacgaaagtcatacaacaaa

SEQ ID NO: 9824 - DNA, 3332 bp, Heterodera glycines
  misc_feature (2782)..(2782): n is a, c, g, or t
tcacagaacaaacactaatgtttatcaaaaacatgacgcacattattgtgtcacacttaagtcacagaacaaacactaatgtttatcaaaaacattacgcacattattgtgtctcacagaacaaacactaatgtttatcaaaaacatgacgcacattattgtgtcacacttaagtcacagaacaaacactaatgtttatcaaaaacattacgcacattattgtgtctcacagaacaaacactaatgtttatcaaaaacatgacgcacattattgtgtcacacttaagtcacagaacaaacactaatgtttatcaaaaacatgacgcacattattgtgtcacacttaagtcacagaacaaacactaatgtttatcaaaaacattacgcacattattgtgtctcacgaaagtcatacactaatgttttatcaaaaacatgacgcacattattgtgtcacacgaaagtcatagaacaaacactaatgttttatcaaaaacatgacgcacattattgtgtcacacgaaagtcatacaacaaacactaatgttttatcaaaaacatgacgcacattattgtgtcacacgaaagtcatacaacaaacactaatgttttatcaaaaacatgacgcacattattgtgtcacacgaaagtcatacaacaaacactaattttttatcaaaaacatgacccacattattgtgtcacacgaaagtcatacaacaaacactaatgttttatcaaaaacatgacccacattattgtgtcacacgaaagtcatacaacaaacactaattttttatcaaaaacatgacccacattattgtgtcacacgaaagtcatacaacaaacactaattttttatcaaaaacatgacccacattattgtgtcacacgaaagtcacacaacaaacactaatgtttatcaaaagcacgaagagtatattattgctttataaacacttacaaaccaatctttccatcgaaacgctcttgaaagcgttgagctttcagcatgtaaaatttgacgacctgtatttagtaaggtaagcatctgtaaatagaaacagcaaacttacaattccaagggaacaaatttttgaaaatttggacgacacgctcttaaattctgcgagaacaacattctccccagaagcacacgccaacaaagccgtcaacttcttctcagacggtaaaatgcttacaatctgcccacaaaaagaccttaacaattttacttaaaacaaattactaattcaagcacttacgcaagctgagtgccacatggtgtggctttgagctcttccagagtcgtaagcatggcaacaggctggcaccagatttgaaaaaaccgaaccggtagaaaaaatgagccgtagcggcagaaaaacaacgataaattgtttagtcaccagatttttgaccaaactggtagaaaaaatgagccgtatcggcagaaaaacaattctctaattgtttaacaattctaaaataaaacacaaattaaagtagatatatgaaataatgtgtatacaacaaaaataaatactttttctaaccaatacataaccataaaattttacgacaaacagactttgaatttaaaaaaataagcaatattaaacctttaaattaaacaatgaaagacaaaaacaaaaaattaaaatgatgaatggaggtgaggacgattttggcgttatatttgaacatacacaaaaaagcgaataaatgactaagaatgttttttgcaaaacaaactgaaaaatcaaaatcaaacatttccatttttcaaatcattttttaacgcaaaaaaaacaaacattttcatttttcaaatgcttttttaacgcaaaacaaaaccaaacattttcatttttcaaactcatttttaacgcaaaaacaaaacataacgccacacaaattcaaacaatggcagaaacatacagacactcaactttattatataggattcggatccgggattcgaatttgttcaaagtcgatttttaacgaaacgtccctcagcgagcaaattttgtgctctttgcatccgtcatacttgttttacatgaaaaatttggctctagtgcactttataagtccaatcagagtatatgagtacaataaaatatttatagtcatatgaccatttatgagtccactcattttttttatgagtccaatgatttttaataagttttgagtccaatttttattttccaaactgtcagccaaaattgcaaatacacaaagtaaagtcacggggaaaaaatagatttaagaaaatttttcgcttcatttttaacatgcccataaatttttgtgaagaaacgaaagtgccaagttgtaactagtctattgagtagaaaagtcggacaaccctaaagaatgggggtccctaaattggctttttcaatttttgttcgaattcggtctggggttcggaattgggtaaatccgagttcagattcgtaccctcgaaaagcacttaaaacttgttttgagcccaaaattaaaaaagaagttaaattagggaccacaattctttaccattgccatcaattcgacttctgttataatttggtgctataagctttttttggccagtaccaaaagataaacaaaaatgaattttttttatgctcaactcaaaagttacagcattctaaaaaggtaaaacaaaattatccctagtcatattctattattttaccttttttaaggaattggtattccacgtctttgtctgcaatgtcctcaatttcgtgcagtatattgaccagtntaacatattgtttcgcctcccattgatttggaatgttgcattccatatttgcgacacggtttaaatactgtaacaagtttttcgaagttaaataagtactattgaattttttaagcttctaataatcttttaagtgcagcacagtggcatgcatttttcgttgacaaatgagaatccccatgaattcaatttgcgaaaacgagaagtcatgaatctatggaaaagccaaagaaattggagtgataaaactaatatattttttaataaatattaaagggagttgaatttaaggtagcgcgacatttgcgccgcggacatttgcgccgcgacacttgcgccgcccagccaaatcgacatttgcgccgcagacacttgcgccgcgacttttgcgccgcagacacttgcgccgcccagccaaatcgacatttgcgccgcaaaaaaaaattttttttaaattttcaacaatttataagcgctaatatttgataaaaccctaataaaagttagcaaaaaggtaatcacaaagataaacgtccaattttttgtcttt

SEQ ID NO: 9825 - DNA, 988 bp, Heterodera glycines
aatgtattagcatttggttttcaatataaaaagaaaacataaatgacatttgttataacttaataaagcttgacaaaaggtctatctccatttcttgcacactaaataaaatttaatctttatccacccagatgccctcgaatgcatgaaaataaggaatattataagctgtcaccggataaaaaatgattcaaaatgttgcaagaaaagaattttcaactccccaaatttactgttcaatttcgaaataatgaactgtgtacttctactaagctgtgtttatttgaaaaaggttggcctttcaaaaggctctctgaataaaggctcacagaattcagctacaattattttgccgatattagaattttgtacggttaaaatatagattaaaataatgtattagcatttggttttcaaatataaaaagaaaacataaatgacatttgttataacttaataaagcttgacaaaaggtctatctccatttcttgcacactaaataaaatttaatctttatccacccagatgccctcgaatgcatgaaaataaggaatattataagctgtcaccggataaaaaatgattcaaaatgtagccagaatatagctttcaactccccaaatttactgctcaattacgaaataatgaactgtgtacttctactaagatgtgtttatttgaaaaaggttggcctttcaaaaggctctctgaataaaggctcacagaattcagctccaattattttgccgatattagaattttgtacggttaaaataaagattaaaataatgtattagcatttggttttcaaatataaaaagaaaacataaatgacatttgttataacttaataaagcttgacaaaaggtctatctccatttcttgcacactaaataaaatttaatctttatccacccagatgcccctcgaatgcatgaaaataaggaatattataagctgtccccgggataaaaaatgattcaaaatg

SEQ ID NO: 9826 - DNA, 1351 bp, Heterodera glycines
cataaatggacatttgttataacttaataaagcttgacaaatggtctatctccatttcttgcacactaaataaaatttaatctttatccacacagatgccctcgaatgcatgaaaataaggaatattataagctgtcaccggataaaaaatgattcaaaatgttgcaagaaaagaattttcaactccccaaatttactgttcaatttcgaaataatgaactgtgtacttttactaagatgtgtttatttgaaaaaggttggcctatcaaaaggctctctgaataaaggctcacagaattcagctccaattattttgccgatattagaattttgtacggttaaaataaagattaaaataatgtattagcatttggttttcaaatataaaaagaaaacataaatgacatttgttataacttaataaagcttgacaaaaggtctatctccatttcttgcacactaaataaaatttaatctttatccacccagatgccctcgaatgcatgaaaataaggaatattataagctgtcaccggataaaaaatgattcaaaatgttgcaagaaaagaattttcaactccccaaatttactgttcaatttcgaaataatgaactgtgtacttctactaagatgtgttggcgctagtgtaaaagttggcctttttgaaaattttttaaaaaagtcatgaaaatacatttccgggggttttcggggccgctgatcacgaatatgacattcatttcgaccaatttcgaaccccggacccggattcgaacaaaaagtcgaaaatcgtaaattttcactttttataaatgataattttttaaatccttttagcaaatggttaaaatttcaagatattccattattgattccaacaatctgccgctcctcggctttccaacattggacgatataaatttgagatggcttttttcccaaaattctgaagagattctacaatttttggctcacaacggacttatccaaaacaaaatgatgtgcctaatttgttcaaacaatatggctctgacaaaacgtagccaaataaaggatggatttgaagtaattataaaataattatcttttattaatccttttttaagtggcgctgtcaacaatgtcatcttagaaaatctgtgcgcgaaaaaagtttttttcacaatagtgctttgagtctcacgcaaatgttcaccatcatctacatgtggattgaagactatcgaaacaaaaacggtgtcaaaaaattgggtgtgacaaacatacccttggcaatttttttcacttttgtcgtcaacaatggtcaaaacaggcaaaaattggaggaaaaaaccaagtggtcgaaattga

SEQ ID NO: 9827 - DNA, 1591 bp, Heterodera glycines
ttggcgctatactaaaagtgggcctttttgaaaatttttaaaaaaagtcatgaaaatacatttccgggggttttcggggccgctgatcacgaatatgacattcatttcgaccaatttcgaacccaggacccggattcgaacaaaaagtcgaaaatcgtaaattttcactttttataaatgataattattttaattcctttttagcaaatggttaaaatttcaagatattccattattgattccaacaatctgccgctcctcggctttccaacattggacgatataaatttgagatggcttttttcccaaaattctgaagagattctacaatttttggctcacaacggacttatccaaaacaaaatgatgtgcctaaattgttcaaacaatatggctctgacaaaacgtagccgaaaaaaggatggatttgaagtaattataaaaaaattatcttttgttaatccttttttaagtggcgctgtcaacaatgtcaaagtttttttcacaatagtgctttgagtctcacgcaaatgttcaccatcatctacatgtggattgaagactatcgaaacaaaaacgctgtcaaagaattggacatggcaacatatactattgtcaattttttcaacttttgtcgtcaacaatgttcaaaacaggcaaaaattggaggaaaaaacaaagtggtcgaaattgacgagacatgttggacgaaaatgaagcatcatcgaggaaaaaccaaaaaggggagccaaatttggatgtttggcgccattgaacgtggtgaaggtgcaaaaaaacttccataaacttttaattttttaatttaaaggtggtcaagcattttgtgtgcaagtgaaaaaccgcaaaagaaggactcttttccgtcaaataaggaaatggattcgtccaggcacggtgatcatcagtgacgaatggccagcatatctgaaaatgtctctacatttgccgcaatatgaacatctactaattcgtcacaaaaaaacaactggtggtggtttctcaaaaatcatcacgcttccaaacgggactgaattcaatgttaatacgaacaaatgcgaaggaatgtgggcccaattgaagcagaagacgaaaagaattcatggcaccagcataaaattgacagaatcatatatgcatgaacaaattttccgattgaatgctagggctaaaggattgtctgtatttaaagcttttgttgatttgttgcattttaattataattttaatgattaatcttgttaaatctaataaaatacacattaaaattgcatgaatgtgtaaattttggtgaaaatttacgattttcgactttttgttcgaatccgggtccggggttcgaaattggtcgaaatgaatgtcatattcgtgatcagcggccccgaaaacccccggaaatgtattttcatgacttttttaaaaaattttcaaaaaggcccacttttagaatagcgccaaaaatttttataaatttcaactgtgacaacagcaattgtttagaatgaaccgagcacagcgaaaatttaagcagaagcaatctgtgggacaacagcagaacatagtcaatgatgga

SEQ ID NO: 9828 - DNA, 3246 bp, Heterodera glycines
  misc_feature (27)..(27): n is a, c, g, or t
  misc_feature (30)..(30): n is a, c, g, or t
gaagagtcgtgcaaaaacattcaattnggntccccttctcttcacggaactgttggtccgttacaacaaaggtagaagcgatgctggtgccctttatgaattgccgcccgacgcaaaagcatcaccctttggacacggcacttcgaatgcacaaccgaaacgaacattcggcacttcatttgatgacgacttcaaacccaacctttcaactgcagttgatgtgaatgtccaacaaaaacctgtagacaaaacatcagcaggtaaataaatttgaaaactttgatttgcccactatggcgctaatcacaaaactcattaccactgccagcagtcttctaaatccctgattatttgtctaccattttcatgcaaaaaccgtttactaatggactaaagaggctaatttttctcttctaattttgaaaagggaataaagagcaaaaatgctcgcttttgtctcttttaatttatcaaattatggcgtatcctttctgtttagttggtgacatcgaagtgaaaaataatgaaattgttcaaaatggcaaccaattgagcaaagagagcgtttcaactgtaccatatgaacagcagcatggtcaggtgatcggacaagtgaagacggtcaaatacaaagcgctcttcgaattcaacgctcgctccggcgacgaattgagcatacaaccgggcgacttgatcctcgtattcgagggacaccaatccgagccgggttggcttggtttgtgttatgcttttttcgccgtcgtcttttcaagtgccgtttaagctggccaaattcgcgacaaagtcggctggttccctgcctcttttgcggagcccctttccgccgctgctgctggcccattactgaagaggggcggcagtttggccggctctccttccggcgaacctttggccatcattcgcgaggagtgtgagccgccgccgaccgggcaaattcaccccacggaacaaaggcgtggaaatgctttcgacaccgacttcactgctggtaagaatatagagcactaacaattagtgagataattccccatttagcatttacgaaaagtgtttcattcaccgattctgccacaattggaaaagcggcggcggcactgaccaaaggcaattcaatgagtgccagtccatcagtttctgctgctctgtacgatctcccgcctgcggacacagaaactgtggtgaaattgacaaatactactattccatcaccgaccgccactatcgaaccggtaatattcttttcttatctttgaaaaatttccaaattgcgtttcagtcatccgtgccattgtacgaattgccacccgacaatggtaaaatgccaccatcgaaagcgtcagttgctgacagtatggtgttgtctgtgggtgtagcgttatatcagtggaaagcgcgcaatgaacaggaaatgacatttggacgaggcgatgtaatcgaagtgttggagcagagcgaaatgaggtggagaggacgacttcagaaaaacaggtgggagaattcaaattacacccagtgattcggaaattgttgtgccatttgcttgtcttctaattttagacaaatcaccggatggttccctaaaagttatattaaaatttctgctccttcggagcagcaaaaggatgaaagcgcaacaacggacctttatcagacgggtcaaagtgcagcaaaaaatggaggcaaagcacgcgtgggtgaaagtggagaatggtttattgtgagttatacggacaataaatgcactgaaagctttagaattacctgaaacctaatgagacatgagttgacgacaaattattattctttttttttttgcaaaaggctctttaccaatttgatgctgtcgagtcaaccgatctctcattgaaacccggcgatcgaatttgggtgaccgaccaacgtgatcaatggtggcgagggacttgcgacgggaaaagtgggatttttccggcaaattatgtacaaaaggcaggcgaaattgcatcatcaatgcagagtaagctatctttattgttatcagcatagttaatccaaaaagacatttatatcttaaatagaagactcgaagatcgacgggcaaacaattggacgggcaattgcgaatttcactgcgacagcatccaatcaaatttcacttgttattggcgatactgtcaaaatctaccagacaacgccaggttcacaaagagagtggaatttaatttgggttttaaaggggatgttttaggcggttggtgggaaggcgaagttgataaagcaggcgtcaaacaaattgggtggttccccggcaattatgttcaggtgtgggaaacagcgcaatccaatactttcgctgtaatcacccggaattccaaatttagctgttgaatgcatccgatgagacggtaattgctgtggcagcattcgattatacggcgcaacatgaggacgagttgaccttcaaattgggcgacatcatcgaagtggtggaccattcggactcactttggtggaagggcaggaagaagggacagccagaacagagcccattactctttcctgcaaatttcgttcaattaaacaaataaccttctggatccattaaaatcttttcacatcagccaactttgaccaaattctttctttctaattcataatggattttttcaattgacccgatattcataacgcaactaataacttaaaatcaatttgtagaaattttgttaattaactcattattggtttactgtgttttttgtgacatattttcccgcaatatacattgtaattattataaattaaagctatagaagatttacttgtagtcaattccattgtttcaagggtgtgatgggtgctgctaccgcgtgacaaatcacatttaggcaatcttttccccgaatttttcacaattgtcacattttttccattttagttttgtaggcgatggtcggcgctagttacacaaagcaacctatattttgaaaattttttcaactttttggtcaaattttttttttgttttttttacacataatgatgaatattaagtattaacagcacaattatggtgaataaaatgtatattcacgatttttatcctaaaaaaaatttacaaaacaaaagggtcccccctatggattttgattaaattcaaaatctatcactttataactatcgccaaatttgtttattaggcccaaataattgtcatattcgtgatcagcgacctttaaaacaccc

SEQ ID NO: 9829 - DNA, 1127 bp, Heterodera glycines
ttggatgggtctgttacagggatgggatccgtccttgaatggcaaggacgtccttgaaattgggccctctttcttgaaaataaaaaatgtccttggatgcaaggacgtccttgaaaatgagcatttggaaaagctttatttctcactattcatcaaattttattctctagaatttaattttaagtattttcatatgaaacgtcgaaaattttaaaggacgaataatcttgaggttagatgaaattctggttatctatttgttctgctaatcttacatttacatctagatttatcaaaaataaatacaaaaaatgagcgaccatgaaggggacttagcggcagtagccgaggctcgtgcagcggcaagagctcgtgaagctgctgccaatgcaaatgttttggtgagtttttaatgtgataaaaatcctaaaattttcggggccgttgatcacaatcctgtatccattttggcaaatacacatagccgatccgatttacgcacaaaaaattgcaagttctagttttaacattttcatctaaaaattgcttaaatacccgaaaacgaactgaaagccaccaattctgcaacaaaatttaatgaaaattttcggtttttgagagggtgcgaaaataaatattgtcgtggatttattgtttgcagttgggtgcagagcagggcgttggaggtgaacagcagcgagagcgtggggcgggcaacaacgacaaccagcaaagtaaagttttttgacaataaattttttaaataatttcccattggatccgattggcatttttaaaacttgaattttgaaaccagtttgttgctattcataaagagacatttttaagttcgttagagcttgggccaggctttgccaataggcatcactcagaaattttaatgaatgggataagaaaatagtgaaaaatttccgaaatacagattagtgaccccccccctttaattttatatagttcgagagaaattgtgaaaaactattgaactttggtgctctagtacaattttggatatcaatgagcatcatcagtttcttatttcagttgctgcacttcatgctcggatggacattcttgaacatcagcaaattcaaaacggtaatggtttt

SEQ ID NO: 9830 - DNA, 4374 bp, Heterodera glycines
cattactcatttatcaccatcccaaattccctcccgcttttcttcctcgtcggcccatcaactgtcattttatcccctccccccatcctttcaccgttttcccctcaaatcgtcgccagacgaagtgcaaacattcgaacattccgtcgccctcaaactctgagccgagctccattcattgtcagccttatccaaaatacgattgtcagctttgttatttgctgttttttggtcgtcaaactctgattttcttttcttgtttcctagcgcgtattgattttctgattttgatcgcttaaaacatgccaaaagcccactgattccctcacaaaggaacaaaggatgggtgtccaagcaagtgactgtgggaattccgggcaaatcttccagggtaattaggccacccattagcatttgttattacatttctgtcattttttcaaagtgaatctcctggccgagatatgaagttttcctttttagcataaataataaaatatgatatttattagttaattattttgttaaaaatacatttgatgagaaaaggcaaaataaaacaattttatggcagagaattgaacaagaagaaagaaaaaaaagtggtgtgaggggaatttctgatcaaaattagctgaaatatctccgagatatcattttttcttccgttctagcacagaaaagatttttgaaattaatttgtgtaaaagatggcaatcatttggggtgcccagctgatcaattgatcagtccatttgcgagtaattcgcctgcgaatgtttcccttccattctgctgctgttgtccatcactaattgattgtccttcaaccaaccagtgatcacttcctcttgcgatggtccgttctttgttcgacatttgtctggcctccgtttgccagcgcagtttggtgttcgatgccgacctttctcttctcccctgcgactgtaaacaacgtttgatggagtttttcgcatcccatgaccaagtgattgtgccattttttctttgattagccaaaatccgcttcagttaaactccgaactgtgctttgggcttatgtcacggccaatgtttggtcggaatttggtaattaatattttaattgaaaaatatttatgtcaaaatgcttcagactcgcctctgcttttacctcagcgaccaattgaatgattcgattttggaagctttggccaggcatttcttaatcacgaacttttcagttaaatcgctcttttcagttttaaccaaaaccttcgcattatttcgatcgtcgaatgcccccgggtcactgatacggtatttaatgatacggtgccaaatgcatttgccaatatcatttgtaaatatagatagcatcagttttcattactctttttaaagattgtccgtcaatttaaaatttgtattaagcaaaataatgtattaatttttaatcataaattattttttaattaattcttttatgattttttcaattcattccagggaattgtcagcgtcactctccgccagaataaactcgtctgcctcgagttagtcggaattccgctgctcacttccaatgcgctcaaggctgtgaattcgaaccgtctgagaagcgtcgatttgagtggatgccgaaaggtgattaattaagccaggcaaaacgcctaaaacacggacacgaacccccccccccctccccaaaaaccaggcaaatgcccgatttctttgataaaattgaaaacatttataaaaaaattttaaaaaatgatcacattttatattccattgacttatctcagatcgcttcagaaggcattttctacttggtgtttaataatccgtcaattgttagcctttgtttgaatggctgcaggggattggacgaggtgtttcttctttgttttcagcaaccattcgttaattaggccaattattcagcaagcactttacgacatcgcgcgatgcatcggcgaacgtttgttccgtttggagttggaccaattgcacaattcgaacatggccgagcacaccgaggccatcagcagtctctcgcgccactgtcctaacatttcccgactttcactttgccaatttttcccggttggcgccttttgttcccattttttgattccccccccccccctttcccttaagtcctttgaggaagatgaacagcaagaggagcagccgccatgtctcatcgaaggcaccggcctccgtgacgtggatttatacggtgggaatggcacaaaatgccacccaaaccaaacgaatggcatttcacttaaggcaacttcttctgccaacttccccgccttcccctcaccatttattcaattcgtttgtcggtgacgggccaagagaacgttcagactcttctcgactccctccgggagcagccgcatttagccaacattcacttgcagttgcattgtctcgaggaggacgcagtaaacaaattttgacgagaaatttgacaaattaatcataataaccaaaggaattgttttagaattccgttgaacgtgccaattccttcctttgccaatttcttccgttaatgggcaccaaaatcactcggcttcatgtgtgttttgcaatttatttagtgaattaaactgatcaatgacaaattacagtatcctgcctgtttttcaggttactgtccaacgcctcgtcgactcggcctttttggttcattgatttgatgtgatttgttcgttaattgtttctcgttcagctgatctctcaaattccttccctcagccatttggctttggatgtcgcctttttaaatgcccattttctccgccgtctcttcgccggcggcgttcattctccgggtgctggtctccgttccctcagactttgccgacttcgcatcacttaccgggcactgttttcgattggccgatgggtaagtggcgcggcagccaaagtgccctcatccttttaccttgataaataatgcggcattgtcaaacaaattcccatttgttttgaaggcccgttcgcttgtcgacttggaaacttcgcatatgccagcggtggacgaccgttttttggttttgttgggaaagaattgcaaatatttgcaaaatgtgagctccgtcattccaggaacattgctgttgtgtaccggcaattttaggttaatttcaacggatgcaaatgggtgacagacaaaggagtggcgagtttggccaggtaattgggaaacaattaaggcaatcccgagactaattgtaaatgacaacatattcaggaattgcaagcttcgagaagtgcggataaggtaaattaattaattagtggggctggcaataacaaatgtttctttctgcagaggcacttcctgcaccgataagtccgtctacgcatttgcacagtgcgtttttctgggatttaatgagtcttaaattagttaattagtccatcattactttaaggttctgtccaactctcgaatggatagcacatgccgatttcagtggaaggccaaatttcagtgacaaagcattgaaatgccttcgcgactcgtgcattcagagagtcatttgctgattgacattcattcattggcaaatgtccaaattttcaacccaatttgatggaattccttcttcacatactgtaaatatgttacttttgcataatgcgatggatagcaaattcattttgtaatggcattgacataatttttatttcccctgaggcgccttttgtcccccccccccgaatgtttttcgcctttttaatggcttttccacttcactgccgtgcatcccttcctcatacatttggccaagtgcatgcgctcgttcctcctttctaatggaaaatcgatcgctgctcattcaaccgcgcgttctccaattatacaacgggtggtgttaaattccaagaaagccctctccaaacggcatttttggcactggaatttcgaaaattcattagtgcctgtgtcgtgcgaaaaggcagacgcgccgccagcaacacgaaaattgccagggaacgaagcggcgcacccaaacgccgggggggggcaaagagacattgcagtgagaggcacagagagaagagacaaatgggaagggaaaagcgggaaattcgcttttgcatgagaacaaaaaaaggtggggggggggggaaatggcacaaaaaatgcatggaattggttaggaaaaaagcggctaaacagagaaaaaagaaacattgaaaaggaagacaaaggacaaacgataccaccagaaaagaacagcatttcatgttgtaacagaagcaacagcagcagtgtcggctgttggagacgagtgagtgtcgctgctcttcggcgctaatggcgaaagacccccctttttcacttcactccccctccctctctca

SEQ ID NO: 9831 - DNA, 2400 bp, Heterodera glycines
atggaaagagacggacgagaacgaatgggataaaaagaacggatttaataaatttatccgatcagaaaaagagaacgcgaaaggagtgatcaaaggatgaccatgtcgaggataaaggatgaggatgaaggattaccatgttttgtgagaaatgcccacggagacagcgcaaaaattagcgaaaggatatttttttaaaaatgaaagcgaaagcaaacgaaagaaaggcattaattcggagtataaaagccaattagcatcaatataagtcacattcgtgcgatttcttctgctctcttccaaatgttcgccttcgtttgccgcttcgttctgccgcttttccttttcgcccttttggcacttcccccggccaatggcattggacttcccatgcagaaaatggagtgctgccaacaacagcaaatgtgttgtgccgcaccaatgcaatgcacgccatcgtgcggagggtgcggacggcgccggcggagagaggcgagcgattgagaagagagatgttttaacagttcgaatttttaggccgccgttcagccgctgctcagagggaaagaaacgccgtgcccacagacggagtggcaacagctgatggaaaatgtgggaaaaagtgctaaactcagcagttgctaacccgggacaatgttaaggcaattgtgccactcgacgacgtccaatcggtgaactccgtccaaaaggcgctcctccgacgctttccggacaacaaatttttggtgatgtgcgcaatggcgggggagggacgcgcggaaggcaaagagccgctgccaaatgaggtgagccgagaaatttggaggatttaaacaaacaattcattgccttttcgtctaaaatccgtcgcttatttctaccgtatgctcaggtccacctcagctccagtggccacgggtactgtaacgtggtcagcgaacgcatttggtgccaagcggccgcagtcgtcggctgatggcacttatttattacttgtttattgatgttcagccctttttttgctttcatatttattgttattaataaaatagataaatatgatttgtatgggtttttaatatttctcactgtgagaagaacactaagcaaaacaattgttaaattattattacgagacagtttctcgactcgaccaaccgaaacccaactttaatttttaaaatttttgttaaaggaagtcaaacttaattaaatataaacaactttgataatttattgttttaattttgttctgaaataatgatttttacataaaaacaagattgaaaaaattaatcgaaaacgaaaaaacttacttatacttacacgaaaatttaatttataacaaaaatatcaaattttaagtgcccaaaaaataataaattatttgaacactttttaattaaggttttatattttaaaatgggaaaaaataattttatttatttatcactcaataatgagctttcaatctataaaatgctttttaaatgaaaatattcgattaagtttaaaattttttatgaatttttatcctacatacgattgggcatgtctccgcggttagccgacttttgcgccgcgacatttacaccttatttatgtgctttataaaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggcggattttaagcgaaaaaaataggtaaataaataagggcataaaaattgcgaaataatgcgaaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaagtgtcgactttgctgagcggcgcaaatggcgcggcgcaaatggcgcggcgcaaaagtccatttttgctgggcggcgcaaatgtcgcggcgcaagtgtcgactttgctgagcggcgcaagtgtccacttttgctgtgcggcgcaaatggcg

SEQ ID NO: 9832 - DNA, 2407 bp, Heterodera glycines
tcatatcatacgccgcatatgatttttaggggtgatttaattgaaacagaaattttgcgtatgatatgacactgtgtcatagagtcatatcgcagatatgacccgaattgaaataggccccaggggtggagcgcgtacagaaaaatcccacggtcgcgcatcgcagattcaatttgccgcggtcgcggatcgcggtcgcgcatttaaaaactcaaaattttccaatttttaaaaattttattttaagttttcttatataaaaaattaataaattcctgtgcataaaaaatttgcctgggtcagtgtccaaatttgtgaagggattctagtcatgcaaagatttagagccggggtaaatgaccatgctgcggtccccaactcgcaaatttgttcaaggacacatttggatgcaaatcatattggtttttggtgccctgcatatccaatggtatataacaacacatatgcattttccgagttcagttcgggtgcttccttgtgagtcaagaattaataacacattttcttttaagaactgaaaatatgtctcttaatcaattgtgtaaaaagggttcccaaactttttgaagtccatttctcctgggaaattggcaattttaccgaacatcagctgaaagcgtgagtacccagtgacttcagacggagaatatgtgttaccagattggaggcggaatttgcgtttgtatgtggaccacataccctcgatgttttgggtgtgaacattttggtggttgggattatggaaattttcattatggtttacagtataatagtataatgttggtacccctggggcagattgggaatccccccgcaagccgcccacatgtcgctatcaattatactcccaggagcatgccgcgctcaatttctccgaacagccactcattcatattacctaccccttaaaccgcagtcatgataacggcctaattctatactccaaccctggcccccaatttggatcgggggtcggacatacgtcgcggagaaagatttcggaatcgttctagggccattttttggggcaaggaattggttcgaaggaatgatccattgctgacagccgatgaagcaccgacaaccccgcaccctaccccggggggaaacaaaagacgacacggcagcagcgactggtaaatacaaaaggcagttaaaaatgcagagcatggacacaagtcagcagattttgaacggagagacaaacgacggccaatgaattgccattccatccatttgaatcaattttggacaataaatgtgaaatttgttgaaaatgaaaatttttactttttgttcgaattcgggtccggggttcaaaattagtcgaaatggatgtcggattcgtgatcagcgaccccaaaaaccataggaggcgtttttatggttttttttaaatttttttttttcgaaaaatgggggggcagggatggcattccgaggccccaacaattttcggaaatcggaattccgggggtcaaaaaaatttcggaaatcggaattccgaccccaaaaaggtcggaagtcggaaatcggagatttttcaaaaaatataaaatataataaaaatttataaatattttaatcgactaattttttaaattcttaactattaaaaggttcacattgtttttttgcggcgcgcttttttcaaaggattttggtgaacaggggggggggggacaggcgtccggcggtgccgataggcgcctccgaaaaattttttgaaatttcagtgcaatttattaaagaaattgtacaaaaattactaattttttgaaaaaaattcaaaaaaaatttccgaaagtttccgactttttatcaaaaatttcggaaattggaagtcggagttccgacgaccaaaactttttcggaaatcggaatcccgacctcaaaaatatcggaagtcggaaatcggaattccgtgggcgacaaactgcactattaccgaaaattttcgagactcgagaaactgagactgagaattggtcccagaaccaatcttttttttttgttggagacggatagccaaacataaatcaaattctttacaaatgataattatggaaggtaatgcctgagtaaatttatgcaatgtattctttcttttaaagtcaaaaatgaacaataaatgacaagtaaatcatttgctcatcaacggtttcatttcgcactgatcgacggacaaaaatcactcaaaaagtgatcaattgtcagacggcggtcggttggcggggcggttaaatggcaatggcattcgtccaaaaaagggcaaaaaggcaaaggacggcggcggcggtgccgaaccattggacgaagaggggccaaaaggcactttaaatggcgacgttcgtccaaaaggaggcctaaagccgaagggcggcgg

SEQ ID NO: 9833 - DNA, 1186 bp, Heterodera glycines
gcaaaacaattgttaaattattattacgagacagtttctcgactcgaccaaccgaaacccaactttaatttttaaaatttttgttaaaggaagtcaaacttaattaaatataaacaactttgataatttattgttttaattttgttctgaaataatgatttttacataaaaacaagattgaaaaaattaatcgaaaacgaaaaaacttacttatacttacacgaaaatttaatttataacaaaaatatcaaattttaagtgcccaaaaaataataaattatttgaacactttttaattaaggttttatattttaaaatgggaaaaataattttatttatttatcactcaataatgagctttcaatctataaaatgctttttaaatgaaaatattcgattaagtttaaaattttttatgaatttttatcctacatacgattgggcatgtctccgcttcggagcggatacacccgcatatgatatgcacaagggaaggggtgtcatatatgacggcgtcatacgtagaaaagggagttaattgaaacgcgcatatgattaatccgtaatatttttgggtccaccgcacgacgatcaaacacaatcaaacgaccaaataggcttacaactttaataaaattacaccaaacaaaattaagtaaagtcggaagacgagatgagaaacaatcaattacgattaaaaccaaattttccggaggagaccaaaaaaaggacaaaattgaggagaataatacacgaatgaaaaaatgagaatgaataaaagaaggtcaaatatcaaaagtcaaaacgccaaaacaaataaaaataggcacaaatttaaataattaaaacatccccaaacgctaaaaagaggcgtccctgccgtggcaattagaaacccgcgcattcgactgtcaaaaggggtgttcgtttgggtgtagagctcactgccgacgaaagccgcgcacgaaacgacgtccacccgcaccagagaaggaagagttggagctgtggccgcggtaaggatgcatgcgcatgtaaggaccggacacaaggcggtcgtctcgacccaaccctgatcgattagacaaggcacgtgatggaggtcggtcgcctggacccaaacccccacgttggttttggcggacgacatgaacagcagaacgaagcgaacgaattccaagctctt

SEQ ID NO: 9834 - DNA, 3840 bp, Heterodera glycines
tgctcccggtggtttaacggtggggcggtccgctcttttttcattatatacttgatggccattcgcaaattgctatgcgccagcggcttaccgtttgcggtgttaattgtattcacccgaacacccatacgatcggcataatggttacatttgagatataatcgttctattctctgtgtcatggtcagttgatttgacggaatagcaaacagctcacgttgctgttgttgttcttcttcactttgtgcagatgttgatggacctggctcgggcgagtactgtactcttacccttctcggttgcctcactcgttttcttatgtgcacctcatcatcatcattctgggggtaggtgcgtttggtccccctcctaggcggaggaatatagggcatttcttcgacgacaacagctggaggaggaggaggttgttgttgctgctgctgtaatggcttttcttcaatttttggctcttttttcgggatacggtatggcactggcctctttgtaggttgcaactcatgttttggctcggttttgattttcgggggcgggaagtacccggcttgcttcgatgtggatggtcgtgggtcaacttcaaattttggttcctttttggtgaagtgacgcggaggaggaggaggaggagctagttcaactttcggttcccttttggagacagtgcgaggaggtggaggaggggcgagctctatttttggttctctctttgcgcgatgtggaggcaatggtggaggcggtggcgaggcggattttttcaactttgttggttgtggatcccttttcagttcaactttgggtatagaacgaggcggaggagggggatggtctggtcgtttgtacacgggtggtagtgtgggagatggtggaggagaatagtaaattttgtattttttgtttttatctattccctcctctcctttaatctttcttctgcttgcaagtctttgttgggcggtgtccatttcctcaatttcatctgcatagtcaggcaatattggcatgtctccataattttgtgatggtgttggcagcagatacccaccttccagcatttgttcatcgtcatcgtcactttcaggtaaaggagcagctgctgcctcagcgagtagatcacgtactaccggttgttgttgcaagtcacgacgcctttgcttccattgattcagccgaccatgttttatagaagattgatggtttttctttgttctttgaggacgtggtggacgaggggggcgaggcggatgactatcgtcagatgaggaagactgctgatcgggagggctgggatggtgacggtggtattgatgaggaggtggaggaggtggtggtggtggtggtggagcgggaggccgtggctgagtgttgacgacttcgccgtcgtcatcatcaacacccccatctcgcttgagcaaaacactcaagcccttggttaactcaactttggtaggtctatcggcaagctcccttctcatttgcagataacgcctaagctgttgattgtaccggacattttttgttgtcggattagtccgttcacgcctggcacgctccaggtcatgccttaccgcatccaaattaatgactcccgtatccgacgctgaggttagccctcggtaaatttcttgtggaacaagcaaaaatttattagccattttgcaaaaatgtgagcgtgaacaacaaattgtggggtatttatgcgtttttggtcacaaatgatttcgctacttcaattagcacgggtgttaggagggcagcaaacaaccccccaaatcccgatcctttctgaacaagcacacgtctcgcgccgcgttcacttctcgatctgctcatccgtcgcacagtctcaacatagggcatcaatctttttttctgtcgtgtagtcaatcggaaacgtgaagcgacgagattcagacaaatttccactagcgctaatagctgatcgctgttcgcgtgacgtaaaatcttcctacactttttagaggatttggtcctcgccaaagcatacagccagtccgagttgtcttttattagctgtcctatttttatctgttgctgttgttgactaaggtcctccatttttgggaatgaacacaacaatgccttcgtcttcctcctgctcttccttaaatatgtttgtgcgcagacgcaacgatgggtccgacgatgcatgcatgtcgatcagcaaatagccgtagggacgggcggtcgcttgacgatacgcatccagaaagaagtcgagctgacgcgggaaaagttggactccaatatttctgatggacaacagagagttgggtgctcgcatcagtaccaggtactgggaggataggcgcgccactttgagcttattctcaagctaatgttgagtgacaaaaactgacacaaattgattgtggtgggacagtttggtgaacaaatctgccaggtcttgttaaaaaatcttgtcagaacaaaaaaaactttcgtcaaagggggggggtaccatctacagtattaccaaaacatgtaaataaaagtcccaactttttttcgcaaacacaaaatgaaaaattttctcctactcattaaaattttagagctatttacataaaaaaggaagccctaataatgaatggtccgagactaactgtctcgggaaggaaaagtcccgcattgattgacttatctcgatttgagcttaaagaaaaataatttctgcaattgcagcatcgagagtctgctgaatggcagtgtgcagctgctgatcacttccgttccgatcactggcaattttttcgtctccgcccgtcagttgtccatcacggcactgttcgacctgcaaaaagaccagcacaaagtgccgtaccttcgcattgccacctgcgagttgcgtagcggaatgattagcaccaaagtgacaaatatgggcctgctcacagaaccgatcaatttgaagtacaaggtgggacatggccaaacaaaaagtttgccacttcgatttgtaatggttttaaaaattcaaatcgactaatcatgctcagattttttataaaaagccatatatttgggatgctcgagaccaaaaattcccggagactcgaccccgagatccaaaaaatccgatactttcttttctcgagtcgagacagggactctcgagaaccactaatgtttatgttatatttgctttaagcgtggcgaaggttgccttttcatgggcattttgtaaaaaaataaaaatttaaatccgaaaaatgatttttggctaatcacagatcatatcctcgtttgtctcctccgattctgacgactgttcttcgtccccgccaattgctgctgcagaacaaaaggaagtgccaactttgttgtccggcgggtatggcaaatccggcaaaaactccaaggaacactttggccacaatggcacaagcagtgcccgaagaaatgcactttctgcggaatgccatcctatcaatggcggatttcaaggagaaaattcgggtgagaaaaaaactcgtaccgtagccaaatggtccggtaacgaatggtaggtacagtaatcaactggactactgttgaggaagcacaaaacttacggtgggcagccacaaagtgttggagacggccaatttcgcactgtttgtgtacaaccgggagattgtgctcgccatcaaataccatgtcagagtgcgcattttgggcgacgatttaaacttccttcgtaaggtgaaagacgaaaagtaaccggggaattgcctacggtacttttgaccggggaattggttacagtactttttctgggatacgatccaagcggaacttgaacagagttctaagtgtaataaa

SEQ ID NO: 9835 - DNA, 2382 bp, Heterodera glycines
caccctccgccggcatcagtgccgccgatgaacaactgcaggcagaagccgacaagcagcagagcaaggcacaatttcaaattgttgatattcattgaatcttaatattattaaagaaataattattgtatttttaatatcgaatgaggttaatcagtgggtatttatactgactgacttgccgcttaaatagttttgtatatttatcattgatggtgagtttattaatttgctgaaattaattaatttaagaaacagccaaggggcattttttatggtcatctaattgatgttcagtttggaaatgaaaaatacacttgcccttgatgagtgaaatttgaaacaaaaaaatgtacaattaggtaattggtttgacatattatgcaataaaaaacgaatttatttacaaatgttgcatgatcattttcaacttaattcgatcatttgaaaattctgttcaacaaaataattaaagtgaataaaaaaaggaaattttaacccatccttttaccattttgtgaattaaattgcttcaagagtttatacgtcacaaaatatttgatttaatgaaaataattccatcattaatgatttaatctgctgagggtttggacgaaaaagggcgaaattagtcatgcattctattgaagaaatgaaattgcatttcatggctacccgacatttgaggacttgacatttgaggacccgacatttgaggacttgacatttgaggacccgacatttgaggacttgacatttgaggacccgacatttgaggacccgacttttgaggacccgacatttgaggatttgacatttgaggacccgacatttgaggacttgacatttgaggatatacacaatttcaaaaaaaaatgaatgaaaatcattataaaaaagagaaaaacctttcccaagggccaacgggtgcaatgtttaaggacaaccgaataatttaaatatttgacagcacaaataatgatttcaaatttaattttggagattaacagcctttttctttcttaatgatttacaagtcatcctaatattcaatttgctcagactaacagcaattgaacacgatataaattataccagctgggaagctcctgtcaatctttgatcattttggatcgcatttaacacaaaaagtttgtaaattaaaatgtatttaaagatatatgaacttttttgcctttcccacaaaaaaatgccattcattagtgatgtgaaaatctttcactccaaaagggtgaaagcgaaatcaaaccctgctggaaactggaagtctttataaattgaaaatttttgaaaaaataaaaatgtaataaaattttaataattcattgattttcatgaaattattctaatgcgatttgttaacagattttgagaaaattttttcaagaaaatatatatttttagggtcgggcggtttttatttttttataagtagccctaaataaaaatgttctgagaaaatattttgggcttctctcgccataataacgcatagaaaaatatgatttaaaattccgggctctgttctaaaaacaaatctccctgagttggttcaactcattcaatccgctctcctttcttcagaacaatcattaatgactctgatattaaaaagtattataaattcattcttgctttgacttgtggtcctaacaatgattccacatgttaatagaaaaaaggggatcttcatgaattaccaaaacacaagtactatttaatgaagtagttaatcttaaattgtttttgaatatgaaactttccaaaataatcaaagattgataagggcttaccagcatttggtacaatttattttttgcttccccggccctcgggaatagctttttctctttttttataatgatataaataaaattttcattcatttttttttgaaattgtgtatatcctcaaatgtcgggtcctcaaaagtcgggtcctcaaatgtcgggaatatccgcaaatgtcgggtcctcaaatgtcaaatcctcaaatgtcgggtcctcaaaagtcgggtcctcaaatgtcgggtcctcaaatgtcaagtcctcaaatgtcgcaccacggaatcatttacccgaaatcggaatttgccctttttgtcgcatttttggtccgtcaattggtcgagcaagtccggccagctcagtcccgggtttgtcatcccgtttctgcacgtgctgctgcatgacgattccagcgacacattcgtgtcaacattgtagaacacttgacagcagttgagacctgtattattaattattaattatgaatattaggtacttttccgttttggggccacagattcaaatcggtgcgaattcctttggccagaggactgctaatatcgatgtatggacc

SEQ ID NO: 9836 - DNA, 3227 bp, Heterodera glycines
ttataaaaatataaattttattcatttgacacatttataccctccccacaccaacaaaataattacacaaattgagatcaaacattaggaattttgcgttttcaagtaaaaattaagctcggaaccactttagaaaatttgtaaattcgaaaaaattcaaaaatctaaagactttggttaaagtggcaccgatactaaaattgacaaataatcaaaactttcagcacttcattaatgggatatggtcgcccactttcgttggcatcgctccgtcgtcgccgatggcgccgtaatccgtcaccgaattggtgcgcgagtcggccaatcgtcggaaaatgtcgtccaccggacgaccctttgtctcgggcagcaatttgagcatcaacagaaggaccaaactgctgaacgcggccaacgggaggaagaagagcgcaccgatggagacgatcagtgacgggtaggcgagcacaatgccaacgacgacaaagttgggcaaaagcagtgccacctgtgcaaatgggacgcgatattctccaatgttgcgtgacaactttttttctattttttttttttttgctgtggtgccctttaagaatttaattgtcacggtttgaaaaaaaaatgtcgctggaaaattttgaaatttggtgtggtgtaattttctaacatattgcccaaaagaatctactgttgttttttgaggatttttgatcaaatttggagtgatttattaaccggctgtacctattggcacagtaggagaaaaataacgaattttggaattcataaataccaccaaacaattattatcataaccgtacctgagtggctctagcgcgtgccgggtgtgggaacaattcacccacgagaatgggcgtcatgttaaacagccccaggttgacgctcgcttggcccatcgtacacccgatcagtgccattgacgagacaaaaatgccaccgcctcctgaatcaattctgtttttatagatcgtttgctttgttagacttaccgagtacgtcatacagtagctgagcaaccgtaagcagcgttagctcaagcgttgacagagcagtgatcagcaggaacaatggacgccgtccccaactttcgatcagacacggtgccaccaaacacaacggggcggtcagtgcggtcatggcctagcaaatgggaaaacaattaatgtaatttcaaacctaattttaagagaattataatttattatgcaaaaaagaatcaaaaatgaaaattgattatcaaaaatttataaatttctcccattcaaaaccagcggaattctccggcctattataaatattaatttatttctgttttttatttaaattaaattcaccattgtgaagactagagactcggattggcccaacccatagcgcatcagcatcggctccaagtattggctcttcaaatttatcagcgacaaggcgggtactgaagaggccagcagtgtaatggccatggaccatctgataaggtaaaaatcctttttattatttaattgatcaatttatgaattttttttcaagcttacggcaatatattgaatggtaggttgtttcgtaaaatccactaatttggcattttttaaacaaataacgtcctaactttgctcaaattagtaaagtttaaacttcttgatttcgatagctattagcttcaaaatttcatcaagtttaaaaaatgttatactgatttttggaatttgttgattattgttttctgaagctggacagaatgtttaacatttcgcaggctaatagatacttataacgacagaatgaaaaagttaaattttgttgatttgagcagttaagttttgttgatttgagcaaagttcttagaatgatttgtttaaaaaaaaattacaaaattggcgattttacgaaacaacccatcactcaatatatggtattatttatatggtagcccaatattttggtaattttccaggaaaccctaaacgtttaaagttaacctagaatgcctaaacaaaaagccattgttttttaatggactccacctcaatcgatggcttgtccaaaactcggtccatcccactttctcatggtgcacaattagacgttcatgctcaaattcgtcaaagagttcggctaaatataaaagaatattaatataaattagtgtaagagtaagctctaattgccataattagattttcaaataaaaaactaccaaggtttgcgctggagccatggtaaaacattgcggactgtttggcctcctccttggcaccgttgccgatgtacagttgcttgggcgactctgggaaatgggcggcgccgaacagatgaaacatggccatgaggagacagccggctggcagcaaccaccaggaccaactgttgccgaacaacgccggcaggcacaacggggaggccagcaacagcatgaggttggcaccggagccaattgcggtcgaggaccagcctaacaaatgagtggattaataggcaattaaaatttcaaaaataaatactgtatttcttgtattagaacccctggggactatatttttcaactcccctccccttcaaaagggggctttatttcaaggggtagggctctaatttatgggggggggctatattataggaaatgcggtaatgaatgagttgggatgtttcgggagtcaaattctcgagttgagaaaatcgtccaagactcttgcagtctcaaaacgaataattcccagtcgaactaaaaattggcaacaatcaattagcgaatgcttttttgttattcgaattttgtgttagctagctcaaaaacaaaaccaggaactttcaaaaacaaaattaaattgtgcccacctctcgcctggtccggagcacattccgccacataaatgaacacgaccgttttcagcgcagagatggcaccggctaaaaggtgtccgagcacaaacaattcggccattccaagccatttggccatcagcatggccagtgctgcaataatgccaagagaagagctgaaatgggcaattaagttgctaactaaatttcaatctttaccgtatatacactgcagtacccttgcgcccgtaacggtccatacaccacgccatcatcaaactcgcaatgatcgcgccaacaaagaaagactaaaatgttttttgtaatttaattttaataatttaagtcgaattttaatatataaatatttgttatttaatttaaattta

SEQ ID NO: 9837 - DNA, 3070 bp, Heterodera glycines
  misc_feature (7)..(8): n is a, c, g, or t
  misc_feature (26)..(27): n is a, c, g, or t
atctttnntaagggataattgacatnnttgcctttaattgccttgccgcgtgatccaaaatattattatttggggttttgacgaacaaggaaagtgaaaagcaactcgtcacaccgaaaagcgggggaaagggtaaattgggaaggaaagcgattggtttgacaggcgacttttaagcagccaaaagaaggggagggaattggttggttccatctatcggagcaaaacggggcaacttttccccgtcccttctgttgcgtttccaatcgccgccattcctcgctaaaagcaatagaactggcgacacaaacagcacaacaaatgtccatttctctgtaaacatttgtccaaacattccatttacgatcggcgcgacgctttcagaaaacgaagccaaccgaaacccaaaacatttgtgccgttggactggccataacagaagacactgacacgacaaaattcagtggcgattcgtttttaaaatattgaaacaaattattattttttaaatgttaaaagaatattgcctatcattttgttttgtgtgtcggtgtttgtttagtgagactggaactgcctttattactggacattgttttattttatttttgtattagaaaaataaaatggaaaaataattaaacaaaaaataagtggtgggggcgcatgacaattccagggaaaataggcgaacagttcggcacttcaaatgaatcaaaaaagggatggatggccttgagagggattggactgaaatgaccgttggatttgcaggtccctttcacccatatattctcattgttgttttcattgtgccaccactaataaaatgtgaaggccgttgaaataatggaggattttcaggggagaaaataagagaaaaaatgtgccaaaagtaggaacagccaactgaagaaagttaagtagtgaaaagggtggtaaggaaacgaattgagacataaacataattaaactgaatctacggaaaacaaataattaagtccgataagaaagagttgatgcgtaattcatgttcaatgatcaacttcatttttgtggatcctgaaaagtcgagagcaagcctcgcgcaactttccccagaacaagtccctctgatcgagcaacaaactctcatccccggcatggtaaaatttggcatggcgaactgaaattcaaaaatttatttaaaataaataaatttgaaagttttgcccaccagcgtaactgcgaaggtaattctcgaagggtttgtcacaactgacgcatttgtaaagagggagatgtaaatgtctgaaaaggaagattcgggtggacgaatcgcaaccgaacaacttggtgttgacgtggttcagcagaatccattcctggttgatcactaagtcgccgcaattgccgcatttgatcgaattctgcactttgtttcctccttcgtcatgcgcttgggaggccgacgaagacggaatcaaaccgacggagtcggaagattggcgcacgattggagaggtgctgcgcttgtcaccaccgcctcgagcgatgtcgactaattgagccaaaattgtgttcggagtagagtggccaccaactttgtctaaaaagtgatgaaatgtttcgaagtccctcgcccactcctttgctgcaaattcggtaaaatttcattttttgtggtcaaacccaccaagttgctcgtgttcgttgccctcctcggccgtcgtctccgttttccgctgtttcacttcctcaaattcgtccccactctccgccgtctcttcctttgcggcatttccgtccaattcaattttctgttcctcaataccgctcaaaatatgttcctgaactgttgggctattcgaggcggctttgccagggggcaaattgaaatattcccgacggtgacgattcaaaatcgggaagattctaaaatcaaaattaatcaacacatcaaacataattaaaccaagccctagtgccccttttcttcccacctttccgtgttgttctcaattaacgactcgtcccctccgtggcgtttggcgtgtcgattagccgccggacgattccaaagaaattcctcgccacactgtttacacttgaagattggcaatttgagatgccttaaaaaagtgatgcataaagtacggtggtgaccaatgagatatttttaatcaaaaatgttttaaatttgtgtttttggcttgcatttcttatttagctttacttgacattgacgtggtacatcagtgaggtgcttctgttgaccaccatcgctttgcacacatggcattggaggggcagcttctgtttcgccgatccaatgccgggcgtcggatgggcgactatcgaagcgatcggtgaggcgacggggacattcacactgacaatgagagacaagaataatcacgcgggaattcgaatcagaattgcactgcacctgtgctgctgggtctttccaattagccccgtgttaaccacgttcacgccggtcgacccgactccgagcgccggcaactgaggcgatttatgatgcgccagaagagcgcccaagtcgtgctgctcattcgtttgctgttgaactgcgattttctctttaaagtacaaatgaagggagtcccatcacacactttcctttctctcacccaatcctttcgtcgccccattttccacgttctgtgccgcgatgtccgccgcgtacaattggtcaaagtgggacatcacattgccgtccatgtccgttttgatgtgttccaagaggttgcccattagactggatgtgcccatttggtcaaactcgtggacagaatcttaaaatgcagcaaagtggggatgatctaccgatttttgatgatttgtttaaaataaaatgtaattagggtaatactggggaatctgggctccacccaaaaaaatatttttctgatatgaaaagaccaacccgtgggttttcggggctctgataacgaatacaatatcagatttgcgaaaatcagttttattgtgttgaaatcatttcagaaaatttgtcaaacgtgtcggggtggatttcaaaattctgagttatcagaagccccgaaaa

SEQ ID NO: 9838 - DNA, 1480 bp, Heterodera glycines
agccggcgaggaatggcaaatgcattcgctccaaaccattcgcggaccttttgcttcttcttcgtaaatttcgcgacagaccctattccgaacctgaaaaaaaaataaaaaaacattcagcaaaatattattttggagaattaaaattaagtaaaaagttatttctaaagataatttgtatacaaatgcattttgcataatcatttatttgcccaaaattcagcaaagaaaaagtttttggccttaaaatttcttcaatttttatttttattttttgttgtattaatacaaaataaattgatcgaaaatctgctatttttaatctataatggacttatcaaaaaaagatggaatgcaaaaatttggaacaatttattgatttgttttgccaaaatattatcttaatattatgtccgtttatgtaaataaaaagaaaaatcaaaataggtataatattttcccattaacgctaaatttcaataatacaatttttcaaatagaaatatttcttatgttcgtattactgaccaaaaagatagtccaaattaaaaattgaaaaactcacgaagtattcggataagccatggtcctcttcgtagtggcgttttattgcaaattctgttgggaatttggcaaatttgcacttttcgcattcgaaaggaagacactgaaagaataattgttattaaaggaaattgttgtcacgaagaaaaatatgcacgctttcgatggttgggagaaaaaagaacaaaacattggaggtaaaaaaaagggggggggggagggaaatgataaaaggaattattggaaatgaaaggagaaatgttatgaataggaaagaaagaatgaatgaataaacacgaccactgctgatatgtacatatatcatcaacacttatttattatacacagcacaaaacgcacgttaaaatggtcagcagaaatgtgcgcctccaaatcgtctatgctggagaactcatcagaacaaagggaacattttgccgtcagtgacattttgtttaagctgaatacaaacaaacaaataatgtgataattagcaaatgcatttgagttttgttttgcttttttcccgtttcttgagtcaaacgacaactttagatagagtacagtatgcattttagtcaaattaccatatatatatttccaaaataaattatataaaaacttttaaatttaatttagtaaattagagaattagaattaatagagcagtaagagaatgttgacgctgtgggttttatggtagaggagcatactgacatagaatttattgtggtgcggttgggtctgggcggacatcatgggcatagatcgatattaatggtgtagcgatgttgtagaccgagagagcgatataccggcgatatactgagacactgtgtaagtaagtgaaataaaaataggggaaatagaacgcatagagaagatagagcggaatagaaaatagagcggcagagag

SEQ ID NO: 9839 - DNA, 1234 bp, Heterodera glycines
ttctgcacattttgttgcccgtcccgaccaaaacggagggaaggcaagcaaagaacggacccctctctccccgcttcactcatcttcctcccacttatcttcttcacttcacttggggtggaccttctccaccctcttcgccatttgtcatatattcaaaaaagcactttgctttggctaatcgtccaaagcgtgtgaatttttttttaaattcttattttaaatgagacacacacttttgctgaagatgccctaacaattctcacgaatgacataatttagctaggaaaataagcacggctattgtcatttttctctgccaatttaaacaaaaattgtacccctcgaaatatttttaattaaaagaaacatttgaccaaataaactgccggtatcaatcacagttttacgccataaatgcaaaataagaaacagaaaaaacaacacaacgaatgcttaaatatcaatgaaatgcatttttgcgattatgcttctcatcatcacaataatttatcaaaccacaggttcacgtgcaactttgaacggttcactgactgttagctctgaaaaatttaatgctttttaagtcagaaaacatttgtgaattgcctccactgtcaacgatcacgacgtcttttttgggacggtctccgccagcagtttcgccgtcttcgatttctctaacaatgttcatgccctcgagcactttaccgaaaacaacgtggcttaaagaaaaacaatttagaattaaaacttagaaaagtaaaatttcaccgtccatccaaccatggagtatggacctgagcaaagacaaaacaaaaattaaaaaactagcaaaaacaaataaccgtggtaatgaaaaactgggatccgttggtgtcagggcccgcattggccatactaagcctgaaaaggcgaaacaaaataaattaagcaaatgtcctttctaaaatattttaacataaaaagttgctctagtgcactttagggatcatcttcagtttcttaggtcataactttttttcttacttgatggttttttataccttttgatttaatttatctaattcatttatacctttttttgcctacatttttgatattgcgtaaaattcttatataactaaataatgaaagcaaaaaaaattcttattgttagtatactcgaaaatgagttttatgttttctcggcggggtttttcgttttaatgccattatttgtactttttttgta

SEQ ID NO: 9840 - DNA, 1073 bp, Heterodera glycines
cagggctcccagatcaaagatttcaaaagcctcatttcgcaggcaaaaaagcctcattttggatcaaaaagcctcattttacaaaatttatccaaaacacgcttaaaatgttcaaatgttatatttttgattgtctatgatcaatttgagcaattttttgttagaataggtaagcattttatgaaattctaagcttgaaaaaccgaagttggtttttttgcggcgcttttccaaaaaacttttggggaacaaggggggccggcggtactgataggcgccgccgggaaaaaatttgtaattttcaaagcgatttgttaacagattttgtccgaacaataaattaagaattttgactatatttttagcagattttcattgaaaaaattcttaattttgtgattttcggaaaagaattgattattttctagtttttatgaagaatttaacaaaaaaccacaaaaaacctcaaaatttctcaaaaaaccacaaaaaacctcaaagcctcatttgaaaaaaaaacctcattgacctatcaaaaaaccacaaaatgagactaaagcctcacatctgggagccctgactgtaaatccgcttactattcatgatcggagttctcaatgaaaattttcaaaaatcaccagttggccgacgcaaaacgaagatacaattgaaatggaaattgaaaaagtgtccgaatttgcgttggaggaggtgggaagagcgattaagcgatgccatggaaattgggggattttcatggaaaatatgggcagaaatcaaaagcaaacatgaaagaaatcagaaatggttgggcttttacctttacaacaatgaccataaaaatggtaaacaaaaaaacgctgatgcttttcgtaagtctgagataaaaatgattaatttcattaaaaaaataataaagttactttaaaaaatatgaaaattttggtccattgggcattaataaggcattaatgtatgttgtgtcccggggtttaaggcttcaagccatttcaaattaccattttaagagagagcaatttattgaaggaagagcattgacaaataattatatg

SEQ ID NO: 9841 - DNA, 2455 bp, Heterodera glycines
agaattgccaaaggcaaggaatggcacagactgatccaccgcagacatctcgcagcccccgaggggaaattgagtggacttatatactggcacaattgggatggacattggataggatgtggggtatgacggcataaacacaaagaataagagagaaagggatggcatatgcaacagaggtgaatgggatagaaacggcacgataacattggaaatgagagggataggactggcttgggatgggatgaacattatgaatattaaaacttagcttattaaaatatttaaaaagtttattatatttcaggcgaaaaattaacttttacgcgcacttgaaaaaacttgctagcaaaattctcacattttttcaatttcaattttaaatgtcccaatggataaaattaattttgtcgttttccatcttcaaaagcaatgatggtcttcattattttgccataatttatttatgtcctcccttcctgcggtagccaataaaaaaatttaaaaattgaatttaaatcataataaattaattttaaatatgatcaaattcattttagaacgaatcaggtgcaaaattaatcaaatcaaatcaatcaaattattaactgttccacttcttttttttgggtcgtcgttttgccgttatattttatgccagaaaatttttcattttatcagcagtttctatacatacaaatttgaattagggcatttttaatagagtttgaattgttaggaaaaattccgaaaaaatcataaggggattttttttttttgaaaattgactaggcctaaaacaattattatttattataaaatatagatgaattccattaattattttctgatcttttcctccagcagaaaatactttacctagtaatttttttattgtgttcgaaccgagtctcatattttcattttaatatctggacgcaacttttgcattggactgtacataatccaaaaaactgtttttaaattaaaattacataaacagtagggaaataaattaaaaataaaaaatagctccaaaaagatgcttattcagtgagatttttcccaaaactttgttgcttatttaatatttatgctctgtttttgctcattttacattcaaatcatctatgcgttcttataaatttatttgggatttcctaattgttggaatttatttttagtttaaatttttaaataatccgatagattctatcaactaaactccgttcataacttgacaaacttttttccattggtcaatggagatgaattttttttcccaaattatccttctcacctacatcgaaaagaagagcctgggcattcgcaaaaaaaaaaacattacgcaattttgagattggaattagcaaagaggggccggcattaattatggtaattagcaaagactaattgatacttaattatgatgataaattgctggaaaaattaacggagattctactaagattcaaaaaaaaactttcttagtctccataaaaatttgcaaaaatagaaaattttctaacaatttaagttccattaaaagtggtctaattggaataatcaacatatatacatagcatgtataaaacatatattgaatagttatagccagtatgtaatacaaatattaatactttgggtacttaactttgaaaaattatggctaattttgtatgaaaatgctcctggcgatttgggagttgaggaattcccttctctcgccctccccaagtcagagataaaattaatagaatacaatggaatttatacaattctccgtccattttgtcccaaattacagtattatggccaaatagtatcgtatctcaaatgttacgtaaatttccctttattacacaaaattagccccacttcggggttttaaacgaacaaagccaaattgataagaccaggaaaaaaataaaattaattttacatattttcttcataaatttgttaataaattaatatttttcagtttatgcgagttttcttattcttcaatttcatccatttgggttcatcgataaacaaatccaaattctttgttatctgtgttccttgattccaatctctctcttgtttttgtcatcgatctgacaaaaataattttctttttcgataaataaagtgcaaaataggaataaaaaatgcattttctattttttaaaattaatatttttgttcaaggtttaaattttgggcaagaaatggacggggaaaatttttttagaaaatttaatttatgatatttgttaaaagccaagcgcgactattttttgcctttaaaaatgatttttttgcgacgcacttccaaaaaattttgggagcaggggtccgcgccgggaaaaatttgtaatttttaatgcgatttcttaccgattttgctcaaaaaatgacaagcttttacgatttcgagccaatattgaagagaataagaattttaggg

SEQ ID NO: 9842 - DNA, 1004 bp, Heterodera glycines
tgtcgtctggtaagaagtagcaaacatgtcacaaaatttcattttcgttaagaaatttttaataaaagatcgggagtttctttttttattttcttttttcaaattataaaaaatgttttgccaattcaaaatgattgattttaagaggaaattccgtttttcggcatttttgtggtcggtattccaaattcaaaaaatgtttagccttcgatattttgattttgaaaatttttgggacctcagaatgtcattccttttgaaaaaatttgccgaattcagtattttatttatttatttattttataacacttaaactcctgcagacgacctcgatctttggcgcgaattggatctgttgttcgccgaaacggagaaggaggagccggaggaggctgacgacaacattttgcaacaatttccgcccaaatcagtcgagtgtaagaacgaaaatttttgatataataattcaaaaatttttgcttaatatttaggaaataatttataattgaattctgaagggatttttttgacttatattcataaaattatttatttaaaaaataattgaataatataaagttaaataatcattttgtcagtttgcaagcaattttaggctggtttgaagcatcgtacaaacgtccttcttggaccgtaatcgaggaggctgcggacgcagaaattcaggctaacggagtgcaattgtcatttggtaagtattttacacatcctataaaattctaaaatttttattgtttgtaatcttttaggtcccacaaaaaatactgtatacgtttagtgaatttgtgcgcatttttttggtttttgaaaataaaaattctaataaatcctaatacatgtgagttaattaaaactttcgaaaatataagcaatgaataaacctcaaaattaatcaaatttatttaatattaatcgatgtttgttctattatggttaattaaggaattgctggagccgagcaaaggcttttacgacaaaagcga

SEQ ID NO: 9843 - DNA, 4977 bp, Heterodera glycines
tctgaagaaaattgcatatttttcaagattttcccgatttttacctgctttacagtagtccgcaatgacctcacggaggtcaaagggcgtgttgcggttctcctcgtaccactgctccaacttcttgcgctcctcagggaagtgcccgccagggtagtagtcctcaagcggcggaagagtgtccagcacaacaccataatttgcagccttaattattgattatttttggttttatttattgattttttttactttgttgaacttgtgcgggaagtatttcttgttgtccactccctctatttccaagccgaacgtcttcacaaaggaggccagcttgatggggatcagtttgtaactgaaaaataatcgattatttatgttattttacactttttacctgtcccggaagatggtggtagtgattgctcctctcttgcgggccttcatctccagcaggtgattcccctggcgcacgagttcgggacgcacacccatgcgcagcatctcgccgtagatcagcacgtgatcgtaacgtgacccttaaagttgttttctgcatcgttgtcatcgctgtcgtcgtcttccgcttccatgtcgatgaaggcatttgcagcaggattccgggccttgttgttgttgtctccattcgcacgcttccgtttgcggcgcttctccgcagggtcaaggccgaggacatcagcttcaaagtgcaggagccacttggtgaaggccgtcagggggtcgtccacaacgtaggcggtctccacttcggtgttgtagaactcgaacggtgcccatgcgaaggtcctcgtcagcccacagattccacagcttcggtccagtggctggtcccagatgccctttgcaatgcattccgtgcaagtgacgtgcgcgtagcagaagttcacctgaaagaaatacctaattttcgtatattttgtgttttatttacctgatgcttgaagcgcaggagttcagggtcgggcttgaagtccgtagtgcattcaaaatcgaagaagatgatgcgcttttcggtcttcttctttggccggtacgggatgtagcattcccgtggcacatggaatccgaggcacactttgcaaaacttctgaccgcattcgtgagccttttgtttgtggtgcttaaaagcattttgttttcaatttaaaatatcaaatgctacccgaatttggtaaataactccacagtcgatgcactttttcgagcttttgcagatcgatttttcgattgttgccacttcggtgccacgcttgactttgcattttgtcacttttgtatggtgatcatagcactctcggcttttgaatgtctaaaaaaatatattaaaaataacaattcattctgtggtactttggagcattcaaggcatgagtgaaaaaagtcgtcatcggcatcgacgcagtttccacggaaggcacccccgacgcgttggcagttatgacatttccatttgcaagtgttgtaaaacgaaagaaacatacccaaggtttggtagtggcgtaatacagccaaattcacgagcaacttcctcaaggattggcacacattcgatgagtcggaattcggtgttggatgtgacggtcatttttttcaataaaaatcgtaaaataagattgaggaaaattaaagtatgaaatatttgtacagtaaacagtacgcgaaataattgaacatttcaaagcactttatgaatcaacactgaagaaacacatgacattgttacggaggaagttatagaattcatcaattcccttttctttgtcgaagtagatagtctcaacgcttaggacgtatccaaactgcttgacaattcccttgaactcaatttggtctccttcttcgctgatgtagatgaaacgcggcttgtcctggtgctcgaaaacgtaacgcttctgctcctcctcgtacggcaccggaattttgcagtcgaacataaccgcaaccagatcaaatgctgtgcaacattcggcgagagtgaacggctcctcctttttgttcagttcttcgtccattttctaaaatattatttctatttgatgatattaataaaggttaacctcaacagatcgtagctcgtttgatggttcatccaaagacaggctttcaatcattgtttgttcatcaatcggcgtagtcaaattgttgaaattcatagttggtttggctaaacagcattgtaaaagacagaaacagaaaatattcatgttaataaataatgaaagaagataagaatgattttgaaaaaagggtaggattaaggatagaaacaaaaaaaaacgactccaagccacttttcccgccaaattttgaatttgaatctaatgcgaaaggttttcgtctcaataaattatggcgttatgtatatattgtggtgttttgtcttgttttgcgtattttcaaagtttttccaccggactacagtacccctcgcagtgatgacgtcatcatctttgctgcatatagttgataattatcctttttctggcaagtggtttcgtggcagagtggtaatgtgttgggttggtggcagaccaaaagttcgagtccacttgcctgcgactaatttattgcgatttttcaccggactacagtacccctcgcagtggtgacgtcatcatctttgcagcatatagtggacaattatccttattctggcaactggtcttgtggcagagtggttgtgtgttgggtggcaaagcaaaagttcgaggccgcttgactgtggcagaatttttcgaataaaaattttaaaaaattcaaaattaaaaattataaataattttagaaaaaattttacaaaaaaagtcgcgcacccctgcaataggtttaggcttgcagaaaaaaagtcgcgcacccccctgcaataggtttgggtttccaaaaaaagtcgcgcaataggttttggtttcagtactgaaaattttggcgctcagttggcccgcgctcacttggcggcgctcacctggctggcgctcagttggccgtgcacccctcccataggtatgggaggctaccgtaatccggtggaatttactgccctaactacttagaaacctttcagaaatggaggacatcaattgagtttccggtgtgtcttttccctaacgagcacacccccgtttggtatcggatggaatttgtcaacacgatgaccctcagacacgaggatggtaattcctatcaaattgatttgagtaaagaacagaaaaatgatccagaaatattggcattcattgaatttttagcaaatggcaatatgccaccagacttttcggaaaatgaaaaagaccgattttcagccctgtgtttaaatatagtctacgaatcagaggtactttattttaaaataccctcatcaagtacacgaatttttgtaccaacttcgttaagggccttaattttcgaatcgttccatacatctccattgggaggaggtcacatgaacataaaaaagacactacggaaatgcaaaaatatttttggcccaaaatgcattctgatatcgtctcatggacacgtcaatgtattacatgccaacttaggcataatcccacccctgcatatcgtgctgaaatgcaactcgcacctagcaataccctttttgcgaaagtcggcttagatttggcaggtccatttccaaccacatcgcgtggaaacaaacatattttgaatataatttgttggttttcaaaatatgtaatatctgttccaattccggatgccaaagcaaagactattgcaaaagcttttctttcaaattgttacttaaaatttggaggttgtactgagctcattagtgacaatgccactgcttttacctcagaattttttaaggaattttgtagtatgttatacataaacaaaacttatgcaattccccactggtcacagggcaatgcggtaacagagaggtcatttcgtacatttcataatattttatcaaaatacataacgaaagaggaccccgattttgacgaatttttagatttcgcctcattttgttataacacttcttgtcactcatccacatccgaatccccatttttccttgtttttggtcgggacccaattttctgtgtagaccaaatattggatgctcgcattcacagtcaagtccaacaagcggaggaaaccgatttcaaacaaaagttagtcagctcattaagaaaagcatggaaaagtgcagccgatgccaatgaagcagctcagcagaaaattaaagagcaatatgaccgaacagttagacaacctcaaatttgtgtaggagaccgagttttattaagaaattatgcaggtaaagttggaacttctaagaaatttcatctgccttggaagggcatttttagagtgatagaaattgatggcatatatgccactatcgttagctgcatttcgccgcaacaaaacccgaaaagagttcacttaaatcaaattaaaaaatgttttgaaaactttggtcctaattgcaccttgccaaaattaccaatcgatgaggaagagagtcttgataaaatgcatgcaacaaatttggacaatttccctggtcacaatcattttcccaggactaacagacaacctagtaaagaaaatcctgaacaggaaaatgattcgcaaaatttggccgaaaaaacagattgtcaagaagaagatggaaataattcattagacgaatcaattaagcccaaaaagggaccggagtatgccttgagagaccgaaaacgcctaaatcttccattacgctttagagaataatttaaatatttttttttattttttttgttgttgggtttgtcatactttcataaaaaccacttacggagaatttaaaaattcatttcatatttaattaataatttaatttacggtttgtcgcatttgcgccagggatcgatcccgagtggttggtgcaccaattttggctttaaaataattttatgaatttttttttttttttgt

SEQ ID NO: 9844 - DNA, 949 bp, Heterodera glycines
  misc_feature (932)..(932): n is a, c, g, or t
taaaaacccaaaacttaatcaattaggtcatttttttttacaaattctagttaacaaatcgcattaaaaattacaaattttttcccggcggcgcctatcggcaccgccggccctccttgtcccccaaaagtcttggaaaaaacgtgccgcgtaaaaagcggtgttgaaagcaaaaaaaaggtcattgatttacattaatttacatggccggagaccccttcgcaaaattggaaaattggctgctgaccccttgttttgcaataatctgaattttgaggtctacatctgaattttagtgttctatgtcctgaatttgaaaaaaaaaaacttggtcaccctcaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctacttaaaagcgaacaacatttttcaaaatatttaaatataatgggtttttaggagatgccatgtctatgccattttttgttggaaacaaaaaacgcatccaaaagtttgaatgggcatacttacaacagattgtcaattgtttaggcattttcttacacttttatacttattattttccttttttgtcataatttcaagtttttcaatttattcaagttaaatttctatcgaagtctaaaatataatttaagaaataatcatttttgaatccaatctttaaacaatcaaagggggtttgagaatgcatgcggcacttccgggagacgccaccgagagattaattattanatacaaaattcccctta

SEQ ID NO: 9845 - DNA, 5731 bp, Heterodera glycines
  misc_feature (62)..(62): n is a, c, g, or t
  misc_feature (91)..(91): n is a, c, g, or t
  misc_feature (2622)..(2622): n is a, c, g, or t
  misc_feature (3269)..(3269): n is a, c, g, or t
  misc_feature (3286)..(3286): n is a, c, g, or t
gatgcatagcccagcgatgccactagaaatttacaaattcaaactacagtgtcaaaaaatgngtagttaagatgaattttgtgtcaattgngagtcaaaaacaatgaaataaattaaattttagctcacattcagctcaattaaaggattttgaagtcagatttggagttaattaaaattaggattccataattacgaagttttcgaaccccccgtaattacgcattactgggtttctgtgatttaaaatcttgttacgcccatactgggtaccgaaaagcgccatcggggaaacttttggaaaaataaaacgcattttataagaattttcatttagatttaaaatatatttttaaatttaattttctccaaaataagtttatggtctagcttcttccaccccaatttttgggtatttctcgattaacccaaatttattctttgttttttaaaaatggcattttatctgtacattctaccccaccacaattcatacgttataaattatagcagaattgcccaagaattttttcgtacatttttccgctatgatggaaaattgtaaagggcggaatcattagggaataatgcgaaaaaggctgctgaatgaatcaccaacaatttttagcagggaaaagcatcgaaattccaacacaatttgtcggcctcattcaaggcatttgcttttcatctctctttcgccaaatacagccattttccgacgtttttactaatttctatcatttatgttttggcgcattcatttttttgttatactaaaagctcatttaagaaatattttgggttttttaaattttggattttctcgtaaatgaaattaaaaattttgtagaaaacttctaataaaaataaatctcactctcgtttttcaatgccctaatttgtaaattgctaaattacagtattttatatttattaatatttcttaggacgctgaaaaatgctgaaaaaggaagaacaagtaagtttcaaattaatttttttggttatcatttaaattatgggtctctgatttatagatagataaaaaattcgaccatccatccttttttgaagtttaccgacttttttcattttttgacaactttagccatttgagatagccgatagaagataaggatatgtttacaataataaactcctaaactatggcagattcataaactagtagaattagattactccaaataaactaaaaatgccaaaaattctccccaatgagctaattctggaagtgaataacttcaccaaatttaatcgaaaatggacaaattgccgtgtttcatttgcattcgacaaatttttactcgaaaaaatgggcgcttggttaattcaattgaaaaaaatggtcactaaaataaataaattagttattttttgattttaaatgtttttacaggcccaactttgcgcacaatcgatcgatgagttgtgcattacgatcaattcggtggctgatgatcagtcaaaattggcggcagctactggtgcttataatggcaagttttacaaaaattagcttcaacaaatttgatattttttaatatgcagcttgaattgaattcatttttctatatttatgttcgatcccactttaggactgaaaaatttcatcgaccaactgcccaatttgcccccggcgccggcattggctgacctcagtcttgatgaggaggaggattatgtaagtttcacttggaatttttctaaattcaatgcttatgatttctttcattttgcgtttttaaattaaaatattttttcttaacttgatttttgcaaacaaaacaggcggtgtccgtgcttaacaagtgctcagatttggttcgcatgtgctgtcagttccatcgttcttccgcagcggctttgggtctccttaatgcttgtaagtgttatgtccgaatatggtttttttaaaacttggttttcatacacttatgatttaaatagtaccgaaaattcatggattggaaatttatacttctcgtttaagacgcagttggaaagattttttcattgttttttaattaagtttaattaattttttatttcaatttcaagatatcactggcttcaaagacgcctacgcaacggtttgacgacatcgttgctttttgatgtgaagaagtcatcattagtgccgttcgcattgctttcatgcatggaaaggggggggggtggggtcctaccggcacagcctgagcagaaaaattcttattttccacaaaatggctaaacccataaaaaacggcctttttggtgcaaatctgttagaaagaacgaaatttgcaaaagttttccggcggcgctgataggcaccgccagtgcctttgttccgtaaaaggcctttggaaaaagcgcgccgcgaaaaaagcggttttaaaaccaaaaatgatctattaacatgggaccggactccaagaaaatttgcggctgacctccctcccgccccccccccttttcgatgtatgattgctttttcagtgatttttgttgacatttatgctttttgtttgtcattttgacgtttacttcaatgttgtcagattttaaaaaatggttaaaaattctttggattgcgccaaatggaaaaacttcctnttgtttcaacattaatttttaatgctgccttaacttgtttgttgtgtaacggaatgttgggttactgtaaagaaaagaaaaatgaaaaaaaaacaaagtgtaaatttttgattatgatttaattttgggatacataaatttttgcatttttcttaagaaatttctataaattgttacggataattttttatacaaaaaagcttaaagcaaattttccaataagtattagttttcttgtgtgtacattcatacaaaaatggtatggtccgttttttgattaatatttatgtatattaattaccgcaattatggccaaaagataataaaaaaattaaaacttgaacaaaatttcttttctctcacaaaactcatttaaatgttaaaaacaagaaacattgatgataaatggaaaaataaaattagttggaaatatgaaaagaaaattaaatcaattaaaaaacggaatatttatgaaaatggcgatgaattgaaagtgccaaatttggcattatattcatccaacagaattgtaatttttctattatcttttgttttgttcgatgcttttctcaatttcgtcctttcttccttggcattttctttcatattttcatacattttttccattttttgctcaaattctttcncaattctttcaaggtcncatgatcgagtcaaaattccttttcccttttgtataattttatgataccaaattttctcctctttaaattccaaatttaattcctcctcgtttaccaattttattccataaaggatttcttcatctttgccaaaaatatttggaataatcattcagttttttgactacttcgattaaactttccgatatactttctgctgaattataaaatattggcttcaccaatggtggcaattgtttcgacaattcggattttagcttaataaaattatgtttaattattaaaatttcaaattaatataaaacaaaaaacaaaccttcggcatacaatcggaataaatattcatataaaatgttcaaatatttacgatattttggaattctttcagttcatattcttcatatgcatccgcaattttattacattgccaattttttcgcatcaaatgcataatgccaagatgagtctcatatttttgctgaaaattcacttccccttggtaatagaatttgaatattctttagccttcttaaaaaatttctctaaattgttgctaatcctttgataaattccaaaaatagagcatcttcgttctaaattttgaattacatatttaattttcattgaatgtttactctctctcacccatgccaatttatcatcgaatttagaatataaaaactatttatgcatattatcttttgattgattgattttccatggtttatactttttttccttatttttcgctttttgaaacattttccctaacttttcttcaaattttttgtttaaattttgttgaattattcattttaaactttcatttgtttggcattcattcgttgtttcaattgccaattgcaaaatcatttgattaatggcaatttttgttcatttttcaattttattccataattcaatctcttctcattcaacaattttggttgtaatttcaaataatgaataaatttattttattttatattttcttgtccgacccattcaataaaataaaattctgaaatttcgacgaggcaattcaccacataaattattggcccattaatccacttcgattgccaattcattctcataaaacagtaaatgccaaggtgtgcctcatatttttgctttgtaaattcactgatttgcattttctgatcatttctcacaaaggcaattagcatttttggtcgtctccctaagcaaaaaaattagaaaaattaattgcctttattaagaatcacatataaattgcagttgaaatgtgaattaaaatatgatgaataataaattgaaaaaggattatagaaaaagaataaaacaattatattttctttaatgaattaaatatcaaatgaaaattaaaagaacattaattgtttttcaatttatttacataaaaaagtaaaaattatttttattattatgaaattaacgaatactttctaattaataaaaaaaatatataataaaataatttaaatctattttaaatgaaaaattaaataatgcaattaagccttttttatttatatatttaatagtttatatatattaaataagaatataattaaaacttagattgatcaacagtagaattatttgaatattatttatccaaacccttatttattaaatatataatttattatttatcccttaaaggatgacgcaattcaaatttttggaatgagtgaattgatctgattttatagaaattatttataaattgcattgaaatttaaatttcccgcctgccataaactccttttgatttttaacagtttgaaaatttataatgaagatgttttttataaatttcatgcacttttcagatgggaacctccttagaaaccaagaaggtttactatattctgacatcaattttgaccaatctctaacctaaactcggacaaaggtagaaatttaaaattcttggatttcttttttttttgttcgaatttaggttagagattcagaattggttgaaatatttgtcagatttgtggtcagcgaccgcaaaaaattcctagaaacaaattttcacaattgttatgacaaaaaatcccaatgattttacaaaaattcaaatcccgtatggaaaagtgccggtttcatctgataagcctggataaacagattttccaactttttttttatgtgatcagtttgtggtaattttctgaaacagaaaaatgcggtaaatgaacgacagttattttaaatttatttaacgagctatgagaaatttaaaaaaaatgattataagtggaacacaaataattaaatttatttaataaacagtgtaaatctaaaaattaaaaaatattaattctttatacttagaaaacatttgatttgcttgcatttttttgaaaaattctttaagacgacctttaaggtgccatttgaacctcttgaattgagaagaataataa

SEQ ID NO: 9846 - DNA, 3009 bp, Heterodera glycines
tttcatttttttgacaaataacttaatggtcgatgcgtaagcggaattggctattgaaagaccgatggcatccttcaatactgttatttgtcctcattaaattttcatcaactctaaatttttgtttcttaaaattctatttccacttttacctttcactcatattccacatttcctgtggaaaacttgcagacctcccctgtaacccattgttttgaatgcgatttcgaatccatgcatccactcgtccataagcacccaattccggatcatcttcgagcggaattgattgcagttgccaaacacggtcacacccaatccaatatgtcacaaaaattggacaagagctacaaaatagtgattgccagcagattttggccaataacaattgcatcagaatcctgcgcatccaacagatgatctccagcatccacacgctgcttggaaacttctcgacgatatgagcggcccattgacgaagttgcaagttcggctcggattccttctgggattgcgcctctggcaatgtcaactgcatgacgagttggcgctgggttttcagcttgagcagaagctcttaaattcgtttgagccgttcgaatcgattggtgagaagcggatggttatgattggcatttttgaccggcgttaaccgtggttaaaaatccttaaccggtatgctcgtccttccctttttaaccgtggttaagactaaaccacggttgagttaaccgtggtttactccctccttaaccacagttaacgcaggttaaccgtggtttatttccaaccggtatgctcatctaaccgtggtttaatctttcttaaggaatcttaaccacaactcgagttgtggttaacgtaaatttatttaataaatttaaatagtaaaataaataaataaattttttctagggtaattttacaggcagaaaaagaatctgactttttttttttgtctatgatataaattattgacggattagtgttatttcatcaaaaaaatttgcacacgcccaaaccgctaaaatagctttttaaaaaaggtgacaaaattgctgctgtttgtagcatgttgcataacaacgtaattgtttgtaatgcactattaccaagaaattttggctccattgcagttcacacggccataaaaaaataatttgacaattttaatgcagcaacaggtcaataagtcgtacggtgtatgcagcgataaatttcaatgcctatgatcaaaacgcggcgctactgcattttactggccaaatgcacggactaaccatctgcaattcggcttagagcttcaaagcaatactcgaaaccgtcggccaataaaatttctctgcgctgagttccaaatttacttttgcatattcatttatttatggttgtatgggtcactcaaaattatctttaatatttcttattttattatacttttgttactagcacaccaaactaacttttttaatttgttaacaagtttaagctaaattgatttgattgatgtatttttaggaaataatccgttctgatgactagaaaatatttttgtttaatttaaatttactgtcggattgtccactgtcggattgtccactagattgtctagtcacgaattagagaggggaagagaatctaaaataaagagttagttaatgggaagtgaaatgaaactgggaagaaaataatttaatcatttaattcattatcacaagtttttatagcaaactttttaaactctttgagatcagagcggttggcgccgcgaagcggagcccaaacgctcgtcaatattattttatttggctgaataaaaaaaaagtttacgtgaaccgagaccccaaaaaacccgagaaacaatttctcgactcgggaatcgagaaccgagaaatcttaaagaaattaatttaaaggtatttttttaagagcataaacacataaaaaagggatagctcaaacggaatttttgcttttagggtaaaatcagaacattttgtaaaattgctttaaatcagttatttttacaatttattcgatcaaaaatatatcaaatattatattttttgtctcccattatcgattttatctagcgcattcgggatcactaaatcagatttttaacaagttttgaggcgtgctttttgtgcacggcggcgccgataggcgccgacgggaaatttttttggaatttttcatgaattttgttaagaaaaatatgttcaagcttgaataatttttcctcttttctccctttgccggagacccaccccccgaaatggtcatcttaacagtgtaaaaatttctcgatttccgagaataaaaacccgagaccgggaagcgaaaaacacgagaaatttcccgagtcgggaaccgagaagtgagactctcgcacatccctagtgaccccgacccaatttatatacatttttaatgcctgcagtattcttcagttttaccttattttcaggtgtgcttattcacttacatgggcagcactgtcagctcgtcttgtgtcaaatttcgttcaatgatggcgaattctgaaacagaactcaaattgccgtcgaacatcgtcccattgcgtgaaatgcaaagatttgcgggattcagcggcgatttaatgtcagtccaacgggggcaattaaatttaatgatcaatttgaataattttattgaatattttatgccaaaatttgtcttcacaatttcgtttccctcctattgaagagctcagaagatggcgcttcatctgttctccaatttgatggaacccttttgcaaaagcaggctaagtctcgaagaatttctgctgctccgtgccattttgatatgccattcgagtgcgagaagggaagagcagggctggacgtaactgattttcagttaccgccatcattacggcgattttttcagttacggccatccgtaatccgtcattacggaggtccaaaaaggccgtaatttggcgtaatccgtaattttcaaaaaacatttttttatttaaaa

SEQ ID NO: 9847 - DNA, 1990 bp, Heterodera glycines
ccccccccttttatgtttgttaattatgctacaattaccaagaataaatcagatgaaatcgaaagccgtaatttccgtaatccgtaattacgtccagccctggaacagagagacaaataaatgccgatttagcgattgttttggcataattattagtgttgttcgagaccgaaaatttctccaggccgagacttgacctcgagaccaaaaaaacccggacttttctcgagtcgagattctcatgcaacactaataattatcatatgacttgtgttttctcaatttagctaaaactggttttctttaaggcaccccaaatctttcgcgctcggcccaaaaactgcttcagagtgaatctgaacgctatgccggcattttgttgcattttttgcagttaaagcacggaaatgttgcgggtgcttctcgctattcggaagtcatacaggtgggaaggccgaacgagaagcattttacactttaaactgttaattttgatttaagagatattttatgtttttttcggtaagtaaacaaagaccggtcggggtcgttttcccgacgtcgttttcgcgccagcccgagtttttgggttctaacttttttcattatcgaccaaataatcttggtatcattcgaaagcttaacatctttagaggctgtttctaagctgttgctttgcgattagacaattattaaaaagttataccatgaaaattacaaaaaaatcaaaatttttgaaatttttttaataacttttttgcaggctagaaaattttttggcttttttgtaaggctaatagagcttgtaaagggctttcgaatgataccaagattgttagatttggtcgacaaagaaaaaagttagaacccaaaaactcgggctggcgcgaaaacgacccccgaaactcacgcgtaaaatgggcagaaaataaacatttgtgttcaattaaaataaatatttaaatatagaaggcatacaaatttaataaaaagggaatataaaaattaattgtataatataacccggcacaggtggtcgtgtgtctgctccactcgaagaacaaacatcagtcttatctaaagcatttgtcatcagcaattctatgcgattccctatctatgtatacaccttcgctttttgttccaatgatgttggatggttgacaatggaaaagcattttagttgattattttattgtgtatttatgagatagcaatttaaagattttttattcaaaaatgttaaagcgccgtgctgggtcgtttcgtaaaaagtgccaattttacagattttcgagaaaaatccgtcataacttttcttaaacaaaaaacccaatttaactttttgaaaactcaatgaaatttctgaaaattgagcaagtcaagagctataaagattacttaatttggttgtgtttaagaaaagttatgactagggcataaaaaatatggatataaaatcgcgaaatatggccataaaacatggaccaaaaatcgcaaaatatggacataaaatggcaaaaatatggagataaatttttcaaaattgagggtgtaatttctcaaaatttcttctaattctctaaatgtaaggtaaaactttcaaaaatggataaatatggaattaaaaatattaaaccaaaaaaaacatgataaatttaaaacttacttatttttagagaaaaatcaacccaaaaagcgaaattttcgtttttttgcttatttttgacatacatttaccgggaccagagcgtttgggcccccgtttttgggcccccgcgtttgggcccccgtttttgggccccggggtcgtttgggcccccttttttgggccccggggtcgtttgggccccaacccaaaaatagaaaaatgtgcttttttaaaaattaagattctaaaaactaagccttagggatccctcgccaattggtataagttaggtttaattaacattcgctcattttttacaattttacttattccaaatcc

SEQ ID NO: 9848 - DNA, 4495 bp, Heterodera glycines
tggaagggaaaggccgagttggccaaacagcagcagcaccaccagcaacaccaccggcgatttaaagtggggagaaaaagcaaaacaagacaaaaaaggaattatcaaaattaattagataaaaagagcatgcatggagcagccccggaggcaaaatcaggcacaaaaagggcaaataatggcacaaattgggaaaaaaacaaatttaacagaaaatccatccgacaattgatgaggggcaagcagttgagcacaacagagaaacggaaggccaaagagagcatcaacagcagcagacgcagcagccgaagaaccgacgcttttcgagagggttaaaaaacgaaatgaaaaaagaaatttaaaaggaaatgccaatttaaggggcacaattttggaacatccgccgaacattgaattttaccgcaacactttggagaaggaggagaacggcacggtacggccgacaatgttcgacttggtggagggggacaaacagcagcaaccgcagcaacagagaagggaaagtgggaaggccgtggagatgttcagggtgatcagaagcaaaaggggggagggaaagacaaacgaaaatgaaaacggaaatgacaggaaaaaaatgcgcaaattttggagggccaacagcggacaatgggagccaaattgacatggcgaaaccaaccgaaacgcagcgaaagtgacgcgtccaaggtgaaaagcattaagcatcgccaaaagcgcacaaatggtgccaattcgttggacagaagtctctgcaagtgacgccgcgccgcgtcgtccgtccgagcggcgccgacggagccaaagcgaagctgaccaaattcggatgggtcgagggcgtgctgatccgctgcatggcttccatcttcggcgtgatgctttacctgcgcctcagttgggtgtccggccaggccggcatctgtttgttcttcccccccccccttccgttgactatcccttctcttttcccccatttttgtgctcggttcgtgcattgttctcctcgccactttgatcaccataatcaccactttgtccacctcagcaatttgcactaatggcctcgtaaagggcggcggtgcttattttctggtcactttgtgttgctatgccaacaattttcagctgatggcacccttttcagatcagccgatcgttgggccctgaatttggtggttccattggcattattttttccattgccaatgccgtcggtgcggcgatgtatttggtcggtgaaatcatttatccaatttgtgaatcggcatctcatctttaggttggatttgcagagacggtccgcgacttgctgaaacaccacggaatttttctggcatggaattcaaattttgaaatatttttttttacaaattttagttggacggcgacataaacgacattcgcatcatcgcattggtcgcatgtgcagttcttgtcgtgattattttggtggggctaagctttgaaagcaaaatgcaggtgaacactctcaacgcggaagaggagggagaggggcataattggccattaattagcgttaattactgagtgcattaatgcgtttcgcttctcagatgtttatgatggttttgctgtgggtgtccgtttccgactatatgttcgtccgtttgtcctttagttaggcttaatttgcgcatttgtcctttttagcattggcacttttattccgccaaatgaagagcagcaaaagaaaggaatcaccggctttaaaagtgccttttttggctttattttgcaaagcagttttctgttgctttctcagtggaaacagtgaaagagaatttgatgccgcagtttcgcgacgattacagcttcttcaccgtttttgccgtttacttccccgccgccactggcattatggcgggtgccaacatcagcggggacctgcgcgaccccgaggtgaatggaggggcgtcggaccataacaaatttggcaatgccaatttggccatttgccattgtgccgcttccttcccctcagactgccatccccctgggcactttgatcgcaattgcgatcacttccgtcgtttatttactgctaatttggctgaccggtgccactgttgtgcgtgacgccgacggactgaccattcccacgcttttgctgaacgcgagcaaagaggtgcttgctagcctttagcccgctcattagtccaatttgcgtctaattaccgctgattttctgcggcatttgtgcccaattcccccctccgccccccaccggtgccatcgctttctttcccttcaggtgcttttggagcaaatctcctcccagtcggtccaactcgtctccctgtccaatgattctgtggccaacgaaactcagccgatggtccaccaaattgaaaccttgtcctcctccgccctttcctatgcgccgccccaatgcgcgtacaatcaaagctgtccctacggactgatcaactattttcaggtgcactctttggtctgatttttttctattttgtatttcttccttttatttcctcccctaaatccttcttttctcttattatttatccttttttatggctttaatcccgcttcatccctccctcccccatttccccccattttgcttctctattttccgcttattcatttgccgcttctttcctcagatcattgagcttggctccgcctggggtcctttggtcactgtcggagtcatcgcctccactctcagctcagctttggtttccatggtcggcgcacccaaaattttccaggtgttcgttcgttcttccgttcctctccaatttcaatattttgcttgaatttcccctaaggctgtgtgccgtgatcggcttttcccttacataaatcgctttggccgtggccacggcccaaacgaagagccccggcaggcgctttttctcgccgctgccatcgccgtggcagtcattctgatcggtaagcttttatatgctaattgatcatataaatgctttcttcttcttaagggaacctcaatatgatcgccccactgatctccaactttttcctttgctcttacgctctgatcaactacgcttgtttcgacaatagcttcgcgcactcgccaggtgttcgttcgtttcatcctttgtttctcttccctattatctctgtgccatactccgttcacattgtctctcttccatccctctttttctcttccctattgtctttgttccatctttttcaggcttccgtccctctttcaaattctacaataagtgggtgtccctcgccggttccctcatgtgtgtgttctgtatgttcatcatttcctggtggacggcacttctcaccttcttcttttttatcaccatttacgtgtacttggcccatcgaaagccaggtcgaagaagaagcatttgccaattgaccatcattttccgccctttaaagacgtcaattggggctcatcgatacaggcacacagctaccgtaacgcgctacagtacgtgagcaagttggagcggactgaggaacatgtgaagaactatcggccccaactgatggtgcgcaatgggggccaacttgatcaatgccaaaataaaaagggggatcaattaaaatactgagtaattaatgaggcctatgatattctcaattatctaaattccattaaagtgtgacgctttctttgctaattgcctgccaaattccctcaaggttctgaccggaaaccccgccgcccgtgccggcctcgttgactttgcctattccatcacaaagggcagctctcttctaatgtgtggatacgttattccctacaaagcgtgcaattcggtcaaatcgatggctaattaattaattggttcattaattagtgccattgtgtccattcaggtgtttacgatgatgcaaagcttcaaccagcagctgcgtgattggtttgttgttcgtcacatgaaggcatttgcagtcaccgtggccaaccccaaccttcgttccggcgttcagtcgttgctgcaggtaggcaaaatcaaataattaattaattactaaaataattaaaacttgaagattgccgggttgggcaaattacggccgaatatcattctgatgggctacaaatcgaattggacccaagcgaatgcgaacgtcgaaaaaggactggaggaaatcaacgattatttcggcctaattcagtcggtttcaaaagggacgattaaaacggacaaaaagcggacgaacgcccgtttcagagacgcgttcgacctgaacatgagcgtggcggtgttgcgtaactcggccaagggattggacatttcggaattaattcttgaaacgacggatgagctgaacgaacagcagcgagaaatgtacatgaacggcaggtaaaaacgggaaaatagaggaatttgaattggcattcgtttggcgaattgcaccggcagaagggacagttacccgacggagcagcacccgtcccatcagctgaacgtaaacgcagcagcacagc

SEQ ID NO: 9849 - DNA, 1668 bp, Heterodera glycines
ggaggggaacgggagagaaggggaggaggagaggcgatggggggagaagaaattggggaaatgaaagggcaaatgaatttcggtggggcaagtcgtagggcactgctaatttggtcacactcaaagtgccgatgtggagcatgtgcagctgcagcatcagttgctcccgcctttgcccctcccttccgacgcccttcgctttcaaacccgcgtcaaacacggcaccatcgacgtttggtggctgtacgatgacgggggactgactctgctgataccgtatctgctaacacagcaaaaatcctaccttgaggttatacatattcatcccccaagggtttcccgtccatctgatttatgcttttttccaaagaatgccaaattgcgcgtctttacgctcgctgggcagggcaaaaacctgcagcaggaacaccacggattggtcacaatgctgaagaagttcagaataacggcagatcaggtgatgaaaaagggaattgaagggaatcctttggactttcaggtcaatgtcattcccgactttaccagcaaacgcccggacccaaaaaggtgggccaatggacgaatgaatggcaaatgtttggtcaattcactatttgagtttggcaaagtttgaggcgcttatcaagccgtttatgagcccaagcagccgaacggaatcgaatgtgacggtccaattggagtcggacaatgaaaatgaagagacaaatgttggacaagccgagggattgattacggagactgagctgaatgcccagcaggcaatcaaccaatcattcgttagcatttcacaaatatgtcttaaatttctccaggcacgcacttggcgccatttgcgcatcgccgaattgttgcgtcgttatagctccgactccgaccttgtcgtcgtgtgagaattggccattggaattaattaattaattgattgatgctctctttgggtcattcatccgtttcccgacacttcagtactttgcctgtgccacgtcgcggactgataaatgcggcgctttacttggcgtggcttgaagcgatgagcgccgaattgccgcccacgctgatgctgcggggcaaccagcaatctgtgctcactttttattcataaaacggacaaaggcgaaggaatggatggaattgtgaagccattggattaaaagattgatgtaaaataaacacatcatactcaaattgtttttcaataataataatttcgaattttaacattgtttttttatttctcactttatacaattgtattttaattttaatttcacagttaaaataaaaacaaaaaattttctactaatttcaaaaaaattatgtaatttatctttaatgactctatgatctatgaaagaattgttgaattatttttgcattttcataaaattgcttaagatatctgaaaatggaccgtcccaaaacaaatttctaatttgtatatttggaaaagcatcaattcctttcctctttatacatatttatggtatgttcctatgtcattccttccaaatgaaacgagttttgcttcttcactcgtccttttgcatatcatttgtaatggtaatgaattgcttcttctttcttcttcttgtttgtttgtttcttatcgtctgttgtccctcttttactgatttttaacgccatttt

SEQ ID NO: 9850 - DNA, 1665 bp, Heterodera glycines
  misc_feature (1604)..(1605): n is a, c, g, or t
gcgcgccaatgatgagcaggaaaccgaatcatcagacgttgatgaagacgaatatgtggtcgaaagcgatgacgacatcccggcggttgaggtgggaataaatttgaaagggagggagggggtcaaacaaaaattttgcaactatgaaaattatatatttaaaaataaaagttacctaaaaaatttttcagcccaaagagcgtgaagagcgatgggtggacccattaccagaaaagttgcaatttcagcagcaggtgaacaaaattgccgagctgaaatgcaaatactcgcgggccaatgccaaaggtgaaaagccatggatttaatttataaaatttacaaaaattatttttgaaaaattgttcagttttcactattttaaaaattgagaaaaacacttatttttaaaaagcgattgtttactgattttactaataatttaaatgccaaaaaaatttaaaaaaaaaattttagctaattttttttcaagtatttctttccaaaattattattttttcagtgcactggtacaaggaccgaaagaagctgttctcggacggtctcaagtacaaaattttgatcgacaaacagtccgtcacgctgatcatcaacaacccggacccggacgacagcggcaagtacacatgcgaagcgaacggagtgcccaccaattcatttgtcactgtggagggtatgttttggacggggcggacaaaacatggaaaattaattttgatttgcttcatgtgtttattattgtattattggcctataattttattaagctctcaagaaaaatttgaatttttaccacttataaacagattttcacgaaaaaaattactaaatttgcagttttttttttttgaaaatttgggtgcgagagatcttggagaggtttcgattcgtttttttttataatttttaattgattaaaaaagtagttaaacattttccacggacatttttggttttttatttaataataatttaattttaaaatttacttttttatcaaattaatactttcattttatttaaaatatatatttttttaattgtatataaaatttataaaaatgttttaattttttttaaataattatttcatattaaagaaaataaattattgctttttttcaaattagataattattatatttttcacataattttatatagaatatgttttattaaaagaatgcattttgtttcagactcaccagaccaacaaccattgtcctccaccgctcgtcgccgcgactcgcgcagaccaaaaagtgccagaaaggaagccactgcattgacccccttggacgccatgcagtggttggtttaacaaacaaaaaacgaaaaagaaagtttaattcattcattttattttttagttgcagcagccatttgacgccgccacgtcccaaaaacatggtgagcaaattcgggttttttaaaattatgtattgggaattttgagaaaataaattttttaatttttaacctgaacccaaaaccaatttttaaaagtgatgcaaaatttttgaatttttataaaatatttatacaaacttttttttttgttttttttctcataattcctcttctgnntggtctttgtcctgacaaaagcatccacaggcaaaaattttttctaatgatcattttttt

SEQ ID NO: 9851 - DNA, 3184 bp, Heterodera glycines
aaatttattgtaaattttcaaggtttgaattttttttcataattttccgggggtaacgatacttgaaatttgtccaaaacccactaaaaattggcatcactgaaggtggccggcgtcaaaccgcagcacacctacgagttccgcgtggctgcagtgaacgtggcgggccgaggcgagtggagcaagaactctgtgccaattgctgccacatggtccccctgtaagccgttgatcaccatgggaccgttggcatgcgacatgactgtgctggtgggtgaacaggccaagctgctggtgccctacgcagcgaaaccacgtccgaaattcgagtggagcaagaatggcgaagcgatggatccgcgtgacgacccacgcgttaaggaggaaaaaagcggtaagtgagcgcgcaatcctggcattaacagggtggaggcgcagagccatacaataaaaaaaagggagggggattaaccaaaatttttgctaaaatggtctggaaggagggggtcgacgggaggggggtcagcggccaattttgcgaaatggtccagccatgaatttgacgttctttcaaacagatttttttttgggtgcgctttttaaaaaaaaatattttttggggaggacggtggtgcggctaggcgccgccggaaaatttttgaaaattcagtgcaatttgttaacatattttcactaaaaactaccaaattgcgattctttagcaaggcgatggctttttttttgtgtttaaaaaacctttttttcgcggtacacttttttaaacaactttttttttgcaatttgttagaagattttgtctaaaaaatggccaaattttaaaattttggctaaatgatctttttaaatttttttaattaaattttattttttatcatattttttattttcacgtttttttctcccatttttagacattctcatccagctgtgctaccagaaatgcgaacaatcggacaccggcaactattccattcgcattgtgaacgacttcggctcggattcggtggacttgcgcctgaaagtggtcgatcgccctgcaccgcccgaggggtcattgaaggtgcaaaacattggtaatatttttgtaaacagaaaatgatatgagagtgacatatttgtaaaacaattaggagtggatttttttaagtttttttttagaaatcaatttttaacggagtattttcgtttttactgtattttatttttacaaaatatttttataaaaaattgatgaaaaattgttaaaagcatttttgtaaatattttatttatgaaataaattgtacaaaaattgatatttaaaataaaaattttaatttcctcgcttaaaacaggtattatgatgcatatttttgaatattttataaaaattttttaccaaatatatatttttttgttttttctcaagaatttcgcttctgctgatcatgttccagacaaagcatccacattcaaaaattttttttaaattgatcattttttctttgtaaaaattttggtttaaattgtccccttattcaaaacgaaaactttaaatatttaatgcataaaaaatcatgaacaggagcggaccgcgtccggtggcggaaggcgacgcgttggcagcaccgcggcggaccggtcggcaaaggcggcagcagcggcttgcgctgcgggcgaagaggcaacggacgaggaggaagtggccgacagtgaggaggagcagcagctgctcgacatgacgacggttgaggtgggaataattttgaggcgggagggggtggggccaaattttgcttcttgccactttttttctctgtgtttttttttttaaatttttttttggggatgggtggtgagatccaatggtgccaataggcagacgcgccgtggaaattttgctaaagtgaatgcaatttgctaattgattttatttaaaatttatttagtttttataattaaaatttttgtatttttttttatttaaaaaatttattaaataagatttaattaatcaactttaattgatttaatattaataaaacatgcataattatcattaattaacgaatttatgataacaaatattatgatttttatccgttttatttataaaatccaaagcttttttagactcaaattttttgtgtttaattttttattacaaaaaacccagaaattaaaatttctgctctttgttgaaataatgaattaatattttccaatttttaggtgcgctgtgcggacgaacggctgctggccaaggcgccattgaatgtgccagtgcggcccggcccgccgaagccactgtacaccaccgacaaatcaatcatgctccaatggacacgaccgttgcgggacagaggcacgccgatcactgactacgagctggagatacgcgagcgtggcaccaagctgtgggggaaggccaccaccaacgcggagctgtgggagaaagacgcatttggcaatgtaccggacacacgattcaaggtgggggaaaacatgagccgttcgtcccctccccctcgtttcatcccccccccccctcgccgtaaattttttttaaatttacaattagaaatttaaagaaaatcttagaaaaattttatgcgacttttcagcaattttttgcaaaactgaaaaaatcgttagtttttcaaaaaaaaatttttttttttttgatatttttttataaaaaaatttctaaaatttcttgtaaatttcaaggcttgaatttttttcaaaaacttttcgggggtaaacgatacttgaaatttgtctaaaaaagcactaaaaattggcatcactaaaggtgatcggcgtaaaacggcagcacatctacgagttccgcgtggccgcagtgaacgcggcgggccaaggcgagtggagcaagaactctgtgccaattgctgtcacaccatcctcctgtaagccgttgatcaccaagggactgtttgcatgcgacatgactgtgctggtgggtgaacaggccaagctgctggtgccctacgcagcgaaaccatggccgaaattcgtttggagcaaaaatggcgaagcgatggatgtgtgtgccgacccacgcgctgaggagaaaatcagcggtaagtgaatcctggcacttacaagggaacattccaaactgtcaccactcagatcgttttaaaaccgcttttatcttgta

SEQ ID NO: 9852 - DNA, 614 bp, Heterodera glycines
  misc_feature (598)..(599): n is a, c, g, or t
gggggggggggggtcagcgaccaattttgcgaaatggtccagccatgaatttgacgacctttcaaacagatttttttttgcggtgcactttttaaaaaaaaatattttggggggggggacggtggtgcggctaggcgccgccggaaaatttttgaaaactcaatgcaatttgatatttcactgccaaattgcgattctttaacaaggcgactgcacttttttttgtttttaaaaagcgtttttttttttttgcggcacacttttaaacaactttttttgctatttgttagaaaattttgtctaaaaaatggccaaattttaagatttgggctaaattctctttttattatttttttaaattctattttttttttatttttcattttcacattttttttctcccatttttagacactctcatccagctgtgctatccgaaatgcgaacaatcggacaccggcaactattccattcgcattgtgaatgaattcggctcggcttcggtggacttgcgcctgaaggtggtcgatagccctgcaccgcccgaggggacattgaaggtgcaaaacaaagagaatattttttgtaaacagaaaanntgatgagaggggcat

SEQ ID NO: 9853 - DNA, 2359 bp, Heterodera glycines
tttttatggatccaatttccattccttttttaatatcgcttcatacggctataaaaggaagaagaaatggctgattaaaataaggataaatcaataaaaaaattttattttaaagaaaagcattgatcattttttgttttcatttattttcctagtcgccttttcgaattagattttttaacacgtaattttttttcaaaaaacttaagaaactcaaaaatttaaccaaaaatgttttactgatgctttcgagactgtcgccaatttttttgagccttgaaccatcgttccttctttttcagccagccgataatgagttgttcaaaagtgtgctagggcaaatttgtacaaaaaattcaaaattttttgcttggttcattcattaatgatactgtcgaagtccacgaatattctttccattgaatgtgttaaaaaaatggtctttctgcttcatctcttcgtgccccccccccaatgcttttccctcccatcatgcacaaaaaacaaacaaacagagaagccttctctctcttttgtgcttcttgtgatgcgttgcttttgctttcccctccccccattaaaaccataaaattttaatccttaaaatgcgcttcacctctccccccccctcgtcctcccaaattttgtccgcttctgtcctgtccttgttgtccctcgtcccctcagctgctcccgcccctctctatccgcagatgaagcatgcttcatgcttcttcttcccgctgtctcccatgccccgcttttgcttttgccctctaccccaccacagagagctctcaaaaaaatgtttgtgcttttggtggcccaagcaccaaaaccaaaaattgattattagcccatcatttccaatgcgtcctccccaacctcccacacattatgtaccccattcctaccaccgccccctcccccgccccacgggagacgacctccgcttttcctatgctgccgcccgccgccaccgtcgttcaaataattcaatttggccaccaccatcagcgctgttcgtcctgcttctgccgtcgtcccttttcaacactttcggcagcgcctttcatgctgcacctccaaattttttttatttttgtctctgttctcgggacatatcagcggcatgtcaaaaaatcgaacgaaatgtcagaacgcgcgcgttattaatttttttaaactaattagaatctttcctacaatgcaattacttaatttaattttgagtaccaaatttttataaaatttaaaagtaaaaaggtagttctatcctttctccatttttgtctatttaaaaaaaaattcctcccttatttgcacttttctgcttacgaattagtggccatacggcgagtgccacttcggcatcatttcaaattctgtgtgaatttttaaacacaacaagtgtgccatccgcgcacaataccccccccccccatcctcttccaacaatgaatgtgtcgtcttcctccgtccgctgtctgttctgtcccattattcaatccttttcgccccacccccgggggatgccatgccgaatttatttatttgttattttttgtgccgccacccctttattgttcgccaccattcgtccgcgccttttagtcaaattatctttgccttctccgctcttttttctcattcgcccccctcccccaggggcttttaatggaccgccgccgcttttgaattggccgaatggtgggcggccacggcacgcaacggaatgccaaaaagcagtccattgtattttttttttgttgagccgtttccaatcattttttattgtacatgcaaacaaaaaatcattgattgcctttcaaaaattaaatgaagcgccaaaattactgaaatacaaacaaaatatgaacgaacatacctttgaattttattagctcattacttttccacaaaagcgcacatactttttccattttatctttccattttcaccaatttgctaattaatcattttcaaaggaattatctttaaaaattaataatttagcagaaatggaacgcagtgagctgtccagctattcaatggccagcagatcgaggacaccgaggagaaaggttggtttgattccttttatcgagataaataatacgaaaatttctatgatttaatttttttttaatattgaaacaaatttaaattcacaaatggtaatagcgattggcaggaattgggcatggaaaaccttaattactcatcaaattaactaattgcttcatttttcatttaattaatgtgacaaaaaatcggctcagttaaaaaccaaagaattttctgtgaatcaataattttggtgtcaaaagctatcaaaatgtatgcacaatcaaatta

SEQ ID NO: 9854 - DNA, 2064 bp, Heterodera glycines
gctcagttaataaccaaagaattttctgtgaatcaccccaacccggtgtcaaaagctatcaaaatgtatgcacaatcaaattagtttatgccacgcgccagtgcgtcaaacctttgccccatggcaatgggcaatttacctaattatgcaaaacattcccttggggtcggtttccgcccggggcatcgccttacaattagcagctaatttatcggttaaaattcggtctgtccctttctatgcataataagcctgcgaattttctcccatggattttgccctcattttgctgcttctgacgcgcttttctcttccattaagccctcccgccttccgagtgggtcttccaattaatgttcacaagccaaaacagtgtaaaataacatggaaatattccaagggcatgctaatgacatcctcgagagtggggcctcaccccatagatcctttctcgaatagaaaattttaattcattttccgttgggtgttggcactgatgaatccgacaaatttaagccattatgtcatccagattaattttaaaaaaattttctttagaagtaaattataaatttaaatgccagattcaacacttgaattatttttaaaattatttatgcacaaatactcaagtttctgcaaatatttcgagtgcgtttttaattttcacgaaaaccagtaatcccaacatttttgtttaatttatataaatatttattatattctttacctctgaatagtttcttgcaaattgaagcaattgaaaattaggcatatattctctgcaaatgaaatgtaaaacaaattgaaatttgctttaataaccaaaatttatattaatgaattaattttttaatgaattgaaaaaatttatttgctctcttgaaaggactaacagtattgttcctcattaaaaaaaatttgctttttttcgctgccatcatcgccatgcttaattttttaatttcatcaaaaatcatgcgaaacattggtagtagagcttcatcgaattcgtcataattattcacatctttgcgtgccatttgttccttataagtgtgctttttgcccatatctctctctgcacattggcattttgagacgggacgcattataatgttctctaacaaatagttcactaattgtcaatttaattgcacaattagagtcatttggaagctttaattctatgaaacttcattaattcattccgatgaatgagctacggcaaaagaaggatacttaaaacaacgtaaaaacaaattgtccgtttaacgctctcattggaatggtttaattaaatcgcacgcttattaaaagcttacgcggaattctcgaatgactggctttaaattatttaatcttcctacaaaaaaatatgtcccctgaggggatgtggctcgaactttccattccaatgccactctcatgtccagtgatctcgaagtccatgaaaatgtaggttcgggtttatcttttcatatatatatatatatatatatcttttcatatatatatatatatatatatatatatatatatatgattttataaaaattagagttgagtggctcgtttaggatacattttaaatcttaaaatttttcacaaaaaattataataaaatttaataaagctagtttggtcggcaatctttatgtagccgatttgactaggcacccatctatggtcggttccgggtattggattttcaaataatattccccgggttcgtgtccagaaaaaaacggttatcaggtcaagtgtccgagccgtgcaccaaccttaaattggtgatcattttaaatggtacacaattacatattttcttcaaattttatttaaaaaaaaaattttaattcctaatcttcatgaacaaaatgttggtgctaggtcgtttcttaaattccgccacattgggcgtttcttaaatccgccaaggggtaggaaaacaaaaaatgtaagacatataaattcataacttggcttaaattcaatcaaattaataattcttggtatcattcaatagctctagatgttctctaacggaatattaatttacaa

SEQ ID NO: 9855 - DNA, 5818 bp, Heterodera glycines
cgacaagtttcgagttcttgtccaagtctcaatcttgtggtgccaagtctcgagtctgagtcttgatagtttttgtcaaatcttggtacctatatgctagggttacacggacctgggtatttgggtaaaaatcgggtacgggtattacctggacccgaaaagcctggctcaggtccggatccaagtttttaaaccgggcacgggtcctggaaccggtattgaaaaagccggatatccgggtctggggacccggtcgggcacccgggctcgtctactgtaggtcccaaattcatagtctcgatacttggcaaatgcaaaattttatcgaacattgttggtggttggtcccatcacatttatgttcagtttgtggttcgtcgtggtggtggtggttccggtgccggtggttgtcgtcgtggcagttcgtcaaacagtgccaacgccgtggcggcagcggcggcggcacaacgccaacaacagcagcgccagtatgactatcgcttaaagcgcggctttctgctccgcaaaatcagcagtttctaccgctgcggtgaagcggaacggttaaaggcacggtgccgtaagcgaaaggtgtcgtctcattttggggacaattttaatggcacaaaaatctcgaatttgatgactatgttcgagagttagggggtttgatgtattataaaacacaggtttatatcaattccattagtccttgaatgccaaaagtatccttgaaaatcaatccctcccttataagccgtctttaggaattaatggttggaatttcctacttaaaaaattcacataatttattcggcatttgctcgtattttttaatgaccttaaatcctaagtccttggaaattcgttaatctgtacttgattttccatttaccaatccgatccatgataataaaaaatttacaatagaaatactgactattaattatccctggatgtccctttgttcataatttaacactattttttccatattttttgttgtgatggtctctctgtctctttgatggtttttgtttttccctaattttctaaaattggttgccctttaactacactcacttttttttggtaattaattagtctaattaacagtttaattgtgtaaatgtcattccaattattatccatttctctcttcttttttttacaggaacgtgaagatttggatgccactttgttcacgtttgaaaagttcttgcgcctctaccataaaatttgtccacgcacagaagtgcaggaactgttcgttcgactgtgagtttcttttgttggcacactcttttgtcggcatttttgaattttttcctgatccttaaaagcaaattaatgtgtctctggcacttggcaccagttaagcaaatcccaatatattgcttttttttttgcccagaaatcctcgtgaatcaaggacaaccaaacatatatgcaagaattaattttggcccaaagaaccatcaacaaatcaaggacaaaaactaattcctatatacaggaattaattttggcccagagaataccttgaaatcaagtgcaactagttctatatcccggaaattaattttagcctagagaattctcgaaaattaaggacagacagacatttcagatgcccaggaaccgattattaatttttcgggctaaaattttcaaggacaaaccgccacccttttttcaggtcgggtcaaaaggagtatctgacgcgcgagcggctgctccagtttctcaacgaggagcagcgcgacccgcggctgaacgaaatcctgttcccccactttgaccaggagcgggtgcagcagctgatcgccaagtacgagtcggacgagtcgtacattgcgcagggaaaaatgtccggggacggcttcctgcgctttctgttgtccgacgaaaatgccccggtgttcctgtcctggaacgagcggtaccaggacatggaccaaccattgtgccattacttcatcaacaggtggaggaggatggccatgaatattttatggctgctgggagtacgaattctggcatttttaggggggtttctgaaaattttttgcgccgcggaaattttaaggcatgagaatagcgcaatctccgattttgttggacatgtcagaattttggtttccgacttttttttatcatcggaattccggtttcgaattttttttaagcctcaaaattttgattctggtgaattacttacgatttctgaatttcttaaaattttgttcactgatattctccgaatggtgtgtgctcagaagtgcaccaattttaattgatttctaaaaattcgaaaaactcgaaagcataggcactttcccttttgataattagctttcttttttgccaaatagacaaagtctattaaaatttggtgcggtttgatcatttggaagagttaggggctcctaaattagcatttttgattttttaaatattatgttctaatccatatttttaatcggataagattgtcatgtcatgatgattaaatgatcttaattaaaatcacgctctttacagttcccacaacacatatttgacgggtcgtcagtacggtggcaaaagttccaccgaaatttatcgccaagttttgttgtccggctgtcgttgcatcgagttggactgttgggacggcaccggggagaacaaaggcgagccgatcatcacacatggtgagttaattgcttaacgaaatgaagagacactccaaatttccaaaaaaaaaatggctaattgattgccccgagtattcaatcgaagtaaaaattatcgttccgtttctagctgatcagttggaaccaacaaaagtgatctatggaatatccaactgatcagttaaagccaaaagacaatcaatccgatatccaactgatcagttaaaagtcaaaaacgattgatcggaagtcaaactgatcttgagaaattgaaagtggtcgatcgatcggatatccaactgaagttaaaacccaaaaacggtcgatcgcttacccaactgatcagttaaaagccaacaaatggttgatagagcaattggtcactaatcgggctttttccaatttccactccccccccccccccctcaattcccaattcaaaagccattacattggcataatgccaaaaattgataaatttgtttgtaataattccccgcttccttcagggaaggccatgtgcacagacgtatttttcaaggcaattttgctttcgatcaacaagctgcttgcttgatcaccgatcgcctcattaactaattaattacatttaggaagtgctctatcaaatcaaagagaccgcctttacgcgcaccgatttccccgtcattctgtccttcgaaaaccattgctccaaatccaatcagttgaagatggccaagtactgcttggagatctttggtgacatgctgctcagcaaaccgttggacgaatatccggtcggtcttgatccattttttttgcattttaatcgaataatgaccggatttccgaaatccgcactaattttatttaccgttaaatttcaataatttttgtgcttgtaaaataataaatatttcagttggagccgggcgtgccgttgccgtcgcccaaccgattgcggcggaagattctgatcaaaaacaagcggttaaagaaggaagaagagcggcgacaaatggaggcattaaggtggggcttaattaattaaattattgttaggcattaattaaattaattaattaggcgaatcaataaatttatcttttggattttcgggtgggaagataggcctaactaattataagcgaatctggcacacatttaataattggctgagtaacctagtgatcgcaaggcttaaaattataaaactgggtttttgatcaggaggatttggagttgtcattgactctttgtctttgctatgcaaaaatttccgggaccttgatcccggcttttttgaaaaggccgggattgggatcccgacaaatggggatttgaatcccggggtcggaaggatttaaatttcgacaaaatccttgctcccccatttgacttggatgtcacaatttgccacaaatcttgatcaaaattcaatgtttttttatttattttagccagggccgtctgcttgacgaggaagaagcgcaggaggagcaacaaccggtggcacagccggcggcgatgccatccaccgccgccgccacaacggcacaaccaccagcagcagcagtaggggacaacaacaatgctgttgttgtggaggaatgttgctgtaacggtggtgaaccaccacaacagcagcaacaagggacgacgacggcggtggcaccgcgtgagtttggcaccgtttcttttctcgggttgtgccattggcgcattgactgttcggatctcgagtaactaattgggtggactattagtgccacgctcgagactgaaaatccgagtctctagcttatcatctcataattacaaatttattattttcttctgatgctaattgtttatcaatcagtaatcctacttatctcattttattgtttaccaaatttttaatttcttatatttatcattatgccaaaaaatgccaatattgttttttaactatatttggcatttgtgtcctttacaaacaccaaattttggtggcattagcccgccatcaaattttggcataatgtgctgtgtcgggcaccataaaaacccatcttcgccatttttggcaccaataggcgcctctccgttcggcacgccgccggcaaacagcgccgaattggcacggtcttttgacttggccgaatgccgttgctcaccaccggtggcacccgggtcggccaccagcaaccgttgtagcaggcacacgttgtctaccgcctcttcgtcgtcgccgagcagacgcgccagcatggaaccgatgttgtcccatgttgtgtcgccccccatgatggtgttgggcatcgagtcgtcattttggtacatatgtacaataagtactaattaccttagcgcccgctagcgtaaacaaaattgatgccccgagacttggcacgaaaccgaaaatgttttcgaaaacgaaatcaaaaattttcaaaaaccgaaacgaaacgtaaaagaaacaattttttttaaattttggaaaccctaacaaaaacgaaatgaaaatttaaattttgaaaaccaaaaacgaaatttttaaggacgaaaacacgatcagaaaaaactcagaaagtgccaaaaaagtgggggacgaaagtttctacccctccggcgctttgtgtccgtgtttgatgccctcatcattcatttcaccccatattgggctcttgcgcagttcgtcccgcaactgttcccagcgtaactcgttcatcttctcgccgtccgccccaggcggttcggccaacgccgccgcctctgccgaaccgcgtctctcctttctcttttccgcttttcatcccgcggaattgcgccggtccgccaggcgtcgccgggagcagcagcaacaacaacaagcggcggcggcggcggctgaccgtatgccaacggtcgccactggcggtaaggaatcgttgcgtcgaaccgcgttgcactcgcacagcggtggcggcggcagtggcgacgcggaagcgactgctactgctgggtcgccgcgctcgcggccgccgtcgcaggttggcgacgcgggggcgacaacggcacgctcgccgtcaccggcgagcgccaagtgcccgtatcaccagcagcagcaacgacgggagtcaaagaaagccaggtagatttttttatgcatttaatggtggaaaatggtttactat

SEQ ID NO: 9856 - DNA, 1703 bp, Heterodera glycines
  misc_feature (17)..(17): n is a, c, g, or t
ggattactgtgtgtacnttgtttgcacgtcattactgtacttttgtgataaattactgttgttgtgactattactgtaccttagttccgttttccatttccaactgtcactctctgtgctattcttttatacatcatttttttggaaataccagtagtctattactgtaggttttttaccaattatactgtattgtttcgcaaatttcatactttccatttctaacctaaactgtcactttaactcagtttcgtcctattgttgcagcaattttattcccagttactagactactgtaccttgtaacataccgtttccttttcctctttaactaagttttgcacattttttaattttctgcccaattttcctttccaagacttcgtttttttcaaaaattttcttttctatctaacctctctctttggcacaaatgtgcacaaataaggatagaaaaaaaatgtatgtatataaatttaaatgcatttttaaggaaattttttatttgaaaaatatctttttaaatccgcaaatccggcatatttaaatataaagccaatcgggatcgggattcgacatgaagtgtacatggtgccaaaatccagattcactgcataaaatctcggtttttctgcaaaatccctgctcatcccgataacatcatgggtatactatactgtacatcatccaacacagtattccccccatacggtattgtatacataaatatttaagtgatatatatattcatgcacatgtgtgcctacaacttttagtgctgtctgtcctctttctttccaaaactttcaaccgctacagtataatagcaccgtaattatgggcacggatattataccaatttcgatcgacaaacaacaactaatgacagatcagtttacagattccatcagttccgctgatcaacgcgcgcatccggaggctgaagaggacgcgcgaagcggtggcagcggcggcggtgacgcggcacaaccgcctgctggcatcaccagcgtttccgcgcttccgtcccatctttgttgtgctctgccggcaaagccccggctgtgccccaccgcttccagtgcctcgttcaatgccagtcagtgtccctgttttggcattttttatgcctaatgatgcctaaatgaccctatttttgatttattccgtcatttttgttgccgcctattttaagaattttcccaacatttcttaaaaaacatacctaagatcgacctaaaaatttttcaaaaaaattcatctaaaaattgtataataaacttcaataaaatttaaaattttactgaaatatattttgttgttttaattacccattttcattttttttaattttagacctaaaaaaggcttttttaataaaaaactgggtcccgaaattgcacaattcttttcctatttttgaatttgtcattttattttttttatttttgtagcaggggctttcctttcttttgacgttggaattccgcttttcgaaaaattttaggactcggtattccaattttcgaaaagttttagagcatcagaatgctttgatccattccatacaaataattgatcaacagcactgatcactttcagctgagtttatgcccgcttcactgtgctccgctgtccaccgtgcctcactgtcccacacgccgtcccggcaaaattccagcgtcacattggccggcactcgg

SEQ ID NO: 9857 - DNA, 1019 bp, Heterodera glycines
  misc_feature (19)..(19): n is a, c, g, or t
ttagaaataagcatttttntgggattctgaacatgaaaaacgaagttgatttttttgcggcgcttttcccaaaaaacttttggggcgcaaggggggccggcggtgccgataggcgccgccgggaaaaattttgttattttcaatgcgatttgttaacagattttgtccgaagaatgaccaaattttgcgattttgagcaaatttttgcttgtaaattaaggatttttacggtccggcggtgccgataggcgccgccgttggaaaaattaagaattttgaccatattttttgcgtattttcattaaaaaaattctttaaattgccaaacattatgccaatttatcaaaatttaaaggattctgaggtttttccccaaaagcctcaaaaatcctcaaaatttctcaaaaaaccacaaaaagcctcaaagcctcattttgaaaatttagcctaattgacctatcaaaaaaccacaaaatgaggctaaagcctcagatctgggagcccggagtatgagtcactattttaaatttttcaattttcgtattgaaaattcatcaataattttaaagatatcttcataaaatcaaataaattcaaaaacaacaacttacgcgaaacaaaaaagtagtctttttattgcgtgcgtttcttctcgtggagctgatttcattctcaggctaaatttttttttaccaatgttaatttattgcaaattattttataaaaatattaatccaaaaatatttgacaaaacaaaagccgagtgagaattttgtgcattttttaaattattgccttctcgaaatcgaaaatttcccaaaatttgacatgttccaatttagacttttttgaaattttgtacgggccaataaactattttacaacaggcgccaaaatgtgattaattatttatgattattaattaattgttgacttgtattacctgttccacttgagctccaatgatgcccatgtagtcatctttgatgtcatcttcccagcccgaattggcttgcgct

SEQ ID NO: 9858 - DNA, 1885 bp, Heterodera glycines
  misc_feature (1838)..(1838): n is a, c, g, or t
acattcgagaaaacatgagataaagcagttccacattttcacgatttgaaagaaactgtaaatcaattaaataatataataatggtgactcaaacaattgtataggtatttgtttggcattgaaaataaattatatttttaacttagaacaatttttgcttcatagaaacatataaatcagggtggttccaaactaccgattatggggtttttgtccgaaattctggagaatttttttgagtttccgggtttccgtattacaccacaccgctcctggtcgttattaattagaatttattttagtttttgttttaatgcactatatgttattattatttatatttgttttaaattacatgtttttattttaatttgttctttgtaattggaatttttatttatttttattaaaaattaaatatatatatatatatatatatatatatatatagttaattacctgatcaatgtctgtcatttgctgcgctccaactcgactaacactgcgcaaaattgttgaagttggtggtaaactttcgctttgactttggcaacgtgtaattttttttgtttttctaaagataaaacaaattgtttatttgaatttgatatttaagcaaaaaatattatttgatttatttttaattcaaattttaaaattatttccaactttgaaatttttgaaccgctctgcgcaagctgaagcgcttcttgtagcgtgattttgtgatatgcccgaacaattggtgacgcttcgtatgttttgcgctgctgttcaccagatcgcatcagaaatggggtcaacacggtgttgttgaaacgttcaaatctaaacgaatttttttttcaattataattgtggcgaactgactaatttttttaatttcgtttaatttgtctttttaaagttttaataaaattttctttgaaaattctttaacattgctgccaatatcaatttacaagaacgtccttgatttgtcttgatcaaaaacaaaaacaacttacgcatcgcgtaatgaatgagtccctttatgtccaatgattgcttccaacccgctcattgtgtgatcagtgtactaaaaatgaaaaagaaaattaaagaatatttaattttaataaaatggtatttcaattcattaaaaatttttaactgattcagttcattaaggattagcataaaatattggtacatgaattaatgagtttttatgagctgaaaatcagaaaaatgcccaagtttttaaaactttagtatttcttaaataaagaaagaaaacaaaaacattttttaacttattttaacaacaaaaatgagcttaaaaattataaaaaattaagttaagtaatttttttgcatgcgaaaatcattaaaccatttaaaaaatgaaaaatttctttatttgttttattaacctagtttttaaaaaaatttacaatattttagccacaatttaaaattttgtgcatcctaaaattttttaaaattttaatgatattaattaccctctcaaaaattttgttgctcatcattgtctcaaggccatcgaggcccgatttctccacttttaaccagaataataatggccgaatggaaatgccttgcacaaaaacggtgaagaaaatcacagccaatgttgttgagataaacattgaacgggccttaaaaattttacaaatttaatttttaatttaaatttaaaaaaattacagggaattgatcagctgaattatttgttgacatgacaagtccaaatgcaattgcaccacgaagtcctccataagaaagcacaaatttggtcggtgaatgaaaattttttgcgtcggaaaaggttcanaacagcgcattgaacaacacacccttttatgataatatatttcaaat

SEQ ID NO: 9859 - DNA, 4630 bp, Heterodera glycines
ccgtaaatccgctattttaaaaacaaatcatagttttatttgaaaaaaataaagaattttttctttgaataaattcaatggcattacttaaattaatccatttgcataattcaaaataattaaataaattttaatcctatttttttttaccgacagtccgatgtatcaaacagaatgcaattgtgctgcacacaaatgtccaatcccatgtgtactcccgtgacaccagggaaaagccaaggaacaagaaaatcaccgtctcactgcattgtgccaacattttggtaaaatatttgacggaactgtacgcatcatgactcaaattgcccttcacaaattgcttcatcgcaattgtgcacgcagtaattctaaagaaagaaaacaattgatatcgttttcatttttgcccaaaaaatgctgatgatactgtatgttctaatgcattactgtaaaaagtttcttacaattgtgcacgcactaatttttgagagaaaaaaacagtatttattcgtgcaaaaaattgctggtgatactgtattttcaagagaataaactgcaaaaaaaacattttttttttaatatcgaaatttaattattcaatgaaaaaataaacattacgccaagattgaggaaatgccaaacatttcagcagtcaaataggacatatatggtacaacaaacacaaatattggtgctatcagacgcacatgggtataccttaaaaataaattcacaattttagttgtgctttgccgaaaaatggtgtcaataagaaataataattcgttaatttattaaaaaattctataaaaaaaaaactttgtcgctatgcatgttagtgcagcaaaaaatagtccaagaatgcaaccaccaatggaaatgacaaaaaaggacaaaatgccttcaatgtaatccattgcatgtaaattgtaagggccaatattggtaaattcttggaacattttgtaaagtgtctgtaaacaaaaaaataataataataacaataaataattagctattatttattgttcttaattttttaagctatttcctcgttttttggggtcgccccataaaaattttaaaaaatcaacgaaaaaaatgtccgaccatgtcacgcatttccgagtcgtacccggacagcactatcgactaaaaccatgtcctgttttaacaggattatgaaaccaattagaaagacgaaaagtcatcaaatatttgaataaattaattagaacctaaatttcctgcgtcatatttgaaattttgttgtttcaagttccgatgttttatttcaagttattaaaaaatgattaaatatatttaatcatatattattttttgtcaattagctatttttaaatattcctaagcaattcatttgtttgctttttaaaaccaatttcaaagaaaaaaacatccaggccatgacaagcctgtatttttccaggacatggattttgtttagaaaatgcaggttcatgtgcaacatggaatgttggttcaggcccaggtcaacgacttttttttcaggaaataatttaaattaaaatggaattaaaaagcaaaaaaattagaccactgctgccccgtcattgaacaatgcctcgccaaaaacgttgatgaacagaaactcgttgacacgaatttcttcaaaaatgccaatgacagccaccgggtcaacagatgaaatcagtgaagcaaataacaaaatttgaaaggttgtgaaggggacagaaaaaaagccgacttggcccatccaattcaatgagtaacctttgaaaaactaatttaattaattatttaccaaattaataaaaatttattattttttttaccaattgcaattgtgttccaaattgtgccaacaaaagcaaacaacagaattgagtcaaaattttcaaacagttgtcgatttggcatgaaaaagcctaaagttcaatgttagaaatttgggacaattaattgttgaataaattaaattaaaggatttttggcactttatggagtcaaaaagtctgactaagaatcgaacaattttattacaaaactaaaagggggacccttttgattttcaaaatttttttatacaatccttgattttgcaacaaaaaattttaatttttcaacccttaccctgattttttttttgtcaaccactccttttaatattgcctgatttttaactaaatttaccagcatcaaaaatgattggagggagaaggtacagaaaaaatataggcgattggagcatataaattcggtgatcaatttggcacaagcgtaaaatgaagccgagaacaaagcccaacgcaatcagcagtgccgaatcaggcaatgcttcggcaattcgtttgtttacatgaaaaactaaaaaaaaaaattaaaaatataaattaaaaaaataaattatttttacataattttgacatgctggctaacagaagccaggcactaatggaataagctgtcgacacttcattccagtcaaaaatcaacaactgaaacgtgctttttatataaaaataaattaattcaattttattttaaaatttttttatttaaataaaaatgtaattaatatactttaatttgtttttacatgaaaatgccgttttgtttctgtaaatgattcgccaaaaagattcaatctgattgcactataattgctgatgttttccatgaattgagaagcattttttaatatgggatattgtgccgacaattttatgaataaaacaattacaagaaaaattgtaattaaatatttagaacaaaatgttgccatttctaaaaatttatttaaaatataattgttaaaataaacaatttatttgatctatcaaattattgaaacaaattaaatgcaatgaaaaataaatctcgtaaaatgtgtcaacagcgttaacttttcgtataaatgtcgcaattagcaatgaaatcaaatgaacaattcccaataaataaatttatgatttttgattagtacatacatggagctcttgaacattttgctttctaatgcaaataaaattttatggctttcttgtaataaaactaaagtattgaatttttttttaaatttttactataataaatttattggaaaattattatttttttaataattaagtatataagaataaatgatcatatcattataaaatatacaattatattaataattttaaataattttataatttagtttttatagaattatttgttaaaaagaatgcattcttctattatagataattaatttaatgaaagcattattgtctgttaaatggacaaattaatgaataaaaatagttttttttctcaattttagtgaatcatcacgagtttgttctattaatttcttatcattaacaaatttaaatctcatcagtttacctccgatttatagaaaaaaacagcgaattgataacgcataaatcgaagaatatttattatttaaaataaaaatttatttacaataagcaaatatatcccatacccatttatagatgagcaaatatatatcaaagcaaaatatacaaaatatagcccataaatatttgcatagagtggcacataaataactttaaattctttgatacaaatgccatcaaatttgcccatttgattattcaaaatttttaaattgtggaaatcaaatttttactaaaatccaatttggatttacaataaaatgaaagtttatattgagattaacaagaagtgtcattgtcatccattatcatgtttcatcatgttaacaatggtcggccctcttcactttccgttcgacttcgagttggcatgttatgcaaatgccgtgccaaacttaaacattcaattattaattacagcattttagttattaatttcttaataaagaatttctcaaaattaattaaaataattataattgggttatgtaactttgattcataaatcactaattattctttaaatcaattaatattataatagcctttgtcttctccattaaaataaaaaaaattacgcttttcgtaagaaatgtttgcccgctccgctcgtaattgtctccaggccagccattgcataatctgtgtactgaaaattaaattattttaaattatttatttatttttggcatactgactctgtccaatttttcgtctggattatcatcctttttttcttcagctgctggtcgtgccgtatcatcatcacgttcaacttttagccaaaacaatagaggccgaatggaaatgccttggacaaaaacggtgaagaaaatcacagccaatgttgtcgtgacaaacatttgtcgtgccaaaaatagaaatttttaaaaatttagcaatttttattttgttttttaactggcgggatttcaggatccgcagatcttgtcgttaataatgcccgggaaaaataatatttttaatttaaatattttttttattattttacctggaagtgttggagagaaatgacaagaccaaatgaaatggcacctcgtaagccgccataagtgagcacaaattggtcaacaaatgaaaatcttttgccgcggtatcggttcaaccacgcacattgggcgacaacaccaattgtatatttataatttattactttttttagcattttaaat

SEQ ID NO: 9860 - DNA, 4447 bp, Heterodera glycines
  misc_feature (4273)..(4273): n is a, c, g, or t
  misc_feature (4314)..(4314): n is a, c, g, or t
  misc_feature (4342)..(4342): n is a, c, g, or t
ttaccatcgctggaaaactttaagcatcccttttaacaaatttattgatgaatgcatctgatacttggtcttttgacgaagttgaatccaattggtcattttatgaaaataaaacggaaacttaagtctacaagttgcgagaaagccagtgggaagtatataaaacaaagattttcaatatttatctaaaattttttaaatattcctcattgatgaaatgatcagcgacgaactgaacagtgacgaaacgatcaatgacgaaatgatcggccaccataacatacagtcaagtgcaaaagtattgcatcaaaaaaaattttttcgaaaaattcgattttctcaaaaattaatggtgggatatcaattagtgtacaataaatacccaaaaactgccccaattactttctatgctatcgagaaaatcggtcatgacctaaacaaaccccctttttggcggtgcaaaagtattgcatcaaaatgtttaatcaatgaaaaatcaattttatttagaaaaaaaattctgaaacaattcctgctaggctaacttttgacaaaaaagtcttttataccaacttgaccagatcactctttcatggtgatatccgaaaatggcttgaattcggaaatttttcggaaaaaattcctagggggttgggaaattttttctggaaaatttgagcaggcccattgggttttttgagttcctcgaactattttttaaaatttaaggaaattttttgaaattttgcagactgatagagaacacttagggctataaaatgatatcaagaattaaaaatttggttgctttggagcaaagttataaataatttttcgacaaaaattttcataatgatgttttttaaataacgccctttatgatgttttctaaataacggctccgccccattatgacgattaccgaaaatgagtccgaactcattacggtgtttgggcatttcgaattcgtaccttaagacaatttatttttataaatttaaatttgcccaattttctttggcaattgcatttccaagtggaatttgctgcctattgaatgggccgcttattctgatgtcgtgccaaactgttctttccatgcaaaggccaatgctttgaaagttccattaattttttttatatttaaatgtaatataagatatatttaaaaaaagatttaataataaaaagagacagtgaataattaaaagaaatgcatccattggtcaattatggtcgatgatcaaaaactccttttctttctgctgattgatcatttgttatctccgcaatttgtgctctgcgcaatgatttgccgtgttattgacatcgatcattcgcatctgccttttactgtgctgtgtttgtttgagctgcggcattctgttactgtaatgggttgtgaatggcgccatttcagtggcatttctcttccggacaaatggcaaaattttgccaatcattcgcacaaaaataacgcgcatttctttacaaagcatcagcaaaaacagcttaagaaatgtttatttaaaatattttattcaaattccattaaattttaattttgattgcctcgtccgctatcacataaatgcacacgaaaagttggatggggaaaaaagcaatttgtccgattggatgacagttgataaagtcggagtaccacttgtaattggccgctgaattggcccccacataagcccaagcttggatatgaatggcaaagcatgtcgcagtgattcgtccgctgtctttgtccgacgattgggcggacgccccttcggagttccaactgcgattatgcgctttaaaagtggataaattgggaatttcgaaaaattaattatttattttaccttttatccacgccaaacgaattgcaattgccacataaagtgaggaagaaacgatcagataaggccaagtgtaaagtgaaataactaaaagagaagagaagcggaattgatactgtagaaaatacagtaaccaatcattacagtaaaacattcacttaccagggtagaaatatgccaaaacagtgaagaggatggacaacaaatgaaagagcgcacattggaacagaacaacccttaatgaaccgtaaaaaaatcatcaaaatggggggcgaaggctattttattacgcaaaaagggtttaaactaattaattaattacctttttgtgactttttcgttgtaatgaaatggaaagaacagtgcgtgtgctctgtttacggccaatgccatgatatgcaaacgatagttaaccaatccgaaaatgatcagactttggcgcaccatttggccaatactgacgaaacgaacgaccgaatcaatgcccaaaaagaaggagcatatcatgatgaaggcaggaaaaagctaaatggggaaggaaatcacttaacttacaacaataattaactgtttaattagactgaattggctaattgattaattaagtgttcaatttttggttaatttccccatgttcgccttcgcactttgctgatcagaatgtacagagccaagcgttctcgagccaatttgatcaaagggtaaacacagaaggtgagaaacagaacgaagaccagataataagacatttgaaggcattggcgcactttgacatcaatcgaagaagcaatgccactgcgattcattggcaaaagaaaagcggaaaaacgaagaaaaaaagaattaaaaagtgtcgaaattagagggagaaatatctttttaaagaaagtgttggctaacagaagcctaaattaatgcccacccactcttctgtagctgtgattttcacttatttcgcttgacgccactgccaattaatgaaaaaaagttaaaaaatgcaaagtctcagacattccgcacaaattaatcaaaaagtcaacccatgtaattacgcaaatgcataataaattatgggccacctgttcttacttttttcttttgcctttcgttgtgccattttccaagaaaatattttgagcataaaaagtaatcattgcaaagcagcagcaaagaagcattcattcttgctagattttaaatttaaatatgcaattgggaggaaattgatcgtctaagtacaaaaatgggatttacataaataatattgaaataaaacaaaaaatatattcgaaaaaatcaatttaaattaacaaaaaatggactaatgagaaaatttgagaaaaaagattaatttatctatattttaaaaaattttaataagtctcgctgccagttctcaagtaggggaaattgaacaatcaatctcggtcttgttcccggaagcaattttctgtctcagaaaattgaaactctcggcagcctaattgtttcatctgtaaattaaaaaaatagaggtccaaaagcaactcagctggcaaatgaatagagctgggaatttaagtcataaacactttaaaatcttaatgacttgacttgatgttacatcaagtttcttaatttctttagctgcaatttttcccgctcaatagcaccacagaaagtttttatttattttacctattccaaaattgaagtaaaagtgcaaaaagagtaacacattgaaaagggacccatttttgaaaaaaaaagatttttaaatttgaatgatttgactcatccaaaaagtacaataaatcccttaataataataatggtacaagcgaacgtgttaaaacattttaaatcataaaaaactaataaacttatataattttatttatcagttagttgctaaccaaaaataacctcttgcttaatataaaagtgcaaaatatatttactttctttttcttaaattttgttttttttaattatgtgccaacgacgtaatgtttttatttttattttaaagaagtttaaaaataaaaagtattctaaaacaataaacaattttactagggctcgaaattatatggataaaaaacgtcaaatatggacatataaaaatgcccgaaatatggactaaaaagctcaaaaatgccaaatatggactaaaaactgccaaaatgtatgttttaaaccttcaaaaattccaaaaaaggtgtgtatattcaatatttgcttaaataaacttaaaaagtacaataaacaagaaaaaaaaatggatttaaaacttaaaatgcaaatttttattgtccaagtttgccaaaatttcgaaaaaaattctcatttaaaaaaaagaaaaccgcaaaaaatggaaaaaatatttattaaaaatgccaaaatgaccgacgaaaactcaaattttttgtattttttgngggtgtaattttttaaaatttccaaaaagtctattctttanggggtgtactttttcgcttttttgcatntttcttgtgaaaatttgccaaaaatggccgaaatatggactaaaaaaggcaaaatggcgaaatatggatttattcccgaaacccctaaatatgtatttatatgga

SEQ ID NO: 9861 - DNA, 1876 bp, Heterodera glycines
  misc_feature (95)..(95): n is a, c, g, or t
  misc_feature (107)..(107): n is a, c, g, or t
aatgggattttgtcatagcatatgcgcagaaaaaacatgttaatccatataattcgagccctagtaattactaattagttgtgaacaaatatatntaattcataatntgaaaaattttattatttgactcaaaaatctgtagaaaagagacaggtaaaattgattacatcggcttaattgggcctttttttgattattaaattgatttttaaatagaagaattcaatatttaagatgaacatatttacattattcacgcaacattcggtagttttttatggttatttattatttttaaaatgcgttgcaaattggcacaaaaacatattccaaagcaaatatattaatttcgaaattgggtataattaacgtagaaaaaatggtggtctaaaataaagaatttttaaaaaagttatacaacaaaaacaaaagcaaacaaactccaataaaacagatgagattattgaccataattatgcttagtgaaaagattattttcttcatattttgtggcactaaattaaaaaataaattaataaattaaaaaaatttgttaataaattggcactttgttcttcccgacaccaaatgattgcccaaatggacaaatagcaaataaattcgcagacaaaaatgccaatcccaccaaaggaaaatgctgcattttcatgcattgaactcaattcaagcataccgcacattactgctaaaattaaagtttatattaataaattagaaggaattttattaattacttttcccattgtttggagcattcagaataaagaaaaagagaaaaaagtaatacgccaaacgatgacaagcaaagacctttattcgtttaataagaaaagtaaattttaatattgacacatagaagaatgggcttaaaaatcacagacagactcactaattaacattttaaaagaaattaagtctcttttcaagcaaattactgatctcatctatatccgaaattaaattcaattgaaacgatgctattgagaagtacaaaaagtgcaagtgatcaaagtaaaaggaaaataattattttaaaattaaaaacaaaaaattatttttaattaaattatagggtgaaaaaaatcattttttcctactatttagcaaggagaaccaggaaaaaatatgtatttacacgaaattggccgccctaatcatcggtatggacggaattgaaacaaatcgcacaagtttttttttattaaatgtcattcaaaaaattgttaaaatatgtttttttttgcttttgcttttgcctaatttttcagaaatatttttgcatttttcgttgttttttaatgaattttggcgatttatttatgctttttaagtctttttttggagatttttaatgactttaattccagccctaatcctcactgcagtgtcttaagcttttcctgagctttccttggtttgaaataggattatacgggccgggtatttaagcaaaaatttggtcctggtattacagggtccagaaaagccgggtttgggtctaagtttttaaaccgggtgcgggcgggccgggtttctggtctaaccaggccctgaaaaaacccaaaaaatatttttttttttttaaattaacttttttcattaaaataaaagcttacacttaagcgccgcattatttaaatactcgctatacactaaaaactttataaaaatcatcatataaaaatggacaatgagtagcagaataattttaatgggcgagaaaagagtaatcgaaaaataaaacgagaaaagtaaattaatatgataaaaactaataatcattccttaatataacgaattaattaaatattttatattgatttgcaaataaaatttttaataatcatgttaaaaa

SEQ ID NO: 9862 - DNA, 1515 bp, Heterodera glycines
tccagggaagttgacttccaattcgtcattcgttgaccacaattgtgcttcgtgattcgtcatttcagacttggcgaatgggcattctctgctcgggcttgatgattttttgcgaagagctcaattgccaggttgagccattgagcagtgagtgatggcgggggacggcaaaaaggtgaattttccgtgctcttgagtttccaaatcgtgcttacgcgatctggggcgtgtcgttggctttttcgtggtctgcgttctcgccctggtgacgtactggattcgtgtccttgctcttgttgcaagggttgttcgctgagtcgtcgtcgtggtccagtgagtgccattgcagaagacgcagtgtgaaggcggatccctcgaccctgcttgtactgtgccatcccggattggcatattttaggcgcttgagttggccttagtcccctctgttgtgacctccgcggttgcggtctgttgtggttcattcgctgctgaacctcctcaatcgttgaggacatgtgaatttgcttccggaaacgtgctgtcagctgcatgctcgagtgcttttgcttgaattggtgacgtagtttaacgtccttatggaccaattgtcgttgcttgtttgacgtcatttcggccctgaccgtcggatggattgctagtttagcgtcttttcggacaatggttgtttggtggccggtgctttgctagtttaacgtcattgcggacaattgatgctttgctagtttaacgtcattgcggactttgcgtggtttgtttctctagtttaacgtcattgcggacatttgatgctttgctagtttaacgtcattgcggactttgcgtggtttgtttctctagtttaacgtcattgcggacatgttttgtttgcttttctagtttatgtctttgcggacatttgttgtttggttggttctttagtttaatgttattgcggacgattgttgtgtgggttggccgatgctttgctagtttaacgtcattccggactcgtggcagccgggtgattagcgtttcggacagttgttgatggcttaggctagtttaacgtcattgcggacgattgttggtgattagcttagtttaacgtcttctcggacgagtgctgttggcatggtgtcttactgattgttgccgagctcatgtttgggcaattctgttgactgcccttatcaattactgttgttgagtccgagcttctggccaatgtagcgacgcaatgatggttggcgcctgatccacttgcggttggcgacaaggctttcatttttctgttgagttcatttgtttggcttgtttgtgcgggattcgctacttttccttttggttgtttgctggaagaaaatgctggtcgcttggcaactgatgaactcttccttgttggtgttagccgttgcactgccataggaattggtgccgttgaatgctcatttggtgatttggcttgtctatccctgactggattttgtatgatctcacatgcctggatgcgtcgct

SEQ ID NO: 9863 - DNA, 3444 bp, Heterodera glycines
tgaagacttctgatgtgttcctccggggctccgtaccctttatgtgacagctgaaggaccgtctcgtagtttgcgtcctctagccggaagcccgctatgagttctcgcgcttctccacccagcagattgcggagtaagttcagcttctgcgctttgctgattgattgactgccgattgccgatttgaaggattcgtagaattcgggccattttcgcttttggccgaaaaatttatccagttgaattggctggaattggtagagcggtgctgtgaatgttggcattgtcattggtgctgccattgctggtggcatgggcggttgttgctgcggattggccaattgatccgcctttgcttctctgtcggctctgcctctgtgcagtttggctgcggcactaagtgttgcttcgagatctcgcaaatcccgaagtttggttgttgctgcgtcgtatcggtcggcgattttttcatttttgtcgaatttgatgtattctttttcgccgttgtctttgtcgtctccggtcaggcgggcgagaagttcaatccaagcgttggatgagtctcgtagactgtccatctgcatttccattgtacggatttccttgacgacgcgatcaaattgagcctccaagttgacggcattttcccagtttgataggtccgggtcggggtgtagaatgagtgaggtggcgcttttggcgttgtccagagctttgagtgcattgatgatccctttttgtattggcccagacattgcgtgcagtttggttgtgcgtgtgtgtgtgttgtggtgcacttgttgttttgtgtctttttccgggatcagtctggccttggtcctggaccttttgtgactaaacacctgcctcggaggacaaggtgtttgccttttgccttatggctaaactaaagcctcggaggactgttagtttgccttttgccttatggctaaactaaagcctcggaggactgttagtttgccttttttccttatttgtcaatggccttgtgcgcgcttgaacacccttttgtacgaagtacttcctcggagggcaagtacttcgtccactacacaacaccttccaaccctctgttcggacgaagtgcttcctcagagggtaaacactaagtccgctacgtccctcgtgaagttatgcctcggaggacaataactacacgaaactatgaacactagacaagcctcagagggtcttgtctaggctctctaatttgcttttcccttcccctgtgtcaccgggattcgtcgagtcaatccgtggttcacagcaaatccacccaggagcgccaatttgtcccgacttgctctggggtcgggccaaatgaattccacggtgcgggggtcaggggcaggcagggacgaggaccggccaaatcaaatgccgagaattgattaagcaaaatttattccgggaaaaagcctcaaacttgggtaattaaaccaaaattttgaaatggtgaacgaattatcacaaattgattacagaaatgccatcaccggggaattatcacaaatggaattgggcaccgggatgggacaggaaatggagggcactggggccacagaacaaaaatcaataaccggggggttaaagaatgatcacaattggggggccatcacagttaaaggcaaatggaggggcggggagagaaacggcaaaaattgccaaatgaaatttggttgtgaaattgggggcatttttggccgcttaaataacaataaaattagataaaaagtggcaaatgtgagcagaacaaaatgggccgaaaatttgggcacaaaatgaaaaacgggggacaaaaatgaacgaatgaacaaaatgggcggaaaacgggaaatttgggaggttcatcgttctttggagtcgattcgccaaattggggacgggggcagaaaagttgcggtttgacaaattggtcattaatttgtgcgcagggcgggggaggaacacacaaaaacaattgacaatttgaaggaaaagggggacagagggatgaaacggcgaaaacatgttgcgcggcgggcgggggattggtgaagggcctcctccctcttaattccgccgatcattgatcggcgataggaataaaaattccgacatccgcgatagttttctgggctttttattgacaataataactccaaataaattgtaattatagcattttatgactctttgtatgtataatgagagtaggaacattttattggtatgccttttttaatatccaaaaaagataaattctgcttttctgttaaacataccactaaaaattttggatatgtgtccaaacaatttaataaaaattcactaaattccgcgatagttttctgggctttttattgacaataataactccaaataaattgtaattatagcattttatgactctttgtatgtataatgagagtatgaacattttattggtatgccttttttaatatccaaaaaattctgcttttctgtttaacataccactaaaaattttggatatgtgtccaaacaatttaataaaaattcactaaattacgcgatagttttctgggctttttattgacaataataactccaaataaattgtaattatagcattttatgactctttgtataatgtatccaaagagtcagaaaatgggcagattacaatttatttggagttattattgcctttaaaaacccgcagaaattattttggaattttctggaattttattaaactgttttgaaatatacccgaatttttgtggatgcgatgttaatgagaaaaagcaattttgcttttttaaatattaaaaaaggcataacaataaaattttcctattccaataatgtatccaaagagtcagaaaatgggcagattacaatttatttggagttattattgccatttaaaacacgcagaaattattttggaattttctggaattttattaaactgttttgaaatatacccgaatttttgtggatgcgatgttaatgagaaaaagcaattttgcttttttaaatattaaaaaaggcataacaataaaattttcctattccaataatatatccaaagagtcagaaaatgggcagattacaatttatttggagttattattgcctttaaaaacccgcagaaattattttggaattttctggaattttattaaactgttttgaaatatacccgaatttttgtggatgcgatgttaatgagaaaaagcaattttgcttttttaaatattaaaaaaggcataacaataaaattttcctattccaataatgtatccaaagagtcagaaaatgggcagattacaatttatttggagttattattgcctttaaaacccgcagaaattattttggaattttctggaattttattaaactgttttgaaatatacccgaattattgtggatgcgatgttaatgagaaaaagc

SEQ ID NO: 9864 - DNA, 2231 bp, Heterodera glycines
  misc_feature (2190)..(2190): n is a, c, g, or t
  misc_feature (2204)..(2204): n is a, c, g, or t
agcgatttctcgacaaaacatggcataactttacttaaatgcaaccaaattttacattcttggtatcattcgatagccaagctttttctctactagcttgcaaaattttaaataaaattatcaaattcaacataagttatggcagaaataatacttattttcatacaacttttaaagttgaccaaatttttttaaaattttgcaggcttatagagaaaaagcttggctaccgaatgaaactaagcacgcaaaatttggttgcttgtaagcaaagttatgccatgctcatgcttaatgaacaaaattactggcaacggaaaacggtaattatttcgggacaaatgccaaatttgtcgtttgtaattgtatatttttggaagttcagcctgtagaaatcttccgctgagctctcattcaccatacactcaatgccactaaaaatgaaaaaaatattttaaaattggtaagaaattcatgaaaaatgtatgcctctcaaaatttttttccatcttttacgatttgtttatttatattaaataatgttaatttcatttaaaatcaatattgaataaatattattctacgcaaatattctttctctgaacatttaggtatatgatcattttcccaactttaaaaaaatcttcttttttttcattttcttactacaatgatttctaggccctagattttttggcacttaaaaacgccaaagtgcgagaggtttaagcacaaaaaaaaattgccaaacaaggtcgaggctcagatttttaggcacttggagaagtttaagcccaaaaaaattgccaaaaaggccttgccccaaaaccgaaaaataggcactaaaaaggttaagtatttaaggggtgtaaatcaggggtagtcgctgaattcgattattattttttctattttttttatacgtttttctttcgaagctatttagggaagtgtattatgcgaaaaatttttagttaattctccgaactgctttggaatggtggttttacgacgcatctgcgaagtcaagcgggagtgcattcctgaatattctttttccagccttagcggagaggaattttaataattagaattattaacttaattgcattatttggggtgttatatatacgtcattttgccaaattatatattttttttttcttaaaagtgattggaatgactggcgatttcctgatctgatttgatacaattattatttcaactcaaatcaaacgtatcatatttttattcgaatgatgattctataactaggaatcactattttggtgcttcgccactaaaaaaaaactatttcggaagttggccactaaaataattttttgccaatattttggcatttttggaaaacttcccaaaattgcaataaaaaagaaaaatacacccctaagaatcgacctaaaaattttcaaaaatacacccctaagaatcgacctaaaaattttcaaaaatacacccctaagaattggaaaaatttcacaaaaattcttcccccaaatttttttttcttgttcaatatttgctaagaaaatattttgtaactgcaatcagtgaataaaatctttttccttaattttaaattattttcaaattaaaaatagttatttacatccctaaatttggaactttttcgccactatttttgccaatattttggcattttttggtcactatttagttaattattttgggattttttatcactaaaaatcccatccctattgatcaacctgaaattgggaattttttttgacaaaactctatttaaaaaatgggattaaaattcgctgacttaatgcaaaaaaaaaacattgaaaagttcaaacaaaaataagaggactaaaaacattcgttcttaatatttttccaaaattcaagttatgggcatataattcaaattttaaatatgaattgaaaattgtgggcaattttgtccgttttttatggatgttcaaaatggattatattttatatagtaaagaatgcctaattaaaaaaggttctttcaaaaaaaaaactgtaaagaaaaaagagaaaaatcaaatggcgacaaaatttttttcaaaaaaaaaattaaatattttttagggttttccatgttttgctaaaatcagcatattaattaattattgcttaattaattagttaattgatttcatgacccgaatncagagcaattttanattcataaggatatcatatcctaaaaa

SEQ ID NO: 9865 - DNA, 2578 bp, Heterodera glycines
  misc_feature (1631)..(1631): n is a, c, g, or t
  misc_feature (2554)..(2554): n is a, c, g, or t
taattctggctgtttgtgtgtgtgtgtgtgtgtgctgtgcggggcatactgtaatgataaatgattggtgaagaagagaataataagcaaggaatgaaaataatggatggaatttgctgcggtggtgtgtgaggggagagaaaacaaaaatgattgctgtagcaatttctggcatacggttggttatagtaggacaaacaattcggtcaatcaaatatctatgggcaaaaatcaatgggagggaatgagggtcatagtatagtagtagcattactgtaagcatgggaaactgtgccctaaggggaaaataaaacaaaacatcattcggctctaaaccattaactttgtgatcaatcaataaatcaataatcggtgatcgttgagtgagtctgatcagccgcccggcccgacaatgtcccgattgatcattccgcaattgacggtatttgcagtgtcagcggtgtcggaccgccgacgccactgctgccggacagaatgttggtggatattgtgccattattgccagcgccggtggcgcccttttttgtgtgggcgccggccaacattggcattggcgttgtggtcggtgcgcaagtgttccggcgcgtgtgccaacgcccggcgccagcgccgccgctgcgcggcgacaatgacggacttcggctgcaactggcgccggacagtgatgacagtgacttggttgtgacggcacatccctcacgggcactggcaaccctgcaaagagcaattataaataattaattaattaatatccattagctttgtcgctatggaaaatttgagacctcaaattttcaaattttagtatgaaacctcacaatatttggtttgattttttaattctcttaaatacaatatttaattaatctaattataagggaaggatttttatgcctttacagatttttttcgaatatattatcgcatgaaaagcccaaaaataaagcatttgttccgtgagttttgagcacataatatgttggaattttggctgatttttgagatttttgtcacatattttagcgatttttttaaattcgattttttacaaaaataattttttgatgctaaaattcttggaaaatgattttaaatgcttctttttttgtctgcttatatcagaacccggttgcgtgttaaaattcaaaaataaatgcgcataaatttgatttacaaaatttaaacgaatggcttttttaaattatatttatattatgaaaaaatgcactaaatcaaacaataattttaacattttccagaagaaagttaaaattccgattaaaaaaagtaattaaaaactagagaccggacaagagggtcggtcggtcggtttcggtataaaaaccgaaaaaaaccgaaaccgaaaaataccgaaaaaaaccgaccggtccgatctctattaaaaacatacacatacatattatttacattttcccgttttatttttataccgtaccactaattaataattaattatatttaccgtaccttaacagtcccttaggctgttgcatgtgctctcccccatcattctcattattgttattgccgttgttattgttgttgttgttcagcaattccaggtactgctccgacttcagaaaccgtgngtacgaatccttggccatcagttggcaatttttttgtgtgccaacatgaacatgtcggcacgcaacggcacaaccgacaatgccgcttgggtggaaaggcgtgtttggctgtccaaattcacctggaaaatttctaaaattagtttaaaattttttaaattggttctaaaaattatataaattcaattttttgtaaaaaaacgtaaataaagagaaatttaaaaaaataaaaattttaaaattttaaaattaaattcagcaaataatttcagaaataaaaatttaaaaaatcatttactgtggtgccgtttgaaaatgctaattgctaataaaagccaaaaatttttttgttaaaatttttgtttggaaggatgacacatgatccttgaaaaaaattcattcgctttttgtttgcataataaaaaaaacaaatttaaattttttttttagtaaaatttattaagatttctttaaaaattttacttgacatgaataaatagcaataaatttaaaaattcaaattgcattaaaattgaaacaatgatttataaatttaaaatatttaaattgattaaatattaaattaaaattaaatatcaaattaaatttcattcattttggcatttgattggcatgcctcttttggtgccaattcccggatgaatgtgtcataaatttggttggccttttgcccggtggactttttggccggcttcatccgcttgaactgttcacactccaaccaaaactccaaattctcctcactgaactcggactgcaaaaattcacggaacaacagacaaccgtctgaaaaatacaaaattttttcgtaaaatttcaaaaatttttccaaaatttttacatttatgggccaacaaagcgtcaaacgattcttgccaatgtcggcagtcttcgcgcgacgngcacagcacagaggcggacatgct

SEQ ID NO: 9866 - DNA, 1202 bp, Heterodera glycines
  misc_feature (1189)..(1189): n is a, c, g, or t
ctattattttagaattgttgaaccgataaatctaagttcattgttaaaaatcttaaaatatagccgttggaattttgctccaaaaaattatattctctaaaataacaataaacggatttaaatttaataaaattaaataagacgaaaaaaataaatcaaaaactaagaattctcaaaaaattccggtaaaagaattgccattttaggatttgtgttgtagcttttggaaagagatgatcctgattttttttatatatatatacatcatcaaaaattggctttttcctagccaaatttgtaaattattttgaaaaaatgtcaattttttattaagtgccaaatatcgtattttctctaattatccccagtctccattaatcccgcccgtctccaattatccccccccccccttctgaggaggttgaaaaatatccccccgaggggataattagagaaaatacggtaatcattttaaggctctggtgaaaatttgaaaataatttttgactgatttgttagcgtttgttaggcctcccattttaagctaccctcccccccccaccctcaccacatgccaaaaaacactactcacagtgccatgcgtcgctgcagcttgtcagtgccgccgccgccggttgcaaccgagttgcgcttgtccaaccgcaacgcgcccgccgcactgttgctgctgcagtgcttgtccagtgctgacaaaaaattttgctgctgcagctggtgctgaagctggttgtgttgcagcgagccggcccgtagcggcggtgaaaaagtgaacgacgcaacacggcgcaccatcgtgttgtctgtggttgcggccagcgcgctgcgcaggcgaccgccgccgcctcgtcgctttgttgtcggcgactgttgttgttgttgctgcagggcgttggtgttgttgtacgggtcgaccagctcggcggacgacgcctgctgctgcttgagcggtgatgtgggcccaactttttggggcgacgaacggttgccaccgttggtgccgccgccgcctccgcgatgcacacgcatcggcgagtagtgatgctgcagtgaggcctggaattttttggaaatttggattcatttttcatagatttttgaaaaaaatttttaaagacgcctctggtgggataaaatcaccatttattcaaatttaaaattttttgccctnaaagtcacaaaaa

SEQ ID NO: 9867 - DNA, 1724 bp, Heterodera glycines
  misc_feature (1718)..(1718): n is a, c, g, or t
cggggggcaaccccctcatcggagaaattttcataaaaacgcatgaaaaaaatttatagtaatttttctaagtgaaaaaaaccttagaagtcgatgcttaaccctaaatttgtcctttgttgaatgaaaaatcagaaaaaaatctcaaggccagcatagaaatgaaaaactaattaaaatcaattagcctaattgacaaagcaattaataattattattccattccaccacacttttcggaactgttgttgttgtccatctgctgatgctgctgggactgcttggccaacaatatttgtggacaattcgaccacaaccggtgaggacgacgcggatgaggaagaggatgatgactcatccgacgacgacgaaccgccgccagcgtccgcgccgccggcaccgacctcggcacaaccgctgctgaaactgttggccaatgacgacgatgtttcgatggggcccggtgccattgttggaagctgttggtggtgctggtgtccgatgagcatttgaacagtgccacaatttgttggggacgaggaggtaaagccgcttgatgtgaaatcggaggtggtcgagtcagctgaaaattgcagttgttgttatagttgaatacaatatacggtatatttatcatttatccgtggtataaataggcaattcagaaatgttgacattatacttaatacacaaaatgagcatggctagtgatgctcgagagtaaccggcattgttagaccttttccgggatttggccatttttcggggttatctccgacccaggtgcccaaaaacggacttcggcgccactcgagaaaaatgtctaatttatgagggtctcggtctctagtctttggcatacaaaaaaatataaaataaaattgggatagttgaaaatatatttcataataaaaaaataaaataattaaatatgtatttatatggtcttttttgtagcaatgctttgaataaaactatgtatattgttgtcagtatttcttggtgaaacttttccatgcttatatataaactaattgtatatcggagataatcaattaattaaaagggccggatgttaacacggaagtccggatgatagcaaatatgcggatgttatgcaataaaaaacaaacataaatgaatttattggtgtatttaaaattatagtatcttggcggcggatattttgttaaaatttttgttttcgatttatactttattatttattaaataattgcatatccggatataatatggaatatctcatacatataaaatgtgcgcgtaacgcgtacaaaaaataattagtaattaaatgtgccgccggtagcggaaaacaatgcgccaatttggtttttgaaaaaccccaaaaaaaaactgtaaaattcaaatcattgaaaaataattcttttttttttaaaatttttgtttacagctaattttttaaaaattgcttccaaattaaaataacatttcgaacctattgaatgacattttggtagtttttgatacaaaaaaatgacgcatttttcgccaaaaaacatacccaaaatggcactaatttgtttttttttcatagcaaatgccatccactaatacaattttgtgtagctttagagaaaaagaatgcctactataatacattatgtaaataaatacctccccccccctataaataaatttatttatgggacaattttttgcgggggatgggtggngggggg

SEQ ID NO: 9868 - DNA, 4832 bp, Heterodera glycines
ataggacggaaaagcaaaaagagccgcctttttgtagggctcaccgcgcgaaaaagcgcagaattgaaatgaaaaaagtgataatacaaaagaaggaacggaaaacaacagaagaagcggcaaggggtggtggaaacggacaacaaaaacaagaagaatgccaaagagtgaattaccaatgaaaaacaatgggggagggcacgggggaaggggaaaggggtgccaatctcagcgaaggaaaagcagtcctaaggctttgtaaaaatttaaaagtgtcccttttttgaatatcccagccgagtccaatgatcagcagagcgctttttttaatttatattaaaaataaatttgttatatttgaaagttaattttgatagattgaagaagcagcagaagcatacgaaagttgggcacaagcagtgccaaatccattaactgctgatgattccgaggcatcggtcagctccaattcactgggagaaaaacaaatggccgtcggcccagggccaaatcccatcaaagaattgacggacaaattccaccaaaaagcattttataacactgaaagaagcgatgccggcgcaagtagcagcagagcactgataacgaacacggtggtaattagtgtaattatataaatttaattaactaatcatattttaaatagaacagaatttggaagaagcgaaatcggaaaagccatcgccacgaaggattgcggaagcactcaggaaagcacaagtgccaacgcgactaatgccggaatggttgtcaagcggaaaccaaaaagcagcgaaaaaggcgcaagaagcaaatcggggtaaaagtggcacatgccaattggcccagattagcagctgacattcccaacttttataatcggttcaattcctttgacgaattgcattttaatttccccttttgtctccctcctcattttgcggcttttccctatgctcaattcattaagcaaattacccgctgattgggtcgcgttgggcttccacaaattcatttgaaacctttcaaataattccctccccgtcggtccaccgcggcacaaacgacaaaaagcagcagacaaacaaccaattggactcacaaactcttcagttcatcaagctgataaagacagtaagcatttgctaatggcaacagaaaatggccaatgaatgattttggcaaaattaaaattcggggataaatgggagatgagtaaaagaagcgatttcggaatggagacgtgcaattttgttgcaattatttaaaaaatctcatcattacagaaacaacggtctccgtcgtcgcagtcgccctcagagaattttgtcgttggcactttgcccatggacagggatttttcgccaatactaaacccaaccattgggcaaagctcgctaatgcggaggcgtcaacatccgggaagagaggagaagcagctaaatcaatcgggagaagcatcgacagaaaaaaccggcgaaacaactgacgaattggtggtccgtgcgattgccacaagcattcgcgcagtcggaaagcccacgcgccaattgcgcttcggctttgtcgcctccggcagcggaccctttccctacgcgttggatgccgacgtgaaaagcatagtcaaattgattagtgatcgcaaaatggagtcagcattgaaagcggaacatttaatgggccaaatgaaagagatggcaaatgaacggattgacaaaatattagtgcaaattggggacgaaagcagcgaattccacgcgaaaattaggaggaaaagccaaaaacagagggaattgagcgttctgttcttttttgttagactttggcgcaaattgggcacacttttggtattggaaaatttggacattaattcgacagaatttcacgagcaaattttgggctgtctaaacgcactaagagcagagatttggaaggaattcgcttcttcatgtgaagcagcaaaaaatggaaaggttatgaaaaatagagttttctaacatataagtttcattaatttttgtttttttaatcgtaaaatacatttttatatttttatattttttaattttttgtttattgtaaaataaaaataatataagtttaggccgaaaaaattatttaattatttttttatgcattggtttttattagctttttaaataggcttttttaaatgcatttttctttagttcatttattattgataaaaagtattaaccaaaaaaagaaaacatggtcactttcgataaatgaaaaatattgtttaagtaattttgttttcatttcttttttaggcatttcaatgggttgaatcattaaatcgctttgacgatgcaattgaactgactaattttggtattttgttgctttttacaccgccaattgtccaagcggctgaaatggtaaatcggccaaccacacaaaacgaattcttcaacacacatagtccccaatttattgttcaagaaggaaccgatgacaattattcgacggaattggcagatcaaatgacatggaaacaattaagtaattagccaattgattaattaatcatgcaattatatcaattaattagctaattggttaattaatcaagtatttttttcaacatttgtatatattaaaattgcatagcataaagaattaaaaattggtttatttaaataaaattgtgttcaaaaaacagagagaatgggcggccaaggaaatgccattgaaaaattgaaagaaatttttgaccgattcgctgacaaagttaaacaatgcaaagcgtccatggctcatgtcaaaaaagtgccaaccaaagcaatgataatgcttggcgtaatgcgacgaatccgtgacgaattgaaccgtgccgaatttgaggcaattacggcacgacatttggccacggaaaggacaaatggactggccattttggacaaaagtttgacaattttgaacgccaaaattggagcattcaacaagcaactgaggaacgatttgggggaagtggacaaaatgtgcagaaaattaatgggcggcgacggaagcggccaaaagagtgaatgagcggaaaatggcaaagaaatgatggcaaagcaattaaagggtcattaatttgccaatttgacaattaggagtgatcaattattgatttgattgtgcttttactaatgtaaatgacattttgtgagttgccgtattatttgttttgctttgcccttttccatgtccatctttttcgcattttcttccatcgattcgccgtccaaggccatttgacactgtccgtctccacctctgctaaattattgcatttttcagcccgaatttgagggctacccaaagaaatattatttaaatcttcggtttttcggcatttttttgccaaatgcgtctccgtttgaatgcaatcgtttcgctgcgtctcatcaatacctttttgtttgtttggctgatgctcagaatgccgactttttatgagaaaattaaacaatggacggaatattttttgccaaaagaacggtttctatattttttaatccatttttaatttttttttttaaatttttttttagtcacaattttggcacttcgtctttttctttctctgctgtttccaattttcttttctttccgttgggctccgttcgtttggaggcaattcgaatgaatgaaatgttggcaaagcgttcggcgttcgcatgccaaaaaaagcgcaaaaaggcggtgatgaatgccgaaaaaggcgacgacgatggcactttcttcttttgcgcagaatccttcccggaaaagggagaaaataaaaagtgaaatgaaagtgccaaaaatccaattaaattttgatgtaataaatatattattattttaaattaaatgattatttttaggtttcaatataaaaatgaatcagaaaagattttattaattaattggcccaaaaagggcgatcatcagcagaacaatacaacgaaaaagcgggaaaatctggataaaattggaggttatattaaattattaatcctttcttataaaatgaaattaattttacccataaaattaaaaataattaaaagggaagagtttacttaaatttattttaattatacgatttgtttaaaattattaaaatatattccagaggaattggtttttgtggagtttcctgaaagtgataatattaatagcgctgcttggagacgattagaggcaaaaaagtggcaaattgaattaataaaattggaattaaatgcaacaaacaaagaaagtgagcacaaaattgcccaatttttagaacacattgaatggcaaattgaggtaaaaaacattatttttataatttaataattattttttgcccgaattcggagttttatgttgttttatttttgaatagcgactcaaatttcgtcatttgttcttaatgctaaggccaacggattacacagactcagagagtgaaaatgaacagaacagtgccaccattctgttcttttggtaccgctttatccacaaattgttcttcaaatggcattttgcaatcgttggtaaattttttaaatttcataaatcattttaatttgctttttcaattgaatttaaggcctccgcaccatcggaaagtgtggccaaatgctgcagaaatttgacatgaaacactgcgaatggagaataaattttgccaaatttgaacattttggccaagtggaggacattccctcttttggttcaggtgattaaattcagaaaaataaacaaagaaatcgaccaaaattcaatttatttcatttttaaggttcaccaaaggaggaaaagttgcgcttttttcatttgttgttgggcaa

SEQ ID NO: 9869 - DNA, 1184 bp, Heterodera glycines
  misc_feature (84)..(84): n is a, c, g, or t
  misc_feature (128)..(128): n is a, c, g, or t
tccgaggaaaagttgcgcttttttcatttgtgttggggcaacagcaacaaaatttgtcgttttccatcaaattgggacaaattntcatcagaaaattggccttgtgcccccttcaacggagccaaatntaataaaattgtttttattcgctacagaaattttcgcttaaaaattgacgaaaggaataatgccttggcaacgttaggcaaatatgccgaaaaggtcgaaactgtcattttacatccaccgggaaattccaacgccgccgaaatgaagttggcattttttaagttccattagagcctttatggcatttgtattaatccttattttatatgttcaaaatgtcttagtgtatttaagctcatatttgcgtttttttccacaaaagttgattttattgaataattcttatttttttagtttgtgtgtcaccacgtcgcattgttttagacattgcaccggtaaatttcaaaaaacatttgccaccttcagccattttaatgatttttttagagtttagagaaacaaattacaatttaacattgtcttccaagaattttggcaccgttttggacgaatttgttcaaaatttgtctgaacggagcattggacttttgttggatttggatggatttgaatgggaaatgctcgagaggatcgacggaattcaaaaacattgtgtcaattggatgaaaaaggtggaacaactttcgctacggatacggtaatatgtgaaagggtactgtaacttaagggacggggccggcggatcaataaattttgcaattgaaacaaattagggcagcagagggggagggtcgtcctcccctcgatgtatttttggccatttttgtgcaaatccccgacaaattcgacaaactccgacagtttccctctccgacgtcattgggccctacccaaatttaaattttaaaatttataaataataaaataatcatttgaaggctatgggaaatagaggagagtgaaaattggcgacgcttttaccttcgcttattacagctcgaagaatgcggcggatttgaaagaattttcagcaaaaaaattggcaattggaacattcaaataatttatcgaaagaaagcgatgaaacgccaaccaaagtgatttggtcaataacaaaaaattaattatgtgccgacaaaatgccgattaactaa

SEQ ID NO: 9870 - DNA, 952 bp, Heterodera glycines
ctagtcgatcgcacatgatcgcatgcagacggatgaaccttctccacgggttggtaccgtagaacatcacataggcgagtctatgtgcgtcggtactcagtcggaccacacactgggaggagaacggagcagcggcagaaccgtcgcggattactctctcgccactctctttctaatgacggggacaaaatgttcagttttcactttaagaaagtaaatttgatgcttttcttggcccaccctttgagaggtgccacagctgtccactgattgacgtcgttgtcgccctcggcgttgtcgtgcgcttaaaattggttgcctttccccttcctccgctccttcgtcagtgccactcggcttttcgtcccctctgctggtcgtctcgctttcatccccacttttttctgcatttcgaaatgggataacacttatccttccgtgacccttcctcaccgctggtctcctccacctcctcgttgtctgaaaaggccatttcgatgtgcagcatgaacagtttggggatgatcgactgcagcacttcctttatcttcgccttctccctcttcgggatgttgggctgccgtttgatgtaatgcaaaagcaattcgttcgtctcgtgaaaaacttgcggatcgggtggatactcaatggcaacttgtggcccaaagtccgcctcactctcgcccgacgcgatggccttttgcaagttctgaaagagaagccaatgcgtcggcgtgaacatcgtttgctcatccatccactttcccctcgactccctccattcgttgcccacctctgtgtaaatggtctccaattgctgaatgaatcctttgctgcgtatgtccttcaggtcgttcgctttgaaggtcagcgcctgatggtcaaactcttcaggtagtctttctcactttggtccgcaaaatttcgtgtactccttgcgcacccgcgacac

SEQ ID NO: 9871 - DNA, 3249 bp, Heterodera glycines
caggtagttcttctccacttgggtcccgccaaatttcgttgtactccttgcgcaacccgcgacactccacgtccttctcccggagacgcctcagcaccatcggcacggccaccagcggattctccttcagggcgaacaaaattttgcctccgtgttcactgaaaagcatggccgacgacgaatttgaggctggaaatggccgaacccgtagagtttcttcaccgccctcgtcaaaaaggtgggggaacagcccaagtcctcctcgctcatgaacttcttcgcgtcttcgtgtcccatcgactcgattttgcgacgcgcgcattccaacgctgtgatggcggccgaattgacttcgatgaaaatgtcaacctggagaattttgaatttcagaaggttaattgtcagaacacctcaaagcgttcgtcctccgtccgatacattaaatcctcatagggagacctgaacaaaatgtgggaaatggtaaagggatttcatttgataggccagccatgcaaatcatttgtaatggatttgactcttgaaaagtgtgaaataaagggaacagcagatgattccatatctcacagcaattactttttcgaagagatcggagcagaatcttccgaggaccttaacaaatgatcgcatttaaacgcaaatatgaaggttgccaatcctacgagaatttttaatgtcataaataacatttttgttttgttttttccattagtgattttggtcatttttggacaaaatccgtcgctaaaatttctgtcgacccactcttttcatgtatgaaacttgagccaaaataacatgatcatttccgtaaaatgatagggcttaccatttgggaaatgagacgtacgaatcgttgagcacttggttgcagagagcactgcgtcccgaacaaacagaacgaatgccgtcctcgggtaggcaacggtagctgacgccgtgctgtttgcaagtgttgtagtctgaaacaaagacacttatttattaggattttgccacaatttatggcaataatagggatgaaaatggtaattgttagaccaatgtgttcggcaaggtcctgtgggagacgttcctccaatggtcgctgcttccgcgaatgcgccccaatcgccgtttgtcctcccaaaatgtctttgaactgcttgagcagttctggatgttctcttgaatggcatttttaggctaattgaatataaacaattggtattacgccaaaaaaggtgtgatcaaatcgacgagttccgaacgcgaaaccaaacttttgttgtacatcaccaaagtacgcatgaaattctcaaaaatcgtttcgctttgcaatgcccgatggatctaaaggcagtgccatgatgcaaaaagcaaaagcccaataaaataccttctcgaaaatcacaaagtctctcagcggaatttcctccaaaatttccgcaactcccacatcgtaagtgatcttgttaacagaagccttagccttctgtaaaaaataattatccgattgaaataatgtgtccctgtttctctccataatgttttttaccaacttttgcattcaaattcgcctgctcctttccgaattgccttttatgaacaatgtccgcactcttcgccgccgttggctttgcgttttgtgccgtttgcattggttgttgttgttctttctgctgcttctgtttctgctccatcacttccctttttccctcttcttccaactttggcttttgctgctcactttggtgctcaataaagtccaatttggcgtcaggcaaaaacgatttgaagtcgcgcatcaaatccaattcgttgtgaaagagccgagaaacgcgttggtaaacctccgcctcactccatttctgaacaaagtggcaattcgaaagaaaattcaccaaaaaaccacctgatcgccctcacactgttgatagtttcccaaaatgttaaggaattcacgataaacatccggtctgtccgcaaatctcccctaaaagcgaaatttccatcgaacgatcagccaaagcccccatttctcacctttattcggtttaggtagcccaatgcctcgctgaaatggatgagttgtcctgttttggtagtttgttgttgcgattgctgattttgaatattatgctccgattcgcaagataaaaccttttgctgggtttgagtgccctcttgacttatcctttgagaacctccatcaattgaagggcgaaccatttcattttcaacttccattggaattgtcgtaagaggctatattaaaaaaacaatgaatcgaaaaagtaaaaattaaatacattttctatttggtgatggacgtgtacatatcggacagattggccaattcctgtgggggactcgctgatggccgtattcggtttcgagactgaatgactttgaattgtaggaacagatgacgaggaaggcaaaggaatttgtggagaagcagcagcaacagcaagttccatcccatcttcgatcagatcgccaccgattgcaaaagctaaaaaaacaaataaaaaaatgaaagaacataacatagtcctaatttccaaacattaaatcaatttccttacaaattagtgtcggtgaataacgaaagataacggtgtgcaccccaaatttcgccgcagaaatttaaaagtttcaaaattagaaattttttcaaacaaatttttaaaattagacactttttataagaaaatttcaaaaaaaaacagtaatttatcataaaaattcaaaaaatcattgaaactaaaaaaaaaaattctcaaaaaatttgttggaaaaatttttaaaaatttctgaggctagattttgcctcggcaagatattgtccaatccccaagataatgctttctgtccgtttttctgaattggtcattctcccgatttgttaggtccgtctcccacaataactaacaattattgatcatactgctgcttccgttcggttcgaaaatgaatatgtggctgccatgaactcgcacttcgtagccatgagggagaaaagtgttgaagccgtcaatcaattcggggtatgcttgaaacagttgactgactcgtcgaattacgccattagtgtcaattctttgaaacaaaacaatcacaaaaaaaaaaaaaattaaaattaaattacgtatgcgatttaaactccttcataacttcgaggaaatcgttgtaaacttgcgggtcatttgaaaattgctgtcgcactttttctgcataattatatat

SEQ ID NO: 9872 - DNA, 1288 bp, Heterodera glycines
aggggtcgtggatggtcgaactactgccgggggagcggggggaggagagacagacaccccagtgcgggggcaccaaactcattaatttgaatttgtgttgtttgattttccttggctttatccccgcctcccatgccccataagaaatggtccgctcaatctgtgccgatgttgttttgattaaaatccgaaacgaaacatgacaaattttgaatttttgaaacccaatccggaggcaatgaacaaatttaatgtgtgccaaaagcaatgtttatcgaccgatcaacaaattgtatataagcattagcataaattcattttgtattgggcaaggattactcaaattatttaaaaatctctctcccagattaaaaatcccgttctccgaaaaaagcgggagtcgagagcgggactcccgtaaaatcccgcgggagtcccgatccggccggactctaataaaaatatatcaaaaatctgtaaaaaaaaaaaaaacaaaaaatgaaaacacaccgctaaacattaacattcttgccatttcttatagcattttcaaaatttcctttctttattttgtgtgatttcgaacccctaactcgaaatcgaacaaaagctcgaaaaattaatttttagaattttcaatttttgtttcgaattccgtttaggaacaatggaattgataaatatagaggtcagattcgtgatcagcgagcgacctacaaaacccccaggagcagacaacatcttacaaaaaacaaaaagggtctcctttaaaatatgtcacttttaacatagcgccaaatttttttagtttttgtaaggaaataaagaatcttaagggctattgaattggtacctaaaatatttaatctgattaattgacagttttttttttgaaaaacagtacgattcggggcactttagagagatcgggcgatagttttttcgctaccgaaaagaaaccaggcggtaattagatttttcacgggtttgtggattttagattatgatgtttaagccatttggtattgagtttcttggacatttggtggtcaggtcgtggatgtgcggtgggaactaatcattttgtgtgatagcgtttttcgtttagatagggaggtggtcgctgcagaacgcagaatattaacaagaagtcttaaggaaaacatttatttcaaatctttagtttttctgtttcgatacttacggattaacacatcataatttgaatcaaaaaagtcattaaaaagaaaaaatgtctcagacacgttgcgcagttgaggaatcagaa

SEQ ID NO: 9873 - DNA, 1950 bp, Heterodera glycines
ggtacaacagtgattagaagaggtacaacagcgattcattagtgattagaagaggttcaacagcgattagaagaggtactaccactgtcgaaaaggtacaataattgttggagaggtacaaaaattgttggaatggtacaataatggttaaaaagggtacaatcatgattttaaaattaaataattaaggaaatcgtttattaaaaagtaagattaaaaattgaatgtaattaataaatttttaaaaataaaataaatttccttttattaattaaaaagagagtttgaaatgtacagggattgaatatttatttaaattgaaattaagaaattaatattacaaattctaatttaaaaaatacaggagttctttaataaaagtaaataaattattattttaatttaaaacatttttcacagaaaaataatttaatttaaattaaaaatttttattttttatggattaaacaaaactatttaaagtgattagaagaggtacaactgtgattagaagtggtacaacattgttaggagaggtacaatattgtttaaaattaaataaataaggaaacgtttttattaaaggttaaaaatcgagtgcattttaatttaaaaattttttaataataaaatactcttttattaattaaaaacaaccttggaaattattaattgaatatttatttaatttgaaattaaatgaattttttttacaaattcaaaaataaataatgaaattctttaatttaaaaaaaataaatttaaataatttaaaagaaatcttcaaattaattaaaaacattgtaaaataagccaaaaatacaaagaaaaataatgttacaccgtccggattcgaacctgctgccccccccctcagaacatgtcccagaatccccaatcacacagggattctgaggtcttgacgatgtcaaaagtaaaatctgatcacgtattcgtgatcagcggcccaaataacgcctaaagacatgtttttggaagatttttggtgaaaattttttttcacttaaaaaccatgtgcacccccctttggtcccgaagcccaaaatcacttttatttttgtatctttttttaaaaaaatgataaaaagatgaaataaaatttatataatagagcaaaaaattgcagatttttgtagtattttactcttctctaatgacttttcagaaccgaattatgaatttttttctgaaaaatcgaaaatttccagaaattctggaataactttttttcttttgaacattataaaaccaaataaatctcataaaattctcccgattttttgctatttttaaagctttaattcacttaaattgaccagtcctccattgagttatgaattttcaaattttaacccaaatttccaaggaccaaaaaaattaaaaatattttcgaatttttaaaaaattctaaaaaatctgaaacttaaaataaacatcatatttgtgctcaggaccctaatttaccccagaaaaatttttttcaccctctttttcaacccaaaaaaaatttttgaaaatttctagggggcctagctcgaaaatttttgaaaattttcgaaaatgaagtacaccgttcgatagagcttaaaaagctctacaattttgctctaaggccatttttggctaaaaccaacccctgacgagttatgggcccgggactcaaatgtcccgctcaggccaaaaattttttctatttctggaaaaaaatcgaaaattttccaaaaaaattaccaatcgatagagctcgaaaaactatgttttggaagtggtcttcgtttttctgggaaaattcgttaaaaaatcataaaattaaaaaacccgaaaaccgttttttaggcctaactcgaaaaattttgaaaattttcgaattttttaaatttggaaaaatcgggctttcaaaactctacaataagtctgctggtaactccc

SEQ ID NO: 9874 - DNA, 3552 bp, Heterodera glycines
tcagtccgtggttctcagcaaaccacccaggagcccccaatttgtcccgacttggtctggggttgggccaaatgaattccacggtcgggaggtcaggggcaggcaggcaacgaggaccggccaaatcaaatgccgaggatgattaagcaaaaatttattccggggaaaagcctcaaactttgggtaattaaacaaaaaatttgaaatggtgaacaaattatcacaaattgatcacaaaaatgccatcaccggggaattatcacaaatggaattgggcaccgggatgggacaggaaatggagggcaccggggccacagaacaaaaatcaataaccgggggtcaaagaatgatcacaattggggcaaatcacagcgaaatgggacagaagtgaagagtcaatcactgatcattgaatgagggggaccgggtgaatgacagaaatggaacggacaattgggccgggggaaaaggacaatgaaatgagggggactgagagagggacggaagaggcattgcttgcctttgctggtgcttctgattgtgggaattggtggggatttgtcgcattaaatacgagcaaaattgaacaaaaaatggtgaaattgagcagaacggggacgggccaaaaattggggaaatgataaaaaacggggccacaaaatgagcgaggggacaaaattgacggaaaacaggaatttgggggttcatcgttctttggagtcgattcgccaagttggggacggcggcagaaaagttgcggttttgacaaattggtcattaattgtgcgcggggcatggaaggaacgcagaaaaacaataacaatttggagggaaatgggggcagaggagtggaacggggtgcgcggggcatgtgaaagggagggggaagggtcgccacttcctttcttcaattctgctgatcaattgatcggcagtcggaatcccagagttccgacattccggcgtgaaaaagatgggcccgtcagaattcttttcgtctgggcctcccaaagggcgagtcttctgtgaggtcgagatggctctgtgttcgtggttgttggtaccgagccgttctggcgatcatgtccaatttgattggtgacatggatcggtgctctgccctgcgcgctggtggtttgggggttcgtggcatttcacgcagcggcattccctcttcgataccgagtggtttggaaacggtgggtcggaatgtcggatgcgggcgtactccaacgaggctgagaagagtcactcggatgggattgagcaaatacggcagagtgcatgggagagcaatgtcgcgcagcatgaggaaggttgaataagttcagtaatcttgtgagcaccataggccggtttgcgccatcaggccgggcgcttcgcgcccgttttttattttttcgtgggaaatcggccgcatcgcggcctcaggacgggcgcttcgcgcccattttttaattgtgttgaggacattcggccgcttcgcggcctcaggtgcgggcgcttcgcgcccgtttttaattttgttgagaacattcggccgcttcgcggcctcaggacgggcgcttcgcgcccatcttttaattttgttgaggacatttggccgcttcgcggcctcaggacgggcgcttcgcgtcctttttttaattgtgtgggaaacattcggccgcttcgcggcctcaggacgggcgcttcgcgcccgtttttaattttgttgagaacattcggccgcttcgcggcctcaggacgggcgcttcgcgcccgttttttaattttgtggggaacattcggacgcttcgctgcctcaggacgggcgcttcgcgcccgttttttaattttgtggggaacattcggccgccgctcccacccctcagaatccccaataacacggggattctgaggtcttaaccatgtctaaagtaaaatctgattacatattcgtgatcagcggcccaaataacccctaaagacatgtttttggaggatttttggagaaaaaatttttccactcaaaaatcatggtcacacccctttggtcccgaatgcaaaaatcacttttatttctataacttttttcaaaaaagtgataaaaagctaaattaaaatttataaaatagagcaaaaaattgcggatttttgtattattttacttttccaatacaacttttcataaccgagttcagaatttttttctgaaaaatcgaatttttccagaaattttggaataacttttttattttggaagatagaaattccaaacaaatctcataaaattctcctatttttttgctatttttcaaaccgtattacactaaatttgatcaaaaacgaagagagttatgaattttcgaaatttcactggatttcccggggcccaaatagtgacgatttttcaaaaatttgtaaccaccttccaaaaagtctgaaacccaaaataatgtatatattcgagttcagcaccttaaattaggccataagaatgcattttggctaatttatgagcaaaaaaatttttcatgaaatgcaaaaccatggggtcccccctttggttttgcattttaaaatttatttttgttttataactttttttaaattcataataaaaacatgagataaagcacattagattgggcttaaaattctctacaaaaaagctcttagacgattttttgatagattcaactcctgacgagttattgcgccagaactgaaattgaggcctagcaaccaaaaattttctatttccaaaaaattttcgaaaattttttctgaaaatcacaccaatcgatagagcatgaaaaacggttgcttgaaagtggtctccgttttccccggaaaaatctgcaaaaaatactaaaattcaaaaacctcaaaagtgacgagggggcctagctcgaaaatttctgaaaatttcataaatacaaaaacatggttggatagagctcgtcgagctgtacaaaaaagccgcttacaccgacctcctccctcaaaaccccgacgagttattccgccggcgctgaaatggccaaaaaagtaagcaatttttccacgactgtacacggaatacagtaggccgtagagaaaaatgattggaagcgaagttgtagggcacacttcaacttaaaatcctcccagcaagcattttttgatcaaagcaaaagaaaaaaatttcgtaacagtgagactgaaacgaaaagccgtttcagcgccgccggcgctcagttggccaccggaccggaatgcccatagttttcctggatgcgcctcaaaaagttgcttaagcaatgtcaacatttcaggtccccccgattagccgttcccgagatttttgttttagcaatgagttgcactgttgttctaaggtatataaactagcgtgtcgcgcagtaattgctcggtgtagacagtatgctttgcacagtgattgcacggtgtagacagtatgctttgcacagtaattgctcggtgtagacagtatacttgtgagagatgaaaagaatatgcattacatgagcgcttcgcgcaaaggacttcgttgctagtgcatgcgcg

SEQ ID NO: 9875 - DNA, 7045 bp, Heterodera glycines
ttatctctcccttattttctgctttcttttctggctccttttcttcttttccctcttttttcacttcttttccttcctctctcttttcttctgctggcttttgttcctcttttctctcctcatttttactcttttcttcttctttctcctctgctttttcttttacctcttttttcacttcctttttgccatcgtttttcgttttttctgtaaatattatttttttttttgtataatttctcaatacttttttattacctgttaagcggttttcattaaactgtgttcgaaatgctctaaatttgttggttccattttgaccgtccaaatctgaaattaatttttttaaataaatgtttaacacccactaattttctaaatgtatttaaaaaaattttcactttacaaaatactatttttaacaattatcacaaataattttggacaaatatttttaatcaaaaattttattttatttttaaataattacaaaatgtccaaacttaaaatttttcgctgatttccaatttttaaacgttttaataactaatttaataaatgaaagataattaagaaaattaaaattaaattattaaaaattttaccgtccattctttgaacgccttccactgatgtgccaacagtgtctgttgaagcagcaatcagtgaatttggtgtattatctagcattaagcttttagcatggtccaccgggtgctaaaaaaataaataaaaatttctgtaaatattcaaaaatttttgaccgaccttttctcgaacaggctcaataacccgtgactcaatagagcttggcacaacaaaatttgtttccatggcatttttctcatttgtatcagagccattcatagactgtttgttaatgctggtatcacttttggcatttggcgcatcttttgaagttatgttctccattttggcattttgttgtgcattggcattttgttgctggattgcaggctctgatgctttggcattttgttgaacaggctctgaagctttggcattttgttctgcagcttcggatgctttggcattttgttgctggattgcaggctctgatgctttggcattttgttctgcagcttcggatgctttggcattttgttgtacatcttctgatgctttggcattttgttgctggattgcaggctctgatgctttggcattttgttctgcagcttcggatgctttggcattttgttgtacatcttctgatgctttggcattttgttgttggattgcaggctctgatgctttggcattttgttgtacatcttctgatgctttggcattttgttgcgcattggccttttgttgctggattgcagcttctgatgctttggcattttgttgaacaggctctgaagccttggcactttgttgagcaagctctgaagctttggcactttgttgttcaggctcagatgatttggcactttgttgcgcattggcattttgttgttgattttcaggctctgatgctttggcatttatctgcttctcagacctctcctgcagttcagcactatttcgcttcttgaaagcatcgcttttgcccaacactctgtcccaatagccttcctcctcaagtccgcttgtacgatttgtgtcgtcctgttgtgctccacgaatgccgaaaaagttgagaatgtcttccaactttttccataatgggttgttcagggattcatgctgagttaaaaattttaaaaatttgaattaaaatatttattttaaacaataaaaaagccgagattttaaagaaaattgttttttctaaaaataaaaatatttttcatgaattttatatatttttgacagaaattctgaatcatttctactaattttctgaattaaaaacattaaaatttgatttgaaactataatatataaattaacataaaagcatagaagaaagcgctttaattatttaaattataattattttcattaataaaaatttaaacatgattttatgcataaattgtgatcatttcaatctttccaaatttttttgttcttaccattgacaaatcaaaaatttcatctatataaaataagaattaattaccaaaaaaaaaatggttgttttttttgacaaaattttgtttttttaattatagaatttagctcccaagcttattccaaactaattttcggacatttcttccaactttgaacaaattagacaattaattaattaaaaataattatttataaaagtctaaaattttttagaactaattacctcaatatgcttttcatgagttcgttcgcacacgaatcggtaactgagttcggggccggcactcatgtcacagtcaatatcatcaatgttggcatccaatttgatgttcaacattgcgcaacgttctcgcccatttgcttcgtcgtacggttcaccaaaggcccaattccttgagcaaatattcattttaaatttatttctctaattactttaatttgtttggcattggcgcaattaacccaatgactatttttcctaaatttattaagcctaatttttgaaaaatgatatttaatttttcatttaattaaaaaattaacttggaaattaatttgaattcgcttaattttacagattgttagaacgcattaaatcccatagaattgcatatttattattattttattttttcaagaatttccttatataaattttattttgatcaaattttgtcggggaatttcttccccgacttttctctcccgaggattaggagggcttaaccctagtttaaattagagaccggacaagagggtcggtcgaacggtttcggttaaaaaccgaaaaaaaccgaaaactcataaatttctcggtcggtttttttcggtcaaaaaccgaaaccaaaaaataccgaaaaaaaccgaaaaaaaaaccgaccggtccgatctctagtttttatgtgcatatttcgcaatttttggtgcatattttatgcgcatattttgcgattttatgtgcatataattcccagccctagtcatcattgttgaaaccagcagcatttcgatcaattccgaaccccggacctgaattctgttcagattctaacataaagtgaatttaggtgaaaaatgaattttcgacttttgtttgaattcaggtccgggattcgaaatcggtcgaaatcgatgtcagattcgtgatcagtgatcccgagaaccacctagaaatgttttatatgtatgattgataaaaactatttttttatggtctgtaaacgggataagtaccggtgagcttactaatttggatgcctaaccgtcgaattatttaaaaaggtgcgcatgaagatgaagttgttagaaatattgtttatataattaatgggcttttactccacatacaatacatacaaataatataggaatcacaacaaagaatggctcacggctttgatggtgccatcgggggttcatgtgaaagaactccaccgattcctgattgtgaagcatcagctgcaacaaattgaagcatgttgatgattttgtcaaatgctttttgacaagccgatgtgcaatcccaaattttgtccttcttgagcagatcatccaagggttggcgaatgaaacggaaatttttgacaaattcctggtaataatttaccatcccaaggtatgaacgcagtttatttaaatttgaaggagccggcatttcagcaattgcagcgattttgttgtaatcgggatttctgccattttggttgatcgtgactcccaaatatttgatttccttttggaaaaatgagcatttttctatgtgaactttcaaaccccattcttgaagacgggcgaataatttgtcgagatgttcgcagtgttcttccatggatttgctgactgtgatgatatcatccaaatatgcgattgcaaatggataatcagaaagcatattatccattattgattgttgaaaagaattttccgccatttaaagttggaaaaatgtcggacggaagtggcaatggatgcttgttcagctggagacagtcgtttagaccatttgaaaaatcggcacacaacctcgttgatccattggcctttttcaccaccaaaattggggcggcccactcggtgtgttccactggtctgatgacattgattttctccaatcggtccaattcgttgtttacgattggaagagatgagtatggcactggacgggctcgtcggaacacaggtttagtgtccgacttaagcatcagagaggctttcattttggtgcaaagaccaaggccttctaagaagacttgctcaaattttgattgcaattctttgattgcttaccgaatttttgtctcattatttttggaagtgatctgattgatggaattgggatttacgcggattgcatttttgattccttcaaggaacccaaacttatccattgttgctgcgccatgcaaattaagtgctcccgctttggcaacataaaatggttgtttgactttgatcctttgaatttgaaggtagcacatcctttgccgatgaattggcagcggcgtccatcgaaaagaatgccctcttcgtcgctttcttccagcggcggggatccgatgcatttgtatgcgatttcatcaataatattgatgtctgacccactgtcggcaatgaatttgatcgttttgccgttcatgattatggaaatccgaattatttttgaagtaccatttttgttgatgcgagcgacagaaattactatcgtgttcaacttcggattcttggcctttcggttttattgtaggcctggattcggtcgcattacttctcgatgtgtctcttttggttgcactttttgcaaacataatttaatttaggacagttttgtgcccaattcatttcaccacaccgaaagcaattattaggaggggttttgcctttgtttccgatattttggcttggcttacccgaattttcctttttgcgaatcggtttattttggctgaaagcatttattttgggctttgcctgttcgagaattttgacttctgcctccgttttcagcattgtcatgatttcctctgaaatgttttgaaaaatttcggcgttggagttgcctttgtttcttcggtagtgagtcggctgaggatgtgctgtcgtagctttgcttcactcgatgacttcaatgaagtcaaaagcactaagcacttgaattggtcctcgtttagttccgagtaccgaaattttcggaaaagcgatttgagtcggttgacaaaaacgctgaattcctcgccttccttacgtgttgcctttaggcactcataccgatcgatagccaatgacggcggacgagcaaacaatttcataagacgggttttcgtctcattgaaattgaatgccgtaattccatccggcaagcatgagcgcttgtattcgccgcatttaagaatggcagaatgtccggcagtgtgatgttgctctgcactggttggtttgccgtgttttgttgctgcttgacgatgtttgtcaattgagtcaaaatgctttccaaatttttgttgtccattttgtcttgaattgtccacagaaatgataattgcccgacttgttactgacaaagtcgtctgtagcacctgctatcagttgggcttaaatcgatgagccaaacttgttgctgacaagttaatctgtagcacttggctaacagtgttggcttttgttgacacttaaccttcaatttatttcgacacaattggtgtacgaaataatggcggcgatgaagaatgatttcgacacaattttttttgttcgacatttcgcccgaatttatttcaccgctgactttgttcgaatttgcacaaatttgttgaatttgttcgaactaggacgggcgtcgccactgttgtgccgttgaacaatttattgtcagtggaaattggtgaaacaaattaaagaaacagcaaagggtcaaatcaatatttggggaacaacaacattttaagaggaggacaaaaagcggaggagaagatgagtgcaaaagacagaaagaatttactgggtcaatggggataaacaattgtgtgagggactgaagtggatataaataaaatgccaaaagaataacatttaaaatgtcgtcccaacaatttttaaggatttatccgagaaaattattttcagaaaaaattggtaaataattaaaacaacgaaatgatttcaaaataaatttatcgataggtaaaaagcgaaggaaaaaaagctaatctacggaaagaaaaagataaaatttatccacccaaagaaaatccgaaagttctgccgttctcccattttctgcattggttttcactctcctcgtcattccgcccaaatcgatcaacaacaagctcctcccttaaaaatgatcaccatcaattgttaattaacacttattctacttctccattgtcctgctggtcaacatgaacgcgtccattgttacggatcttcttgcttttgtccttgtcttttgacttatgatcaattgtgtttattgaagctgtcattcttcgcattttcattttcccagcagcaggagacaactgaaatttcaaagaattttttttcaaattgcaccacttataattcggaagactaaaatattttatacttcgattaatgagcaaatgattgaaaaattgaaatgagggtagagcccagagttttcaagcaatcatttcaagttccactaatatatttgtgccttctattcctcccctgggcatacgtaccattttgtcaaatttttgagctgctggtagttgcggtacccatgaatgaccagcaactgtcgctacatgaacttgttcaatcaggcgagcacaattggcccctggtaaacacgaggacaacgccagaccagtagtaagtttttaaggattttccgaaaaaatcgataaaataaatttatcgtttgcttctcattatcaaataattaaataattttgaaaaatttatcgataggaaaaagcgaaggattaagctaatctacggaaagaaacagataaaatttatccaccca

SEQ ID NO: 9876 - DNA, 2085 bp, Heterodera glycines
aatgcgctgatcatcatcaaaattctgaccgatcacatcaaaacatttcggcccgcctttctgcccgagctgatgaatccgttctttgcccagtcgaagagtgtgttcaacggaatgttcgcgcacagtgccaacgaagcgatgtttctgaagaggccgttcctcaccgccggcaaaaccattgaggagagtgttgccgaggttcaatttttattccaaaatttttccccaaattttattttattttttaaggctttgaagacatgttatgcctccgcaacgctcagttactcgcaaaaccaacaggcattctttacaatttgttttttgtatttattttattatggcacccccatatctccccctgaaaattttcctaaaaaattattagaaaaaattttcagaaaaaaatattagaaactttttataagaaatttcttgaaaattttttcgaataattcattctttttttaattttgaaaaacttaaaaaggcacacgctgtttggaagtgaaattcgccatttccccccgtttcagtacactttggtgccccgtgccagccaaagtgtcaaagtactggccgaaatgtccgtctttctgttcgtcctcatccaagcgcatcggcagcagctgatccgcgaagtgttggagctgatccccatctttgtgcgctttgtgaacatcgccgtgccgcggcacatccgcgggcacaagctgtacaacaaagagttggtggaggagttccactgggcacaagtgcgagcgctttccttcattgcctacatttcacgacaagctcaagtccattttttatttcatcatttttgtggtctttctatattttttcaattaaaaggtttttgttataatatgcaaattgttatttttatgggcctttttaaaaaggcatctaatttaaaaaatggctccaaatcttggtcattttttggacaaaattgttaaatttttcccgctgacacctatcggcaccccccccccccccctccggttccccaaagtttttttttggaaaaatcgcgctgcaaaactaacgataaacatcccccttttttaaatgtatgaaagttattttaatacaattatcacatacgcagtgatcagactaaaactctcccccccctgtagatggccccggtgatcagtgagaatgacaaggtgttgtcggatgtcattgtcagccttttcgacagtttccatgacgaagtgatcacccaacgccgtgaccttttggtggccatcaaatactttttttaatgcgaagcacgcgctctgttcattggcatcattcccaaaatgtgcgacgattgttcactgctgggccgctcgttcacttcacaggaccatctgaggtgggcaaaaatgtgccgaaataaatagccccgttaaaaacatacaattttccaggaaccaggcctattcatttttggccgacattttacaccatgttcggatgagcttggactacaaacttctcaagcagtatttgctttatcttcagttcttaaattttatttttccgggaatttaactaacgctttttgatttactatgtaattcaatttcttaccatttttaaaaaaattcagcatttttttcattgcgtcccgcaatttgcacgacgcccaactgctgccttatgtgcaaacgatgtacggcaaactgatgatgaacttgatcgaagccgttttggtgcagcccaaagagcacagcaaaatggttggtttttatagggaattgaaaaaattggatttttaaaaaactgattatttgttttggaatacccttcaaaatttacacttttttactgaaaatctgtttgcccaaagtaccaggaagtgctttgcgcatcggtcgattcgctggtgcgaaaggccaaatttgttgccgagtaccatttgccattgattgtggagaagcagcgcgcccaacaaacagaagccaaacaaccacagcaagtgccatcatcatcatcatcgacggcagcagcaacggctgaggaaaacaaaagcacgggacgaagtgatgaggcttcaaagtgagtaatatttaatatttgcatttg

SEQ ID NO: 9877 - DNA, 3400 bp, Heterodera glycines
  misc_feature (1275)..(1275): n is a, c, g, or t
  misc_feature (3375)..(3375): n is a, c, g, or t
gtacgcgttgcgcaagacatagtacagtgccgggttgatgtagtccgtgagacgtttgatgctcgcgtgcatgtccactccacgctctttattgtggaaaaaggcgacgaagcgttgctgaaatgatgctttgaattggaggaaccaaaaaaaatttagaaatttagactaaaaattagggctgtgttttattcaccctccacggccattgcccccattttttttttaatttttggaattttttagttatttcatatcgagaaaaattccaccatcggtgatgtgaaaaaattaaattggatttttccattatcatcaaattgtgtcttcagaaagaaacttcggtacttgtgggttttgggcctacaccacaaaattttaaaaaagttagggcgcgctgaaggcattttagcgcgcgttactattttggcagcataaatgcaacaatctgaagcaaaatttgttcaaaggtatcaactttgcgtcttttacagtcctcatgcaaaaggaattcgcacaaataggagtcgagttttgcgctgtaggcccaaaaccacaagtaccaaaaaaattttttattataaaatattttctaggggttttcccaacaatttgtttggtttcacctttttaggctctcgaagcgtgtcattccttttggcaagattcaggccaacctttggcattgaacgactgcaaaaacatggtccgcttcagcatccaaccggtgaaaatgatggtcatcgcgttgaaggacatgggcgcttttggttgactaatttattttttcaatattttaattccgaaattccacgcagaaaacggtgatgaattggtgatgtaccgtttggcaactctgttgtccgaatacttctgtcatgggctcaaatgtctggacattttcatcgtttctgcaaattcaatgtcctcctacccgaaaattgggtgcatttttttatcttcttaaactcggtcttattttggtctccaatttgttataatagtgcaccaacaatagctttaaaattttcaatttttttttgtattttatacacattctacgaaaatatgaattcttacgacttccgaaaatgatcgaaaaataaaaaaaattcattgtcacagtttccattttggtgattttagggccggcgagggacgggacccagccacggcgttttgttggatccagtccgcaatcccgtattttttttggaaattttttttttataatttggacaagaaaagcgtttgggcccccgtttttgggccccnggggtcgtttggggccccaaccagggacgggcgaaacttcgagcttcgtgcttcgagcttcgaaacttcgcggtttttgggcttcgaacttcgtgcttcgaaaaaattgggcttcgccttcggcttcgagtgccgagccgagcttcgccgcccctgttttgcagaaccatctcgcaaatgccaaaagaacataacacatacaacaacaattcgaaggagccgaaatctccaagagtacaaatataattaattttcattcctcaatagaaaatttatattcaaaaaaatattcctaactcaacacaaaaatacaaaaaattaaaattaataatctaataaatatagcgcaaaagtcatattattcgttggctttcttgaacataattataggaaaaagaatcatagaattggcatccatcttaagtgaaagaattttatataaaattaaaaatggcttaattattaatctgatttgttatttggctaaaaagaattaaaatgcaatatattaaaatcttattttttcgaaaattggcgaccagcgaaaacttaggtttattttgaatttagaaccaaattaacaacaattttaaaaaatggaataccttcactgatttcacatttagacggcaataatcaataaaactctaaatcataaaaaaattcacaactacttaatattttatgttaatctttatggttttttattttaaaaaaccaaacaacaaatgttaaaaaattaaatattgtaatatctattcagcgaaaattcaaattaacgttttaatccaaaccaataagtgagaaaattcaaaattttatctaatgccttaatttaaactgaatttcatggaattaagtataattgattaatacgtggttggctaatgaatttcgatgtgattggatcagcttcataatagttgatggcttatcagcatacagcatacaaattaaaaaggttctctctatttaaataattaattatttgaaaaaattttattaaaaagtaaaaaaaacagagttgctataaattacccgaacgtaagagatcgataaattagtaaaaaaaagtacaataattaaaccttttaaacaagaaaatctgtgatttggataattaaaaatgtaatttaagatttctatttgaattaatttaatctaaatatataatagccaagtccatgaaaacttgctgacacattaaatcgtttggtagggtaagctatctttaaaatttaaaaataattggctgaaattggaatctcagtcgataagaattagtaaatataagaattaccgaaaattaaacaaaaactacgcactttaccaataaagaaatataaatcaattaattgaatataaataaatacggtggaaataaaacagttaacgaggataatttattgataattacatataatgcttaagtacgtacaaaagagcgcgaagacgtgaagttacacctgcgccctcctatcaaatagtttagtggaaaaaccgcgcctcaaatcagctttgtcttgattcataaagtttggaataaaataattttacaaaaaatgatttgtactttatgatttgactattaaaaagtagtagaaaaaatttcgctttcgcgtctcgcaatttcgcgagtttggaattaggcgtatcgcatttagtttcatttggcatttttgtcttgtgcaactacagtgtttcgcattcaacgtcgcgctctgctccatccgagcagtatatgcaggagtcgaaaggatccgctcggtacctataaaatggcgaaaagatggagtaggatgtgaagggaggggagggtgggcgcagcaacagccacaggaggctgaggaggaggacgaggtgggtgatcgggcgagactttgaaatatgtattaataatacaatttggttattaaatatctttcttggtccccgtaaagcccatcccgaggtcattggcgtttgccataataaaatttattaaaatttttcttggtcgcttatcacgaatatgacatccctttccccgtaattcccaacccgtcaagagtttatgtgttccctgatcatgaatctgacatatggtacaataatcttcanaaaaattttcttcttatttcttgaa

SEQ ID NO: 9878 - DNA, 1995 bp, Heterodera glycines
agattattggcgattatcagctcggtcattccgcaaacacggattcagtttatatttcgcgaagaatgagctgtaattttgcgaattagacaaaaatgagagaatttcacattctgctaattaggctttaaatataaactgtttaagtgttgcagacgaatcaggttgataagcgccaataacctcagatttactattttcgcgaccccactttttgaattctgacattttcagctcattacgctctaaatataaacagcatcactcactctctctatccgcctctccccccttctctatcgattcgctctcttccctcttcccactctctctctcttccttctttctattaattgtctctctctcctctctctccccactctctctaacccccccctttctcttatcaatcttctctttctctctctacacctctttcccctctcttcttctctctctcgcttctttctcctctttctctctctctcgctcccttcactctctcccttctctcttccccctctctctctctctccattctctctccgtctcccttttctctctctcccttctctcttccctcctcccctctctctctcgctctccccattctctctcttaacttctctctctctccccctcttcacactctctcccttctctctctcctctctctccgttgtctctctcaccctctccccccttctctatcgattcgctctcttccctcttcccctctctctccactctctctcttccttctttctcataattgtctctctctcctctctctccccactctctctaatctcccccccctttctcttatcaatcttctctttctctctctttcccctctttcccctctcttcttctctctctctcgcttctttctcctctttctctctctctctcgctcccttcactctctcccttctctcttccctctctctctctctcgctctctctcgctctctctctctctgtctccttctctctcattctttatctctctctctcgctctgtctcccctctcgctcttacttcactcttcttttacacattctctcctctctctccacactctctctaatctccccgcccctttctcttatcaatcttctctttctctctctgcacctctttcccctctcttcttctctctctctctcgctcccttcactctctccctttccctctctctctcgctctctctgtctccttctctctcattctttctctctctctctcgctctgtctcccatctcgctcttacttcactcttctttcacacattctctcttctctcccccactctctccggaacgggccaactccgtctgagccaactttgagtcaatataactcttgaagtttttgaccgaatcaaacaatcttgatatcattcgaaagctcttcacaggctctattagcctactaaaaactacaaaaaatttcgaactataaaaagatagaaataaaaaactttgaaaattctgccttttttgcggttttaaactgacaacttttttgagagctgattaatcactgagaaatagcttataaatatcttctaaacatctagggctttcgaacgataccatgattgtgaagtttggccaacaaagaaaaaagttatagctttttgaacattgctgagacggagttgacccctaccgactctctttgcttttttttatcatctcaactcttttgattctctcttttctcccattatctcgccttttctcttccctctcacccactcctctctctctctctcactctttctcccttctccgttctctttccccattctctctctctcatccaccccccccactctcccttcttttctcgttctttcccttgtctcctcctctcatccctcgcactctctcttatttttcctatctctcacttcttattccctcccgctcctacgctttcatcacacataagtaagcaaactgtctggtcttcccttttttctt

SEQ ID NO: 9879 - DNA, 3328 bp, Heterodera glycines
ttctctctctcccttctatcttccctcctcccctctctctctcgctctccccattttctctcttaacttctctctctccccctcttcacactctctcccttctctctcttctctctctccgttgtctctctccccctctccccccttctctatcgattcgctctcttcccgcttcccctctctctccactctctctcttccttctttctcttaattgtctctctctcctctctctccccactctctctaatctccccgcccctttctcttatcaatcttctctttctctctctgcacctctttcccctctcttcttctctctctctctctcgcttctttctcctctttctctctctctctcgctcccttcactctctcccttctctcttccctctctctctctctcgctctctctctctctctctgtctccttctctctcattctttctctctctctctcgctctgtctcccctctcgctcttacttcactcttctttcacacattctctcctctctctccacactctctctaatctccccgcccctttctcttatcaatcttctctttctctctctgcacctctttcccctctcttcttttctctctctctcgcttctttctcctctttctctctctctcgctcccttcactctctcccttctctctttcctctctctctctctcgctctctctctctctgtctccttctctctcattctttctctctctctctcgctctgtctcccctctcgctcttacttcactcttctttcacacattctctcttctctcccccactctctccggaacgggccaactccgtctggctaactccgtctgagccaactttgagtcaatataactcttgaagttattgaccgaatcaaacaatcttgatatcaatcgaaagctcttcacaggctctattagcctactaaaaattacagaaaatttcgaactataaaaaaagatagaaataaaaaactttgaaaattctgccttttttgcggttttaaactgacaacttttttgagagctgattaatcactgagaaatagcttataaatatcttctaacatctagggctttcgaacgataccatgattgtgaagtttggccaacaaagaaaaaagttatagctttttgaaccttgctgagacggagttggccagacggagttgacccctaccgactctctctgcttttttttatcatctcaactcttttgattctctcttttctcccattatctcgccttttctcttccctctcacccactcctctctctctctctcactctttctcccttctccgttctctttccccattctctctctctcatccacccccccactctcccttcttttctcgttcttccctttgtctcctcctctcatccctcgcactctctcttatttttcctatctctcacttcttattccctcccgctcctacgctttcatcacacataagtaagcaactgtctggtcttcccttttttctttgtatatgctatttcttttctttttctcttctttttttcatattaagtcaaaacgccaaatgccaatttaattgagggggcggggcttgctctcatttaatatacttaggggataagaacaatagcccgaaataaggacaaatcttataaataaggacagatccgaaccctgttttaacaccaagaaaaaaagttcacgaagtgaattaggattttctattaacagagataacgaaatagtacgccaaaatgagaggttttttatctgcactctatttattggttcatctctcgttttttgaaacggtgtgtttaattatcgcatgtattctttttcattttagcagcgtgtttcaatttgaatttgccattcatattcgtgccaaatgagccaccatcgcgatttacgacaagatgtcaaggcgaggacgatgcgctttgcggctttggacccagacattgcatcaaaatatgacgaattagatgaagaggaaagcaacagcaacagattactccgttttgaggtttattatctcagggctcaatttttcatgggatttttcatttgaagcagccaagagaattgcatagaggcggtagcaatttttcaaagaaggtggtaaatataatcgagaggcacataactcgaaaggatcagaatgcgatgcgaacgacaggggccgggacgagttccagcagacgcgacttcattaatttggtcacggtatttgacgaagattcatccaatcaagaagtttctagctcttttctttggtctaggtcaaaaatgcttctcgttccggaaaggaccatgttctgaagttgctgtccaattccgtggataattttattccaatagcgccaaaaatgctggagaacagggatttgagcttctacatttctgatgatgatgatgcgcaagcaatttgtctgatgtcacggagaattgctgacaaatacaacccgggccttaagtacaccattttcacaaaacgagttcctgccccgtttgagacgatcagtttctcaaatcgacagattatcgaggtttgtcctttatggacagacgttttcacgtattgttcttttgtttagcaagtcgtaaagggtcgcttcaagcagcagaccaactctctcgacttgagcagctttcagaacgacccgctcttcgaacggagtcaactttcttatggactttttcacaaccacgtggtggtcgccgttgccaatttaatcgcgcaaaattttccctcaattcgtggcattcgtttaaatgtaattaaattgttactttgatgggatgtttttctttgtcttctttagaacaacagtctacgcactttggacttcctgagttgtctcgtctacgccgcaccaaatgttgttgaattggatttggcaaacaatgcggtgagtgagtgagtgtgtccgttgcgagatagtcgtaattatgtattccatttaccacagatttcacgcgttaatgaattggacaaattgaaaagttggtccttggaaagtgtccactttgaaaacaacgaatttgtcgcgagttatcagggcaatttcgtcgcatattcacagttcgtcttcctgtgacattcatttaattgttaaacaatttttagagcaattcatcagtttttccctcgtgtcacatatttggtactttacaaataaataaataaaataacattttgacgttcttttcccctccccttcaacaggatggacggtcgatccaaccttcgcccgaaatgggtgccgaaatgtcttcggcagtcattccacgcttcagagtaaaattatcatgtcgtgctaa

SEQ ID NO: 9880 - DNA, 1182 bp, Heterodera glycines
  misc_feature (1161)..(1162): n is a, c, g, or t
aaaattgttggaattatgtcaaaaaaacatcgttttgatcattaaaaaggcggtggatacaggcttaaattccttaaaatgatatgataaactacaagtttggaggtcaacggtataaccaataaaaacaaaacaaaacgacttcgacttgtgttaaattagttttttttctggggggggggggttcgctctcctttctcttcttcctccctttttcttcctctcttcttccttccctcctccttcttgctcctctctgtcccttctgtttcctcctccgccgtctcttttgctgctcccctccctctcctcaccaactttgccagtccgtccgtgtcccttcctcctcctttttgccccctcccgccgcactctcttcgcccttttgctgctcctttttctgttgctcattccttcgctgttgtgccatttgagtcgccacacttgcaaaattccctgtgctgctgctgttcgccgttctcttcaattcttttgcatcagtcacatttggcaaatgttttttgccaagtgaattttcctcgcccatatttaaatcgagcaaaaggtccagcaaattgtcattagcttaatggaaaaagccaattaaaaagacacgcatataaagtcaatttgaacctttcgctttgtcggagggctttttaactgctcccaattttagagtcgttcctttcgttggttttagagtgatcggtgaagaggacgtggaaatgtttggcattgttttcgttttggcattttgggttgtgattagctcggcattttgaacgaaagtctgtgaatggaagtatttcttttaaattaagtaattggtatcacttaaaagagacagtagggacggtgccgggttttgactcggggtcagggctgggcgcaactggattttcaattacggaaatttgccatccgcaattacggcgattttctcagttacggaaattcgcaattttcaaaaatcaatttttgtcagaatttttgaaatttttttaaaatagtgaattaatgaaaatcaactttatttttgatttcaattttacaaagaaattataattttgtgtctaaaaaattgattctttttgaatttttagggttcattttggaatttttttttgaaagtctgatcattataattggatttatatnntagtatttcaacatttataa

SEQ ID NO: 9881 - DNA, 1530 bp, Heterodera glycines
  misc_feature (29)..(29): n is a, c, g, or t
  misc_feature (38)..(39): n is a, c, g, or t
  misc_feature (44)..(44): n is a, c, g, or t
  misc_feature (200)..(200): n is a, c, g, or t
ttgagggcgcgagtgaaagcagagattanaatgcgtgnncgatnggacggtcaaatgaaacagccgattttgccgagacactaaaaaagaaaggcgtagttggggatgaattattactactgaaaatgtacaatggttgtgtttgtccgaatgctgggctcgggatcggaacctgaaacccttggcaaagtctaattaanaagatttggcttcccccccccccctcccatttcgtttgccttggagtcgtgccaaatgcttcatcagatcagtgttcaaattgctgtggtttaatttgtcggcaaacgaaacgattgccttcacagtgctttcccgaacggcagaattggaatccatgaaacccgtaattaaattcctttaaaaattcaaataaaactatttttttaattttgtgcaatacccgtagattttttcattaaccacttgtggccttaaatggctggaaaattcatcgattctctccaacagtttgaccctttaataagaaaaatatttaaaaacccatgcaaatggtgcatcaccgtgtcgttcgatccgtcgaactgaacaatttgacaaggcatgggacgattctctgctggtactaaaccaaaaggttaaaacccagttgaaaagagtcattgtcacctcattctcgtcaagaagtctgcccaatttgaacattggcaccaaaatgtgggcacccgcgtctccgaattcgtacgtctaattggtaagtgatttgttaataaaacaaaaatgagccaaaaacggacatgaattagctttggcaaaattttgttgcaagaaatatcgtcggggaaaaggtctaaattcgaattcaactgcatgaaaaaggactgcctttctgcagcgtcccgaagttgaaattcgtcgaggaataaaagagtatcaacgaatttgttcttcataaaaccgccgacggaccgacactctgaaaaaagacaccaataaaaaggggagggacgaaagatggaaatcataattgagaacattttattgttagtgaatcaccgtttagaatgtccgcgactgccatgacggaccttccgcgagcattgaaacggcgaaacaacggttggactctcttcggaagttgcgtcgaatctgcggaagaatttggtcgaaaaattctgttgagagtatccgccaaatcagtgaggtcgcattgcggtgaactgaaggaaatgaaacagatttatgggggtgggcaatgatttgtttttgttggacctgaaagtgccgctgaggtggaaggaagccaacttccaatcgcccgactcagtgataaaaatggcatttcttaggttgttgtgcgaaatttttgcctcgttatgcaggaatttgagacaattctgtggtaaagggacaattggcactaaagtaaattgaggaaaaacttggaaatcggaccaacacttggtaaagcccccaggagacgaacagttcccgctgagtgctgttcaacgaggtttggccgaggtaataatccaagggcggcacggctcc

SEQ ID NO: 9882 - DNA, 1079 bp, Heterodera glycines
ttttctgcgcactagtttcgatatagtaagcataaatacctcctttgtcacttggtttgaggcttctccgttgacttttattatgcctttttttgcctttttcgggattttcgtgccttaactgccttttttgacattttgccgttttggtgcctttttggggtttttttttctgaaaaattccattaaaaatgcaataaaatcgggaaaatacaccccaaagaaatgaattgaaacaaaattacagaaaatacatccctaagaattgaaaattttttctcaaaaattgattaccaaaatttaattaaaaattttccttattctaaaaacattataaatatttaataatcatttaaatgactaaaattaagttatttcgttaagtttacgtgttttactccctgaaaatacttaataaaaaatttttaatgccttttttaatgcttttttcgcgatttttggtgcctttttagtcggtccctaaaaataacttaaaatattttacactttgttttagcttgcctttttatttgacgttaactttttattttttttacatataattttttgttttttatgttattttcataaggcaaaatttgtatttcagcgaaagaattgccgaaaaacaaacggtcgatcggtaaacaaattaagaaaacccgggaattgaaacaattgctgaaaaatattttgaaaagcaaaaaaaaatgcaaaatcttgactgaatttttggtaaaacaaaatttgacacatttctccttgaatttgaaaataaaaagatttaaattttaatttacttagataataaaaattttctttctcataaaaatggaaaccctaatgttaaatcacaaaaagattgtctctaataattagattgaggttataattttataatggcgccaaaaatagcccgcgccgagtggacggttcccctttttagccttaggcattttttatgactttttagcgactaaactaaactgtccaattttattgttaaaatgccatggcaccgcggacaatttttaagtgttaaaaagcaggttttaataagaattcttctttagctatgc

SEQ ID NO: 9883 - DNA, 1973 bp, Heterodera glycines
ttcatttttcatgcataatgaaattttatttatttattttttgcttacgctttcgcctttaattaagcagcattaaaattgccctttttgacataaatgtttttgaattttctaacctcggggggtcgctgctgttcaagaatatgtcatgataatcctacggtaatgatgtccaaaagataaaacatttttctagggtaaaaaatgcgctgatctcgaacccgagctcatgttttgcaaaatcattgactttgtctatgatttccatcaagtaaaggacatatttttgcatttattatgaaggggaggcatagatccctcccttggccatggctttgagcctctccttttggctaccacaattaagccatcattcccctcccctccccccccccttccttagttttattgtccaaaattttcatttcaaatactccgccccctcaacgtcctttccatttacaaatttttttttcatattttgcttgtttcccaggccaactccgctttttctcagtattaaattgtcgactgctgcaacttggaaggactgaacttggacaatcagtcgaaatgcacgtgactttgcttggattttctgagattaagcatgccaaacaacgaaatggagaaatatgccaaaagaagtgatttcggatgggtggacaaatggaaagggacaatatttgtgattaagaggagaaggacgaacgaacggacagaaggaaaagcgatcggatggaatttgagaaacggaaacgaaagaacgaagcagcgaaagcattgagagaatgaagccaaagtgaagtgaccaaacggaaaaagtctttcagccgcccttttcgcttgtctttcagattgtctaatttggcaattccgatttccccccccccctccttaaattgttcttacgcacaaagaaaaaccaaaaaaatgtcacggtcaaaaattgtacacggaggactgtgaccaaaacatgccaagaaagtgcgaataaattcagtaaacctatcagatgatttgatacaattttatctttgattgagttcgagtcgtctttgagatggttttctttactctttctctctctacctctctctcgccctctaactccctttccctcttccttctcctttctctccactctctctcctccctctctctctctccctttccccctccattctgtctctcctcctcgctctttcccctgctatttctctcccgctttccttccctctctctccccctttctttctttctctctccctccctctcttctctccctctctctcccctttcactccttcctttcccccttccttttcttttctctcctctctctctttctcctccctctctctccccctttctttatttctctctctctctcccctcacttttgcttcatttacctctttacttggggcgtcatttcccactgttctcgtaaacatctcctagaaggaaaagaagaggcaattccccgtagggctgaataccccgatgatggaatggaatagttacgtaactgtgccggccgattcgctgaggtcaggtcaatgggaggggcggcggacgacggccttcgggggaagttcaaatgaagcggggggggggggggagattggacaggtaattgggcgacgctgtgccgacccttcccaccgcttggctcgctcgactcggctcggcccgacctcactttggctgacgagtgacaacaatcgccgtcctaacccgtccccccccccgacagattgcgtctgcctccgacgatctccgcccccggcggatgaccccggcacattcgttgccctgaagggcatgtcctcacatcagcagagattgtgagattacgtacctctccaaaatgcacaagtaaatcccacatatttcttttaaaatttagattcctaattgctttccctcagatggattctagatggtgaccgatgggacctgtcactgcg

SEQ ID NO: 9884 - DNA, 1228 bp, Heterodera glycines
ttcaccttccgctgcgcttctcttgcttctccatcagcatcaacacacaacatctcaatgaatgtttcgttgttttcggtgaccgggcgagcgtacttcatttcggagtgaggaggcgggaagtggaatgggggggaagcggaaggagaggggcaagcggaagggaaggggtgaagcggaaggaaaggggcaagcgaaaggaaggggtgaagcggaaggggaggggcaagcggaagggaaggggtgaagcggaaggggaagaaaaccagaaaggggtggggggataagcggaaggggggaaagcggaagaggagcgggaagcggaagaagaggggcaagcggaagaggagcgggaagcggaaggagaggggctagcggaaggggggaaacggaagaggagggagaagcggaaggtgggaaagcggaagggaaggcgtgaagcggaaggagaggtgcaagcggaaggagaggtgcaagcggaaggagaggggctagcggaagggagaaaacggaagaggatgggggaggggaaggaaaaagatgacaaagagattttcaggtgcaaagctgcgaaggatgcaaagtaaacgaaaggcgtgtgctcaaaatggcaagttgcgtgcgtttcagggctttttccgccgcgccattcagaacggagtgcaattcgcatgttccaagaaagagaagtgtgttgttgacaaagtgtcgcggaaccgatgccaaaagtgccgattggcaaagtgagttacgcagtgggttaggtgattagcaggtgacggttgctcgacttaagatgcttacgggtgggaatgcagcaaacgcacgttcgactcgagaagaatcggaagaggaaaagcgactcggaacaaagggacgtgggcttggaaagcacgcgacaagccatcgaactgatcaacgctgttgtgatggcatttaaggtgggacaacacagacaaattgaagaagggccgagggggggggggggagacaggtgacggatgcactgaccgatcaaagatccagagtttcataactgcaaccgattcatgctaaagcatgccaaactcagagttcgttccttacgctcgtcgacaccaacagcgccacatccgctcagcttttaaacatgcccaatttgaagacagctcggcaccattgtcagctgttcgttgaagcgatccccacctttggtgccttaaactcggacactctttgagcagcgacg

SEQ ID NO: 9885 - DNA, 4031 bp, Heterodera glycines
tttaattgaaattttttcgaattttccaaaatcccgcacgggatcccgcaaattttaaatgcgggattaatcccgcgggatcccgtcccgcaaaaaattttgagttccagtcccgcagcgggatccgcaaatttgaaatttccggtctctacccggtactacccgacaaacgatgtaggggaaaaataaaaaatgtttgccttctattcctatttggcataatgttttttttaatttgaaaaattaattccaacgatttctgaatttttggcaaaaccgcaaaacacatcatacctacagtaagtcggaatggatttccatttcatccatagtttgctttttagattacttttattaatgtaaaactcccttcaccgagtgttcttctgtaggaaatttgaattcggatgcgaaggtcgtcaagcgtaattagcaaatcgttgactttgcgtttgcttgctttggctctttcttacttcgtctcggtgctcattttccagcgaggtttactcgtgaagcgtcacattcttccacatcgaagttcatgtgaagacatagtcgccagggaaccgcgtcaatgctggactgaggcccgattcagcaaagttattctgctcgttgtggacgctcttcggtaattatttcgacttttttgacgaccccttttccctttgttttctaagttttgattttattcttccttcaaatggtctgcaaaataactccactgcaaaatattacaccggaaaaatgccttttgtggccaagttgctcaattcctcaaacgctggtctttttgcgcttctctcggatgcgccaacaacaacattccagcgcattaaggcattggttaccggttcagtcccggcattcattgaagcgagtgataatttcggggggtccgaaattggcgaagataatctgattgaccaacttatatcatgcggtcggaatattacaatgttgggtgatgatacttggtttgttctttgccgccttttgttttgcataatattttaaaggctccaacttttgcctggtcgtttcaaccgtcactttgagggaccgagttttgacatcaaagacctggacacagttgacaacatcgtttttggtgtcataccaagccatttaacacttatgtgacctgactcataaaacagcgcgtatttatgatgaattgaatcggacggattggtcgttgctgatagcgcactgtcttggagtggaccacgccggacatcgctatgggccggtgcacccggaaatggcgcgtaaacttggccaaatggacgaacttgtgcggaatgtcacgagcaaaatgtcggatgatgctgtcttggtctgacaacaattggtatttaatgaacctttccttccacagtttgttcttggcgaccatggcatgactcagactggcgaccacggcggggacagtcccgccgaaataactacggcacttttggtctatgcaaaggggctgaatattttgacaaatttgtccgacattttgaccgttcaccaggtcatttccctttttcagttggtcatctctttttgaccccttttcaggtcgacatcgtcccgacattgtcccttttgttgggtgtgcccattcccttttcgagcattggacttgcaattgactcgcttttgccgcagaattcgctgcatgaacttcgcctgaactcttttcagctgattcgttatgctcagcaatactttcaccactacccgccaatgcaagtcagttaatgaataaatgcatcgattaccccccccctccttttttcgtttgattttacttttttaattctttaaattctccaggttaagcttcgttacatcattcgccaatacgaaactgctgcggatgatttccattccaatttgttcgtcataaaatccattcaaaagttgctccgtctctccctcgaccaattccatttctccgtttgcgtcgttggccttatttcgctgctcgagtcggtccttttcaatggttttttgttgttggacaatgccgacgaatggatttcgatccgtctttgggtcttccgttctgctctcttgtttttgcaggtggatttttgtttaaattaaaaaaactatgctcgatggatcatctcgttattccgttgcttttgagttacgttcaaatttatggctgtgtttattaagttggatatgatttatgggtcgactaaatattttaattcttgtttttttatttttttcatttaccgtcgctttgttttaaaatctgccaaaaataattcccgctttcagctcagtttggtttttgctgctgaaccgagtgttgacactgtctttttctctgtgacgagcctcgccgtgtctctgtgttcccagacggtggtcctttcctacaaaatatttgctgccgtcactaacaaatattcgccgtttccgtcctctccgtgcctaacccttttcgccaatttcgtcctttctctgctccctttgtctaacagtttcgtcatttacgaatccgacgtccttcgcttttcactccaaagtgtcatctgtgttcttttgctgtacagtttgaacaccaaaaggtcaatgaaacattttgttgctttttgtttcatgttttttttattttaggtcatttaatcttcgaaatgtcagtgctgaggtgagacttgctttgctgcttctattcattacgcgctttttaaaagcatttgagaattgccgtgaagaacaggttctctgtctttgccgttgtttctgtttggttattctacggtgtttccctaaggtcggatgtgttcctgtcaaattcgctagtcattcggcctttcttctgtccgttctgttcgtcatgggcgtcctttgggctctttttgagcgtttttctccccgcgcgcactctctgaccaaagcctttgtctggtcgatggccgtctttctcattttgcattgggccttcgagctcagcgcactcagttttgttgagtcaggtaatgtttatccgggtaatattttggtcctaattgcagcctaacgacctgctggttcactaatgctcttagacataatggtcggctcgctatgtctttgtccattaactttttcggctatccaaagcaaatatctattcgaaattatttattttttttgcatttaaggactcattgaaagtgcttcaactgattttgtcgtttcgctcgggaacattcggctcatcgaatcggtctctcttcgcttggctcaattcgtttacttcgctttcttcgtccacctcctcgccttccgttggctgtccgtttcggcctccgcttgggtttggccccatttccatgcgttggctgttccgctggtgatgttgtccggctattcgtacggacaaataatttcggtgattgtcttcgctttcgctgtctccgaccctttgacttcgtcaggtgggaggacaatgaccgtttgtttcaacttttcccctttcccagagagtgtttggaccggtgcctttctcctccatctcatcgcattgctttccttttatgccaccggccatcaccaaacgctcaattcgattccgtggcacgccgcctttgtcggtcttccgggcaatttccccttcaaatggttgtccgcacttctcatcttctttaacatgttctccgggaaaatgttggcttctttgttggcattcacaagggaaagagaggacacaatcaaagggccgctctgtttgttgtttttcggtggaatgcgtgtaaaatttttttttggagaaacggactatttgacatgaatagcctttttccccgcccaatttttaaatagaatgcttataaacacaaaaatacctaattcggggattggacacctaaatttagaatatttctgtaattgtcggaattttgttaagaaaaatgcaaaactcggtaatagtttagatggtagccccctttttcaaaaaataaaacttttgattttttttttgttcatctaaagaaagtttaggggtttcgagggccgaagaatccgaatccgac

SEQ ID NO: 9886 - DNA, 3009 bp, Heterodera glycines
  misc_feature (1380)..(1380): n is a, c, g, or t
  misc_feature (1428)..(1428): n is a, c, g, or t
atttcataaaaattattgacactagtaaaaaaagaaaacaaataatgcgggaacagacacagattctccgaataacagaaatggctaaaaattgtgcttgatcactcaaaacgcaacaaatccgggcggccaccgttcagtcggcgttgccttccagcgtcaacaccatgatttggaaatgacctattcaaaatgagggaaattagagaaaatctataaattatggacaaatccgtaaaataaattttaggtgttaatgttcggcaaaggcccgtaaccaaaaaaatttcaacgggggatgggaacctggatttttttgtggtcgaaaattaattaaataaaattgtgggaaggggtcaattttttgcaagggctaatatcaaaatcgtgcttgaattccatacaaatacccctgaaaatgccgcggacgtggcggcgaagcaccgccaatgatgcgcattcttttctcctctgcgtcggaatcatattcggaatcgctgaaaaattggttctcttttccccacacatggcccaattctttaaaaaacggttatttttgattaacttgtaaagttcaatgaaatcaaaaaacaaaacaaagcatttttgcagaagttccgaatccctccaatttcataacagatgatgccaaaatgaatgcctattgttagcaccaacttgttcaaatcggcgtcaatgccatcgtccgttgtcgaggcgctgtcatcccaattgtctacttgccgaaaatcgtcagagtccgactccccgtctccgtccgagtcatttgccatgccataacgttgcgctgcggttcgttcaccccccaatccgtcgcacacctcggaaccgaacaaaaagtcaacatagccggcctacatacaattctattataaaatttgcattcgggatttggattacaaaaccaaatgcatttaaaaaacccacttgacagtacaatttgctgcgcaactgttccaccaactgattttgcaggttttgttgttgagcaacaacagattgttccggctgacttgtggtcaacatttgtggcggcggctcgtcatcctgcgcaataacgggaagatgtgattaatttacattagaattaaccgagacctgcataactaatgcccctccaccatttctatgagggatttcccgacctagaaccaaaatccctggggcttttttcatccaaaatttcaaaaccgaccaacttgacattttaagtaccaaaacattagtgacatcttcattttgcaaaagaattgcctatatacgtataaacatggtggcaaaaaatgctttatcaatataatttatggtgcttggtgcatttatcggcaataaaaatgaatttatctcatagattactgngaaaaagcagaaatcagcagcagagagataggtgagagaacttaacanaatattgagcagtaaaacaataaaataacatagttttaaaaaagtaagttgaaaaagaaatgagtaaaaatgggtaggaaaagcatagactcccattctttaaaagccgcttcaaatgtcatcggaagcaccaagacaacctaaaaatcggaaatgagtcataaaaagagagggatttcgaaataggttttgtaaaatgaaaaactactttgactattgaaacggcttttttaaacaagcattctttattatttttttaaatttttacacaaaacaacacctaaaatgtggataatatgaaaaatgagaatattaaagcaccgtttagtataaatatataacctggtggcatgggaaatattaatcaataaaaaccaaattttgcaaaaaaaagtttcgtccactttttgtccttgtcagtttataaatttcaaaaccgcaccagcagtgagccccacgagtcctgcacaatttcccagtgacagccttcagtttctttgacaaaagtcacccaaacattcgctgatttgtcgtacaagtctaaattaaaaagcaatgggacgaaaatgagttagatatttttattcgaccaaccattgtgagttagaaattccttgccgaatcgaacatttcccaagtctcaaaaagggtttaaattagcaaaaaataaaaattgcaaaaatacctgtcttaagaacataatgatcgccatgaagcttcgttattttttccttggtaaattcgcaattgacatgaacctgaaaaaggaagttatagcaattgacacgattaggtaccgggaaaatatcaatttgaacccaaaaaaaaaagttttttaaagggaagtataatttcttacatgcacaaatcggtccatgatcagccgcgttttcagcattggttcatgcaatttaaagtcacccttacacatccattcgtaggtcaaacgacgcgcctctcgctcggccacacgaataaatgcgcatgaatagaattcgccaagtgaaaatttttcatcgaattcgcacgcgctacaaaatatatatgtatatcaatatgaaataaaaagattaacgttcggacctctgcacattggcgtacttgggcaacagtatgcttagtccgtatttggggttgtacatgagcaaatattcgggccgtttgcgaacaaccagtccatttgcttgcttaaaaagcctagttaaaaaagtgaaaaaccgagaaaaccaaaataaaatatgaaacaaattcgtggtgggacttttagtttaaaatacccaaaaatgatatttatttttttgaaatatcttgaaaaatactaaaggcaattgtttgttcgcgcaatgtcaatactcacgattttcttatgcgccgtagacggctcataacgcaacagttccgcaagcacaacatcgtcactttcgccggcgtccacatatttaatggtatttgtcgtgattatcttctttaccggagctgtggccggtgctggcgttgcaccaactgccttcctattgaccgaaaagcatccaatgtgtcgtcgaaaggactgggcttcagttgcacgtgatggtgttgctg

SEQ ID NO: 9887 - DNA, 1941 bp, Heterodera glycines
  misc_feature (79)..(79): n is a, c, g, or t
aatggccaagcctttttttctaatgcgcagaaaatttcgttttgaattaccctggaaaagaactttacaaacaaagggnctttttttgcccctcccgaaaaactcactggtgtcccatgtgttgtctcttgcatcaaaaacttggtcaattaaaatccggtgtgcatcgtcacaagtcttaccatcctctacggaataaattgacaacttaaatgggtaaaataaatggaattgagaaaatccaaaaacgaaaaatgtgatgacctggagtggaactttatgcacacttttcaccgatttgccatgagatttcagcacattccagaaacaattgcgtcgattctccggctgacgattgatgccaatttcgaccaaatagctttcaccaggttttgttctgatatgttgttttgtgtcctccactcgccccaaataatcgtttcgcaaacagttaacgacgcatttcacatcaccacataactaaaaaaaggagggggaggggtaatgaactgtcaaaaaaattttaaaaaaattgacggaatagatatcataattatgcattaaattggtaaacaaattggaggacgatcgccaatgaatcccaaaagattttcggatacacccccattgcggcaatattatgttccggcgacctttcatccgacgacgttacgggcaacgacgttttgttatgttcccaatatttttaactctcaagaaactgggcacaaatacggcaaaacaaatatgcgaatcccctcgacagacatgacccagttgaccgaagtccatctcaccagcaatttttcggccccacttttgttgaccacccgtgttgacatgggcggtgaaatcttctttgagtacagcacacggtacgtgtgctcgtgcatgaagctgtcgtaggcaagcgtgcgcaccgcttgctcgtcactctccacctgaatggtcgcctccacccaagtgcccagctccaagcgcttcggctgtcgcgcaatgccatacgaagtggcgatgactgacactttctcgtcctgctcgttgccaatggtcactccgagcacattgaccacctaaaataatgttgaatgacgatgagttggtgatgaaaatgtaaaaaaatttacagtgtttccacattctcttgggcccttccagtccagcggtggctaaattataaaacaatgagtttcggtgtttgtataaattattgccagtatttgtcttaaaattgtccgttccgtacaacctgaaaacgtgcaccaacattcaccaaatgcatctgttcgtctgcttgctgcattcttctgccgccgattcgattgaaaaacggctgaactttggcatcgatcactgcgggaagttcgtccaacttaaacacatgaatataaaaaaataatgaaacattaaaaataggtttaaatagacagattttgggaaaaactattaattgatccagtaaattactctttgtcaggcaacacgcctgtcggaaccgacaaaatgtcacctctcaacaaaaattttttttgaagcagcaaaaaattatacattttttgctgcaaaacatgtgaatcaaatacaaaccttttggtaaacatcgttttgcttctccatcgcaaatgccatccaacggcacttgtattcgtcggtgaaaatggacatcacctaaagaatgaagcaagtgaaatttagaaaaatgtgaaactgaaactagtcaacaacctgcacgcactgttctttttgcacttgctccttgagccagcggtcatgcggacaaatgactcggccaacaaaactgtcgatggcttggaacaactgcgggttgtgctccgtgggatttgtgagaaagcattgcatctaaaaatggtaaagattaaaagcagtaggggcagttgtgagattaaatagacttttttagagacaaaaactgaactcttt

SEQ ID NO: 9888 - DNA, 1893 bp, Heterodera glycines
ttttgtatacctatattttttttttgaaaaattccaattttgatggaacgatgcaggggtgggggaaatgacctggtccgatgcgttttatcccaattttgtatcgaagaggttgggaaagtaattaaaaaaagtttttttttaataaaatttagaaaagcgagcaaaaggcgagtaagaatcaaaacacttacgacaacttcagtgccgtaatcggtgctgcatgtgctgaccacacggtcatcacgggaagcgagcgcaacgtaataggcggtgtaactgcatcggactccgcggagcagctgagactgttcgtcaaaacagcggtaatggacccaagttgcaatgttgtactggtgagaaaaaatggcaatacgaacaaaaattttaaacaaaaacacacacaaaactaaacatgaattcgaaataagtatttttgtgcgtaattcctccatggacaaatttctggtttcggtacaaaatatgttaaaagtacctgttgttgttgctgctgaagttctgcaccggttggtagctgaatgcgcaccaaatcatgagtgggactccagatgacggcatattcgtccgtcacgcgtacaactagtcccaagaacggggtaccctcctcaaggtcttcaagacgagcagcgtaattggaggcgtcaatttctacaaatttttgtgctataccaagcattatgttaatgatagcttattgaccattgctggggaagtggtcctgcactttctgcactgattggctcctgatcgagttttggtcgctcctaactgagttttggtcagcgttgctttgagttaccggtgcccaaattgtactcgacgaatggtgtgctctctgaacggttgccgacttaaacacggaaaatagaatcacaaattcgtccaccgaaattggagtgactcaaattttgaaacgaaagttaaggaaattgacttggaaatttatatgcaaattgtttaaacaatagtataagtaatagttttgctccacttccactaaaccaaccaacatttgagggaagcccaatgtcgtcgctttcgttgcttgtaatttcgtcagcaaatggctaaaaatttggatttttcaacaaattctgctgccgatcgaacagtgccaaaaacgcacacagtgctcaatgagttcctcaatggctttgctgtccgtcacaattgtgttgaacggcgtcccttgccggtgcttcacacaaaacagggagcccatcttcttgccaagaacaatgaacggttcgggaagtctaaagccgtgatgaaaacaattgggaagatttggaaaaacctggttacataaccctcgtaaaccatgccggggacaacgtcgagtttaagaaagcagagcacctccataaaattgtccgtaaaagccaatccttgtaccttctaaaaacaacaaattataaatgcaataaatttagttggattaaacccttggcttcgggagagggggggggggggggggggggggggggggtgggaaaaaatttttttttttttttttttttttttttttttttttttttttttttttttttttatttaaaaaaaaaaaagggggaagaaagggggggggggggggggggggggggggggggggggggaaaaaaaaaaaaaaaataaaaaaaaaaaaaaaaaaaaaaagggtgggggggcggcgcccccccccccccccccccccccccgcccccccgccctccgcttttttcttctttttttctctttcttaaaaaaaaaaaaaaaaaaaaaaccccccccccccccccccccccctcccccccctccgtgtgggggggggagggggagaaaaaaaacaaaccccccccccccccccccccccccccgctttttctttttttt

SEQ ID NO: 9889 - DNA, 992 bp, Heterodera glycines
gagagaaaatatgaaactaaggaaatgcttagaaattctccataaatgtaggaattccgaaaatcgaacacctttctcccattcattcccttcgctgactttcactgaccaacaattgcccaaaatgccttgggttacgtcgcatgggctcgcgccctccacgaataattttgggtccgcaacaatttcctaaattggcttggtttctttattatcactcattagtggtgccactgtttgcttatcactccctccaccgtttctttaccgtaccccgggccttttccactcaatttccaattcggccgctctttcggcacttccgtctccattttcgtcagttatgaacagtgtcgtgttgtcgggtgggaattccgtgtcgatgaacaatttgcccgtgtttgcgcattgtctcttcagctgtctgtaccttttgcttattttggacggactgataactgtggcgggcactgacggcacattttgatcgacgacggcaccgtttggcattggccaactgattgtgctctttttattattcataatttgacacttatgaccatcaactgacgatgatgacgtagttgggctgtttagcagatcggaagcatttgctaatggtgggcgtttaattgcgtcagaattggaggacaaagcgaactcagccaaacggccgaaaagagacatcgaaacggggatttatgtgttcttatataaacaaattattattttaaattaaaaaaaactattgtttaaattcttataaaaaagaaaattacttttatttaactaaaaaatatattttggtaatagtaccgatggtagcccccctttttcgaaaaacaaaatttttgaattttttcgagaaaagattatattaggagttttaagggtcggagaatccgaatctgacagtaatttcgacctaggtcgatcccggaatcgagcaaaaaatcgaaaattcaaattttagaatttctcatttttggtct

SEQ ID NO: 9890 - DNA, 3839 bp, Heterodera glycines
tatgtcgagccccgaacccgaattcgagcaaaaagtcgaaaattattcaatttttatttttggtctaaaagtggcttacatatcgagaaacaaactaaaactggtcaattcattaaaaaaaaatagttcaactatttctagaccaaaaataaaaaattcgcaaatttgaattttcgactttttgctcgaattcggggttcgacataggtcgaaattaacgtcagattcggattctccgacccttaaaacccccaatataatcttctctcgaaaaagtttcaaaaatcttgttttcgaaaaaaggggggctaaccatcggtaatatatttacctaatttaatgaaaaatttgggggaaatgcatgtgaaaaatgaggcaaagaaccgtgatgaaatgaattttgtgaacaaaactaagtgtaaagtgacgaaggctgaaattcggacaaaagtctgacggacatcgaaaaaagagcgatgaatcatcggaagaaaaggcgaaaaattcaaacggaacaccaaaaaatatttggcgaaaagggagcgcaaagaacggggaaagaatggacgaaaggagaaaagcgatcggaaggatcaccggcggaaagatgggaaacgatcggagagtgatcggaacaccaaaccgcgccgaaacgaattgagtgatcggaggggaaggagtgaatggatggtggtgggttgttgtcgttgtcacacttaaaacatttttggagtttgattcgaatgaatgcgccacaccccaaaagatgggcgatcgattggactgtcgggggaaatgaggcaaaacgccaatgaaatgtcaaaatacgaatgaattcaagaggaatttacccacaaaataaaaataaagatctttgaatgagaaaaattacacagcagaacaaacaaacaaaaatggaagacaaaagcgaagggacaccgtacagtaagacgatttggaattacggtaatctacaatccatgatccatgattggaccaccccggtggaaatagacactaaaaaatgccattacagtctcacttttgccgcacgcttttttaaaaaaaaacttgaagaaaaattttttaattgatttaatgggacaaatgccgttttcaaagggcatcttcgaaaaaaggatgttcaattaattttcgaaggatcaaagaaagtacagatacaaacctgtttttacacatttcttgtttttccttttaaaattgtgttcatatttttatcatttgttcatttgtctgtccctcattaatttttcgtgtccaatcgatgctcaaaggaaacgattctcggcccaaccgattgtcatccatccaattaattaataatgattcatccattcattcatgcattattcaaactcatcacttcacgtatgctccgaattgtctttttcattttttgtggaaagtttttaattgataatttttccaagcgataatttgttaatttgtcaaactttgtgtcgttggcatttccgtgatcgatttaaaatgcacaaaatatgcactaaattattttaaagaatctcatggttcttatttatatctaatggtcccttcttctgctttgaaattgaaatgtccggggatttcaatttgacacgaaaataaaaagcaaagataacaattgagggacacgacacagctgttcaaaatcaaatcaaaaacgatccaatttattttattcagaggcgaataattcaattaaatttaggagacgacaattaaagatggacagcaacacaaaaatatcataaaattagaaagaatgtcaacaggaaaaatatttgattgtaaatgaatattcgtctgatttcgcacaaatcgaataaatttttaaactcaaaattgagtagtgagttaaattttcacttgaaccggtgccggtactgccaaaaccggggcggtgccgaaaccaacattttcaaccggcatcggtaaaaaatgctaattttccgatgttggattacattttataactcaacaattttttgttaaaatagttttttattttgaaaattctaaaagattcgttttgccgtgagatttcttttgaattttttgtgtttttccattctccgacaactttttcttttacttttataccactttttttcgcgacgcgctttttcaaaaaattaaatgtgctgtaagttcatcctcaaatgacccaagccatgcttcaaaatttttgcttattttttctgcggctttaattcgacgagaaatgcacgaaaaacacattttttgttcgaaaattttgtgttttaacgcacttattcgaacttagaaatgcttattttggcgtttcgtgcttaaaaatgcttattttagaggttcgcccttaaaataagtttttgtacttattttagcgttttatgcttattttcgttcttatttcgcgatttttgggaaacttattaacaaaaatgcaataaaaatgataaatacacccctaagaatcggccaaaaaaatttcggaaaaatacacccctgagaattgacctaaaaattttcaaaaaatacactcctaagaatccacccaaaaaatttcggaaaaatacgcccctgagaatcgacccttaaatcctgaaaatttctaaatgtacttcatttctaactgcaatcagtaaataaaattgtttgacttaattttaactaatttacatagagaaaacagcaattttaacaaatttcacctctacatttggaattttttcatgcttattttcgcacttatttcgcgcttttttcgcccttatttaagcacttattttggactttttcgcgcttaaaaatccgttccctaattatgatcatgatcagagtttgcttcaaatgattgtacatataaaaaaagcagattctgaagtgtcttaattcactttttggaagcattaaaaatataataaaacttgaagattaccaaattcataaaactaaagcatacttaatcatcagggcccggctttatatgttttacaccattttttttttgcgaatattctattgcagaaaagcttaaaaagagcattttatccgggtttcttatcaatcagcgcgattttttagtgcataaaaatattttggacttttggatcataaaaacttattatttttggcctttttgtggtttttaacaaatatttgtggattttttggcatgtataaatccgggcctgggcctgttcataatgcattttacggtcatattattatttttttggcccggcaataagcaataactttttacacacgctcatttaaataatttagtgactcacatcaattaacaattgcaattaggtcaatcaataaataataattgcaaaacgtaacacttaccaactttcttctctttcaaagttttttctccaacttttgttgtcctgttccgtcttctccgatacatccgatgcatttttgtttaatattataataatgttaaaatttttatgcgaatatatcgcatcgcacgagaaagccaaaattacattttcctcagaacaattttaaaattagggcgattttgtgtcaattccaaactacggaccgaatcctgacattggcttcgaagaataagtcgagaccgagacaagaaaaaaacatttggataacagacaaaataacaaacgattttcatttattgaggcatgcataattaattcacgagaaagaaatcatttcttaaaaacattcatatggcggataatttggtggatcggttgaagctgatgttgagcacgggcaacggggcggacattcactttttggttggccaaggagaagaaaaggaggcgagttggcccacaaaagaattt

SEQ ID NO: 9891 - DNA, 1474 bp, Heterodera glycines
  misc_feature (17)..(17): n is a, c, g, or t
  misc_feature (37)..(37): n is a, c, g, or t
aaaaaatgctaatttcncgatgttggataccatttantaactcacaaattttttgttaaaatagttttttattttgaaaattctaaaagattcgttttgccgtgagatttcttttgaattttttgtgtttttccattctccgacaacgttttcttttacttttataccactttttttcgcgatgcgctttttcaaaaaattaaatgtgctgtaagttcatcctcaaatgacccaagccatgcttcaaaaattttctttgaaaaatttaaatgtgcaatttaattgacaagctacctttttaattatattagttatttttttaagttttgtttagtacttatgtcgtttattatttaatcaattctctttaatgcccacatttcttgtgccaaaacttcctccggcgaaaattaataacaaaataaaaagaaataatttaaattgaaaattgtgataaggacgaaaattcattttggttttaaatttatttgccgttttgttcttaatttaatgtttgtgaattgtttaattcctcctctgacttggggcgttttagcattcagttattattagggcttccatttttatgtaaatacatattttttcctggcttctccttgctctaaatagtaggaaaaacactttcttttttgtatttgcgaacaaaagttgggacttttatttacatatttttacatttttcgggattttatacatatttggtacatattttggactttttcttacatattttcattttttctacatattttgagaatttttgaaatttttttagaaattacttgtgaaaaaataaaaattcttttttttttgaaaatatacccctaaaaatagcaaaaaaaatttttaaatgttaaaatgtgattctaaacctatttaggtcatttttatatttaaggtttttatacatatttcttacatatttcgggatttttttttacatatatatgtacatattttgaccactttttgtacatatttttgacatccctagttattaattatattcttgttttattgtcgtctctcctcctgatttatttgtggtgtttgattttaattggaaataaatagtgagtgttatgtttggttttgtgtttaattgattgagcagcgaaatattagtgccccaacgatccaattttctctacaaaatatccatgcccattttccgaactttcataagtttagctcggatttccatttttgccaatgtaaattttaggttactaccagtaccgccggtactagaaaaatgggtaccgtacttcttattttgaaaaactggcttctactctacttaaacgctaattaaattaaatcaaatcaaatttattcggcattttcaattaaattaaaggaaagactcgttctcttctgttgatcaataaataaaattaaatttagaagcattacactttttgttgtttacgacttgtcaaggttaggcact

SEQ ID NO: 9892 - DNA, 4384 bp, Heterodera glycines
tgaaggtggtcctgccggcgtccaccttccaacgcttcgcgctgatgcagtgggggcgtcgtcggacggagctgaagaagagggctggttgggagcgtcttctggtcaggccatccctgacgaaggaggagctggaaattgaacgtgaacagcgccaaaagaagtggatggaatttggacagaagaaaacggatgaaaacatcacgacgcgacgcggaggcaatgaaaaaacttttgaggtcacctccttttttaaattgtttatatttcaatgcacgaagtttggcgaacaaattggacaagttaaggtttttgttattagaaaataggtttaaaatcattgctgtatctgatttggttgagtaacaaaatagaaaaccctcaaattttggaaaatctcccctattctataataagatcagatagacttaacaaaaaaggtggcggggttgctttcataatatcgaatttaattacttttgaaattatcaaaactacaaaaaacaaaaattccgatattctttgtgttgacctattttcacctcttaaccacacaaaaatacgttttattttggtctatagacccacctcccatgaaaaacaagaagatttcgaaaaattggtcgaacaactctctgttttagtctcggcttctgaaaaatgcattttgttgggtgattttaattttcctcttttaaaagcaaaagactttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttgaaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggatattcacaaagaccatataaaaataaaattcttagaagtttcgaaaaaatcgatgtagaaataaataaattttataaaaatcgcgaaataagtttttgcggactttggactctaaaaaacgtttccaatttataaattctttccttaagactaaaaatactatgatacctgcatttactgataaaaatagtctgattctcttctcagataaggaaaagtcgaatgcattagcgcaacaatttttttccgtttttacagatcaaaatttagaacaatttcaatgcatagaaaatcctgaaaaaaatatcgaatattttaacataactccatatgaaatttatttttctctttccaagctttcaaattctaacaacactagtattgatggaattcccaatatttttttgaaaaattgtaaagaaaatttagtccgacctcttttccatatttttagtttctcatttatgactgctcaaattccagaaatatggaaaaagtcaattatttgccctgtcccaaaaattcaaaatccggtaaacccagtcgactttcgtccgatttccctgctatgttctgtttccaaaatttggaagaaaatatagcaggaaaaataaaaaattttgttgaaaaaaataatttgttaccaaattgtcaacatggttttcgtaaagcacattctgttactactcaacttcttgaagtggtggatgatttcagttttgctttagaaaataaaaaatcaattgatgtaatttattttgatttggctaaagcattcgacacggttccacataaccggctaatatctaagctaaaaagcattggtataaataattccttattaaaatggattcaaaattacttagaaaatcgaaagtttttcgtcaaaagcgggtctgatttctctgatgaatatccctgtctcagtggtgtgccgcaaggctcaatattgggaccacttttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcaatactgtaaatttaacggccttaaaatcgcttcaaataaatgtttaactttacatttaggacacaaaaatcaaaaaataaattattttattgatgactttcaaattcctaaaaatcccggaaacgaaccagtcagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaatttggatctccaattttcaatccttatttaaaaaaggatattgaaaaactggagaatgttcaaaaaacttttttgagagtaatatttagacgtaacaattatactgttgatttacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaatgaattcattataagaacagcttattgctcaaccaatgctagatacaactcgttctttattcgaacctctcgtctctttagacttttacctaaagagacgagattactaaatccaaatgagtttgccaaacttcttgaaagatctgatcttaatttgttgatttctttgccaccccaactccaaaagtgaccaattgattgttttgacattattatttctttatttttcggcgtcacgcttctgcgtacttttcgccgccataattaaaaaatcccgaaaaatttttgcaattatagttaaaaaaccgctaaattatggtacgattgctgaatttgttttgagtcttcgtataactgattatttttgaagctgatgtcggccatacttgtgcatcttagattaataaaaattttgacttataaattttttttacgcccggaactcaacccttcctttatattcggtaacattttgacaaaatttttatttaaaccaatcagattcgcctttttcaatcgttccttcttttgtatccattgccagaatttactgatacatataatttgcataatacaaagagaaacctatctttaacttattttttcacttcgcatcacagtttcagctgtagctataacaaattattgaaaaataaaaaaaatttttaaatttttgaaaaataattatgggagcgaaaaggacattttcctacgggcggcgaaccggccgcggcgaaccgggcggttccctaggaaatgcagggcccagaactttcaatatggaatccaagtccaggtccaggttttttcaaaatgtcgaacttagctattcttcatcaaaaccgtttaggcttttacactgtttttcctcttatggaccaaagcatagaatcaaaactgaatgttttaacaatcggagaaggaattttgctgccacttcagaagttaaaatcagcaaatgccaacaacacttcactcaactgcgcttctttgaaaaattacagattggttgcaccgtaattaatcactgctgatcagtgattattcaataattactcaaaaacacctatgaaattcgatttcactccgttcgttcctttgtcccgtccccctcttttgctctttcggtgccttttccctttcggggattgttcaaagctaagtgtgtcccccccttcctttggcttttagcttctcaaaatgctctttcatccatcgccgtccgctcatttaatgggccttcccccgagggtaatcaaatttctttctttttccgactttcaatgagctttttccgcattttctgacaacatccatcaattgtttcactttcattgttctcatggtcctgcaacttttgaggaaacgaaacgatttgacattaattgaccattacaaaattatgtgaaaagcacatttattaacgcattgatatatgtaaaacttgttcgatttaataccttaaagctaaagtttttgtcaaatcccaccctcttctgccctccctttcccc

SEQ ID NO: 9893 - DNA, 1563 bp, Heterodera glycines
gaaagaagagagaatgtccgcggggcaaaagggagggagaagccgcggcaaaagcattttcatttcagagaggcgacttcgaacggcgaatgttacgcgccttttctggccaatcccttcgtgaacatgggcatgtatttggcctattactggaccacactcgtggccatgttaattctttacaaggcaaaactttttcatttattttggtccaagttgctttaagggcattcacaaagcggcaaaaaagttggagaagcgaagccgagcccgagagcatcggcacattgcacttctgttaacgcaacgattgggcacacaggtgatcagagaaaaacaaactgatgatcagaggaaaagagactgataaagggaaaggggcgactgataagggaaaagaaaaggggactgataaaactgatcagaggaaaaaagagaaacgggggaaaagagaggatgatcagactgacataacagaggtgaagggaccgacaaaagcattactgatcagcttttcagtgacaaaagttttggggaagaggcagtgacatgagaaggaaaaagcaatgagtgtgaaaatgaaaaacggaggcattccatgacgggaaaagtcagtgagtgagtgattttgcattggttgaggtcggagtcggtttgatgcttcacgcgaaacgataccaagaggaggcgaggcacgagcagagcaaacagcagaaactgacaatgcgatttgaagcgaaggacagcggatacataacagcgaatacggtgggagtgtcctctctctgtttctctcctccatctcactctctttctcccgctctttctctctctttcctttctttctctctctttctcccgctttctctctctctgtttctctcctccatctcactctctttctcccgctctttctctctctttcctttctttctctctctttctcccgctttctctctctctgtttctctcctccatctcactctctttctcccgctctctctctctctttcctttctttctctctctttctcccgctttctctctctctgtttctctcctccatctcactctctttctcccgctctttctctctctttcctttctttctctctctttctcccgctttctctctctctgtttctctcctccatctcactctctttctcccgctctctctctctctttcctttctttctctctctttctcccgctttctctctctctgtttctctcctccatctcactctctttctcccgctctttctctctctttctcccgctttctctctttctctgttattttttctccctcttttctttttaattgttcgtcgaccattttcagctttccaccaccgattccgctgaacggcggcgcagttccttctcaactttggccaaagccgttcaaagcactcagagattggcacgatttcgccgctatggcgcgacttttgcatttcgcagcaaatcagccgctttggaagaaaaaggcacgacggaaaagaaaatgaaacaataggaaaatggggcacagcaggtgacagaagagaacagaaa

SEQ ID NO: 9894 - DNA, 2409 bp, Heterodera glycines
tgttcgtcacataataagttaaatttatttaaaattaaataattttttgaaaaattttagatatgcataaaattagcgctgatcaagcagaaaatgcgatccaccaggaagaactgattctgatcgaatagatttataattagcaattgaatgaaaaatggatttagctaaaatgtttaattaattaatatttttttaaaatttccatagcaaaaaattggcaaatattgcattccgtttttaaattaaattatagttcattaaaaaattctatatataaatagaaacaataaaattgtaaaatataacttttaaatttattactgttaaaaagagccccaaaaaatgatgaaactgttgttattttttcttcttcctcttttttcttggcataacgttttgggaatttagtagccggaagaagtgatacaactaaaggatatcatttgcatttgccatgataattggccaacctatagatgatgtaaaagcgatagagaattggacatacaatcagatagattatttgcatattttaattacgtgtataaaattgaatacatataaacaggaagcgccaaaaaatattatacatacacataaaaatttattttaataggcattaataaatttattcgataaatatataaaaaatattaaattaataacatcaaaaaatattatacatgtatattatcttttataataggcactaataattttatgcaataattaaattggattaaattattcttgtttatcaatattttaattcaggcaaaaatatgacaaataaattctttattaaaaatttaatttattaattattatttattaataattattatattatttattattaaattaatatcaatcttcctaccatacataatattattattaaggaaggtaaaaaaattaatattcaacaaaacataaaaaatttcccctttaaaaaaatgcataaattaaaaatatttaaatataatgtatttagtatatataccattgccaatgttgctgctcagttttgggttgatcgttctgctgtttgcgtgtgccaattgttccacggaaggtggcacaaccgaacatccgtcgagttcaccgccgccggcgactgatcggaatggagacaaaccatcgccagtacatccggtactgaaaaagtttactaatgcgcgtgatgcagttaagaagcacgtggaggctgctcagtaattttatttaaaatttattttttaagtaatttggggttattttgcatatggacgaaactgtcccagagatttactttttcggcaataatcccaccaatggactatggcaccacctttctcggcacaagggcagtccataggtgtcgggttggcttagacggggaccacatccccagattgtcttacggtggccaaaatttttttttctagggcttagtatagatttcataaaaattacaatttaaaaaactacaaccgaattttgctgtttttgactatatgcttttattattaataaattattaatttttcaactgaattcattagttattaaattaatttttgatagaatttcttatttaccaaaatagaggaaaaattattgaattctgaaatatattaaaatttaattttaacagcaaagttgtagtgccagcagtgaacaaatactttgacaaatatttgctaccaaatgccaaaaaggttggcgaaacggcaacacgtggcttcagaaattttcgccgaaaatttttgcgtccaactgtcaacaatgttgttgaacggagccattcattgggagaacgattggcatcaatgaagaaatgggaatcgtcggacgatgaggagacggaaaagcagaaagataaaggaggggaaaaagaggatgaagagaaaaagaagatgaacggcaaaaatgataaaaaggaagagagaatgaaggagaacgaacatgcgaagagacatggtgagaaaaaagagcatcatgcagagaaagaggggaaggaagtgaagaagcacgaagagaaagaggagaaagaagagaagaagcacgaagcgaaaaaagagcatcatgcagagaaggatggaaaacctaagaatgaagttgggttgggagaagagaaaaagcatgaaactaaaaatgagtttgaggaggaaaaggtgcataaggagaaaagggagcacgaagagaaaaaggagcaagaagagagaaaggatgaagaaaagaagaaggagtgcgaagaaaatagggagcaggagcatgataaccatgaagcgaaaaaagagtcaaaaagcgacgagatcaactcaattgaggaaaagcttaatgtgagaacattaactgagaatgggatgagaaaaccggaagaactaaacgatgagatggagatatataaggagcaaaaagacg

SEQ ID NO: 9895 - DNA, 1642 bp, Heterodera glycines
  misc_feature (57)..(57): n is a, c, g, or t
atcaattctatgacgcgctgctatcaaaattttttattactagaaaaaaaatgtatngcatagacttataattttttatgcattcatattaacacactatccttaaaaaatgagagataaacaaaatgaacagatagagaatacagagaaaaagatacacataatttttatctcaaaaatttctcttattttgacgaactatctaacaattttcatggaaaacaatattttagttcttctataaattttatttctccgacagatttttgttaaattttacgtacctatggagaaaattgttgcttttccgtttttttaaaaattcaaataaaaaaaatatatatttcaaccaaaggcgcgtggatgctaaaaaaaccgccaaacagttattttggaggcataaagcaacaattcatgtggggcgaggggagatcttaaactttccacccactaggatatccatttcctcagtttgaggacatattaaaagttttatgtttcttaattatggatcaaattagtccaaaaatttccgtatttttcgttttttgtttcgtacgaaaacagttcttttttcgtttccatgtttcgttttcgtccaacaaaaatttttcattatgttttagttttcgaaaattatttatttttcttttttttatcctcacaaaaaaaatcctcacaaaataggcaaaaaaaattatattaacgctttttctctgacaaacacataaaaatttaaaaaattataaatcttgtgaggttttttagtgcctattttctatttttagtgcctatttttgggttttttagagcctagagccgacctattttggcagtttttagagcctataaatcgaagccctaatttattacatttttcatcgtatttatttatttatttattttttttcaagttttcgtgtcaataaaaatctcattcaaaaacgttatgtacagcatcgactaagtatatttagattatatttaatatataaagcaaattggtttctcattaatagaatgctcattttgcagcatatgctttttttttgctaacttggggcgtgataataagcatgaaaagcgcatttctaacttggtttgaggcttctaagtccacttttttcatgctgattttgctgatttctcgattttttaatttttgtgctgatttggaatgttgtgcttttttttgctgattggcattgagcaattttttaaatattttcagcaattttcaaaaaatttattaacaaaaatgcaataaaaatgaaaaatacacccctaagaatcgatccgaaattttctgaaaaatacacccctaagaaatgaaaaattttatcaaataattcatctgcaaaatttattttttgacaagattttgattttttaaaattatgtatctcattaccatttttagcacctattttggaggttttttataatcagggagcaaataaatgttttttttgacgacttttttcaattttttggtgcctttaatctcttaatttttatgcttttttccaattttttgtgctgattttgcctttttggtgcttttttcatgcttattttgtaaaatgtggtgctgtttacagtgcttaatcggtgattttttgtgctaaaaactaaacactct

SEQ ID NO: 9896 - DNA, 918 bp, Heterodera glycines
tatattgaaagataggaattctaaataaatcccataaaattctcctaattttttgctatttttcaaactttattccactaaatttgaccaaaagcgaagagagttataaattttcgaaatttcactggattttccagggcccaaattgtgacgatttttcaaaaaattttaaacactttccaaaaaatctgaaacgcaaaataaagcgtatatacgtattcagcacctcaaattatgccataaaaatgcattttggctaatttaggagcaaaaaaatttttcatgaaatgcaaaaccatggggtcccccctatggttttgagtttcaaaatcacaattaatttaataactttttttaaactcatggtaaaaacatgagataaagcacattatattgggcttaaaattctctacaaaaaagctcttggacgatttttcgttaaaatcaacccctgacgagttattgcgccagaactgaaattgaggcctagcaaccaaaaattttctatttccaaaaaaatttttaaaaatttttctgaaaatgacaccaatcgatagagcatgaaaagggtgcacagttggctatggtgtgcatgcgtggtttggtaatatatggccctcatttgttattttaaaacatacaaaacattatcaattgagttctgttgctgtggggaaagcgcttcgcgctcagggacgcggcttcgccgcgtcgctagaaattgatgtaatttagcaattcatcgcagcctcaggacgggcgcttcgcgcccgtttttaattttttgggggatattcggccgcttcgcggcctcaggacgggcgcttcgcgcccgtttttaattttttgggggatattcggccgcttcgcggcctcaggacgggcgcttcgcgcccgttttttaattttttgggggac

SEQ ID NO: 9897 - DNA, 3245 bp, Heterodera glycines
tcggccgcttcgcggcctcaggaccgggcgcttcgcgcccgttaaaaaaaaattttttgcttgctttaaaaaagtttcaaaaaggcattttccgtatcaaatacccatattttttttagtcttaagatatattttgcaaattttgttacattaaattagcatccctaattattacttattttctttttcaatttaaatttaatgaaaaagtattaatcatatttatgaattgaaatcgaaatcttgttgcagaatccctgtcaaataaaatcagcgattcattgtcttttaaacagaaactgaaaccatcaaaattttgttctgttcaattaatagttttttcgagatacagtgaaaatgcaattatatttattaattcaaaataattttttttgaacttcaatttttgatggctaaattctcataattttcctatgtgatcaggacagatcaaaaagtgtttgattaatataatttcatatttatttttaaaacaaacaaaaatggcggttaagattacaaaatttagtttttattctttttttgttaatttacacaaaatattaagcaaaaatttgtatttttttaacaaatattaacagaaagcaattaaatgatcaagatcataaatcttttgttctgctgaaatggccttaaaatgagatttaaataatatttttacttgcttttaacatatatttttaaacgaacggagtgtaatgatcgattttttttttgcatttttatgactttttttgtgtttttatggcttgttacttcctgatgatttaaatttattactttcaatcctactaatgagttactgttttttttgctaaaatattatttaataacaattaattagtgcgattgtgagcagagcttcaaccacaaaaatcttgaaaatattaaaaattgaccaaaaacgaagagagttatgaattttcgaaattccgcttgatttttggaggcctaaaaattgacgatttttcaaaaatttttaaccaccttccaaaaagtctgaaacgcaaaataaagcgtatatacgtattcagcacctcaaattatgccataaaaatgcattttgttctgagctcttaaccatgtctaaagtaaaatatgtttgcatattcgtgatcagtggcccaaataacccctaaaatcatatttttggaagatttttggtgaaaaaaattttccactcaaaaatcatggtcacacccctgtggtcccaaattccaaaatcacttttatttctataacttttttcaaaaaagtgataaaaagctaaaataaaatttataaaatagagcaaaaaattgcggattttttgagtttattatttttataaaatactttttcagaagggagttaggaatttttttctgaaaaatcgaaaatttccagaatttctggaataacttttattgtttgcaagatagaaattccaaataaatctcataaaattctcccgatttttctatatttttaaagctttattacactaaaattgaccaaaaacgaagagagttatgaattttcgaaattccgcttgatttttggaggcctaaaaattgacgatttttcaaaaatttttaaccaccttccaaaaagtctgaaacgcaaaataaagcgtatatacgtattcagcacctcaaattatgccataaaaatgcattttggctaatttaggaacaaaaaaattttcatgaaatgcaaaaccatggggtcccccctatggttttgagtttcaaaatcacaattaattttataactttttttaaactcatggtaaaaacatgagattaagcacattagattgggcttaaaattctctacaaaaaagctcttagacgattttttgataaaatcaactcctgacaagttatagccacagaactgaaattgaggcctaccaaccaaaaattttctatttccaaaaaaattttgaaaattttttttgaaaatgccaccaatcgatagagcatgaaaaacggttgcttgaaagtggtctccgttttccccggaaaaatctgtaaaaaataataaaattaaaaaacggaaaattttcgagggggcctagctcgaaaatttctgacaatttctgaaatccaaaaacatggttggatagagctcgtcgagctgtacaaaaaagccgcttacaccgacctcctccggtcaaaccccggcgagttattcggccggcgctgaaatggccaaaaaagtatgcaatttttgcgcagtttttcggaaaaactggtaggccctacgaggtcggtgaagagcaaaaagttgtgccaaacctcccaacttgatttcctatcgaggccgatttttcatttaggactttaaaaaatttttgaatcccaaaaacagcaaaaaaaaatttaaaaaagccgtttcagcgccgctggcgctcagttggccctcggaccggaatgcctatagttttcctggatgcgccgtcaaaagttgcccccaaggtcgaaatcccgagtccctcccgccagcggttcccgagatttttgttttagcaatgagttcatctgtttctttagtagtatataaactagggtgcccagttggctatggtgtgcatgcgtggcttggtaatatatggccctcatttgttattttaaaacatacaaaacattatcaattgagttctgttgctgtggggaaagcgcttcgcgctcagggacgcggcttcgccgcgtcgctagaaattgatgtaatttagcaattcatcgcagcctcaggacgggcggggcgagttcgattgtgaaaattttggaaaaatgcctatctctttttctgctcaacactctagacaattccaaccccatttacggaatgatagcgccaaccctaatttttccggaatttctttctgggcgagtttgattttgaaaattttggaaaaacgcctatctctttttctgctcaacactctaaacaattccaaccccatttacggaatgatagcgccaaccctaatttttccggaatttctttctggtggagtttgattgtgaaaattttggaaaaacgcctatctctttttctgctcaacactctagacaattccaaccccatttacggagtaatagcgccaaccctaatttttccggaatttctttctgtgcgagcttgattgtgaaaattttggaaaaaacgcctatctctttttctgctcaacactctagaccattccaaccccatttacgcaaaaatagcgccaaccc

SEQ ID NO: 9898 - DNA, 2750 bp, Heterodera glycines
ctttctctctctctctctctcccttcctcttccccatttctctctctctctctttctctctctcactttttcctatttctctctcccctctttctctcctccctctctctctctctcttttctctcttctctctctcctctctttctttctctctctctctcttttctctctatctctctcctctctttctttctctctctctctctcctctctttctttctctctctctctctctcccttcctcttccccatttctctctctctctctttctctctctcactttttcctatttctctctccccctctgtctctcctccctctctctctctctttctctctctcactttttcccatttctctctcctccctctctctctctctctttctctctctcactttttcccatttctctctccccctctgtctctcctctgtctctcctccctctctctctctctcgctttctctctcacctccttccgtcgtttgatgtgttccttagaattaaaaggattttattctccattttattttatttccaatttttcttacttttcccagcactttcatcgcataaattttaccgtctccatggtaccgtaccatgtacactttcccaaaacttccctggccaaccgttttcaaataatcaaaattcgccggcttcactctaaaaaagccaaatttggttattcgtgatcattcgcacgttttcttttccgatggtcccaaaatcacgtggtcctcgtccgattgggtcaacaaaggaccgaaaagcgattggacatcacaactgaaatgtgaattgaagatttccccctcctttcctgatcaatcctaaatttcccctccttttctgatcggtcccttttctttccctcctcctttttcccacttttccgaatgattcgccaccaaatgcgtgaccaatgcttcggcccaattctttcgtttttccatcaatttttgttctggcacaaggaatttcttcttcggcatcttttcggttccctgaggcaacaaattgcgaaagtgttcaaagagttgttccaattccgtcaatgttttaagtaccgtacacccttctttcgtacggaactcgaaaatctgaaatgggttacgataatgaactaataatactgtaaggccattttcgccttaccgctgcgtttttctcggctccccccgaattcgtcggaccgatcacagcgcattcgatcagcggacgttcttcaatcatttttaaaagtttcgaattatttttcactgattttcttgggaatgttttcttatcaaaacaatttcaaataatttattaataaatgttaatccaaaataaaatattttattttctgaattctcttttccccttaaatttggggtcggggtcattttggcgcagacaagtttaaagattcataacttttttttaattcgaccaaataaaataatgttgatattaatcaataggtctaaatatgctttattagcctgcaaaatttcaaaaaattatattaggttttaaaaaaaatatggcgcgctgcgccaaaatggccaggaaaatgcaattttttgagattttttggccataacttttttgtttctcatctaaattttttgaaactttgcaggttaataggcactatcaagccacttaaaatcataccaagattatttaatgttgctgtgaaatcaaaatgatatagagtcttgcgccaaagtggccggttcccttaaatttggcctttgtccgcccagcgaaatgcaaaaattatttaatgtcataaacaaaatggcaaaatcataggataaaaaactgataaaaagtttttgttccttttttgttttgccggaagaattaattcaataaaataataatttattctcactaataaaaaattttcttatttttaaaatataatttcattttttattgggaattcgtttattttctcattgaaattagagaagaacaccattcattgatctgactgatgctttaattttattgtcaatttttgtttcgatggtcccattttggccttatcagttgccaattcgattctttgcattgctcggcactcactgcaaattcaaaaaacacggggaaatctttaggattttcaaaaatttagcattttttaattttgatcgatgaaaggaaattcgaaaatgaagaacaatcagttggacaaaacgtttattatgagaagcaagtagaacatctgatgagaaaatgttaaatgtgtgcacttttctctcttttttttggcactttccgttatttcttttgccttttcctttcgtttctccgccgcagcgaatgatcagccgaacagcgaattcagtgaagtgttttggtcgttcatgaagagcggacagtacgggtcattctcctcaaaaggggggtccaacgaaaggaaagaatcgcccgggggcgggaagaaaacgccgccggggcccacggaatttgaggagacggcgtcggggtgctgagaaaatgggaaattatgggaaaagcgaagcgaaggaaagcaccggctgagaattggcgaagagcaatttcaacggcgaaagcattctctgctgtttggagggcgaccgaagctcattcgacggaattttgggcccgcaaaagcctaaataaatgctcataaattgacatttcaagcaattaaaattgctttgtgtccccaaagagtcaatcgctttggtctcctccgtttccgcctaaaaacaatttttaaa

SEQ ID NO: 9899 - DNA, 1549 bp, Heterodera glycines
ctagtcccggtcaaaccaggaccttggtactcagttgtccgcttccaggtcccggtcccgtggcactctaccttaaacatttctctctataattgtcaattatttttatttttcgatacagtcgaaaattgaaaataaatgcaatttgacttttccgtctgccaactgaccaataaacggcgtccgtcgggtcctccttggaaagtttcagtgctgctgagagtgcgttggttagtgcgtccaattcgctttcgcttttcgcgagttcggcgttttctttgctcagcgattgaaaatcggaggagcacaaaaattcgtcatagtttctaccaattaaaataataagtgaaagcccggttggtttcgcatttcaatttttagtcaattaaagggcggctaaaatttcgtgtatttctacaaaaaattagccatttttgcaaaatggcgacaatgccatcattgctcacaattagtgttggctccaagaaaggtgcccaatctttgtttattaaataactaatttggaagacacgataaaaattgaagccgccaaaatggccaaaactttgtccccccccccccccgaaatttacttccatcgaatgctgtttttgccgaccttctcaatcaactcaattcctaaaaagagaaactttttggtatctctttccctttttaccttccaatacattcgttatgtcatataatcttcgcttttgaacccccagcaattgggcggcttcgttcaaattcaaaatctgaatgaatttgagggaacggagaaacgaagaaaattcgcaaattacccctccttttgtgtgcaattcgagaaaacgttgcgtcaaacgcaaaagcgaactgtcctggcgagaaggatcttctgaaattccttttttcgagtctttgattcggtgatttcgagtcgaaattgcgcccctccgttaccatccgacactctcccgcctctcatcggcgtgtcggcgtatcttttgctgctcgctgctccttccgatttgcttaaatgttccaacaccaatttccggcgacactaaaagcatttgcagttaaaaaccacaaaaaattaactttgaattgtggcgtttgaaagtttttctggtcggtctgaaggtgaacaaaagacggactgccgctttcattggccgcattttgtgaagggattggggaggaaaatgaatcgaacgaagcgaaggatgggtttggagggacggaagaggacgaagacggggaagaaaaggcaaattcagtgggacgaaagtccattcgcaatgatgaaaaatttaataacgaataagaattaaaaatgtaaaattatgtcaggtaattaacatgaagatcatgcacaaactttaggctcgattgcactttagactttttgattttttggacaaaaaaattaattaaattatccatgatgcgcaacgaagtcgaacctccgccgccctttgtccttttactatcttacaaaaaccacttcgccacaagtgcaaaagcttttttcttaaaggagctcatttttattgtaatttat

SEQ ID NO: 9900 - DNA, 4290 bp, Heterodera glycines
cctatcgcttccccgcgagcgctcgtctctccaattccttccttcctttcttttttgtcttcctctccgattcacccactaaattcccctcttttctcctctccttgctttcccattgtcaaactatttccctcccatttctctcccattctttcgttctttcccacatctctccgattgtcccactctttttcgctcgtctcatgcgctcccgttggctttccgctgttgtgttagcacgcgctcttccttcctcgtcctccttcctccactgctttcccggtgcacttactcattcctcctctcccctccctttctctctctcatttgtcccctctttcgtcatttgcttttgccccctcctcctccgctcctctcaccctccgtccccaatttccctaaccttttctccatcccatccattccccctcttacttagtgttgttggaggaggaagaggaggtttgctgctgcttctgctgctgctgctctccctccggggctggtggcttctttctttcttttctttcctctcccttttcgttcgcattcccccgacgccgccaagcggtggagagttttattccattcatttacatggcatgggcagcagcagcagcagcagtcaccgacctaccgcaccggtggtgttggtttatcaataaatagcatatatttcactcgtgtaaagtaatcattttcggcggggcttgcgacggcgacacaaacactttttggaggagtttagtcggtcggtcggccggcgaaccgtcgttgtcaatgctcagcgaatgcgtgttgtgaaatttgcgtgtgtttgttgcgccattgtttattatttgtttgcacaccgtaacaaaaaataataaatgaatgaaaagtgtatcgcacagcagcagcagcacacctatcactcactcttttctcatcactcaccgactgatttttttgtgatttttgcccattacgatgaaataaaatatatttggggacgacgacaaatcgatcaactgtaataatgcacacaatttaacatttggtccaacaaattggccattaatttgcttccaaattaatttatcatatttaaaatatttattaattacctacttattattgtttgtttttttaattacctaatttgctttatggctctctctctaatgagtgttgcatcgcctgctaattattgcataaattttaaaattcgaaagcgaatgggacgggtcgctttttaaattttttttagtgaattttactgtccttttgttttacgttaatattctcccccccctcccaatttttgatcctttcactatttcacacttcctcaattatgtattttatcaacaaaaaaggaggccgtcctcgtccctcgtacgcctcgcccttcccttcctttcgtcccctcccacacgccattttcatataaatttatctccctcatttgttaattttgtcgtccgttcgctgccttcctccgttcactgatcactgatcacccaccgccccatctatcgcttttatcctttttatcccccgcccaaaatatttatcaacatcattacttacttacttacttaagtatcattaaacacacacaacttttcatcatcataattcgctttttcctcttcttcttcttcttccatttccccattgattttctctctttttttgcttttcgctccgcaaaaattcgattaatttccctccaatccctccgcaggcgctgttttgtgtttgtgtaaatttctcagccagccaacaacgcacatcaccacacaaccaccaccaccacgagcagcatcatcatcacaacattttagtggaatttgtaactaaactaagagttcatcatcatcattatcctcccctttttttgctgtggctttttgtcaaacggagcaacaaattgaatttaattgcctctcattagcacagtgtgcccgaggggaaattgttgtgccatatcagtgaatgaatggccaatgaaaacaacaaaaataacaaagcccaaaaaacgactccgacccaacatttgtaagcttttcgccaatattagcaacaacggcagtccgtcgtctggtggtcaacggtgtcgtcgttaatgagcagtagcggcgggtcagcaacggccggcggcggtggggcggccaacgacggcggagtcgcgtcgctggaggattgctacacaaacatttttcacattgtcgggtttttaaattaaataattttaacgttttcaaaaaactcaatagtgctcatgagaatggttatttctaccataagttttcttcctatttattttttccacattttcccgtcagtgcttatcgctactggcggccaaaactggtaaacaacatggtacagtaatttccgaccagttttctcatattttcaccacataatttgcttcatggtccaataaagttttatttttagaacccaaaatgctaaaaaaaaattttaaaaaacttattttaacctatttggcgttctgcctattatactgatttggcttaattttgttgctttttggaatttttagcacctaaaatagcatccctactgataaatcagaaaacttaaaaatgataattctttacttgtaaatttacacgaattattttttaaataataataaaataattcttttttgcatttaagactgagttgaccggcttgaaatggtgctgtttggccaattcgtccgaccaaccgccgcatcaatcgcggcccgtttccgccgcggacagtgccgccggcgccgcttcgtctgccgccggtgcgccacggtccgacgcaaacgccgccgacggtgggaaatgggcaaaatcaaattcagaagcaaattagggttcgcaagtgcctttattttcaaaagtgcccttgtaaaattgacaaattttgtacaaaaatcggtgcaataaattcgaccaaaagttctccggcgctgaaatcctcaatccagaaaaaggtaagttatgctgtcacaccccaaaatttaaaaaaatgagaaaaatgcgcgtaaatttcatataattgttgagcgttaaaactttcgattttaaaaagtatattatacccagaggatttttaaaattttatttgttcctctctaattcacaaatttggatccttttgtttctattttgtaaaaaaacaggtgctgaattcataattattctaatccatttcatatactttttaggctccgttgatgaccccgttttgcgtgcgtacgcccaatgcgttgcggacggcgttctgtgcgcatggcggcgtcggcagcctccgagcgccgccgcggcgtacgaaagtccggtgccgaaggcaaacgcggccaaagaattatggctgttttggtactccgtcgacgagcccaaacacatcgagcagttcaaggcggaaggacttgcaggtttcattactttttttaaattggataaatgttttaccttttccattattttcccccaatttttccacaattcgtttgttcccttttcagtgctcgtccacagtgaaattgtcgacatggattcgccgcgtgttgagttcgaatacgaaacgcggactttgtttttcaaggcgttgaacaccgccattgaacgccgtcttttggccgaggtattttagtagaaaacaagatgtgtcgccgaatcgttgcagcaatttttttaattagaaaaaaaatcaagcaaataaatacaaaatctttaattaaaatcaagaaaataaatacaaaatctttacttaccaagtcttgaaaaaaaaatagtttttaaatttttttctagaaattcagcaaattttgttttcagtaacacctaagtttttttaaaaaacttaaaaaaaatttctaggattttttttttaattttttttctgcgacgttttgggggtgcccattacagtaatgcaaattacaacacttataaataggagcaacaataatttagttggcgtcacaaaaaattcaaaaatatctattaaaaaacccaccaaaattgctaaatccataaaaatgtcgaaaaatctgctctttcccccgcagggcttcgtccgtttcggccattggctgtgccgtccgttggagccgcgcggcggcgcactgtcgcgcgacgaccgacgcgccctcccgcgctttgtcaacgccgtccgtttccatttcttcctccaccgcgactcgctcgtctgcgcgtcgctgtgcgtgcagcgacagccgaccattctcagactgggcaatgcacagctgggtgaacagagccgggcacagcccgt

SEQ ID NO: 9901 - DNA, 2784 bp, Heterodera glycines
aagtttggaatttttttaattttcggggcggggtcattcatttcgctgtgcccatgtgcatttggtggggtgcacttcgttccccccgcccactcccgtcgttttacaactattcaaaatcatttctcaaccattttagccccttggtccatccgagccaagctggtcccgggccaacatgacctcctccgcctcgtcgcttcctctcgccccacttccaccggtgacgaattgggcggtggcccttccacttcttcacagccggaagaagtgccgtcgtcctcgtcgttttccgtcttcgctgatggcgcccagcagtcctccccattgaagaaggacaacacgggtcagtttagccttgcaattttaaattcaaattagatcattttataaatttgacaaaaatggaatatagcccccccccatcgaaaatttaagattactttaccttttttgtcctgaattttcatattttcaattttagctgacccggtgccgagcagttcaccatccgtaaaagagacggcggcggcatcgaaaaatggcgaaaatagctcaaggatggcaaaaatttcagccattttcgaccgccaatggacggaatggaagcgtctgtaccacagcctggccgacccaccgccgtccggccaagcccaaacgaccgactcagtgccacattcggcggcaccgtcgccacaaacgaacgcacaggcgacaacagcaaggagtacagcaacaacgacaaacgcatccgggctaacaggttcatcccagaaaagtgtggatttttaaggcattccctaaaaatgggactgtcccagccaaatcgtctttcatggctaattagtgcgcttaatgtttttgcatttaaggccggaacagcggcgggggggacggcgcatgggacgccgcgggtcaacaccaaaagcaacagcaagcgttgccacgacttgtgatggtcgaagtgaacgggcaccgaatgctgtacccgagccaattcgttgctgtgttggcggacgaattgttgccaatcgtacggcgggaaagggcaccgtcggaacaaacgacgaaagaggaggaggaacaggcggatggggaaacggaagcagcagctggtgggtggcaaaagccaggaaacagaacataatttcgccgacgaaattttaaaaaatttaaaacttagaaatttaaaaaaatcatagataattttttcatataaaatttcaaaaaaaaatcatagaaatttttcaagaacccttcaaattttttataaatttcaaaaacgttagatttttaaattttttccctaggcttacttttgaaaaaaaaattacggcggcgaaattttcgggtgcacctcaaaagccaagcggaaaacggttaaaaaaattggattgaattttaaatttttaggtttttgggctcacaatcagtcccccgaaagcaattgtatgggattgaaaatatacaattttaggcatgtccaattctgcttcaacatctacggattcctgtggccaaaccgtgccgaaaagtggccacaacaatgctttgccatcctcctcctccgtaacgcaacgaccgttgtttctgcaccgaatgcgtcgccgttcggccgcagcgattggccaatgcgcggcacggtgcagctttgaggacgcgcttttacgcgcgaggggcagcggcgtggcgacagctgtgaaaagagagctgcaacagcagcaacaacaacaatttcaaaatgtacaacaacaacaacacattacggggacaacaacagtacggacgctggacgagttcaactacgactacgcgaggcgcgagttttgctactgtcgcatttgtcatggtgggagacggaatggaggaggattgggttggggtgcaccccgaaatttcgccgaggcataatttcgtcgccgaattttttttaaatttttggctgctaaattatgtcctgttccttgttttgtgtcatcgggagcaacaaccaagcaaagcgggatatgaatgaatgctcagtccccgctttttcagccccgtcctcaaccgccactactccattagccaccacaaccgccgttgggttgaattcgccttcgtccaccgcttcgacaaccgttgtagcggccggcggcccgctgacaccaacggcagcaaccactgcaattgcggcgcctgccacagccgctacggtgttacactcgccatgcagctgtgctgctcaccctgcggcaccgttccatcatcggcacggcaacgatggcaattatgacccttattcgtccccagctacgcaacaatatattcaagccgttcatgacgaaccccaacatgcgcataaaacttcgtcctcctcactgaaaaaggctgtgccttcattggccactggaaaaagagcatcctccaaattcaatggcacaacaaaaagcggaactgacgatgccgcacataacacccatcagcagcactcttccagccaacagcagcagcagcagaacagatgggcacgtggttgcgcaacaaacgcggcaacttcgagcagttcaacaacgagtgccaccgaatggccaactgtgccggagtgggacctgctcaagacgggctccgtgttggcaaatcgaagaaaaacgcagcagcaattgcttgccctaagcaagacaaaagaggggggacaacaacatgaaattgctgcaacgacggggtaaggggaagagaaaacatggtacagaggccatctcaacccaaaaattatcaaaattcgaaattgagttaaattcaaac

SEQ ID NO: 9902 - DNA, 1464 bp, Heterodera glycines
tcattattattttcttatttgtgcctgctgaggtcctttttaaatcaaaagataaaaaattcatgtaaaatccatgccgggcgatcgtttaaaagtttctgtcccattacccctctcccccccccccacccgttaatccccccaattcaaccggatgtccattttgcccactctcaacgacggggaattgctaaagtaagtgaatccaaactctgtctctctgtacgatacacaacttgctcaaatgcattccaattattatgttttgctttcgtttctcttcataaaatgtctccgttttcaattaaaaattattttacgaaacggcgaaagaaaaaaaagagagaaggaaatgaggggggagcagctgtcaatgcaaattcctcgaatgattaactcttccgacgaacaaaaggaaaagcaacgaaaatcagtgacatttccttttttctcaagcaaaattaaaagaggatggatattcaaagctgtaaaacatttgtgaattttcaatcaaccgatcaaaaaattctctttctctcttcgcctcttccctcttccctcctcctcccttcctttttctcttcctcctcctaactttctttttctcttcatcttccttccttgctttttctcttcctcctcctaactttctttttctcttcatcttccttccttgctttttctcttcctcctcctcccttgctttttctcttcctcccctaccttcctttttctcttcctcttccttccttcttcctctcttgctcttcttcctcctccccccttcatcctctattcctttttctctctcttcctcttcctccttctcccttcttcctctctctctttctttctctcttcctcctcctcccttcttcctcccttcccttttctcttcctcctccccccttcatcctctcttcctttttctctctctttcttttctatattaattttccttctcaatcgtatcaattttctacgctttctttgtagccatgacaagacttgatcctaagcaaagaaagggaggtaagctgacggcggcggggggacgcattgacaaggataacacggggagggggtgggggagttgggggatatgtaaaattccctcttttatccgtcgcttttccatcaccgactcatctttccatccactgcttctctttgcccattttccatcagttaggccagtaaataagcatagcttcgtcaacagctgcctcacaatcacatttcttaaagccatttctgatcactttctttccctctctctccctctctgtccccttctctctctctctctctgtcattattgtcttttctctcgcatcgaccttttttatttcagatcaaaaattttccatgatcatgtaggctcgtccttcgtacatatgaatatttctgctcaatagcccccccccactcaaaattagcccaaataactttgggttctgcttg

SEQ ID NO: 9903 - DNA, 748 bp, Heterodera glycines
tccctccgtcacttcttcctcctctcccctccccttgtcccttcctcttcccccacttcttacccactctatccttctcttcctcctctcccctccccttgtcccttcctcttccccctcttcttacccactctctccttcctcctttctctctcgcagcttccttctctcctcgattgttttacgtatgaaatgtgcgcaagtttgaactgccttttccccgaattttcctctttttattcgtctgtctgtcctttagttgtccccacttccattggaatgattgaatgtatgaaaaaaatggaggggagaaggggaaaggagtaaaaatgggtagagaaaaggtaagaatgaggaaaagtaggaagaggaaaagaaagagaggaaaaagagagaaggggaagggagggaggaaaaggaaaaagagagaaggggaagggagggaggaaaaggaaaaagagagaaggggaagggagggaggaaaaggaaaaagagagaaggggaagggagggaggaaaaggaaaaagagagaaggggaagggagggaggaaaaggaaaaagagagaaggggaagggagggaggaaaaggaaaaagagagaaggggaagggagggaggggaagagaaagaaagaaaggaagagaagaagagcaacaaataaaaggaggatgatggatgataaagaaagaaagaaaaaggggtgaaacaggttgttgaggttgtgctgtgctgggaaaggggtgggactg

SEQ ID NO: 9904 - DNA, 1091 bp, Heterodera glycines
gatagttccacccctcccccttccccccccccacccccgagaattgcctgccaattccgctgtccctcccttacgctagtaataatcacccaaatatagtaaatcatttgaatagtgttttatttgtatctgaccaaaaaaggccattcgtcagcgaatgtttccatttgcgcttggttttgtcctctttttgggttgggcagcagtgaccgaacataaatatgggcaaaagcagaaatggctaataatactaattgccactgctgcccttggccattctctcctttcagaattcccttggccattctccgccgattgttctcccaaatcgaatcaacggaaaatttggtccgcaactgaaaaagtgacgcccatcagaataaaagagtgccagcggcagaggaggccgagcaaaaagcagcgacccaatcaaaaacaccagcaaagggtgggacagatcgaatggcaaacattaaaaaaaaaagccgggattcggaatggaattaggctaaataggtttactgagattcaggtcccgatcgatttgtcaggatttgaatcccaacgggattcaaatccaaatttgtcgggtctctccgatctcggatgtaattttaaggtcgggatttaggattttgccagtaactgaaaattcaagcaaaattttctaaaatggctaactgaaactgaatctctagtacgattgcaggaaaaaagtctttatgccaaaaaaaccgcaataaatgcactaataaatacccaaaaactgcctcgataaatttcgccatttttttcattccagccaaaatgtcggggtctcgatcccggccccctttttaaaaaaaagtcgggatcgggatcccggaaaaatcccaacgggatttcgatcccggccccctttttaaaaaaaagtcgggatcgggatcccggaaaaatcccaacgggatttcgatcccggccccctttttaaaaaaaagtcgggatcgggatcccggaaaaatcccaacgggatttcgatcccggccgggctctagttatttgttcttccccggctgaacccggttaatgaatgtgattagttagtgtttctg

SEQ ID NO: 9905 - DNA, 1129 bp, Heterodera glycines
agaagtgggaactaacccagctcaatttaaaatgatgatttaattttaaattaatataagtttcatcttgccatgaattatttaaatataatatttctattccatttccaatgatcttatgtcgctttgggccttgaaaaagctctcccttttgtctgcattttatattttggtttcttatatttagcaaatgtccattaaaaattatgaattgcgattaagcaaaaatgcagatgagcagtcggaagcattttattgttatttgaagtcagtgattgaagaacggagcaaatgtaggcaaactgtcattatcggattttcaggtgtttgaattcattaccatttgagtgtcttttcgaatttgtcctcatttttccaaaggtggttcgatgcctgcctttttggctcaacagctcgtccgtctctccgaccaaaccatcgcaggtcttcgcctttttccggtagacgaacggcacgtctcagtgaacagcgaggaaagcaacgcgggaacactgcttcgcctgttaccggacaaattccgagaaaatgtgctctcgattcaaccagatgacagtggtaatcaggatggattctattttattttgtaaaaattttggtaatactggagaatctgggctccaccccaaaattttttttgtctgttatgaaaagttcaaccctggggttttcggggcttctgatcacgaatctgatatcagatttgcaaaaatcatagattttgaaaatcatagattttcgaaattgatcaattttttaaattaattattgactgggtaataaagatgatgaatttcttcggttccaaattagaattttggaggaacgagccatgacgtaaagcgcgcttggtgttgcaccttcccccaggcgggcggcgccgttggcagcgccaaacaatgccatcgccagtgctttgcctgcgactttcattcatttgttggttgcaagatgggcaaaacggctgcattgagcgtaaaattccgcgatggtggagaaattcgatggcagattcgttggagcgggtcaattcaaggatttcaaaaatatccatttttaattcagcgtgctctttttcgagtgagactatatacatatgagcagcacaatt

SEQ ID NO: 9906 - DNA, 2772 bp, Heterodera glycines
acctaaaccatacatatattaaaccgatggaattggaatacaggaagagtcccgttttgggtcgcgctcattgacgactcaccaaaacctccgcctcgacgcatcacaattacaattcccctgttaaacgccgccgcaaatttagccttcatcgccaacggggcatcaaaggctgctgttttaaaggtatctctggacagaaaataaatgaattttaaaaatattagaaaattcttgtggataatgataaaacatatccgccatgcctcatccgcccaaatcgaccaattcaatggtttttggatgaagaagcggtcaaagaaatggcagctgcaatgaacgtggcatgaaacagcggaccaattaaatagaacatccatttgtgactttaaaataataaatgttcaacggtagtttaaatataactctttggttttatgaagaacaaattcaagttctggcttttgttgtttctcattttgttccttaaaatttatcatatctaagagagaagaaacgatgagtgagatgaatatcaattcttcgtctctaaggtgaaaatctttttaacatttggtggggacaatgttcgatttaaaattatgacttttactttcattaagttcttctatgctcgtccgcgacctcactctcaaaccggacgtatcaaaaccacgctgggatcagtcgacttatcaaggccgggcgcgacactttttcggtaatttggtctttaaacttggattctttctttcccacagtattttctgcaaattattctccctttagctgtgttgaatcctcttaatttgtttacctccaatcaaggattggaagaaagtcgcaacattgtcttagattatcggtgttttatcattttgcattctatatccctatactattttagaaaaggcattttttccccagaattaacagttgagcgtctatggaaggccaaacatctgtatggtaatttatttatgtattttctttataggactttaggattactgaagattatcatgcattctttcagaatcagcttatcatccgatgtctgaccaaaaaatgttgccttttggtcgaatgtgcgcccaagtgccatgcaatatggttttgatcggtggcatgctcagtttttataagtaaatctacaaaaaacaaaaaaaaattaaattaatttttcaggtctccgttggccgtcgttttttggcaatggaccaaccaatcattcaacgccgtcgtcaattacaccaatcggtctggtgactctgtgagcactgaccaattgctgaaggcatacgcatgcgcaacgggtaagtctgaattttaaagtggatataaatttaaaatttacctgcttttaaggcggggcattaaccgcggctttgggattgaatgccgcggccaaagtgtgaccttttcagtgcaccacaattgccaatttcacaacaatcgcttagaaaatgccgccacttttcggtcgtctcgttccttttgctgctgttagtgttgcgaacacaataaatgttccgatgatgcgacgaaagttggtcttgacagttgcaccatttttttaattcttttaagggaatttactgacggaatccaattagttgatgagcgcggcgttcccctcgcaaagagtcaaacggtggcatggcacgcggttgcgcaagtggtggtcagccgagtgctcatggcaactccgtacatgggtgtgtaagggcaagttgatgagggcgcggggacgcccctccaaaatgacatttcgaattggcatttattttctattggtgccccacttggctgttcagtgctcactcccctcgccgtcaatcagttaacaaaaaagaaatggttcaccatacgcccgtgggtttccccagccttccaaatgcttttttgtggtctcatcattttcttctcgacgccgctttgttgtgcgattttcccacagcttagccatataaaagtaatgcctaactggtgatttattcttgatattcctctctctcttcttcactttagacatcggacttggaacctgaagtgcgcgaaaagatcctcaaagaatacgatccccgtgaatatgtgtattataacaaagggctttaggtagttagttatacagaaaacatatcaattatttaatttttctgcttaagcttttcacttcttacaatttttgaagtttgttagtcatggatttctaataaatttattcttcgtatcgagtccgaccctccaagtttgagatacaaaacttattttttattaatcagtgttcttcgtctctttattttaatgggagaaatggcaagaaaatatggcaagtaacgacgatggcaaacagctaaagatggaggaaaactaaggaaatcaagaggatggtgaaaataagaatttatggcagcgagacggcaaaaatggcaatactaagaataggaggcaagaaataaaaatgtgaaccgaaaatgaataaatgagccttgtcaatttgcagattgtcggtacgttctcttaatattttacgccgcttaatacgctattggtttttcgtagggcttcgaatccgatcttttgagctgaactttcagccgtttggcgccaatttggaaaccattcattcctaaaatttgggaactgtattatctgaaaagcaggtgtacatttaccagaaattgcattttgagcggaagattcatcggaaaaactaacaaaacctaaacggactcatagcaaatactcaaaatattttaaagttaccaa

SEQ ID NO: 9907 - DNA, 1823 bp, Heterodera glycines
atttccagcaaagtccactccaaatctgacaatgagcacaccccccccccctccgccttccctgcttacaaatctgtgtcggcaaagtcttgtggcaaatggtagatgaacaaattgcacccgtccggtccccggttgtatttgtcgatgggatatgaaggatttgccggcgtcatccttgaaacaattgagcaagaaggcgaaataattggcaaattcggtggagtcgttggcagcacagaatgaattgcactgggcacagagagattcagcgcagagtgaccgagtggtgaggctgaatttaattaacccaaccgtagacaattttagggggggggggaaacgaaacttgggaaaaacaaaaagaattggcaaaaacattcccaaatcagacatggccaacccttttatcgggttcattgtgtgggaagctcatccccctaagttttggatgtcattttcgttacctccgaccgcggactgttggaggagcaatccctgtgacaggccgagcagtgcgccctgattcaaattcggtgggagcagcgtgggcattttgaaaagattctgttgacgattttggtccattttgagtagtaaatctaagaaaatggaagacaaaaagacggacggaccaatatttaattgagaattaccagcggacgaagtcacattctgtgccgattgtatgacacgtgctgaaaatggaaatcaaaatattttcttttttgcgattatgtttttttttgttccgtaccggcctcaagcagagaaatgacatttggctgctgaagtaaagtgaccaaattggccaatgtttcggtgcctgaggcagtgagcaattgcgaattctgcaaaatgttttagaatccttcataatgaaatcaaagccaggcgagcacctgattattactggtcggtttcccaccgttcggcttcggaccctcttcatttttgacatctggagctttttttgcgtttttttctcgacaggaatcggcgaatttgacgaccaacggtttggaacagccctaaggaattgaacaaaggaatcatttctaaaacaagcccagcaaaacttaaataattgcaaaaattataaattgaaaaagtgcagaaaacggacaaagaaaaattgaaaggccaacagaaaagggaggggacgaaaatacctcgaaaatctgcgaatggtgcatttttcgaatcgcttgttgggcacaggaacgagaaaccaaagtcaaaaaagcacagcctgaacgagacgagcacaaattattacgaaccgaacagaaaaagcggaaaagtcctccaccaaccacagaaatataagccatttacaatgataaaaataaaatgggaaaagcgcgacagatttcgcttcatttagcgtttttgggtaagccgtgaaaagtaaaacataaatccgcgaggcacaaatgggctaaaaagaggcacaaatgacagtgacgacggataaggaaaagtcaatgcgaatttgggccgttaccattcgccacctttgcttttgccgtcctctcgcagaatgctgcagtcctccacctgcccaaactctttgaacagcgcccggacgctctcttcgtccattgacttgggaagcattccaatgaaaagtttgcgctctaaacttttgcatggactccgtcaaggccaataaatagaattttcaagaaaaaagagtaaatttaaaaaaaaattactgtttcattaacaaatcacatccaaaaaaaactgctataaataatgcttttatctccctggagaaggaagttttgaaaaatgacaaaaaaatttggttcgaagaa

SEQ ID NO: 9908 - DNA, 2785 bp, Heterodera glycines
  misc_feature (2777)..(2778): n is a, c, g, or t
tttctatttatattaaaaatgcacttttgtcattttgataaataattagccatacaaaaataattaagcctaatacaccttataaaagccctcccccctcctccttgcgtctcgggccaacatttgttcccattaagtgacgagaataggccacgccccgtgccctcctcctcttcccctccttctgttgggcggcaaatccctttaaaagccgtcgcttttcacagtcttacaaatacattccattctaagtgcacacattcatccaccccatttaaaagcaatttcaaacctaagctttcttttaaagcattgttaaaattccttaaatacctcaactgcacgcagtacagcagcgacatcaaacagaacaagcagtacaagcaccatggcatatctcagctggacgacgacgacgttgaagacaacgacaatgctgctcaacctgacacttttttgccagtgcgttcattcgttggtcatccatccgcgactctgttcaacttcggctgcggttgctgcacgacaaattggagcagggccagaaagaactgctgttgaagacgaacaactgcaacatttgcttgacatcagcaatagccgaaatagtaacaccaaaaggatgcgctggtacggagcagaagccaagcaaatgctcaggtgagggcagcttttaggggaaggcaatgtgccattcatgagggcaccgaatatgccgatattgaggacggagattgtgccgttcattctttggggcagacaagatggccgtgccgtactcacatttggcataataccaaaataaacatttttaaacggccactgaaccaacctccccccgcccttcctcccacttgcttgaacaaagattttattattttttcaatttttttagacaccttgacgagatccggcttcgaacggagacggcacaacagcggaaggcggtggccaaggttggcaaagtgtcgttgctggataaactgttcgcgctgttcacggacaagccggacgacgaggggcccaagcatgactgcttcttctccgccttcaactgtccagtgaatccggcacggaacatcccgggcgttcgccgggtgcgcatcacggcggatgagcgtcagaaactgttggcggcaaaacaacgtgccgctacaatcggcagcagtggtggtggcatcaccgaacggcactggagaaggccacggcatcaccaccaccagtaaggttttgaaacagtgccattgaagccgaacggcacggcataaccatcgattctttgttcactcactcatcaatgctttctctgcttttgcttgccattaattttgttcaaatgtcaaacttttgctgatgacccaaagtctccccaatattttgtacaaaatgaaatgaaattttattgtttgctttgcatttgtatgttattatattatatatttttcgtttctcaaaaaataaaaatatttaaatttaattttttttaataattaaaatgtgaatattaaacttatttgaagattttccttcactaacatattagtgtgattgcactcggagttaaagccagacactcttatttcatacttgatttcaaaatgtaaattcacatattagaattcattagctatgaaacaaaaatgcttaaaggccatcctaattagtgtcaacatttaaaaagccctggtttaattcagtcagtgtaaggggagtgaatttctttttccaatttggccattgtaagtagggaagtgcgaaagtctcggttctcgattccggctcgagaatctcgggattttcgcttcttggtctcgatctcgtttctcggggtcatttcttggtctcggttctcggtaacaatcacttattgcagacacattttttcaatttggccattgtcagctaaaaatggttttaattttaattacttacatttaggtttaagaacaaaaattaagtttaaaattgctccgtttttcttttttactataagccaaagacttcacaacgacaccagcctaatttaaacgattcttcataaattgataatttgcaggtttatttttttatttaattttaaatttattgaatcaaaaaactctcgcttttatgttttaacacgtctaaaagtttgggaaaacttgaaaagacaaaaaaatgccaccattttgtcttgtttataaagagcacgaccccaataaaacgccaatttaaaaacaaatttcaatttcaactttacaaatttggtttcccattttttgtagtcttacgataccactttgttgtgttttgttaggcttgcttggccttttgcacacttccgccgggggcgcacctttactcatcttccggcgccgccatttccttacactttggtggattatggcagcaatttgcttcaccaaatgcacccctctcctccccattaataaatagcaaaatgttttgctaatgccatttcttcttgctaagtgtttacattttgggcatccctcaaaaagttttgcagcaattttgtgacaaatccgcttaaaactgggtaaagttttttattttgtataattaaagaaacctaattgcagcataaataaaacactgaaatagcgccaatgtggcaaatccaattttttggacagcaattatagattttgccgtcatttccgtgccaataaaaatattagaatcaaaagcctgaaactcgtacaagatcttggtctcttggctcggtcagtcactatttttgatttataatatttgttttccatatcccttacagnnacctgca

SEQ ID NO: 9909 - DNA, 1658 bp, Heterodera glycines
  misc_feature (59)..(59): n is a, c, g, or t
  misc_feature (80)..(80): n is a, c, g, or t
aattcagaaacaaactgcagaaacgtcataatccgcagagagcagacaaagaatgtgcncactcttacggtaggcaattntagttgtacgatatttattggcatgtcaagcggctcgaagaatatttgagaaaactaaaaactgttaaaaaattattgtaaaatgcttgtgggccaatttattagattaaaaaaagttttaaatccgttaccgtaatgaactttttgtttggatcgtaatcgggactactactataataaaaataattattattatggcaatcaacagtttgttgaacaaagtgtcagcctattttttgactttaaaatggcctaattcaggaaaattgccaactctttaaaaaacagttccttttacaaaaatggcacattaagaataaaataataaaaaggtcggcggtcggtgcccgccccaactttaagcttaaatctttctaatttatgataaaaatatttttattttaaataaaaattactgccgtacttaaatagacaaaaaaaaaatttaattttaaattccatagctttgcctcaattccatcagtttaagaaaataaatacggaagaaaagtcattcatttgtcagacataatttaacattatgaaaaaaataaggaatctcgacaatttgtatatttgtaatacaggataagtcctttatggcaaaacattcatcaattattacgagaagcaaaatgaattgaaaaagaagaaaacgaaagtggatattgagtaatggtgataaatgtgattggattaacaagataacaccgctttgactgttagcagaaggctcccagccgattgaaatcctgaaaaaaatatcgaatattttaacataactccatatgaaatttatttttctctttccaaactttcaaattctaacaacactagtattgatggaattcccaatatttttttgaaaaattgtaaagaaaatttagtccgacctcttttccatatttttagtttctcattgatgactgccaaaattccagaaatatggaaaaagtcaattatttgccctgtcccaaaaattcaaaatccggtaaacccagtcgactttcgtccgatttccctgctatgttctgtttccaaaattttggaagaaaatatagcaggaaaaataaaaaattttgttgaaaaaaataatttgttaccaaattgtcaacatggttttcgtaaagcacattctgttaccactcaacttcttgaagtggtggatgatttcagttttgctttagaaaatagaaaatcaattgatgtaatttattttgatttagctaaagcattcgacacggttccacataaccggctaatatctaagctccaaaacattggtataaataattccttattaaaatggattcagaattacttagaaaaccgaaagtttttcgtcaaaatcgggtcttatttctctgacgaatatccctgtctcagtggtgttccgcaaggctcaatattgggaccactgttatttcttatttacatttacgatttaccaaaattctgcgaaactgaaaatgttaaaattaaacggtgctgggacgttagtcaaaaaccatcaaatgaataatttttgacagaaaattattcataattttgtctaaaatggatcaaattttataatat

SEQ ID NO: 9910 - DNA, 1331 bp, Heterodera glycines
  misc_feature (1310)..(1310): n is a, c, g, or t
taaaggaaagcgcgctctccctcgcctcaaatccctgcagcaccagtgccatccgagccaaaccgcagcaaatccggggacaaacagaagtccaaaacgaagccacagcaaagccacaaaggacatttccagccgaataattcaacggcaattaaaaaggaagtggacctgcctgatcagccctgccattcatgcggaggcaaaaatcattggcaaaaagtgttggataagggaccacaccgattattgattatattttccctttcactccctctcttattgtctctctcccgccccttgaccagccccataaatatgtctccctttccctcactcgaggcattctcccattcattccaccatttcattattttatttatttattccctgctgtcctccatatttattgtttaataaattatttatttatttattggacaacatttgctttggttaaaaaccaaacatttttattgttgtagtaaatacacaacagcaatgaagaaaggggcttaaaaatagcatttctatgttaaaattttttgatttggtgaaagtttttagtccatataaatccatatttttggggtttttgtgaataaatccttcggcattttgccgttttgagtccatatttcgggtatttttgacaaattttcataagaaaaactcaaaaaagtgaaaatacatccccaaagatgggctttttggaaatttttaaaaatacacctgccaaaaaagggaattttcgaacttttggtaaattatttaagtattttgttagcttccgaaaatattcgctgacaacagaatgagattattaccaaaatcgattttttggtagtcttttagttttaagtttctttaagaattattgaacatacacacattttttgcaattttgagtgttaaaccttttttggcattttttgtccgtttttatgtccatatttggtgttcttaatccatataatttacctagtaatgagctttcttatttaaaaataagcccttttttaactcaaatttagtgaattcacgacaagtcagaaatgccgcaacattaataattttggtccaaaatttttgataatcagcgatattggcaatggttcactgcagaacggttccgaatcattggcgcaaattattttgtggaaatggtctcatggaacacagatcattcgaaaagtagtaaattgatttattttttactaattgattatagtgtttttttttggagttcggaatttggaattggtcggagccgggattaacgggttcaaatcccgattctgctgggaaatatntttctgaagtcccagactcaa

SEQ ID NO: 9911 - DNA, 2357 bp, Heterodera glycines
ccgccccctttggcgccggccttttcggcgcggttattaacacttttttttatatcaaccaaatttaaaatatttttgttaatattcgatagctcttgagattctctattagattgcaaaatttcaaaaaatttagtcagtttacaaaaaagttatggccaaaaaacctcaaaaattgactttttcttggctttttcggcgccacgtggcataacttttttatttttgaatcattcatttctatttttacatgtaaatatagagcgcacatagagctttcaaatgatgccagattggctaaagctaactgacaaataaaaaagttatagcatttcaaaatttgcggcgccgaaatggtccgcgccgaagtgaccccgacccatatcatgcaaattgaatttggtttttaaattcattaaaatttaatttcgccaattattaaaaccttattaaatggtaaaaccagggtcaacatttcgggatcaggattacgacctcaattttccggggtcttgattcgggatttaggaatcggacagcgacggggttacctgaacataaattctggtgaattaaaatctcgaattttacgggatcagaatccccggaaatcccttcctatcacatcaattcttttctaaattattcaccatagacctttatgctgaggaaaggaggaaaaattggggcagaaggtgaaacaaatttgccagtttctcttgtaatcagatttctcaaaaaacgcggagtaatcgaaaagtaagacagggttacccttgaaaatttcccgaaataagaacatcgctggtcaaaaataagattttagggtcaaaaataagacattttttaaaacacgcttccaaaactttaaatgcatttttattcaacaaaaccaagcattagcaacatatttctcgccgccaacttttttttctgagcaattccgacttagaaatgagaaatttatacatttccgaaaatcgattttaacaagtttgtggaaaacatacctaagcaatttgtaaatttcagtgcattcagagtcaaaaaatcagatttttaacaatttttttcggcgcatttttccgtaaaattttttgggtatgggtgagggaagagagtccggcggtgccgataggcgccgccggaaattttttaaacttgatctgtttcttagcaaactgtacccaaaaaatgaccaaatttctatatgaaaacaatatgcaagtctgaaattttcaattatccagtgtaaattattcacgcacacctctaataggcgccgccggaaaattttttgtaatttttaatacgatttctcaactagtttgttcaaaaaatgacaaaattttacgattttgagccaattttttaagagaataagaatttttaaggggcggcgaaaatccaggtccaggccgagctctagatggaagtgtaccgccgagagaaaaatttgaatatttaactgaatcttgttaagattttgcatattaattctcttcaaaagacatttctttcaaaaattatcattccctatataacagggctgggaccgcgccgcgatgtgcgaaccgcgattcgcggcgttttttttttgcacgatccgcggtcgcggcaatttgaatgcgcgatgcgtggccgcggtttttttctgtgcgcgcccccccccccccccctgctatataagggaaatctagggtctgagtgtgagtttttttaataactcttcagggtttgctcggatcggctccaaacaaacgagcacaactattttttaaggattctctatcgattggtgatgagtagggtcgcaacttttagtgatttaattattttttgctcgattgttttgaagaaaggagctcataaaacgcatttctgtgttgaaatttttcgattctgatgtcactttcggtcactagaaaacactattttggcgcttcgtcactaaaatagtgaaaattcactattttggcgttttgtcactattttttcactatttcgacattttttgaaaaattccttaacaaaaatgcaataaaacccaaaaatacacccctaagaatagactcaaaaatattaaaaaatacaaccaaaaaatgaaaaaaatttttcgaaaattcatcctcaaaatttttttcttgacaaaattttttgatttaaaaaatgccaatatttgctaagaaattattagaaagtaaatgcacctcatttgcaacagcaatcagtgaataattttttttttttgctcaatttttggctaaaattatgtcactattcgtcactatttcggacttttttcgttattttgtcactattttggcaattttactcactattttagttaactattt

SEQ ID NO: 9912 - DNA, 3966 bp, Heterodera glycines
  misc_feature (35)..(35): n is a, c, g, or t
  misc_feature (38)..(38): n is a, c, g, or t
aaaattagtgatgaaaattggagttaaaggaaaanaanttagaaattatcataaatatattctttcaaagtaacactgccaagtgtgcgaatggcctaattgctactctccttgacatttccttcttctttcccctggttcaatccctctacagaaattaaaatattttgaaaattttcttttttttttaaatttccccgctaggtccgggaccaacaagaatagggtcagggtcaaattgttaaccaaatgcatgagtgggttcaattcccacccgaggcttaacattttgcctatttcttattgtatttttagtacagtaaaagcatttttataaaattattttgaaagaaaaaatataaaaatttttcagtaccgggttttaccgggtacccagagccggtttaaaatttggcccgttttcagaacccggcgacaaagggtactgtaggggctaccagaaaaaaaagatgggtgcctattgtaaacattttccactgacgatcaaattcaatggcggggagttggaagctttttgcgccacaactgatcaaagtaaaaatttcatggctgatgcatacgccttagggctcagacgcgtacgctcactcccttaaaacagcttgtgtaacaatttaatcaattaatgtaatatcaaatttcgttttttttgcctcctatgatcatttaaaatagagttgagcgggaccgggacctggacacggacaactgagtaccaaggtcccggttttgaccagttttgaccgggaccgggaaattcccggcttttttcccggttttcctagccaaaaagtcccggtcccgttcttgcccaaatttcccggtcccgctcaactctaattttaaacaattttggtgaggaaataagcaaatcgtacatttaaattagagaccggacgggatcgggatcccgcgggatttcttcgggatcccgcgggatttcttcgggatcccgacctcgggatccgtcccgagcgattttttaaattcatcgggattgattgggatcgggatttcatcgggatcccgaacctggatccctcccgaccattttaccaatcccgcgggatcccgcgggattgaagtcacgataatttttcaaaaaatctccattttttaaattaagatcttgaattttaaattaaaaaatattgtcatttgctaatttttcttaaaaaatcccttaaaaatcccaaaaaattttacaggtctccaaaattccactaaaattttcaaaatttgacgcaaaagttggccattttgtgacttttatttcttcataaaaagaattattttttttaatttctaaaacattagtctaaatcttattaggtagttttatggcacaacgatttctaagaattttgtccaataatcagaataaaaattgttgtctacgcatttttccttcggtgccaatcggacatcaccagacccaagaacccattattttcttataaattagttcaaaatcacaaaatatggacagtttttgtataaattctgttaacaaattacatttcaaattttcaaaattttcccggcggcgcctatcggcaccgccgacctcccccccggttcccctaaagtttttgaaaaaatttgcagcaaaaaaaaatcttaaaaatctgattttttgattccgtttctcaaaattattaaaaatgatcatttgaggcgaaaatacaaaaattgatattaatttattaaaggctatgttgttaaatgttctcatttttgaaaatctgattttttaggcatgatattccaattttgaaaaacttctataaaaatctgatataattcacatcccttttttttcttcaatcgaattgatcaattataaatattagataaacatttgaacaaaacttggcacaaaatgtaaaaaaaaattgcgttagagcaaatcccgataagcccgcgggatcccgaaaaaaaatcttcggggttgatcgggattcggtcgggatcccgacccgggatccgtcccgatcgtttttccaaaatgttcgagattgatcgggatcgggattcagtcgggattcagtcgggatccagactcgggatccctccgaccccagttgtccggtctctaatttgccctatgcccaaaaattcattaatcatttttttgagtatcaacaactcattaaagattaggtaagtaccgggtgtaatcacttcctgtcacttatttaatgctgattatgctaaacatgaatttgaaccaatttttggtataggcgcaaatgtctgcacacggaaagatggcatcggacaattaggaaattgtaattatacacgaccattagagttagcagttttttagccttagtcattttttttattcattttcgtatataatctaaaaatttttcttcggtttggtttcttcaaattccacttcgatttaaattttggaatttattttcggcttttcaatttcagcaaatttttgcgcctcttctcgacatttgcactttgtcctcatcatcaaacacaacgacccaacaacaacaattctctgagaatgctttgcgtcgtaagcttcaactttgtgccaattgtcttgccgatttgctgcacacttggcctggctttttcgttgggttttcggtggacaattttcggcacagcacgtgccaaaggtgagaagtgaaagaggaggattttatgaatttttatttgcccaaattttggaattattttagttttttaattaaaaatcttatattttttagtgttattgctttcctcaaaaacccttcttatttggcgcagcagcacgagaagaaattgctgggggttgagctgttcagccgaatgctttgccttccgtacgcaaacaaagaattggccacatgggacgaagcgatgcgattttatggtcgaacgcaatttggaaaattaattgctaatttaattactattttgatagaaagagctcatggccccgaccctttccaaatttcgctcagtgaacattttgttttggccgaactcccattcattcgcccattaataaaagtaaagaactcgtgaaaaacaattaaatctgtataaataaataaattatttcacaaaaccttcatttccgtttttaacgacatgatttatgggataattaggaaaaactcggaattcagcaaatatcaggaaaaccctcaaaacccggatttgaggacccagaaaaacctggccggagtccgctgaggcgaaaacggccaagagacaaatattacaaatgcctttaattgtttcactttcacaattaagaccgaaaaggcggacctgttcatcatttgccaatctgtccatgtctttgcgctttttcattcgggtcttcccgaggcaaagttttttttttctaattttttctttaattagagacccgtaaaaaatatgcgcaagccgggacgggagtccaaaacttttccgcgagcattgccgggattcccgaaaaatccggtcaattttgaacggaagtcctggtgtgagcaggaataattcaaaaattaatgaaactaaaaacaaaaatatgaaatagaactgagattaaaaaattttaatccgaaataatttctagctttttaggtccaattttaatctaaaaattagagatttgtgaacatccaccgttttgcgccaaaaatatgcaatttataaattttaaggctaaaaattaccatttcttgtaattttgtaccaaatcaaaaataagcacaaatcacagctcgatggtcaataatttaatggaagaaaaaatataaaaatataagccgaaatttagtggtatttctaaaatatttttgtggaaggaatcgaaaattttgtcagattttcacttaaaaataattaacataaaaattcgattcaacccagtgcatttttacttctacatttgatgagaaaatttgacgcagcgggattgcgaaactttcc

SEQ ID NO: 9913 - DNA, 1853 bp, Heterodera glycines
  misc_feature (30)..(31): n is a, c, g, or t
aaaaaaacaattaaaacgacgcaaataacnnaaatggcaaagccatgagatcaattatgatgtttatgtttgtgtaatctgtgagttcttatttttgttcctgtaatcatcaaatgttgaacactttattcaaaatatttttttgagttttttattttagtttttcaaatttttttactgcccaaaaagaagagtttttgcgagagtctcgaatggattcggaattcgaccctaaatgatcttggggcaattctcattaccacccctccccccactttcgagaaaagattaacatttgacggaatttagggtgttgtcgttaaccccctcgacggatttccattaattttttttaattatcgcaatataaaattatttttggttttcaccgcttcttcttcccatttgctgtccatagcaatgtcaacgaattgcgtaggttggcaatatgtctttttttagcaaaaactttttttttgatcagcggaaagttcatcgtcgtcacaaaatgtccaatcaatcaatcaatcaaattttggcaaacgaacattacgccaaccatcctttttccacacaaaagtttctttccctttattttcttccttttgatcactttcacagtgtccttttgatcggcgtcaacagttgttatgatcatattatattacctttcctctaagagggccaaaagtcatttatttgtacaacgtcacactgacacggcggaaagcctaataaatccccagtaatcctgatcaaacaaatggattttctggtcttaaaactcgaactttataggtggcttaaatgctttaaatttttctggttggatttgcgatttccgattcccaaatttttttgtgcgtgcctcccacgcctatcaacgaaaagtataataacaaaacaaacaacaacaataataaatagttggacaaggaccattcccaaatctgtattttgtttatctttttcttttcatcaaaatgttaaagtaaaactcctaatttggtcttaaataggtcttaaatataacaaatttaaactttaaaaatatatttaaattaaattaacaaattcaaaatataactatttatatttgtttttttggcaattaagattttaaacactaatttcttagttttctaaatgtctaaatttaattatccaaattgattaaactttcgtttttttcaaaaaatttattttttacacaaattggcaattagggctttaattttgcataaatttaattttttttttccgccaacaatttgtctttctctatatttttgtatacaaactccttaattaacaaatgatgatggtgattgtcaatctgatcacacattgcgctgatgaacacatgtgcctataaaaagtcacattttgggcccaaattattccgtccgttttttcttccctttctgttagacaattttcttatcttttttattttttatattttattcattcattttcatataatccgatttaaatattttcacttcaacaattcttttttacccggaaccaaaatttgtacaaatttttgtttttattacgaatttctcaaccggtttttttgatatattgtctacgattaaattttccgattttcccaaatccttacacgacgagattggcattttgtttttaaagggcttatccgaattacgacgtcaaagaatcgccagactagcatctaatcactctttgtgctcttccgattatgtaatgttgatgatataaattgaatcattaaggaggagggcactatttcgaaacccttcccctggcctaattacccccccccccccctcacaatagggccaattacttaatacgaattacta

SEQ ID NO: 9914 - DNA, 2218 bp, Heterodera glycines
ctcacactctctctctctctcgctcgctctctctctctctcgctctctctctctctcgctctctctctctctctcgctttctttctctctctccctcctttcctttctctccctctttcgcactacttcctccctctcccttttccccaatgtttctcttttcgcttttctctcgccactcctcacttcctttactctctctcttcccagaaattttcccactcccccgaggcgcttttccatttttatcattggctttttgcctcctcattatacataaaatattataaattataatagttcgttttttttgcttgataagagtatcatctctcgatttttcgcagacaattcaaataaaaaatattaataattaaaaataatagataaaaatctttaagaaaattttatcgcaataattttctccaaaaacccaacggtcccaaaaagctttacaaaaatctcgacaaataaatctcgtttcctacaacaacacttaaaatacagaatcaaaatgagacttagcttatcacgttttgcctccaccgtggcaatgttcgccggagggcccatcgagcggccgttggcctattacaggtacataccacaattctcggcacattgaccaagaatggcatcgcgggaaatgaggcccatccatttttgtagactgacgggaccaaattctctaaggatccgtctaaaattcacaataaataaaaaagggctcacgaatgtcttcaatcaattttaataaatacatctgttgtgtccccgggtttaaggcttaagccatttcaaattaccttttttagagagaggaatttattgaaggaaaagcattaacaaaatatttatgtattctaaaccgggaataagtttgatcaacaacaacctcagagcattttgggtaggtcagtgcaattggttatttgggaaaggatcgatgcccaaaggcaaagaacagcactgaacagactgacccactgcatacatctcgcagcccccgagggggaaattgggaggacttatatactggcacaatgggggtggactctggatagaatgaggagtatgacggcataaacacaaagggaataagagaaatggatggcatatgcaacagaggtgaataggaagaaatggcacgataacattggaaatgagagggataggattggtttgggtgggatgaacggatggataagtttatgacggggtcggatcggggaaagtagggcaatttacattatgcacaaatatgaaatttaacagcggacacagcaacatctctggccattaattaattggtgcttttcagccagtttcggcccgcttcgctgaccatgcagcaatacttggactttggccgcaagggcagtgcgtttacctcctaccactttctgaagacggaactgctggtccgcatggcgaacattatgcaggagttcgacctgctgcccgccaaactgttgcagacgcccagcgcacgccatgtgggctcgtggtacaaacaaagtgagtgaatcattaccatttggcatggtacagtaatccctaatccagcgggtaaacctgttggtcaatctaatccacaatccgtgccaaatgtccgttggggcctgatcagaaattgtttgggcttagtaaccctaaacagcttttggtcgaagaaatataatctgatttacatgaacttcatattatcgaaaatgcctggtccgacgataattgtctgggctaataatagctaatcaatgctgattaaggaagattgacaataattatgttcggataagctaagcaaaatcgttttaaaatcgacttctgatcacttcatttttaaatatattattgacattgcaccgttcgttttcaaattgatcagcattttttattatccaaaaaactaattctgatcaaatccaccgaggatccatttcagaaaaaaacaaacattaccaagaaaagagttgtttgcatgatcttgtgattgtttggatcctgatctgctgatcagttctcccagccttgatcaaattgattaaattaacttcacccacatttcattcaggcttctctgaactgctccatttcgagggcctcgagcccagcgacatggtgttggacaagttcacaaccaattgcgcaccaattttgcatcgtccccacaccgtcgtggaaaacatggctgaggaactgctccaaatgaaagaaa

SEQ ID NO: 9915 - DNA, 2646 bp, Heterodera glycines
  misc_feature (21)..(21): n is a, c, g, or t
tttaaaatttaaattttgttntgtctattcgcttttcccgcccttttcacgtttctctccgagcaacacttttgcgtgtcgccaatgctcgacttgcgctgcttcaacacccgaattcccgaccagcaaattagcgtcccgctggttccgctccatttgtactacattgtattcgaattgttgaaggtgtgcagtcaatgcctgtactgaaatggcagggatgggaagggaccggcgggtgctgagaccttataaaataccatcatatccataacttttctcaaatccccattaacttttaatttttggtatctttcgatgccctagctgttctctattagtctgcaaaattttaaaaaattccgtcaattttgagcaatttatagccgaaagtacacaagaaacaggttttcaaacttttttgaccataactttttgaaacaacgaaattttttgaattttcaggctaataaaaaagacctagggctgtcaaatgataaatagaaaataaaaaataaaaataatttaataaaataaaatgaatctttttgtttagaattcgatgcgtgccaccattgagcatcaccatcgggtcaaaggctttgatgccgactcttccgatgatttggcagaagtgcgtgcctgcattgtgctcggcgcggaaaacctttcaattaaggcatgtgctttcgattttttggcactttatttttgtccgtttttattttcactctgaccactcacatttctcatctttctcagatcagtgatcgcggtggtggcgtgccgagtgccaagctggccaatctgttccattatctgtattcaactgcgccaaagccgtcacgcgatgactccaacacgccatttgtaggcaccaaccaatgaataaaaactctgatcacgctttcccgtcaataaatatctgatcatttttttttgccataggctggttacgggtacggtctgcccatttcacgcctttactcgcgctattttcttggcgatctgtcactgacttccatggacggttatgggacggatgcggtcatttcattgaaggtagataattcgatcaattagagttgtttaactgggaaattcgctcctctcttcctctcgagaatggcacgggaaattcgagtaaactcactttacaaacgacggcctttagtctcttttcgggatgcgccccaaaaaccttgaagttttcttatgaaaatatctgtttgaaaattttttttaacatacacggcgagattttttcccgtgccttcttttcgtcttttcggcactcatttaccagtgcaacaatcatttttggcacatcttttaaggccgtgccgtcccaggcctgtgagctgttgccggtgtacggcgcttcgtcacgtcgcttcatcacaatggcacgcgaggcgcccgactattgtttccagaagccgaccgcaatcacagcaccggcattggactctacgaccagtgccgacatttcagcagtgccagtgaaagcagtgaagccgaaattggtaccggaaacaacgacgactaagacgaaaagcataagcagcagcagcagtggaaaagccgaacgggtggccatatgagcgccagtctttcaccgcgaagacggggaccgactatgcactgacacttcagtacatactgcaacacaatgcactaacaaacaaacacattttccggatttccggaactatttacgatatttctaactcttttttgtgtatttaatatgcctatgtatggtaattagataaaaattacaaactttattctatgcgtttcaaaattagccgaaattatatgtgaattctaaaatgaaattttataacatcaaatccacgagggttttttggtaaataaattgttttcaaacatttatttaaaaaaaaacttttgttggtgagaaaaatgaaaattgagaagctcatgtacaacgctttttcctttcataattttcacacgccaacattttgttatttggcacgaatagaataaatacaattataaaacaatgcgctatgctggctgacgtcaccacttgcttttagttgggggtggcacggggtgtgggtgtttatttgctttacgtcgagaattaatgggacggcgcaagggacgccggggctctctctctctctctctctctctctcgctctctctctctctcctgctctctctcactctgtgactacggctatctcgctctcaatctgatcatggttctctcgctctttctctatctcgctctcactctaatcaccgctttctcgctctcactctgatcacggctctctcgctctttctctctctctctctgatcacgggactttgtctatcccgtgagttttatgaagctgatgaaaagcggggcagctgtttcttatgtcaacaacgaaaatgatgttatgaaaatttttcgacgacgatccgatcatttgcttttcgcgtcgtctcgagaaaaaaattgagggacaaaatggtcgacgattgagtgatcagaaagaagcagagcactgatcaccacacacctcccagtagcagctgcacgggcagcttttcatcgttattaaactttacaaatccaacaccaccacatcaaagcaaatagcgaacaaaacaaaagaa

SEQ ID NO: 9916 - DNA, 4823 bp, Heterodera glycines
  misc_feature (55)..(55): n is a, c, g, or t
tttttttttaaaccacccccccccccccccccctcccccaacgtcccaattttcnccgttcatcgcagtgggagggattccattcttccgccatcataaaatcgaaaagccccattcccccctccccccgtttttcgcctcctttttctttctctgccgttttgccgcgctaaattttaaacctttggcgtcagaagagcggcacaaaaaaatatatttgttgccaatttttgataaaccgaatttctaaccctgcaattgccaattgtttcttttaaaataatgccattatttcgacccgtcttaaaataagaaaaaaaacacaattcaatcaaagaattacatatgaaggcactttttaacttaaggtggcccaaattcttataaaaggaaaagaaaataaaaatgggcatcattctgacaagctttttttctttccaaacattgttctgtttggcactcctttttcgaaaaaaaacattttaaaaaggaggcaaaaagatatttccggtcgctgaacaaattgtgactttttaaaacaaaaatattttaaaaaggcgagaactacattaaaaaattctatgtgaagtgcgaatttcccattatttttgattttgattattttcttcaaaaacctttcattaatcaatttggtgacctttacagagatttttaaccacatattctattgaaatgcacgagttccatgcttacaacccggaccttccacaaattatcacttcttttaaaggtgttcaaatttattgccaatgatttaaaattttatcgtaattaatccctctttgtgctttcaggcaatcagaagctgatacttggcggctttcgctacaatatccaccacatcaaagagggcgtgaaaacgtggcgttgcgtttgtgccaaaaaattgaccggcacgcgcagttggtgcaaaggtgggacggataattagtttagttattactggggaccagcagcagtcagtagaacaggaccggaggctcctgcaaaaaattaatagtatacagtacccgtccatgatttcataaaaacaaagtcttactatacttttcaggattggaaatgtaaattttgtccatttgaatttgggaatgttaaagcattagttattccgaaaaatgaattagtcccagcgaattgtttcgtttatttgtaattttgatcaatttgaaggccgtgccgaaacatgggacaacgacagcaaaggcattccgaagggcgaacacaatcactcgacggagcacgaattggccgagttggaattctttaaggtgctgctgctaatcttttaccaattttggcgaattttcaatttaaattgttttcttttttcagagtcaaatgattttggcggcaatttctgaaccaaccgccgatttgagcacactaattgatgaggcggccaaatttctgagcgaaggcctcaactttgggaatagggaatcgatgaaaaagtgagtgccatggcatttgctaagaaacgaatttgaacttggctaaaagaattgcattgcttttctggcgttttctctattcttttttccggattttatctttttggcgttctgtattctgtttttattcaaaatgttcaccttcatccatccatccccaggtctttgcttgtggcgcgcaaatcggtggagagcggcgagttcaatttgggcaaacaccggacaatttcatcgggcggtcagcagcggagtttgagcagttcgactggcaaaaagaaaggggcgggcggcggaggaacgacggcacaccaaagcggcaaatcggcagcagcgatttcagcccctaagggtacagtggcgagcaaaagtgtgagtggtttgtccattgttttgtgggattatttttgtggcggtgaaaccatggcttatctgactgtgactttgtccaaatgcgtgttaaatgttttgtttctcgtccattgtttgttggtcccccttttaattgcttttaaatttgcttttatcttttaattggctccgttattaatcccattttgccattgtcaggtgcccgtttcgtcccttctctccgtttccgctgtgccaatgccttcctcgtccaaatttccctctccgtcatcgtttaaacgtagtgccgcctcttccgccgatggcatcgcaacttccttcgacacgtcgggtgctgcgagttgtagcaacaccagcggttacggcacattgtccacttccggcctcgcagacgaagactccgccacccatggcatcggatggatggatttgtctggcgaaagtggcaactttctcacttcgacggaacaccacagccatgcaaacaacgcgccgatgggaatgaacggcgggagtgccaatgccaatcttctcggagttgaaggtgggatcagatcacttgctgatcattgaactcagggtctaatcagtcagtcacgtttgttcaggtaatccgtcctcctcaaccgatcaacaacagttgttggctgcagcattgtttgctgctgccttgctgggcaatccgtccccaacgccgtcgaccacaatcgctgagacattctccaggacgttggcgaacagtaacagcaacacaactggcagtttccagcagcaccagcacacggtcggcgaaatgatgatgtcaatgatgatgccatcgagcaacaacaacaaaagcaccaaacgggggttggcacggtcttcggcaacggcaccagcggtggctggggttggagcagttcaagcaaaacaacagagggaatcatcacaaacgagaacagcaaatggcactttggataacagccgaaatgcggcgattaatgcgcgaaaaaagacggcacgcgtcaattgcattttgaataagtgagtcccaaaagggaaagtgccattgaaattttgaaaaaaatgcaatcacttttccgactctcgacaaaagctgcggagaagagtgtgtcgccatctccgtcctccaataactccgagtcaagttcagtcgccaaagtcgcggactcagttgacagcgaacagaaggacactgaaacccaacgtgagaagcaattggttacggtagcgacacagacggaccgggatacggtagtcaatgaagacgaagagctgaaagggacgcgaaagcgaaaatctgacgaaaacgcgccgtttggtcgagcgaagcaacagaacaggaacgaaaaagaggggacagagaagcgaaaggttcgcatgaagtcaaatgagaaagagaaaacgaagatagagagagagagagagaggaaaatattattgacaaaagagaaaaaagtaattaactaattaattaccctgagaatgatagaggggaaaagcattgaagaaaacgatttattatggcaattttaggtggtgtgttgctgctgttgcgaggagagtgaattgaacggatgggaaatgccgttgggatgcaaacggagggtgctgaagaccgaacaaaacggcacaacgacgaaacagcaacaaatgccgaaacaggaggaggaggaaatggcggagcaagagagcgatttggaggaggaatttttcgagaatgaccacgagatcaaattggaaattgcggaagaggaggaagagcatccgcaaaagaaggaggggagcaaaggcgaggacctttgagaagttgaagcaaaaacagatgaaagtgtggcagaaagaataaaactcaattgatcattccggtatcgaacatgtgcgaaaagaattggaaaaaacaattcgaaatcgaatggaattgaacaacaacaattttgatcgaatgcacgggtgttttgccaatgcttttccttttcttttttgctgctgaaagcctatttttgtcattttcagccaacgtttttctagtctcgggaagcccttctctctctgataaaattgttttttaattgcattcatttgattgattgtcccttcttttttcaattgtttctttcggacttgatttggctatttctcttcttcattaaccatttgattacttaaattgtttccatttcattcacttaactcctgtccttccaaagtgccttcctttttttttacttaaattattttcaaaattcgaaaataaaactattttctgactggttatttatagttaattatgatctctatttttttttaacaaattcgaaattcagatttcttacgcatttgaaactccaaatgttttttactaaaaataattttattgtcttttttctgaacaaatttgaatgataattagtagggatggtatttttagggtttagccttttttcctgagttaaatggaaaaaacccaaaatatggattataatatgggaaaaaaatcctaaaatgaacaaaagatttctcaaaacttgaggttaaattttcgaaattttaaatcattgaatttttatactaaaactgaaaaatcaatttaattcaagaaaaataaaaaatataaaaaattcatcgatgtcataaatttgttaatttgcgaaaaataattttttcattgagaaaaaataatttacattttttttagttaggaattttgatcatgtaataatcttttatggtaaacgaaaaattttttatattttttaggagtgaattttcgaatgttcttatgacgatgaagaaaatatggatgaaaaataaagaaatattaacaaaaaaaaacatgaaataagggaaaattgaaaaatgcatcttaaaatcagtaggttaaaattatattactttatttttagttcggaataaatgtgcaaaaaaataatatggaaatcaagacaaatcgggccttaataataataacaataaatg

SEQ ID NO: 9917 - DNA, 3470 bp, Heterodera glycines
  misc_feature (1455)..(1455): n is a, c, g, or t
agggcacaaatggaggagggacataaagcctaatgggggagggaggaaaagcagataagccagcgaatgggtaataaagccagatgggtggaaaaaagggagtgaaggagtggataaagcataaagaaaaattgaggaaaagccaaacagagggaggaaacgcggataattcaaggaatgggtaataaagccaaatgaggaaagaaaatagtggcgaagaagtggataaagcataaaaccaaacgagaaaggaaaagcggataaagcaaaaaaaaaaaagggagaaatgaggaaaaacggacaacaccaaaagaggacgaaaagtagaaaaatggaaaaagaaaaaatgggctgccaaaacaaattcttccgcttccaggcacttcacatgcgattggcacggttacgccaaagtcagctggcagcaaagcgcgaatttgaacggaacatgcaaatgaaaggtcagtgttgtaaattcgagaccaatgattttaaaaggaatatggttggacttgaggaatatatttttggtttttcttcggctaaatacactgtgtcttgaatttttaaccaattaaaatttttcctattagggttgtgcattgtcggtgattaactggggagggtactggtttcggttaggccttgttcccgaaccccggctctcgtttttggcccaaaaagccgggtttcggttcggttaaacgattttacacaattctattagacaaacatacaaaaatgcccaacattattggtcaatttaatcacgactatgtgtgctaagttaacattttcagcaaataatgccgcccaatcaccggcatcgaattgcttcgacagagctccatggtaaacaacgccccaaatagagggcattatgccatgccaatttgtgccaattcaacccctcgccccccaaaggtgttccggatggatccaatcctcgccgttgatctgtcgtacatcgtccatttacatgcgccaagactgtgccaagtcgtgcgggttctgcaccagcagcagctgaagcgggcacagctcgccggcggacttcaaaaatcagcagccaagcgaaaagaaagatctcatcgttacagaatgaaatcttagaacggaaagaaaagatttttattgtcgtttttttacatattttttttttgtttcatacataatgccaattgctaaaataatttgtctgtcaataattaataattaaggctcgaaattatatgactaaaaaacctcaaatatggacataaaatatggactaaaaatgcccgaaatatgaactaaaaagctcaaaaatagccaaatatggactaaaaactgacaaaaattaaattttaaccaccaaaaatttcgagaatattcaatagttgcttaaacaaacttaaaaatacacaaaactaacaaaaatggatttaaaccagggctcccagatcaaaaatttcnaaagcctcatttcgcaggcgaaaaagcctcatttttataaagtttgcagataggcgccaccgggaaaaattttgtgattttcaatacgatttgttaacagatttgtcgacaaatatggccaaaaacattatgccattttatcaaaattaatcaaaatttaaaaaatctgacgaattttccccaaaaatcttcaaaatttctcaaaaaaccacaaaaagcctcaaaatttctcaaaaaccacaaaaagcctcaaagcctcattttgaaaatttagcctcattgacctatcaaaaaaccacaaaatgaggctaaagcctcacatctgggagccctggcattgaccaggccagaactaagaaccttccccaccgaatctctggcttagagaattggacaattttacatggacacgagagagggttgaaattggattttttggcataatgccattgggccgaaggtgcgaggttttaaattggaggattttaggtaagaatttcttggcacggtgccagggttcaagttccgccgatccgaattgccgatttaatattttttgccgtttgcctaaatatccatggggaccgaacggtgtggcacagattttctgctttgtccttccttacttggccctcaactagttttgccgggatttgagtcccgacaccgaaattcgagtcccagttttgtcgggatctcgatcctcccgttttccaataaaaaaaaacggatcggcgtctcgggaaatcctaatgggatcccgatcccttcccgtttatagtctcgaattttcggaggtcaatctcggtccgagtcttgccgagtctcaaattttccatgcctaattttctgggcctcaatgcgcggctggccagcagcagcctttttccaaaacagtggtgccaaatcttagcattcatcagaggtgccaggtcgtttcataaatccgccaattttaacgaatttttcgacaaaacatgggataactttgcttaaatgcaatcaactttacaaaacacaaaaaaaatcttattattttaattatattcgtacaattagtacaaatattaacacaaataaaattagttttcgcttttttttttgctcattataaaaaactcattagcaattcattttcattttctgttggtcgtttagcgccaccgccaccgaccgaccgaccaccaacgatggaattgtacaaccaaaaatgaatcatcccctggggggcttttatcgctattagcgatcggtttaccccccccccccccatcccatcccatcctccgtcctgcttatctggtggctttggcctgtgggctgtgtgcggtgcggccgtgcgctgccgcccattggccgcgtcgcttcggtccgcagggaccgcccatttttgtacggccgaccaacgcatttaagcgctgatcggccagcgaaaaatcattcactttcataaaaattttttagctccaatcaaaaagcattcaattaaaatagggggagaaataggaaaagccaaaaaagaaaaaactttttttaaatgggacagcaattaaaaatattaaatgatttatacaattttagtgcatttattaaatttcatttgaattaattccttcgctttaacataattttttgttttagggattttatttatttttttttcaatttataatcccgacaaaactcttcaaatcaaccaaccgccttctcattcaacatgaacaagtgtttagcacttgtgtaagtgttaattggggacaaattcataattaaatgaggcaatttaaagtctcccataaattttgatcaatcaccatcagatttctaaatgctttcaattggtccaaatattataaataaactaattaattaaacgttattaatcgggaaatcctgatcaaatttgactttctcccctctatttagtgtgttgatcgctctgatcagcgcgctggacagcgctgttctgcgacaacggcgcttcgtcaaagcggaaaacgcactgaaagctgagc

SEQ ID NO: 9918 - DNA, 1679 bp, Heterodera glycines
cttgggtattgtatttaaaaagaaatgcctattttaattacatttgccaattttaatttaaggagaaaccaacacgcgcaaaaaacggcaaagcggcggattggcacggggagataatgtggtgccgaacaaattcgatctgacactgccaggccagtataaaacactgaaattgttttagccaatcttagaaaatatttaaaaaaatattcagcgttgttaaaaaaattttgagcatattttttagcaatttttacccaaaaatatgccacaaatctttgagaatttgtgtcattgttgtgtttctattgtgaacaaaacaatcccaagttttgtgtcttattgtccaactttgtccaagaaatatttggcattctttcccccccaaattaacatttaaaacaattaattaataattattttgaagagcatgatccatcgaagtcagcagctaaagcaccgaaatatgagcccaaaattgaccggaataatacgcccgtcgattatgacggaaaggagaaaaagtgtaaagtggaggtgggcaaaaacaaacaaattaaatttattgaattgaaattgtacaggctaaaataaaatttgaaaaattaatgaaactatttttcgatgttcatttaaaaaagaatcaaaagaataaagtgttagtaaaatttaaacaggcaaatttgatcaaattatgacaatttacacattttattcaatattaatttaattttctgtttttttttatattttaaaaatatttttgaatgcttgcaggctaacattgatgttatgtctgaggaattgaagaacatattaaaagagaaaggagcagacaaacgtgacatcaatgccgctgaagatggatgcggactgaaggaatatgcgtacgtttttatttttatggcaccaaattttccaggccaaaaaattgggggatttagcattgaaaaatgataaataaatccaaatttgtcaatggattcaatttgttttaaatcgttgatttgtgagttaagtcttccctaaggcgaaatgtccaatagacgcaatgtccgatttgttttcttaattaatatttgcatttaaattgtgccccattttcagtgaatggtcccgctgcgcgaaggttaaattgcttcttctttatacatatgactttcttgttgatttgatcactttttgttcaggtggcattctacggtcgtggtggctataatgcttccaaaaagtacggcatcgaaaaagcgaagccaaccaaaaacttcaacgacatggacgagttcgacaagtatggcttcatgcacggtgagttttgttggcatttgaaaatagcttttaaatcatgaatttattatagaaaagcataaaatgaaatttttagcacaatgtggaaaaaacggggattgttggccattttcgccaacttttggccattttcagaccaaattttggcaacgttttaagacaatagggacccggcggtgccatgaaaatttagcaaattaaaggtcaattttgttaagaaaataaagtaaatttttaaaaaatgcccattttttctgcaatatttttgaaattttacgggcatggaatcaattttatgctaataatttttttattttacaaaaaaaaaatttaataaaaaatttaaaattttctttccttctcagaccatg

SEQ ID NO: 9919 - DNA, 2234 bp, Heterodera glycines
  misc_feature (28)..(28): n is a, c, g, or t
  misc_feature (34)..(34): n is a, c, g, or t
tattcatggaattgtgttgtcatattcngtgtgnttgttcatttattgttttttttaaaataatttctaaatgattaaaaaggatgaattgaatgagaggacaaaaaattactattactaatttaattttttggttatttattaatttttaaccaaaataataaaacaaaaaatagttgcaaatttaatgaatcgcttttattactgaggaacaacagcagaacttcttttgcagaatattttcaatacaaatgcaaattctttgtgaaatgccttacgatattccaaactaaaaaacaaaaaataaaaaaaatttaaatatatttttcaatttacttcctccaataaagaatggggccatttgatgaggcactgatgtgcatcaaaatgccaccaatttgagttgcgtgccatgccaataaattgttgccaaagataggtacaattaccaaattatttaaaaatacaattagataaccgccaatattcacaacaacgatcgtaaaaagcgatcggaaaattctttgattggttaattgggttgagttagagatggacggaactaattataaaacatttttcagttgccataaaatcgaatttgaatgaataaatacctttttggcattgcaatgcgactgcaattagtgcgtaaacagacacagaaattatcactgtgattaaaccggagagactgagaatgaaactttgctcctaaaaaacaaaaatattcgattgaaaatgaaaaaaaacgcaccaatttacaaattaagctgccaatttcgtaataattggcaaaaacttcaagtgaatttgttttttggtcaaaatattttgttgaggaggcaatcacaaaaatagcaattaaattaaatgtaagtgcaattcccaagaacaatttttgattaaattttcttcaaataaataaaatggtaaaatttacaatgttaattattaattattgctctataatattaattattgtttgtctaattgttcctactttagcgggaaaagcacaataaaaagtcgctcaacccccgtgaaaaacatcaaaatcattgcgcaactggcgccaataaaagggataagtgacagacgataaagcatttgaaagggcataaagtaatggccagaaaaaacggtgtaaaccgagatgaaattgccactcaaattaagcatttcgctgagggaataaaatgccaacaaaatattcacggagccacgaaatgatctgatgggaaaaggaagaacagcttgcttttccaattttaaaaatgatttttgaaaatcagtgaattgacctgcaaattaaacaaaaatttcatttaaaataaaaagctaattatgtgaataaaaattacttccggcgctaaaacactgctgctgcttgaaaatttgtcaaacatttttaaatattttaaaaatttacaaatgatagagaaaaaatgccactttgaattgcgtgacattcaaaacgaaactgttctcttttaatgtaccgaacattgatatggccatgattagttttcgaaaagcacaaataatgtgaatatatctgcaattagataactttttgcgcttctctccctttgattggtgccgacaatcccatcgaattattttccttctcggcattaccattttctcattaagattagcgacatttgcgccgtatttctgtacgcctttaactaaatgggagaaccctttgctttttgcccttttatgacttaaacggcgtaaatatcaaaatcgttatgcaccgcaaattccggcataaaagtcggaaatgatgaaaatttccaactttcccccggcagagcctatcggcaccgccagcccccaaaacttacttttttcttaaaattaactcaaaatccaaaaactgtttcaaaaagtttttttggaaaaacacgccgcaaaaaacatttttattggcttttttcatttggaatataattttctaaaagcagcttttttaccttaagtgctgattttgaaaattttcagttgaaaacccttgggtaaatccttccttctgataattggcttagatttttttttataacaatttagcctcatttttaaattaataaattatttttatgtaaaagatgttttttatcactgctcttcaacaataaatgagagagagaagaggtgtttttagtctctacgaattcactttgctaaatgcttttcattaaaagtgagtcatcggtaccattctt

SEQ ID NO: 9920 - DNA, 935 bp, Heterodera glycines
atattcactcccttttatacccccccccccttccttaattcatttcgcagtgccacaatttccgttaattaacaaatttaataaaaaaaaatcaaatgcaaatactggaccagtcagctcttgttgaccaaaacaatttgctttcaattttcaaaaagcttacttccgattaaatttccgccggatttattttttgcaaaaaataaattaaaacctataattggccaaaactcaaatgaacggcaaaactctttcacatttcattcgtggcactaatttattatattacgctcggtaatttaatttatgtactacaacccacgcaattttgctaaaatattttgcatttatttgtcagctaccctaaacaggtgttcaaaaaataggaagtaaatcaaaaagaataatttaaaatacatttaaaatctggaaattattctaaactttaattgtttttaaatttatccgtctttgtcagaacaaacaaaaaaatctttaaaatattagggcccggaattttgaaaaaagatttatggactcccctttctgttaagtaatgaatagagctgggatttttagctaaaaacccccaaaaaggccaaaataagtgcgaaaataggtgttaaaaattggaaaaatccagtgtctttatgtacaaaaattccataagtgactaattttttatcaatttcgcccacacaattgcaattggtcaagaaaataaataataaatattgtggacgaatttttgggaaaatttttgtttcttaggggaatattttctgaaattttgatcaatctttaggggtatatttaaaaaaaaattttggacaggttcttagggggtgtgtttttcaattttattgcatttttgctatgaaatttctggaaaaaggccaaaataggtgctattgacagaaaggtactcattcagt

SEQ ID NO: 9921 - DNA, 1216 bp, Heterodera glycines
ctcaattttaaaacgaattttttacttatccgaaatgatatttttgaccgattttcgagagacttgcccggaagccggttgcctctgaaaatttcaactctgacctgaaccggcgattttagaacggtattgacaggtttacggtttatgttctctagccaatcctttcctttgaattggcataatgttgattatttttttaattcttaggtttcctactttatcgaatttgaaaatccggtttgaccggtttttgatagacgggctcggaaaccaattgcttctgaatgtcagccctgccggctaacttagaaatctccttctctaaaaatttcttacggtttttctctgccgttatacataaatcattggaagcaagtgctcaatattaattcaaattgtctacctgaaaatcattttcgaatttcattagccgccgatgaccaatccgtacccattttatttctgtccaaatacaaacgatggcgcagtaaacagcggcactttggttggtaatgtgcaacagtcttcggcacagtcactgtctcatcacccggaaaactttctgaggcattttcattgaatatttaccatatgcattttcattaaacgtttaaggcttcagcaatatgtcgagaatctccagagagaacagcagagaaactttgagatgtttgtgcaattggaacaggttttctaatggatcgcccttttttaaattttaatttacgattcattaaccaaaggaaaaaaggaccattttggcatggaattcgcacctcgagagggaaaacgcggcactaaaagccgaaattgtgcaactgaaaaatgccaatgcgacgaggggaaacggacagcaaacgaaaaggcaatcggaaggagcgaaggaaaggccgggcccagaaatgaacagcgaggaacttattgtaagcagagaacgcggttttgaaatgtgcaaaaaaataaaaataataatctcccattaattgggaaaaattctcacagaatgaatttgtttaaccaggcaaaaaattcgggggataaaatcggcggtatttttttctcttcgcatctccaaaattttttgttcgatttcaaaaaaattgagccgtatattgagaaaaagaaataaataaaacttgaggacgcgttaattggcgacgggcagcacgaccatcgaatgcaaatggcacagcgaattgtccaccgtggccat

SEQ ID NO: 9922 - DNA, 1821 bp, Heterodera glycines
aaggagcagtcgaagtcgaacaacttggcccatgttggtcgatcacaacatggttagatgggatggaaagcaaaatggcaatatttcgtgggattgatggacaaataaataataattcgcgggttgaaaatgcaaatttttcaggctctgtgggacagatatcgagcaatgtttgcgcttagaaatttgaacaacgaccgagcaacaaaggcattggcggacggtaaatttggcactcaaaaaggggggggggtgaaatattaaagtaatttaggttttacattttcctttcggtaattaccattgaaaattgaattgtgtgcccatgaaaaaacgcattgtattgtaagaaaacttaaagaaaatttttttttgaaaactatattattataaaattttgaaaaatcgcggaaaatttttcaatttttttttgttaaattttattaaaaaggtttctatgcttttttgagaaatttttaattttgtttacaattactcgcctctttcccaaggtttgctttgtgatgacagcagtgcgctgttccgtcatgaggttgcctatgtgcttggccaaattcaatcgcccgtcgccatcccggcattgtccgctcgactgcaaatgcacggagagaatggcatggttaggcacgaatgtgccgaggcactcggctcaattgcaaccgacgaatgccaacggttgctgaggcaattcgttggggatgaagaggtaatttgccgggaaagatggagatgaacaagggattttgattaatgcagtgggtagaattctccataaatttgccttccagagagttgtgcgcgaaagttgtgaggtggcgttggacatcgccgagcttaatcggacggacgaatgataagcaaaaaagaggaaagaacaaaaaggtgtataaactaatcaatttgttgcttccgcccggaaagaccaatttattatttaattgttaatttttgtttgaatctgattaatatattttatatgaatggtctatctcttaattcttttgctcattataaagatccgctattttatttatttttctcaaattaaattttcgaaatattttccagtgtctttctcgtcaaattgcgcctcctttcgatgctttgtttgcgaagggttctttcaaatggacattcgttcgtcttttctggtgacattttgcttttaaaatttttgagctatatgaacagggctcccaacttaaaattatcaaaatcagcatttggccggcaaaaaatcgcagattttcaccaaaaagtgaccaattttttgcgttctgagtcctttttataaaatatttttgggcccggcggtgccgatagactacttttgaggtttttttccaaaatcagcaaatattgaaaatttagctctttacagtcataaataggtacttgtctagtttacgggacaaatttcacatacatttttagatgcctataaaggtactcattttacattttttaagcaatggatgatatatcctcattagcatcttgccaatgagggtaaccttggtacagcaagcataaaattcgaaatttgtatggatggtacctcatgggcatcttgcccatgagggtaccattgatacaggaagcctgtcaattttttgtccctgtacagctcttgtagtgaattatagcgctgatctgagtccggattcgtgatcagcgacctcaaaaaccccttaaaacttattttcaaatgtacaaatccccaaatatgtactaaaatatgtaaaagaaatttttttaaatggtctaattttcagccaaaaattagccaaaaatattttt

SEQ ID NO: 9923 - DNA, 1879 bp, Heterodera glycines
  misc_feature (79)..(79): n is a, c, g, or t
aatcccgaacctttaatttcatcaaaaaaaccgaaactctgaactattattgccttcattttgtttacgtgtgtatacntaagttggttttgaaaaaacgctcgtaattcgggactgggctcgaattggttggaattctcggaaaacctgttttcacgattttctaaaataaataattagtcgtaagcattgccattaaaacaatgcatgccatttttttttatcttttgtttcagtccgaatttacggcggacgatgtcggaaaattgtacaaagtgcccagcaatctgatgaacgtattgaatgtcagaaggaaaatgccggagttcttcgtaagacaattggacacgttgcgcgaatgcgtttggctttaccgtcagcaaacgcaagaagtgagaaaatggacatttgggagaaaatgccattggcattttcaaaaaatatcaaattaaaagtccattcgctagtgtttaggctttccattgtcttcacgaggtcgacttggctcatcggcccgcccttcgcctcgtcctttggggccattttggcaccggaaagacaatcactttgagtcaactgaaccacttggcaattaacaaaggatacatcattttcggcgtaaaagatggtaatcaattatctcatatattaatatttctttttttatggatgggttttcccgtcttttaaaatttcgaataaaattcttttagcgttgcgttggtctcgtgacaattaccgtcctgtacaattgtccacgtataaacccggtcggttggacagtccatggtgggccgtccgtttgctgaccgccttcaaagttgagaatggccacgcgtggaaaaaactcgcggttaaacacaacaaattttccgtttttcactaaaattttttgtaggaattgaaaacaacgaaagattacgaatggacaaaggtggaaaagacgccgaagagaaagcctttgacggacattgtcgaaatggtaaacaaacgaacgacggaattcacttctaaaatttagcgatggattttattttttaattacttaagtaaacttttcaaaaaagcggagttcgcattggttattcgtcgattggtgagaccgtttagcactcgttcatttttgatttgttaactcagaaacattcgcaacaaaaattaagacaatccgctgattgactcgctttttcagggtctgaccgcccccgctttgtccaccgattgtgtgggcgcactttgtcgcgaattgcgcgcgcacgcctccgccggctcaataaaacttctggtgaccattgacaaggcgaacggtctcttcagcgaaaaatgcgcggtgaaatggccgacggatcggagaaaagtgagaaagaaaaggaaggcaatgacagaaaaacctgggaatatttgaagatttattattattcatttccacaggcaactccggatgaattgtcgttgaacatttttattcgtaagtttttgatgccaatttggtcaaatggactgtgcgcaatgattgccgacaaagcggtggtcagcgacgcgcgtgaccatctgtccgtctctccattagatccacgcagtttatttggcgaaagagtaacattttaaatgtgtgccaactttaatttccgcaatcgcatgatcagggctatgaacaaattgagccattcgtatcggtggagtcacaacactattcggaggccgaattcaatgtcatccacgactattatttggaaaagaattggattagacagaagaagggacccgagggggaggaggcaaagcgacagatgatgtatttgagtgcattcaatccgagccattatgagagactttgctcattctcgtggaaccttagctgtagtgttccccgttttaa

SEQ ID NO: 9924 - DNA, 934 bp, Heterodera glycines
cggctggtatacacaaatcaatagtgcattttcacataaatggctgatgaggacagctacgaaatagatgaaattcttataacttttttatgattgtcaaattgtttagcactcacttcttttcaaaaaattagataaaaatttgttttgtttagtttgaagatgttgcgagttatgaatgctcaaaacaaccaatgcgaaaaaggcattgatcactgatcagtatgttttttgattagcacccagaattacgctatttggcattatgaatcattttgtctaacacttggtttgacccatcgttataccatctaatcttttaaaaaacgaattggaaaatgaaataggaaaatttatcatacataaatactaacactttcaaaatttcatattaatttttaaaagttctcaatagtgtcgaatttactcaatgtcgaaatagtccagtgtcgaaaatgcaggaaaacagtgaaagttttagaaatacttcagtgtcgaaatttctttgtgtcgaaaatgtagtgtctaaattacttagtgtcgaaaatactcagtgtcgaatttacccagtgtcgaaattaccagccacgcagctaaattagcctttttgagcccaaaacccgaaaaatttttccaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgtttttttttcttttaaaatgattgcacgtaattgccgaaaaaattcgagaccaatttccgaatgttgaccgactaattgcaaaacgaaagccgtctttgtcaaagcgccttaccgagtcaaaaaattggaaatgtatctcatat

SEQ ID NO: 9925 - DNA, 4252 bp, Heterodera glycines
ccctgatgtctgccgttgttgatggccctgatcactcctggcatgacgaaagatggcaccaagacgacattctgcaccgactgcgcctccgcttgacgcacaattggccttgatggagccagcctggcaacgtaggatgaccaatctgcgctacttgttcgaaagctgctctccagtagtagccaaccagaaccagcgtgtctccaacggcgagattgcgctgcaaacccaggccttgcagcatgtcgtttccaacgcgaacaaagaagggctcatgatcaaaggctgccgccacaatgacgtaatcctcagccgaagcttgcgcgacgacataatgccgcaccaagttgttcggtgtcggtgggtgcgtgcgcacctcctctcggattatcatgagggcttcaccaagagcgttctgcccgagccaattggccgtagccgttaaaccgacgtcgtgcatctcgcgtccagcggcccaatactcatctctggacgcctccaccaattggccgtagcccgtcgttcgaagggcactgcgcaagggctcaacggcgaacttggcacgcagcgcacggcacatcaattcgaagcggacgacgtgccatttttgctcgacaaacggcatgatgtgacggccaagccgttttgccgccgccggcgttggctcatggcggatgtgatggaacgaggccatgtcgccgaaatgcgccgccttcagcataaagtaggcgtgctcgctgctcattacgttgatttgcccgtgttcatcaaaattcatgttgaaagtgtggacgaagtgattggaaaggacaaagctcctggagaaaaacttgaaagacgggacgttgtccaaaagaaaaggcacggcgacggagtccatcagaattttatttgttttagatctgaacttaaattcatcagaaatcgccacaccttccacaattttgagatttttaggtggccgtagccgttgtgtcgtaatttaagcggccgtagccatgcggaacattaatttgtttagtttagatatgagctttcgccctcagcccctcacaccaacaacaggaccgtctctggtcctcatttaaaataatatttgatggaaaaggtgaaaataaggtcatggaagagagaaaagaaagaggaataagtaaaaaaaaatgttagaacgagtaagactaaaattaattggggcacggaagatcagatttatttgccaagaaagagaaagaagtatcaaaggaggacaagaaagaaaagtgtgaacgcgaagagaaaggagagactcattttgacgggcattcacgggaccaatgaccacttttcttacagttgaagcaggctcccctggtaatgttttgggttccttgcctactgaagatgccttggtcaaaactgttttgaccgcgatttgacggccgtggcctttcagagtgtgatgctcgtatctgtgatggagcaaatgcacgccagccaaccgagcgccctctgaccggtcccccagccgggttacgagcgtctgttggattcgtaaatttgccgctggagggaattggggaataaccatttaaattagccaaaattccatccacgcgcttaattttggtgctttccatcattcgcaaatattcttcattgaaaattggcaccatttccttggctttctcaacaaaacggccccaaactttgcaccccatcagtgtgttaaagtccgcaatcaagaacatgccttctcttgcacgtgaaagcgcgactgtagctctatggctgtcttgaaagaatcctgaaattcttgaagagccaaacgggttttgatcggccgtagccgccgttttcgtcgtcacaacgatcaccaaatcagcttctttcgcctgatacgaatccacagtgtggacttcgatggtccgtgaaagcatcttcttttcacgtgcttccctcatggccgaagccaattgttccttctcatagagataaaggcagatgatgacgattgtgttcgattttggcaaatttgcatccaaaatcataacgacttcctgcgcaatccttctgtgctcaacatttgagagcgaaaaggaggtttcatccatctgaatccgaccttcggaatgaattagcacaaggggaattccagccattggcaaattgattgccgaagttgtgagtgatgtcctcgctttggtcactgcttccactggcaacagaacttctccgtgtggcacgtatgatgcgaaggagacgcattcaaccaaacttccgtgtgatctgtagcatcttttcagtacagtttcctccattcgtggcgatttcagcagttgatccgtgatcgattcgaggccgaagcctgaccagagtacttcttgcagttcacttaagtggacgccaagctgacggacgtccccggtgaccatcattttcttgagattcggtgccccgcatgccaaactcactacggtggtgaaacttgcctgcgttgcttcatccaaaagaagatgggttgcacaatttatcgtacccttgacgcgaccagccatgtgagtcgtgaggaaaatgactttccttttgtcgtatttcagataactttcagccactttcgcttctcggacccgcagaggtgtgttaaacacgtgctttttgtagtcctcaaattgctttacgtcctttttgtctttgacttcttccaagaatgtctgcgtgagtcttggccgtagcagacttctttccaacggttgaatttgctcgccgtagcgcactctggccgttccactgaagagtgccaagtgttcctccgaaactccaactgcccgagtttcttccaccattttggtgacagaaaggttagacgtagctgtcgccacaatgaccgtttcctcatttttctccgacaaaagaaggtcgatggccgtagccaatgttagtgtcttacctgtgcctggcggggcttgctgcaacacaaccaaaggaaggtcacatgcaatgagtgccaaagtttgttgttgttcctcgttaagtcgcgctactgatggcattgccgtcttttggccaagaccataatcaatcagtttttgagtggtcactttcagtccacttcttccaggcctggcgaggagtgctttcatgatctctcctcgcggtgaatcctcttcggccagtcgagacggttcatttgtgccgaagcaatcagcatggtctgagaaaccaacagaagcaccaaccgattgaatgatggtttcttcaccattcaccatctttctgaagttgcttatttgaccatcactttcatggtgtccaaggcgaactttaacactaacaaaaaatatgtcactgccttcttcagtcttttccgacgacttcttaatcagaataacttgcccgtatgcaaatgccttagcatcaaattccatttttgccgtgacgggggagtccgttgtccattgtttgacaagttgtttgacaagctttctgtccttcgtctggaacttcagccagaagtatttcgggaattcttcatttccatccgcgtcagcgttttggtcccattgcggccgaacaactccaacgaattgagtgacaagtttcagcatttcctcatactcagaagctgctactaaggctgctgccacaatacgttcggcaattttcacttcttcgtccgtgtactccggcacaaagggaaaaattacaggaattcccatggaatccatgcgcaaccaatcccggtcaaagaggtcggccgtagccggaatcatagtcccaaagtccgcaaacaattccatcccagaccttaccggactttttggtggcaagacataattcggaccaacgtaccaggcctcaggaacttttgccaaattcaatttaatgatctgagcctttttcaaacttgccatgtgagtgtccgggagaggctgacgctcataaagagccatagctctgaccataccatatgcagtgactgaaattgacccaatggttgcttcagacgctctgccacggcgtgtgagatcaacgacgatgccatattgctcatggtgttttgcaaaacgaacttttgtcactttcgtcacgactgcctgacattggattaaaccggcataaatccatttggacttatccaagaattccttgcccgagatgtactcgtacccgttgaccaaaaccttatcacctgggaggagcggacgctcaaactcacctttgaagtcgtccggcatgaacatcagaaacgggaaattattttttttcatccgga

SEQ ID NO: 9926 - DNA, 6632 bp, Heterodera glycines
  misc_feature (6570)..(6571): n is a, c, g, or t
ttcacggtcggcttggtgctcatcaacgacttcagcatgtcattcttggaaagaggaaaagtgccaatcatttccggtttaaacattaaaaagcaaaataaatttaaaaaaaaatttcgctaaaattttccggtggcacctatcggctcggcaccgtgggaaaccatgattttcccaggttccgggtcagggatttgtatgtttttgaaaaatgcaacaaaatccgaacgccttttaagacagggcttttcgtcaggaattttgtccgggtcgtccattctcgaaacccgggtcccggtccgttttttcattatccttggctctaattttggcaaaaaatgtgtgtgccctcggattttccattttaaatcaggccataccatagacagaatcggttcgctgagtttgtcagacggcacgtccagccaggacattggcaccgcgcctgggtcgcccggtgagcagggcgtcaacaggtcatgagcatgcacattcggatcatgcggagacggaccgctgaccttagtttgagaaaacatgcattagccaatgaattcatgtccgaaaatgccaatgttgccaaaattccatgtttcgctcacccttttgaaatgtgtggcgtcctgcactttgcgcaccggctgcatcagtgcgtccctcaccaccatgcaaatgtcgtgccctgaatagccctccgttttgcgtgccaattcgcgaaggtgttcctccgtcaaattgttgggagtgtcgccaatgtgcagcttgaacatgtccttgcgtgcgtttgtgtccggcagcgaaatgtaaattcgtttctgaaagcgaattattggggaaggaactaaatataaaaatatgaaattaaaaaaagaatcgcattgtaaaaagagcaatttgtcatcaattttttttaaacaaacttattaaatttgcaaaaaaaaatagagcaatttgttttctggggaaaaagtgttaattgtaagaaaatttttgaaaataacagagcaaaaaagaatttggattcacccccaaaggggagatgtaaattggcctaaaaatgaatgtccaaatatttaaagcatttttatccatagccagaatgaaattcgtaggtgaaaattcgaaactgttgttcgggtgaaaaaatcgttttctccagtgttgtttttcaaaaaaaaattcagtttctttgttttttttttgccaaaaattactaccgttttaggtcaaattttcaacacacagcgctaaaatcaaatgttcacaattggtcctactctaaacaaaaaatcaggtaacatttttgcaaattttttaattttgcttttcattttttattttaaaaattttcctaaaaactatgcaaaaaattgcactcacttcaaagcgacggcgtatcgccgcgtccaaaatccacggaatgttggtggcaccgagcaccaaaatgccgtccatgtcgtggccgacgccctgcatttggacgagaaattccgttttgatgcgccgcgcggactccgattcgttgtcggagcgggaggagcacagcgagtcaacttcgtcaatgaaaatgatggacggtttgctgcgccgggccaactcgaacagttcgcggaccaatctgagaaaagggaattggcaacggatttaaatgtcgtataatccgtgggaatgccacttaaatttttgatttttatgtacaaattctgtgcccgaacccaaaaatttgcaaattttatgaaaaaataatgaaataacatcatttttaatgttcaaacttttccgattcgccgagccatttcgagacgagatcactgctggagacggagatgaacgtggagttctgcgcttcggtggccaccgccttggcaatgtacgatttgccggtgccgggcgggccaaacagcaaaatgccacgccatggggtgcgcttacctaaacgaaagttgcataaaaattaaaaaatgtatttgaatttaaaatgcaaattcccataatcaattcatgctaaaaatttaaagaaatatgaagcaaaaaataaagctaacgaggctttatatccatccaattaaggaattgcacttttatttttcccaaaagccaaagaattatggttaaacaatggctttttctcatgtttttttacattttctgttatgtccaactctttgacgagagagacacaagaaaagagcatttccatttcatgcgccccaccataaaacaaagacgggagacatcgcctcgcgggcgtggggagggatggcggctgtttgccatcgccggctggcagagaattggacacaaaataagccgactccatctctttcatactctcattctctcttttttctttctctctctccttccctctcactctctctcttccttttgtgcccggaggcgatgtttggccaaaagcatttttcatttctctgccccatcaacagccatttgtccaacgagacagacaaatggacacaacacaacaaacgccgccgccgctgaagccgccattcccggaccattttactcgcccagccgctcctttctcccacaacggtcgcacctcgtccaagtcgagaatgcagtaaaggacagcaaatctatgatctaccccattaatagcatcattaccctcccgtcacacggatgaaaaagggcccacggcataaaataggaggaaaacgaaaatttcttctgattagggctaagagaaaagcggagtctttcaacccatttacaaattagctaatgtgatggcaaaaagtgagtgaatgtgaggtatttttgcgtataatttgtgcctctctctctcccccgcccaatttctttaaagggcaaaagtgaaagaaagcgctgtcgccgaacagaaacacaataaaagcactaacaataagaagcaggccagcacacatagactttgtggcagcacaaaactttttttaaattgaatttactcactgaaaaagtctctcattttgcaacattaaattaccaaaaaattattaatttaatgttttaaaacatttaaatttaatttttctgtttacgttttatagtgaaatactgtggtacatatattagaattttacggcatatgcaaaccgaacaaatgcaaacacccgcagacacaacaaccacaatcgtacttcgcgaaatgttggttgatcaacaacagtccgacgacaactcctccgctccatggccgtccattgtcaccaccactgaccatgcccacccgtctttgttggtgttcccaatgggtgtcctcactgtgctggcacttttggccaacactgcgctgaccgtttacattgtgtggcgccgtctctaccacaactatgtgtcctcccaattcattttgcacttgtgtttgactaacattgtcgggctcagtgtgctcgtcccactgttttgtgtcaacctgtggtcgggcaacaacctttgggagaacaaccatttgatgtgccgaatgcaggtggtggaggatttgatttcgatgcaaaaaaacagggcacaaattacatggcattctttctggatgggcaaaaagtgccaacaacaacaccaccaccacaacacttggcattatttgccttttagacatttatgatgtgctcagtgtggaccgtaatccacttcatgacactgtgcatcgccggcgttcatctgttgacttttgcgcgcattcactacgcccaactgtttggacttccgccagggtcattttaaaaaaaatgatttgaaaatggatttaaagtggaggtttctcgctggtctaaagaatcgagagtctcgaaaacgtcactgtattcgcgcaacaactcaacattcagatcgctgtgcgcactggcgtggatcgccgcgttcgcggtcgcactgcccagcctgaccaactcgcacatcgttgtctacgacccggcactgcgccactgcgtgtggggcagcaccgactacagctacaagttcttggcctacatgctgatcctgtgcgtgctcatcccctccattctgtcctacttctgctacatcaaagtgttgaaaattctctaccactctccaatcgtgttccagtccatcggactgtacaagagtcgctttttggtctacgcctttctgatggggtaaggcactaatccgtcacattccatagatttgattagaattctctaaattttccctgcttatcggcacaatcgagccatcaacttcttaaaaatttgatccgaaatcctttgcttaattttttagaccaatttttttaaaaacggctaaaatccaattccgtcgatggcatccccagactcacaatcatcatagaaaatgacataaaaaaattcaaattatgcattttaatcaaatcgccgataaaatcccaaaaattggtccttcactacgcatcgcaatgatcagaaaatcagattttctcatcgatcaatccaattgcttggcactcatttgtcagtcacagtcaccaattgttcaggccgctctaccaggcgcccttctacataatcacaatgagcggcacgtggcgctttggccacggctcggtgatgcccgttttggccatgttcctcggctacgcgccatcaatggtggccccgtttgtgtacggcctgtcactgttccaaatgaaggaggaggacatggcaatgaccgcaagggcacacaaaacaatgaacacggccacttatcaccaccaacatcagcacaaccaacaacaacagttgaacaactgcagcaacaaccgcggggcaacacaggaggcaagggcacaacttttgtagaggaggacgggcaaaggcacggaaatgatgaaggacagacaattcaatgctttatattttcttttttttaatatttattcattttaataagcattttgtaaatttatttcaattgtttttatttttcggtcgagaaaatttggtccactccttgccctcttttttatggcacaatttggtccccaattaagaaatgccaaatttcttacagaaacagaaaattaaatttcatcaccgtacctttgaaaatgtgcggaaatttgatgggcaaaatgacggcctccttcagcgcccttttcgcgtcttccaacccggcaatgtcctcccacacaacgttcggcttctccacaatgatcgccttgctcatctgaagaatttgcgattttttaaattttatacaattttttacgaaattggcaaaagttttatgttgtttttttccggtaaagaggttagaaaactaacaataatattaatctggagaaataaatcggatgatcttggcaacattactcggatcaggaacagaaacacggacaggaggacccagtgaaaaaccgggtgcacaacgtttcccgtccccgaaaaattttaaaaaaatttccaagcttaagaagctgtccaaaaggaaatttgcacaaaatactagtagtttggaaaattttgggatggaatgacatgaggggaacgtttcccgagaaaaccattcatgatccggtcctgttccacgctttaccccggaattaattttgcaaaagcacaatttggtgaaaaaattaaatgaaattgaaaaaaattgaaaatggtacctaccgccttttggaactttttgttctcgtccgatgcgtccgcctcgtctccgctcgagtccttctcattttccttcaccggccgtgcccttttcgtccgctcgccgccgtcgcgcaaaaatgccttcaaattttcggcacggttcatgtactccgtgattttgagccgaatggtctctttctgtcggtcggcttggcattcgtctgcaaatgaatgaacagcaaaaatgagccaataaaagccaaaggtgaaggggaaccgtattttgaaaaaaattgtgtcctaagaaattacttttggattggaattagaaatttatcatttcgtaatgaacactccctatcaaaaaaaaactccatggacaaacggatacaaatttcttaaatttttaggacttttttctcaaacccgttgtttttagcttcccctatgttatagaaatgcccatttttggaataggctgttgaaatgccgaagggtttgtccattttgttcatttatcttttcaaatgggtttaagtaaggattattccagtgtatattaattgaaaaaatattcgttggcttcaaacaggaactaccaagcagtgaattcgcaaaattgaaaatttcggtttttggcacttaataaacaaaggacgacattttttgagtttaccttcgaaagtacagttcctgacacctttctcgttttttcgggacaaacttcacagatatttttctgtcataaatttacaatagaaaagtatagccaactccctacagttttcgagttgacatttttaaccaaatctatgcaaagtgccgtactttcacccccaaccgtctcacaattaagaaaatcactttttcgcccactcacatttcaaggcgtgcataaaatattcgcatgatccggtgtataatcgaagtgcctcctcgtaatttttggttttgtcctcttcagtcgctttggtcaccaattcatggnnctttgcagtgcggttgtcattttttaaaagtgtgtgcaaatgcctgaaaactcaaatttag

SEQ ID NO: 9927 - DNA, 1113 bp, Heterodera glycines
atatatatatatatatatatatatatatatatatatatccttctatgtgtatatatatatatatatatatatatatatatccttatatatatatatatatatacatacatatttgttcctcgctaggatactcgtggatagttgaatatttattgtctgctttcatatgagagaccgcacgggaccgggcgtcccttggtttttctctgagtctatcgggattaaactcgggatccccacctgggatctgtcccgaatatttttttacattcatctgggattgattgggaccgagattcggtctgtatcaccacttagggtccctatgcgctcatttgtccggaatccgatgcatatttctctttttttaaaaattatatgaaaaagtcgatcagtaaatgtcgtctataaaaatttatcgaaatcctatttaaataaaatcgagctttttgttgacatatctatacattacattattttttggctatatttcaaaggatgtctttgtcattaaagaacacaccaatttccctgtggaaaaattacaatctaagaattttccaaaagtattcctaagaatgtgtctaaccaccctctgtgatgtattgcctaattttactcattgtacgatatatgcaatgctcccaatttcggggccccgttttttcaattgttcattccggtggtcccccacacgggtgccaatcagtttgcgacgctcttcactatcaggcggtagatgcaatgttggttcgccgacagaggctgaattttttatatttttatttaatttttttatattaattttttcaaataatgaaaaattataaatacatattgttttttactaaaatattcatattaatatattcttttttatggaatttttatatttaaaatatgacaataattatcttattgaattataaaatttctaataaatatataatagaataaattttaaaaactattttttctcaccaagtctgttggatgattgcattttgctcagaacaccaagcaaatagaggtgaaccggtgacattggctgtgaatgtgtggcaattgtttttggaagttccaaaaaataaaaaacggccaacgaatactccc

SEQ ID NO: 9928 - DNA, 4568 bp, Heterodera glycines
  misc_feature (3462)..(3462): n is a, c, g, or t
  misc_feature (3602)..(3602): n is a, c, g, or t
cattttcatcattatttcaatttaaaattcgcaattataaaattaactaatttccgatttttaactttattttaccaatatttgtggtgtcattctccaattttccactgcccatttctaatggtttcgatttcgtcattttataatgcattgtcaatttatcagcactttcattgctgagcttttggccttccgctctaattgttgctaacatgtgctaaaattaattcacagtttcaatcagaattattgctaggaattcttttcaatcacaaaaaagttaattgcgagaaaaatatttttttttataattcaatctttttttttaaattaaaaaattcattttttaaaactaaattaatgttcataaatctgccagtggtgatggatttacgaatatttcaggacagcacaaacagccaataaaaaagtgttgatgataaacaattttaaattaattaaaaaattaattatttattcaaagaaatgaataaagtcaagtaattataattattccttgctaatgtacatgcatttaagcaatgaaagataattaaaaagaaacttttaataaaaacaaaattctcttacaattttgttaatgataaacaaaaattaataaattttatgataattttttaaattcattttaaatttaatacaaatatgcatgtattaaagttattaaagataattaaaaaacattcatttaaataaaaactttttcatctttaatatttagcttttctagatgaaaaaaaaaattaataattttaataatgaatattattattatctttttatcaaaacttacaacatcgtgaccatcatttgctaatgatttggccaatgagagaccaaacgcaaagtgactattgaaaggcggaaatgccggatgggcaaacaaaattttgagggccaatgaagaaccaatgtttgtgagttcattgaggcaaatgaaaaatgccaacgattgaaacattctaaattttctgtaaaaaaataataaataaaaccgatcgcttttggtctgagactttgttttcgctcgaactcgaaaagccataattaaaaaaacttcataaaaaatctacacaattctcgctctaattggaacataattaaaggaaaaaggcaacggtatgccaaaattttgttttttctcttgagaattactttctgaaaaaataagcaaatatataaatgtataaaattaagcaattcttttaataaacgtatacatttcagaaaatattttattggaaattataataatttaatattttcattcatatgcatgtatatcttatgaaaattttatttgatatggctttaagtcttttttattgactaatttgccagcacttgaatattgctaaatgattttgaattatttattataatataaaaaatgcattaaagaaaaaatgaaatttttacgaaaatgtttaagagatttactaaagaattagtgaaggaataggtgcataatgagaactaataaaaaattttaaaaaaactataaaaatcgacaattctccgctttaattacaacataatttgaagcaaggcaacggtatgccaacattcgttttttggcgttaagtgaaggctttttgttttttttaaacaaaatttaatcttattatgtattagaaaatccctatatattaaataatgaaaaaaaagaatttaataaaatatttttgattgtataaaattaagcaattcttttaatgtaaaaagtataagcaaaaaatataaaatgtatatatttctgaaaatattttattggaaactataataatattaatattttcattcatatgcatgcatatttatataaattttaattgatatggcttgtataagtcatttttattgacgaatttgccagcacttaaatattgccaattgattgactttaaaaaaaatttttttatttaaatgcatgaaggaaaataaatgaaaattttagaaatttttaagcgatttaagaaagaattagtgaatttcagctttcggttggccatatgttcgctgagtgacgcaattggccactccattagctaccagtaaaaataataaaatttattgcatttttttaatcaatttttaattgcttttattccttgtttttctccgcgtccggattcctcatttgacttgtggttatgcccaattctttgcagtcactggaaatattaattcttttatcaatctgttttggataagcgttgatcatttgtggcaatggcattccccgttttgtaattttttaaattcttaaaaactcaaaaaatttaatctacttattttaattaagctttcgcaacatctcaaggttcgctggaaaatatgtgataattgcaaatgtcttttccttgtcaatcgttttttatattatttatctgtcatttatatttgctctaaacatccagaaaagtaattaatgaattatttaattgtcgaattaattaaaaattttcaaattaaaagaattgtttatggtgggcctgatgataattcaagacgaattagttttggttgcttctaatataatcatgggaatttatgctgattggtaaaaattaaaattttaatcaattagaaaaaaataataattaatttttatggctcagtgatcagaactgatcgcagcaacagcaacaatcgtcccacccaatccaaaattgaaatcactaatcccattttcaaatcactactgtctgtgatcatggcagtaatcttctgcctttgattctccagttctctgatggtttgcattgttggccgaggactgatcaccagtgaccctcatcgaaatttttgattgatcaaccggaagtcatcattaattatttttttatatataaacattaaatcggctaattgattttataagataaaaatttaacaccaaaaattctaaagcttcatgttatcgtgtgatgggcggcggcgcctcgtaccaacccacatccgccaaatttgtttgtttataaggcaatacacaccatttgacaagatattattcaaatccacaataggttagaatttcatattaagtattcaaaaatttggaaatgtaataagcaaaaatttcatagagttttaaaaataggctttataaataaacatttaaaagagtaagcgtccaggaaaaaaaattaggtacgataaaattctatcatcaaaaataaaaatgcggcaattttttaactggtttaaaaaatttcaataatatatcaaaattttagaaagttttatatgggtataaagattcgaaactaatgctttactgtgcagcagggatggtacggaattccgatttccggtttccgacatgtttggggccggaattccgatttccgaaaaaatttagggagtcagaattacgatttccaacattttggataaaaagtcggaaattttcggaaattttttttttgagtttttttncaaaatttaacaatttttgtacaattttacaaaagtgggcaactgatcattggacattacgacagtgaatgaatgtcaaaacctttttcgaaactgttaagataaatttttatttttggtcgcaatgtccactgtacatnttgtctactggacattttgtccatatctgtccaaattactcaatttacacatatctgttacaattttctttggtatctggccttgcttaaagcattcaagcatttacatattttaattggttactttttcactaattgttctattgtttttagctaaatttatttatttttatcctgtttatcctttcttttgcttttttttgataaatcttttactgggagtaaactctttaatgggttgtcgctcgaaaaggagaaatgtgattgagttttattataattaatttttattttttgagaaaattttttttaaagggataatttttaaaataagtggcggattattcccaaaatgagcaatttcgacgtcatgaggtcgcgcagaaaccaccttcattgaacagggagtgttctcagtcatcatcaagtctcactataaattgatctctcaatgatctttgagtaatttgtttagtataaaagggacaatcactcacctttcggaaccgaaataaaagtgcaatcaattaattaattgagtcaagactctcgagccaagggtgtaacactacaaaatgatggtctatcccccatccgaactgatcgacatccttctggccaacagccgaggcggattggaacggtaaattgagaaaaatgataaatattgacaaaaaaatgaattttatttcattatttaaaaaaaaattcagtcctcaaattgttttgagatttattcaatagaacactatgtatttgaaattttaactcagcttattcaattttgtctaattaaatattttaactttttttaaaaaaagcaatttaagataatatttattacgaaaatttacaaaaataatactattcttattagcatttttcgcataaaatttaattggaaccgggggggagtttatttttatactgtaagaaatgtgaacaatccgactctgagatccccgg

SEQ ID NO: 9929 - DNA, 2548 bp, Heterodera glycines
gaagtaatgaaaataaaaatagtgtaaataaattcttttaaattattataggcaatattttgaaaattcaaaaataaaattttttttttggttaaattttttcttaaagagccaatggctttaaatagaaaatgaaaatagatatttgatttgaaaagtgatttacttcttctaattttcattttattaaccgattataaatttggagttcattaatggtgataaaggttcataaaattttttttaatgaatttattgattatgacaattagaaataaacaattcacataggataatatgttttgaaaattttataattgtttcttcttaaaaaaatgatcacatgaatttcaacaaaccttgattagaatttatcaaaaataacatatataggtaaacaataatttaaaaaaattaaattaagaacataataaattatcaatttaggatttctttaaaaatgcataatttttttttctattttacaaatactaatttcggtgcttggtcgtttcgcgaaaaccgtaaaaatggtgacgtcacaaaaagagagtttcgcgaaaaccgcaaatatttcacataatgagaccgatccacatcagtacggtgttctttgtgctaaaataattttaaaatatttataatgtgtgttccttcccttaccgtagacaaaacaatgcaaaaaagaaaagcaaaccaaatgaaaattaagcctataaaatgtgtatttttaaatttttaattaaatctccctgatcaacgagctgaatagccttacaactactaaatcgccggttacatatttttacatatgtaccgtatgctaattgtctataaaaatatatatttatcagttaacaaattaaagaacctcatcccaaaaacactattaaataaattaattagaaaataatttttttatatttattttacgtaaaaaatattcatttgctttgcttgttttgcttgagtggcttgaaacagacattaaagttgttttttttcttaatttaacaaatacagacaccgtactgatgtggcccgctcttttgttaaatattttcgggttttgcgaagaaaaaacgcccccctcgccataatttccatcacatttttgaaattgaagcaaattcttttttccatctaaccaatgtataagttccaattttcaattcaatggcgattcttttgcgctaatttcaggattttttcctttggttttgaaatattgcttcattttttctaatttcttctcatttaagactttttttgcaaataacattattaatcacataattgttatgtccgaaggtttggcgacaaatatttattgtttggaaaacacaattaaaataaatgcgaacgaagagagagagagatgaaaaacataaatgaaatgaatgaatgagagcgaaccacaaatgggggaaatgcatgcgcttatatgcgaatgaaatggtcagacacaatcaataataaagggtagagaaatgcaataaaacaaagggagtgaaaatggactttggtcatacccaacaataatcatagttgattttattttaaatagctaaaatggaaccaatttggtgttcgagaacgttatccgacaatgcacgaattgaaaaacgattgaataaaagcggataaattttggtatttacggattttgtgagtcccttaatttttaagattttaattcatcaaatgctagcgaacattattagaatataaaaatttcggacggagacccggcgggaaacccgtaaatacgaatatttattgggtgaaagaattctttagggaattttaatcaacgcattaaaactttttttaggttttttaaaaaaatttttgagccgattaataccctcaaaatcacatctcagaaattgatgcaaatttctttttccactttcttagcgtttcatagccaatttccaatttttttgcaatttttttgtcgataatttttggatttcttttttttaatttgaaatattgtttcatctttttaaatttctcctcattggaatatggtgcttaaaatgaaaatttataaatgatataattataaaaatctgttacttttattgtattttggcaccaattcctttttccatttccaaaatgtaaattcagaaatgcccaattccttcacaaattctttctgtttgcgttggccatataaacttttaaattcagcaaatcgtccaatgaattctttctttttttgttcataaaaactcttttccatccttttaattttatttaaatttaattcgtttttccatttgtatattttactgcgatttgtccctaataattttccaattttctgctcaatttttgtgtcatttttcaattgatattttcctttttctctcaatttttctttaattgcatcaaatttttttatgatttctctttttcgttgatcatttgggtcatttcccatttcttcacccatttgatcaactgctgctgaattatcattttgctccttttgttccttttgctccattttcattatcactttgtcttctctttc

SEQ ID NO: 9930 - DNA, 5746 bp, Heterodera glycines
tcgttaaatagtctttcagcttcatttatcgatcattaagttattttatcttaattaaaagaagaagacagatattggaatttgttgtgcaaaattgcaacaatgactcactcgaaacgtagaagggaatggaagaaaaactttatgtgcaacaggatcaagcaatcgcgccattttcttgatcactcaaactgaccttttttgcctatttacgtgcaattgcttatcgaatgcccgaaccaattaatttgacccgaatatatttttaggatatattttaggatataatccgtttatatgcctataacttattttttaaaggtttagtttactgtcggattgtccacttttgtcggattgtccgggagccatggcgagggggaaaataaataaataattaattaattaaggataagtggaggaaaagccaaacaaaaacaaattgagggaataataagacaaatcattaattaattagttaattattttcttttgtccgatcagatgttctgctgattggccgatcaccttttttgggcgacaatgacgacgaaacgctgcaaaatgtggtgaagggcgattgggctttggcggaaggttcgcaaggcctttccgaggcggcaaaagaattcctacactttttgctggtcaaaaacccaacgtaaatcttaattcaaaaaaataaaaattttgtgaaaagtatttgaaaatgaattttcattttcatacatttttttgtccatagaattccgtgccgtgccattatttcttttttcccatatttaatttcgtgctgtgcccgaactttgccactttcctttcccttttccatccgtttttagccatcgcatggacgtggagcagtccctgcaacaccaatggctgtccgacccatctcttggcgacgccaaactttccaccgactgtttgcgcgagtttaaataccagcacaaatggttggagcgtcgggtgtttgtccagcagacgccgtccgatcagctaacgcaactgatgagcggaccgaagcaggcactgtacgccaccagcgaggacagtacgccggccaaacagggtacggtagaaggggcggggtctgcaatattcccctaaatcactggtaaccgtaaaatatttgctataatttatcacaggaagagagccgtgccacgcggagccgtacgccatttacgactatttgcgcatcaaacaagaaagcatgccggaaacggcacgtcgtacgctgccccacagtgaacacgactcggtcgttgcaaaaacggtatgtgacgataaaatacagtaccttttgcctttggctactgtctgtcccttttgcctgccgttgtcagcgtcgtgccgtccctcctccgcccattggcagcggcagcgactctccgttctccacaaagttcagcgttggtggacactgtccgcccggcggctatcagccgcctccggtgccgccccggcgcagcggctccgccgactcggcgcttgcggcgaaggcgccgccggtgccggattggatagtgcggcagttgcccccaggcgtaaagccggaagacttggtggctttttttgaatttaacggaattttcaaaaatatttgagcaaacgcgcccacttcgcaggtgtgggacccgcgttacggtggtggcttttacttgccgccgcacctccaaccgaaaggccccccgccgcagcaaatgggcggcccaccgcgaagccgaagcagcggcacattggaacggggacaacccgggggaatgccaacggcaggaggtgcaaccaaattgacgcaataattaattaattagctaattaaccagcagccacccacacgccctcccataatttggcaccattacccgacaaaattgccaaaagaattgaagcgatggcagctgctgcagccaaacaaagtgcagcacaaatggaacagaatgccacaacaaaatcggacaatgccaaaacggagcagcagcaacagcagcagcagcagaaactgatcggagaggaggcggaaatgatcaaacagttgaaattggccgacttgaagtttgaggatttgaaggtgcatactgttagggcgacattttaaaataaactttgaactgatcagaatccccaatcggcgctgatgaaactgatcagaggcgaacggcgccaaattcaggcacatttggcaatttgcatggatttttagctttggtgtatttttaaaggatgaattggaaaatcgggttctatcggacatttcggaggaaagttcgattcggtccacgatggccaatgaacaccggcaagaagaagaagaggagggggagaaggacagtgacggatcaacgccaaagggaattggaggaaaacaggcaaaaacaaaagcaaacaaaaaccaattagggagattataatgctaattagctaattcgagagattgacctgctgggcttgggttttcctgtggatttatatcaatgctcttttaaaaagttaaacggtttagtaaagccttaaaaattgattttctaaatttttaaattgaaatttgaccctttggcaaacaaacactgccagtgcttttctttgacttccaattgaattttttattgacactgaacatttcacaaaatacagcgcccctgcaaattggaagcgctcggcgcctcgcgcgaggaggaaatgagcacgacgacaaccgctgaacacgagggcccctcctccagcaccgcgactccgctcgcctcgccggcattcactgccgaatcgccacaacagaaacagccggggcaacaccaacagcacttcttcggcgatcacgaagagagtgctgaccaatcggagagatcgaaaaagcgctgggggagggcatttgggacaaaaatcttgaaaattgagcccaatcaaagctgaccattcttagtttaagcgaagaaaactgtggttgagaaatgcattgatcacttaaaagccgatcagtgtaattaaattttatttaaaatgcttttcctatttaaatgagttttttaggctttgcctcctgaagtgttggatgagagtgagcatcagttcagcagtgaaaatttgccgctgaatgtgtccgcttttcgcgaagtgccgccctttgccaacggcgccgcgttggacccgcccgaagtggcaaaagccgcgcttggcctcaagtcgggcaaatgctcaccgtgcgaagaacacacaatcagcgtgaagatcagcggcgggcgagtgccgtcgctgcagcgacaggaggaactgacggagagcgcagagccccctaaaacggtggatggcactgatcagcaacagtgggcacattgactgatcaacacattgatttttaaacttgcccacctttcagtgagccaactacgccgattgctgacgaacagcagccaatcgcagcggccaatggtctgatgaacccgctggagccgccgaacggagtgccgctgccgaagacggccgaggagcgcaagcagtacaagccgatgccggacacggagtttgaactgttgatggacgcggtggagcgaatcaaacgcgacaatttggccaagcagcaaaaggtgcgcgtgggatcgaattgactgcgcattcaaatgatttacagaagagcccgcacctgggtgaagagttggacgaattggagaagtaccggccgcaggacagcgcctgccgcgagttcgagctggaggtgcagcgtcagaagccgctgtacgacgcggacttcgcgtgggagtctcgctaccaaattgggcccgacactctgctgatcccaacgcgtggggcgcgcttcaatgcgcgtgtgcgcgactaccggcgtgagttgtggggcgacagcgcgccgttcgtctcgttcggcgtgctcggcgcgcgcaaccaggagatcacggtgcgcgagcgacgtcgctacaccgacctgatcagaggtgaccgatcagcaagcagaacataaaaggataatgtgtttttttaattaattttatattacagtgtatcagggttcggtttcgtccttgaatggcaaggacatcttggaaattaggccgtctcatttgtgaatttgaaaatatccttgaattcaagacggcttgaaaatgaaaatattgataaaatttattctggcgaaaaatataaaccatttggataaaatttaatcatttttcatcgcatatgataaaatttttaagtgtccttgaatttaatggaatttccccttatgtccttggaaaccggtatacccgtccttggaaagggaagtttattcgatccgaaccctgcagtatctgatcaaaagatcaaataaaagaagaaaaacaataaattactagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagaaaattccttaacaaaaatgcaataaaatcaaaaaatacacccctaagaatttgaaaatttttcccaaaaatttatttgtttttttatgtaacaaaatttttaatttaaaatgtcaatattttctaagaacatattaaaaatatttaaattattcgtttacaaagaaatagaaccaaaattttccccttttgtttgcttttttccactaaaaatcgttaataaaaaattttatttacctattttggtacctattttggaatttttgtacctatttaagtacctattctgggatttttcttacctaaaaatcgcatccctaccgatcacttttgagtggaggaaatgatttgcttgcttgtttggcacacatttcaaatttgtggcattttgatgcacattagtgccgcatcaaatgggccaatcctttatttgacaaggttaaaattcaaaaatttatattaatttcatattttatgaccctttttagctccgaatatcgcgatgctttccaaaaggaattctcttttttattcaaattgatctgtaaatgctcttccgcttcagttgctcctaatcactgatgaaagaaacaagccaaaggatttgagaaatgtgttgaaatttcatttaaattaatttttaagaatttcggtgcatttgtaataaatttatttccgttttgtgtagaatttcttctcccgaagagcgaatattgaaaggtgggaaatgaactctgttcaacatattttgtcatgtgaaaagtcgaaaaatagctgcaataagtccaaattttatagcatgttaacttttgacgtgagtagagaatttttgtaaatattcaaaagtgagcaaaatttctgaatttgcaggaaagtacgccaaaaatcaaggcatttttgtgaaagtttcaattgaaatttagaaaagtgagtgccaaattcatgtaaatataattttttcctcgattctcaattctctaaaagtaggaaaacactcttttttttgtgttttcgaactaaagttggcatgggatttttctttatatatttttacaattttccagatttttttacatattacatatgtatgtacaatttatatatatattttggattttttcgcatctttttgtacatattttcatttttaacatattttgagaaaatttatagaaatttattgtgaaaaatgtaaaaatttttcaaaattatacctctaaaaatagg

SEQ ID NO: 9931 - DNA, 967 bp, Heterodera glycines
aagtgaacgaacagtggtgaaacggaaacaaacggagaaggaattgctaatgctaatgagcttaaaagcaaaaataggcatttatgatttcaaatcaaaaaatattaaaatataaaaatgaattttcccaaaaatagtatttaaaaaaatatagtcgtgtagtcgtggtcatatacaatatttagcattacttgcttttcgttaaactgattggtaaataaatgatggacaaattctccttggtcccggcagtatggaggggacccacccaggagcgccatgtagaacataagaaaaactcgcccaatgagactcgaacccatggccttaccgtactatggaatgctctaaccgactgctgagctataggcgtttcctctaaagttctccccaattccttatcccactttctcctacactccgctcatcacagacgactaaatccacggctgcaacaattgattttctaagttatctcttctctcgtcacgaaactgagacgtcggtgtcaaataatggaatacgatttcgagctcagaattttccaaattcattgtaataatgggatcacatatttatttcggaacggacaggtagaacattttgttgatacatttttgatccaatacataatgattcgctcccggcccgggttcaaaattcccaataaattattcgaaagctttacatgttcagaactctttctaggctattgcttggcgattagacacgtgtccagacatttacgccccggacatttgcgcctagctccaaaattcaagcgctgatagcttaaacacctttaaaattaagaaacatggacttttgattattagaaacaataattctgttgttgaaaaatttattattttttcaaaaatttgctgacgataaaataattgcattcctacgtaattcgccctactaatatcacattcgcgtatgttttttaggtttctttgttttc

SEQ ID NO: 9932 - DNA, 2221 bp, Heterodera glycines
  misc_feature (18)..(18): n is a, c, g, or t
atttaattttcagatttncattcggcaaattcccaaaaatcgtaaagaaatccgcaaaatcggattctgacgttaaggatagtttttcactgtgcgtatgaattgtcttattatccgaattagttggtatcaattcgaattgctttatcgttcatttttagggactttgccaataatggcggaggtaatctcgactttctgtgcctaagagatttgttgttggagcaccaaaactctttgaccaattgcgagtttattttggtgttggatgttacccattacaaatgggtgagtttcatgtaaattaaaatgatgagcaaataaatcttcagattcctgcttccttcgttctcccttgtcccgttcatttcgtagccctttctgacacttcgaactgtgcctcttcctctcttttgtccgaattttctgctatttctcactcttccaatttccaagaacaaagtgccaaaatttcgccattggttctctgccgagatgaagacgctcttcctctcgccaaaaaattggctgggctgccgcgacttgaccactcggcgaccatttttgtcgccccctctcttaaaataaatgtaaaaaatgaatttattacacgttttatctcatctttgtttgttaggtccatctgactccaaatctccacaaaaatggcatttattcgtttgaaggacaagtcatcaaaaggataagcgccttcccccgccccgcaaatcattcgttccgacttttgggcttctccaaaagtgactgtctcatcagcattccctcttcctccctttgtcacatcataaaaccctctgatggtccgttggttgtttacttttacaattttttttcccttcagagggcgtctcattctctgaaaattcggacagtttccatttgtttgccgaggttctcggctcagaaaatcaaattgccattctgagggatgagcaaacggatgaagaatttgtgcttaaaccatacaggttttgatcaaatgcaaatgaaacatgcatttattggcactttgcagggacgacccctccaaacggtggatgctttgcctccaattgttgccaagtgcgacgataaaatggcaaacagtcagccaacaacaacagagcccggccaaaggtgggtgaaaaatatgaaacccaggcaaaaggggaagttaacagcgacatttctgggaaaataaaccgatgtatttttgaacctattactttctcccccccccccccaatcgtaaagtgttgattttataggtttgaatggatatcattttgtttcagttgaatttcccgaagtcagttataagcaaagtgcgtcgactagaatttattggacggatcagcacggcattcagtcggatgtgcagagattgcaacgattacttaaaaggaccgacagatcggaacagttcaggcaggtaattccaacagtttatttcaatgacattcgcaaaatcccaggaattgagaagaattgcgacttatgcaaccgcgttgggttaccataattttgcgagtgtttttgcggaagtgatcgaacgaagggtcggaggtatccccgaagagaaccgagtgacgctgcagacggcggccaaagtgctcaggtggggcggggaggagatgctttggtggtcggttacatggcttggtacttatttggtttagggggacttttaacacacatttttaaattgcctataaattcaatcatggaaattttaactaatattcatgacttatttattcttctgcaaaatcctgacggtgaatttgaagaaattttttttgttaaaaatgtatgttctaagtaccccctaaactaaataagtacccatggcttttgtggcccgaacttttttgcctaattgtaagccaaattgtttttaaaaaataatttttcagtcccatatatggcataaaaaccattaaagccgagaatgaaaaatttgaacaatgctattgggttgaaacattaattgggactggttttggacatcataaatgtgcaaggtgtggctcgacacacccccacccccctcgttcgtcgtaaggggggcggctgtaaaaaagggagggggtcgtaacgaaagggggcagggggaatttaaaatttgcaacaatttccttggcgaattaatacaaaatcaaaggttttttcccggccgtctaccggcaccgcggaaccgcaagtggttagcaaaaaaaaa

SEQ ID NO: 9933 - DNA, 2060 bp, Heterodera glycines
tttctttggacagggaaggcggcttcaagcagttaatgcaattgaaataacggctgaatgaaagttttggagttaaagaatcgtataaatatagacaccgacagtgcatattccgtgtctaaaatttaaacataatttttttaaattagaaatacttgttaattgcttttaaataaatgtatggctaattgtttagttagtaaaagttttgatttgaatggcgacggatattttattccaaatttaaaataaacgacccttaaagaaattatttgatttgtttatcaattttccccggtttgaacccgctcaaaaaccgccgtagaatttttcttttactttttctatcgttttgcgcttaattaatcttgcaaaagtgctttcatgtgtttggctctattcttatgatccgttttcaggctaatcagctcttttattttaataaagtatactggtggtaattcatttattttaaaagacaaataatcgaatgaaagagaaataatgccatctaagaaaccattagctgattagggcccatctttgtctgtcaaaaaatattgccgctaatacaaaaacaaacatcgaaaaagtgatgcccaattttgaagttaataatggaggcgaagaacagctgaagagggaagtgagaagagtattactataatttctttgtcttttaatcgaatgattcgttatcaattcaaaaatgttcgccccttacgtttggttcggaatgcatttccggtcgcacacctcgcctttccatccctccgcacattggcatctgaaagagcgttcctttcgatcggtctgaccaatcagatctgtcccttcctctgaccttccccccaccaattctccattttggcaggacaccaccgtctcgcagttggtgccctcgtaattgtcagcacagcgacagtgctcccccgaattgcgccaccgtctttcattctctgcgaatgagtccaaaattaggcaaaagagagggacgggggagagaatgtttgttttgttttgtttcaatggatttaatcactcgcctctctctgccattctccaacatgccaatcgttcgcagaagcgaccgtcccatggcgccttgcaaatgcattcgatatgtttggagccgagtgccaattctccctcgtgttggcaattgttgggggtgcaactgatgggaaaggggcaattgttcggcacgggagggggggggggggagggactcacacgcccatataaaaggaatggttggctggacagccgatgtaatctgaaaggacaatcgctgatctctgcgcgcctttgtctgcccaccgttgcaaatcggccccttccaatgctctttacactcgcatttgcccttttcctcgttgaaatgtccatgtacttcaaaaagcctttgggtattataatcagaccatctcccgaccaacccttgaggtgtttgcatttgtatcgctcgtaatggctttcctcttcactggcactttgctcgtcgccctcaagccaaacttggcatttctcaagcccaccgccaacaaaaccgtattctataaatcgagaaatgtcaaagccaaccaaacgtgtttctcgggttgaaccttttgccgggtcccccgtccccggaagtacgcctttggcgtggtcgcacccctggggaatattccgtaggggaatcagtcgttgatactcatcgtcgatttctttattacgaacagcggtggcaaagggcaattgaaaacagaaaatggacaaaacgacaaaaaaagaaaaggggggaaaagtcagaaatattctcctggacaacgaaggcgaagccgagagaatggagaacattttggaaaccgaagctcgccaaatcaaaggctgagaagaagcgcagaaatcggacatggcgaagaaccgaagggaggcgaaggcgttttgaagtcgatcagacaaggaaagtcattggagcagcaaagagagggcaaacctaagcacagaaagagagagagaattggcgacgaaaggcgggcaaaattcattggcacattattacagacaagcaaggc

SEQ ID NO: 9934 - DNA, 2209 bp, Heterodera glycines
tgtcacagacatttgcggacggacatttgcggacaatttcgggaaaaaacaaaaatattcttaaaaaattttaaaaaaatctcaaaacatggaatggagactgcaaaactaaataaaaatttatttttggcttttaaaggtatcatattttatttttacacttcaaagaattaatttcactggccaaagtgagatgctgttccttaagtgattaaagaagagttgatccccaacactgttcggggaattcgaacgtcgtctgtttcactctgtcgggtgagagtgctttttttatttttagaaaaatatttttttctatttgacgaccaagtttttgaccccccccccccccaacatttaaaatttttttagccttatagataattctcggggaatttgataccagttccccgactttttttcccaaatagtaggggaagaaccatagataactcttgctctcgtgatcaattggatagcatttcgagaccccaaaaattttcggaaaggaaaaccgaaattccatggcacaaaaattacgggaatctgatgttggaaatcgggatttcgtgcagctattgatttttgaatatggacctccaaattgataaaaatgagtactccgggattatttctctaaaatacgacaattattgggttcatttatatcaatttttagccctttctttcttctatcgaatgcattttgtttcagaaaaaatatttgtctttttttaacaaagacattgttgttaaatataggtgccaaagtggggaaaagcacattttttgacccccatgttacaattggtcaaaattggcacttcaagtttaaaatgtgtaaaaccgaacggactaatttacgaactgttaatttgaaatagtgaaagtaaattttgttcatgattaagcatatcttcaaaatatttttttatatctaaaattagaagaaacgttctgatgagtcaaaattttgcattgcatttaaaaaaaaaatttttttataaaaattttttattttttcccgaaattgtccgcaaatgtccgtccgcaaatgtccgtccgcaaatgtcagtccgcaaatgtccgtccgcaaatgtctggacgcgctttattgtaggttttaagcagtcacaacgaaaatgaaattgataaaaggcatacaaaatataaaaataatttttaagaaaaaaaagctgatggagtgcgcttttctcatttttcttttctttctcgaaatgggcctaattcatagccaatgccacaattcatatgaattaaacatttaattcatgctttatttctatcgattatgattaattaccatgcttttttcatttttgaaaatttattctttttttttgtgtagtgtttggattaacattctattagtattaatattcataaatttaatgcaaattttaaaggctaaatggctcaaaatactttacgaaataagaaataatttaaaaaaatataatataaaatacaaatattaattttaagaaaattaatttgtatatgtaaaagtttagtatatttaaaaattattttttaaaatatttatatgaaatattttatattgcttttgttttcctttcctgcggttttggcagtattgccagtgattgaaagttcatctgcaacaattaactctacagaaccttcaaaaaaggaaaagcaaattttaaaaggtaaaaagaaagaaagatttaaaaatatatataaataagtttggctaaaaagtggcaacaaaattttaatggagtttagaattttaaaaataaactgccggtttttttggctattctccaacctcgggaattttctcagctcaaagcttttgtgatagtctctaattaattcataatttttaaaaattgaagatgataaacaaaatatggagaacctcagtgccaacattgtcagcagttccgataacgtataaaattttcttaagaattcgcgaaacttcgaatttttttcagagttccgaaagcgattatgaaacagcaaatgaaagcggttttgcaatttatttaattatatttattatatttttttgtttatagattcgaatgaatcagtagaggtcgatgaatcccaatcagcacaagatgagtattcattgaatattggaggtagtcatggggttacacgggtccctgggggagaacaaccgggtccgggtattgccggtccagaaaag

SEQ ID NO: 9935 - DNA, 2105 bp, Heterodera glycines
atgcggctcacaacaaatgtgaacagtttaaatttgctaacatcgcactgcaaaaatatttgaattattgtgacaaaatgggaaaaagtcgcggtcagtgagaattttgtgtaaatagaaatcaaaatatgaattcattagttgcttctatatgaattagcttttttttttgcaaaaaaattccttgatttacaaaaaatgccacaataaaattataatacaaaaaaaggatgaaatatgtctcatttttatgacacatttattcagtgaaaacaacaacttaaattggatagatattttttgaaatcgaaaaattaaacttcgtacacttcattatttaattggttttcagatgtgcttatgcacttagcactgaagccttcatttttacttttgaacaacacttcagtttttaatcatactagttcaaacttgaaagagattaaaattattttattaaaagcttatatgcgctttaaccaacaacataaaactgcagaagctggacataacagtgatggtgatgaagaaattttgaacaattttgcaaatagagaaaattgtgagaaagtgatgaaattggctgaggaatacaaaaaaagcaaaacattaaaggggtattttttttaatttcataattattaggaatgggtcgcgacattgacaaatccggaatttttttttaccgagactaattcaggttcccggtttatacataaaaatttggcattttttccccaaaataattaccatatctttgctaaaaatcacaaaaacttatattcttagtatcattcgatagctacaaaatttctcaattagtgtctagtccagactttatatcgggacatgtcccggatttctaatgggtttcccaattttttcgatttgtttgccgattttctggtcaaaagtgagatccaggttccagcttggccaaaattttgtctcaacctgcttttaatttattatacttttgctcttaaggaaaggaaaaaaatggcgtaaagctttgaaagaaattcaaaatttgatggaaaacaatggagattattgtacatcatgtgaaattcctacaattgatcaaattcagaagagtaaaaggcagattttcatgaacattccttcgtcaattgttgatgaaacgaaaaaaatgaaacaaaaaattgttaaaaaactcggtagaaataattcaatttttttttcaaaaaagttgatcattttctcataaatagcatatatagattggtatgaattaggttttacgaattaatttataaagcttataaattaagatgagaagattcacaaaactcgaaaaggtataaaaaatatatttgaaaaaaattaaatttaaaataaataatatttgtgtttattatttagttccataatttaggagaaaatgcataaaaggtatgaaagcgggcggaactatgttttgatcaaatccaactttgatgattctttttattactgcatatattttttggaccttactatctgtttttttttatatttttattttcatattttttaattttttcctctatgcataaaaaaggcatgtctaattttttttcaataataatattgaaaataatatttatatagaaaattttttgtttttcattaatccaacaattcaatataatcgatttaaggcacttttcaaataaaaaaatgcgcataatattttgtataatcgtttttacatttttataacagcgcatttttatttttgatgaacttttacaatttaattttcactgttacattaaaattattatttttccgcttaacattatcagttgaaagcagttcgaaaattgatcaagaagggtcgaaaagtgaacagaacaccgaatcgagttccgaaaaagatggtctcattattaattattaaattttaacaaattaaaaaatatataaatacctattttagacttaagcctggcaaattggataaaacggagcccaaaaacaaatacatcagttaagtatttaaatctataaacaagttaattcttaaaattacagtcttcaagatcaaaatctgaagaaataacggtgtttcgtaatcgaaatgtgccaacatcaccatc

SEQ ID NO: 9936 - DNA, 3253 bp, Heterodera glycines
aatttaagagaaaaataaataaaatatgtccattgtaagatacgaccgctctttgcattccgcaacttccaacgctgtgtttgaccacaatccagctgcttttcaaagtcaacctccgcgaccaactcaacagtttaatgtttcgtagaaatagtaagtaaaattttcaaaaaaaagttagcgtaagattgtgcctaaagcattcttgaccatcatccaaattcggatttgccgcccatgttgttggaactgatctcttttttgcgcgttcatggacttaaaactgaaggtatttttcggcgttatgctcccgtgaccaatatcaaagaattgcagcatcgtataaatatgggtcagtggcatagaaatctatttgttttttagctttttatttgagttttcttaggtgagtcaattgacttttccaacgatttaatgttccacggagacatccaaagcagcgttacccatgctgccgttctttttaaaacattccttcgttcactcggcgagccattaatcacaaacaaattgtacccggaactcacattgttgaacggtgggcacaatttagccagaaacaactgaatttagtctaaacaatttaatatttcttatctaattaggaatcgaaaaaatcaaccgcactgatgaaattcgtcgttttgtgcataaattgccaccagaaaattatttactactgttaaaagttatcgaatttctcgtggaagtggcgcagcacagtcaccaaaatttaatggatgccaataatttgagtgtcgtttttggtccaaatttgacatggccgactgatcaacaggttaaaagagaatggttcaaatagtgatacattatttttttacatttaggttccgatggtccaattgaacaatttgaacagcttctgttattcgttaataaaagattttgacgagatttttgtagataaaattaattgattgtttaatttcaactgcattatacttttttctcatattccattttaaagctgacaaatgaatgcgccattccctttgatataataaacgcgtcgtcggccgacgcgtgccctttttttcccttgccctcacacattctctgcctgtctcttgtttctttttctctctttctttctctctctcttctttttctctcttcttttcatttaaaaatttaagggaaaagcgtacgcatttattgccagggcataaagaaagcgtacgcagcaaccgaaaaagaggaaaatgttccttttgtggcaaaggcagttagtaaaaatattcgcttcaatggccaaaaatgaccgaatttcaaacaaatgagtgattgaggatgcttttccttgcttggtccctcttccatttcgccgttcgcttcggtcgtcgccatcggttaatcgcctcgctcaacgaatttttttctgcatcaacgccagccactgtacgccaacgtcgccatgaaagtttgaggaatgaccgttttggaaggccaatattcggtagaaatacatcgtcaccttaccgtagcatttgttgtcgctctaaaagacctttctcaccgtgccagaagacttttcagtgagttaattgaatttatccttccggtaaattaggtaattagaatttattgcaattttaagcgtcgctaatacgacgataaaacgcgtccccagtgagccgactttgcccacaaaaaacagttacaaaaatgtgcgcaaaatttacagcgatgaacaaagggaaattgttgtatttgatggggaagaggagaagcaggtgaaaggaaaggaaaataattaaaaataacacttacatatatatttcaatatcacaaatgaaatcacccaattcattcattttttagtcgtcgttttgctcttccgaacggtccgagccgactttgccttacgcaaattttcagttaaattctgttcaaattcatgcgaattgtgtgtgtttttctgcaaagacttcttccattgttccaccttctcatttgttcattcgacagatgcattcgaattgcaattttgtgggttaataagttacattaatccaaaattgatcatttttagctcgactcatttgcccttttcattgctcaccatcggaccaatccctccctccgtctttacacggctccaatttcgacattttttgatttggttttctgttggagtgaaggcaccctttttgaacgggaaacggacaagcaaattgaagaaatcagaagtaagtttagtcattttcagtctcagcgactctaaaatcataattttccgggtgagtcgcaatttgcaatattccaaaatttcagagcggaatttttaactttttatattaaacactattgttatttactttcaattccctttcagcttttcctccttcctttgcttccaatgctcaaaaacccttccttttttgccctccaaaaagacgtctttgcgcttctcttccttctcggcctccgtctttgcttgaactgatgtttttacaagaatccacctctgctgaagagaaaatgaaaattttaaggaaaggagaagggcgttttggaggaaataattgcggaagagaacggtgctttatccgtagttttaatataacagaaataagggttcatgattaatttcagtccattttcccgtttctcaacaacgtttttacccatgggcgatttgccagtgccaatgcttccaaattatctgaaacgaatgcggcgacgaaaatgcaaaagtggcggaagtgaaatgccttcaaactctgaaattgctacagaccatttttttgacccaacatctgcttcattgaggcgatttaattaaaaaaccaaaaaatatataaagttttttttataatttagtgatgtgtcttctttatcaatgtcatcgaatggagaaagtgacgtgactctaccgtcgaagggagcgttttgtcacgtgatggaaaaaggtgcgttcggagcggatgaaagggaaaagtgttttggcgatgacaaatccattcattgatcttgcatcgttcctacgactttgaggagggattaacgcttcgttcggtgcctttttccctatttttgtcacttttcccccaatctcccatacacgtcatgctttgctcctccatttcccactatttttggtgtcgtgtttaatcaataattccgtttcgatccgtcccaatttaatcccccccccctctccccctctccctctctctatcttcctctctctctccctccctctctctct

SEQ ID NO: 9937 - DNA, 3858 bp, Heterodera glycines
aacataaccctaaaagacgaaactccgactgtcaattgttcgtttctgtcaatgaactcgaagacactgaaattttcttcacttggccattctcaactctctcgaagtatggtaaaattcttttccgtttttactgactttggtcctcccttggcggaatgtcaatttttcctttgtttatttaattagccattcaaaaatttccagccgattttatggatttttttttgtaaataacttagtccataaaatttagaaaaaatcgccagaaaaactattcaaaaaattttttttcttgatttctctataaaaactttctaatttttctgattaatttctaacaataagataatttcctttttaatttttcggaggggagggcgaactgctcccgggttcatttggcaccttcctttcataaaatttgtatactttcattggtccatcagttcggttccaataaatctcccatttccgatttatcttttgtctcttctctctttcctttaggcacttctctgattccgtcttcgcccgtctgttctcttcgcgcttccgcagatgcaatgcgtcgacgttcactaaggcatggcaacagacagtgccttggattttggcacattttgtctttagcattttgtgcttttttctgtttgctaatcgctcttaccttccttcagtccgttgactttgtccttgttgctaaattatggtggtcatgaacattcgctgggtgttggccctgtcgctcccgcggccgccacccttttcacggccgacccgcactttcccggcaaattgccccaccggcgtgctcagagtgtccctcgtcgcagtttcgtctccgttttttcttgcaacggcaattgttctgatgatgccaaacgacaaagtgataagtcgttggatggcgctgtttcagacgcaacttctcatggcaatcattcgccgtttgccggtggcaatcggccgcgacaaaaaccgccatcggtgaacattgaatgatacagaatgcctttgctactcaatcagtgtttcttaactcaacttttgtccttttttggcattcttaagctgatggtttactgcggggatgacaaagttttgttcgacggaattcgggcagcactgcgacggattgtgcccaccgacacttacaccgtctcggcactgtccaccaaagcgcttctcgcccacccgtggatggattcatgcgctgtgtgtcatttgcatttcagagatcactgcagttttcaatttggacaaattcccttttagtgtttgatcattgcggacacttctcggctggacagtgcgtcgtggactcggctgcaaatatattttgtcaatgtataaaaaaaggatgagtaaagtctatttctaatgagttcatttcccaatttcagtcgggcaaaattttgttcgtatgtgagaattcgctgctcgccagcctgaccagcagcagttcccagcgggaacagtcgactctgctcaaaaacgcattcggcaacaaagcggtcacggccaccatgggcaaggagttcggcaactttttgaaacggtccctcaaaggattagccaagaatgggcaggtcattacttccgcatcatggattctgttataattcttaaaatgaataggtaaatgaaatattttatgcccgcgacgccgttggggacacgcgattctctgtagtcctccacaaaaagaaaggtcggaatgtttggcttaacaattgctacacaacagtgcttttcaacgtcttcccttttccaactctttcagaccagcctttgctgttgtacatgcagaatttgggccaacgtgccagtgccctcttctccgacgccaccaccgaacaattgctgagtgccggcgacggggctttggtccgcgacgcccttcaccgccttggccttaaagacattccacaaaaagcattgccatcggacgaaattgggctgcctctactttcgtccggttatttggttgctgcaagagacttgaccattttggacattccggtgggaaattttaaagtatttttatccaaatttcgagaaaaacttcgacgatttttctcccttcgaaatcgcttattttgtctgtcatttcagtgtcgcgcctttactcgttgacaatttttcagggaatgacttacggcaaagtgttgggttatgcagggccatcactcatttttcatcgatctgatcaccaaccatcgcttaaccaagacaacaacaatgacgatcaaaatgtcccttctgaccaattgctaccggtcgaagtgcgccgaagacgggacggactcccggagacaacgcaacagcatcggttcgaagttgaaccgttcttccaacagttggccacaaaaagacttggccaagtgttgctttatgtgcccgtttgtggtacaacgatggaagtggcaaaaaggttctaattttgttggttctattttgaattaactctttaattaacgggtcctagcctttcgcatgcttttccactctttgacggcattttggttgttgcgggcattcaattggctggtaaaggtgagtgtttttacttttttatcgaaagcctgcttcaattatatttttaaggacgtgctgggaatgactggattagccccgcgggctgtgcttcgttctccttcaactttaacatcccttgcgactcgaatttgggccgttccatttgttttttgcagcatatcaccgccgtttccgtggccagcgctgtttcaaaattattaaaggatgaaattccggttaattatcattagaatgattgaattggttcaccgaatcacaacttttaggattttcctatccgattgaaatggcccaacgacatttactacgaacgttcgtacaaattgggcggtttggttgtgcaagtgtctcactgtggccccaattattgctgcaccgtcggtgtcggactgaacgtggcgaatgcgaagccgaccatttgcatcaacgacatgttgccgatgcactcaaatcgacagctaacggtggaagaagtgttggcagggacaatgaacgaattcgaatgtgagagattcacaaaccaatccccttgcaattgttttttttatttgcagattttgtcaatgttttcgagaaaaaagggagggccgagtttttgaagtcgtactaccgattttggatgcattcgcacgaggaggtgcaggttttgcacactgaaaacggcggacgccgtgaaaaggtcgttatccgagggttggacgagtacggctatttggaagtgcggagcaaagagacaggccaaataatgaacgtgatggacgatggtaatggaaatccgtgaaacttcaacaccaaaatttgccctttttcaggaaacactttcgatttattccacgggctaatagtgccaaagtgaaagcatagacaaatgatgattcacaagagagcatcaattatctcaaaaattgtgatacgcactgacgaagcataactcaaccgacttaaataatttggacattgttgaaatttcaaatgaaggcttttcgatcccatcgatctcttctgccatatttgaatggcaaaattcctattttctctacggggttattatttgttgttaattttgttgaaataaataattttctcgaagtttatcgttggaagaatgcttaataaatggatgtgattgatgatgatgatgagatcggtctgttcgttcggtcatcagttccaattgaaatgtccggacatcaaattgttagggtccgccgagttcgaaaaggaatccgacgacggaaggccaatggcatccgttgacggaccaagcgatcgtttgccgaaactgacaaaattaag

SEQ ID NO: 9938 - DNA, 5555 bp, Heterodera glycines
  misc_feature (50)..(50): n is a, c, g, or t
  misc_feature (61)..(61): n is a, c, g, or t
  misc_feature (66)..(66): n is a, c, g, or t
tgctccgctcgggttgtgttgctgctcgtcctgctccctttaagcgtcgncccccggccgntccgntgcggaactttgcctttcgccggccgcaacgattgttccgcctcagaagcgttcttcggacgtgccgtcttcgtcgtttttcctcttttaattcccccccccccctcagcgtgccttcccggcactccgcgcagttgccccggcacatgtccacccggttgtcgctgtacggtggacagttgttgctacccaagctcaaacccaggcccaaacccttctcctccggtgccacaaccccaaacaaatgtcggcaacggtggtttcaacatggtcaatttggcactgctgatgcttctgtttcggcaaagatcgcttagcattccttccgggggttacggcgcatcggcggcattctcttgtcaggacacggcatggaattgttgtgagctgccccttttttatatgtccttggtttataaaaggtttaaagccgtttttgcgcctccccctttaaatttggccattcttttttctcttaacctcccctttttccagttcagttcgcccccatgtgcgcctattctttgcgtatggtttacttatgcccccgcacttgcggcttatgcccatcgctcggcttcggcacggcaatgttcggcaacggaatgcaaacgcaaattgcactagcaaatgcattgggaagcagcgcaattggaaagaaatgatcagagaaaaggaaggaaaagccaaagccaaacacaacgccaaaaagcacccattagccgatgaaataatttaaaataaattaggcccctcttttgaaagttggagaaaattttgggaaatttcttctgtaagggaacatgaagcagacggatcatttgacaagaaaaagaatccccccgaacagtttcatcaatcgaaaatgacgatcagtgccaaaaaaagaaacgaacgaatcaccggagggaaaaataaaaataaattaaaaaaggaatttgcattattaactacagcacacagtgccattgtgctcacaatttggcctttgtagaaaaaagctgagcatataacacagcacaaaaagcaaatacaatggggggaggaaaagcttccgatggaaaggcgacacccccgggggccttttgtcgcctcccccgttttacccgtcagtgttgctcttctatcccccccctctctttctctctctcttcctctctgtctctctcttccccatccgctttatcccccccccctctatttttatccctctaatttttgtcatcgttttccctttttgttttgtttgactctcccccggcttcaattcccccaaattccatgttttcgtctccgttctctcctccgattttgtcggtgtcccctttcaaattgtttcctcttctgcttgtgcccttctttcctctgcttcttcctctctcttttctcctcctcccttctccctctttctgtggcacttccctttgcccctccggccaatttcgtttcggccgtatgtttttttttcattttttaattactcattctctccttcgcctttttcagcttgcatcggtgaccaatgtcctccgacttgtcccggcgtttgcacatgcgtcggcagaagggactgctgcacagatcgaaacgccggcggaggcggcgatggcattgccgtcgacttaatatccggcggagggtttgagtttgtttttggcactcttttttccctttggcattttccctttggcattctcttttttgcatttaattttggcacttatttatttttggcattcttttttccagcgcctctctgccccgtcttctgttggcacttctgctcggcaccggtcggcccggccttccctccctccaattggctttgtgccgtgacaatgccctcaactgtccgttgtttttgtcctactgccaacttccgcctttctctctttgcatgtattggccttactttgccatttccattttcccctttttctctgatttcccccctttttcggcgcattcattgcaccgccacttgcggaggctgtggcgatgactcattggggctgttgttggcacaattattattcggaggttggagtcgagaacggggaatgccattggaattgggtcgagactaatcggagaataattagccgcaaatgcgtcagtaatacagtattatgaaaaaagcttctgtagaattagtattgtagtacaaaagtcaatattgtataagaaccaggaatgttgcaaagagaaaaataaaaagcgaaagcaaaaaggcgaaagcgaaatgtccaaaaaaagcgaaaaaccgaaaaggcgaaattttttccaaaaaattcctctggtgattgtgagacaaatgtaaggatcgattaattttcataataataattttatttgctttaattttttatttcttttttatcgtagatttttgtatagaaataattataaaacgcatattgctttttttgaaaattactgtttattttttcctttaataattaaaaaatttattctattaattaaagtattattgtggcaaaaaggaaattttttgagaaattacctttcaaaaaataaattatataaatagaaatagtggattttattcaaaacgatcaaaaatttcttattatctttttttttgtatttaaaacatcttttttttcgcgttgcgctttttctaaagacttttcggagaaatgggtccggtggtgccgataggcgccgccgggaaaaattttgaaaatttggatggatctcttcacagatttgtccaaaaaattatagatttttacaattttgagagaactttttttttgaataagatttacgaatttttgggcccgacgatgccggtagttagcgccaggcgaatttaaaaaaataaaaataaataaattaaaaagaaacagtcaaccggcatcgaactcatgacagaaagtaatgtcaaggttgatgcaccaaccaatacaccacactacactttttatttaataaaaatttgtgtaaaaagattaaaaaattcaaaattttgtgttaattttttgctttttctcccacgaaaatgccattgtttattttaaaaacccaatctttaggggtgtacttttttttcgcttttcagccaaaaagcgaaaaggcgaaacttgcaacatccccgataagaacctctttctgaattagtcaattcattttttaaaaggttcaaatacttaaataattttggaaaattacccaatccataaaataaacatactgtaatgtaattggtttattgtaagtttctttccattatttaataccgtaaatagaaaaaagaagtcccttgagaattcagcagaaaaggccggcaaagggtttaaaacttttttaggccttaccgtgtcgacaactttggcaccgccgttggcaccgggacaattagcaattcgcgacaaaatgccaagaattcgcgaaatccaaggagaaccgccaaaggcagaaacaattcacaaaaaaggcacaacaacaacaacaacgacaaaatgccctgctggggaaaaccttaatggcacaacaaaaaacgaaaatgtgatgacaaaaaggccacagaaagcagccgtaattcaccgaaaaaaaagtggcggcacgcggcgaaagacggcacggagaaaaacgacggcacaaatgacgacaacgaagagaacgacgacgacgacggcacatccgccggtggtggtacaaccgatgccccaacaattcgcagttccgccgggattggcaattccgaaacagcagcagcaactgatcaggacattgatcgggaggagcagagagggacaaaacattttgatgagggaaagggacaaattggtggccatgctaatgagacgattcatggggggatgagaagggaagggcagggagaaaacaggacaaaagcaaggacagttgaccaaggacaaaaaaggacagaactcaaaacaaaattaagggaaaagaattaaacaaaaaatgatcgccaatttcaaatgattggaaatggaggcggaaagaatttaaatttggggaaaattggcacacgaaaaattaggctttgaaaaaaatatctgtgctaaactgtttgaatattttattttgtacatattatactatgctttgattaaaatgaaattcatttgacagaagggggcaaagacccgaaaaaggacattagaaaatggaaaatgaggagggcactttttgtgatgccataaaactgacaaacgaactcccccaaataatggcggagatagctcagatcagtcaattgtctctggtcctccattactgtagatcataataaagtcacattgagtcatactgtagtaacatgtcctctaattcattttctattgaattgactaattaaaaaggcttttctctcccatttatttaataatattcataaattgcgtcttcattttgagcttcgtttcgctgttcatgtgctccttctccgtctcctccttctgctgctgttagcgttgaataccctcgcgcttttccttttttctttttcctccgttggcatttgccccgaggcgcagacgggcgaaaacacatagcaattcatgtcatggacagccatcagactgaaaattatggccaaattttggcacaaaagatgaccaaaattggcagagtcagcgcaaattaaaactcaccaaaattcgtcagtgtgcgcaatataactgaagaagccggtgccgcaaatgacattatagaaagtgccgaactgctgctccgcctgctgctgcagccgccgcttggacttttcgacattggacggcacaacactctgagcaaaatgtacaaagtgggaggatggcatttttaaattgaaaatggccagaagtctcggctaggccatgtcctttaattgaattttgagtgcgtgccgtaccctttggatcagtgatctgagtcgtgccgaattgcacatttcccggttttcgtcaaacaaacgattgtgcgtcgttccgtcagtctcttcgggtgatgattcaaaaaagatgcccgtttgaggggttttgagcactgccgccgtcggctgttctctccgccctgacaaaaatgccatctccgtcttttggcaccccgcggggacgcggggaaagggacgccccccggcggaaaataaagcggcaagaggcggagatggtcggtcacgcagacaaggcagacgaaggaagttgggctgtcaaaagggggagaagtgaatgaggctcccggacaatcggacagtggacaatccgacagtaaattacactaaaagatagtaaaatgccgtcgccgaaggggaccgattgtgccgtatcaacaaaaaaggaaaataggcaaataaattgatgagtttttgtaataaccctaaaaatcaaacgatatgaatgtgcgattaatactgtaagggtgtggaaagtcattcaacagccaatttcgttttcttcttacaccattaagcacttttgtcaaagaaatgtaagaaagtaggcattggaattttattg

SEQ ID NO: 9939 - DNA, 1456 bp, Heterodera glycines
ttttgccgataagctgatcggcaactgctgaactgttctcgcccccactgttcgctttgctttcgcgcgacttttctttccgtcccgctttcaaaattttgtacctaaaaaaggctttcctaatagccaattaattaattatgcaattaactaattacattcgtctccgccattcgccgattatttcggcggtcgttctgctgtctcatttgttgtttttgttgtccttatttgttttctgctgctgttcactgtcgctgcttggaaattcgtttttcgattctgtcggtttttgtttttgttggtggtaacggcggtcggaaagcggcgtttctttttttgagaggagaaattgcggaaagggcaattaaatgaattaattaaacacctcgggggagaatttgttgaaaatttgcggcagcgattggcgacggcggcggcggacaaattgggggagagacgggggaaaaaagagagacggacaaaggcgagaagggcacggaagacggagacggacggaacaacgcgaggagtccgaaagtgtgcagtatagcaaaatttggcattatatgagacggggaccaagggatggggaggggcgggggcgaggggagaaagtgccaatcggacatacagggggaaaggggcgggggagagtgccaaattggcactgccaatcgggcattaatcagggaggaaagggggagagggcggcagagggaccaatgaaatgcccgacgaatccaaccgaattcctttccctaatcgaagtgccaaaagactaactcgacaaagggtcgcctgcgggcgtttccttggcaaattccgttggcattttgctgctgctgatcacctattaattaatttgatggtttgtacactcattttgtctctctctgtccttcttttcccattttctcacctccgtccgcgcccccaacgattccatcggtccttcggccgccctttcgccttggcccgaatatctgttcaaattggccagcagttgccctttcagtccttcgccctgtggcatttcggcaaagcattggccgcaaattgtggccaaaagtgccgaggaaaaaaggaaaaaacaaaaaatatgacgacggagggacaaaaaaacgacgaacatttttagaaaggcacggaaaattattaactgacaaataagctaagggaaataaaagtgaaaagagtcaaaatttgcgaagccccggggcgatcaattcgcacagcgatcagaagacgattttgaagggaatgatcagaagggattcattctctgatcaattcccccgccgcccctcctcaaacttgacaatattcccacatgaaaccggcggaattatgcatcaaatgcacgcggacaggtcacaaactgtgaaacgaaacaaacgaaatatcgcccacagttcgacacttctccaacttttgagtctctcccacttgaggg

SEQ ID NO: 9940 - DNA, 1433 bp, Heterodera glycines
caaacgacaaacgacataattttttgtcgtaatgacaatttcggagacaaatgccaaatttgtcgtttatcgtccgttttgtcgtttgtcgttcgtaattgtgattggccccaggccgtttgcatacgaacccatgttttttgactataactttttttctttgtcaaccaaatccaacgatcttggtatcattcgagagcccttcagcagtcgactgatttggtcaagcaaaccatggttttcttggactgaattgaacagaaggtttttgtccaaatttgatgacattacgatcggagttcgaattggaaaaaaaaaatccaaagtgatgtttaaaataaggaaaaatttattaggtaaatataaaaacaggtaaaattcttatgtcgctgtgcccaagcagattctgttagttttagtgccaccgttttcggaccaaattttcgagtttcgcacttttggctcaaaagcgatttaaacacaaggaaacgcctgaaagctaccaattttgcaataaaagataatttaggtaaaccgtttttagacggaatgaaagcttttgtttgtatttcttggttgcttaaataatacatacattaaaggattttttacaaatatgcttttttcccacaagaaaaaataatgaaatgatccaaaacagcgggggaaaattgtgtaaaaaggaggggacggtgaacagaaggaacatcattagtactgtaattagcgcaagcttaaattcattatgaataacaacctcttctcaaacggattcacacgcctaaaatcgaatttttgaattcacccccggggccgaagaagtcaagggtcggtccgcccttgagggataatcgaaaaaagaaaatttgctgaacatctttcaaattccgaagaaaatcttgctgaacgtattaaaaattttgcaggctttgcttatacataattttgacactccaacaacttcaagggctcaaaagacattcaaacaaaagcaaaaagtttttaatcattaaaaatctgatacaattaacattccaactcaacatgttccaatccgaaggtcgtattgtctacataattgttaatgttctctcacttagagacgcgcgggatgaaatccgtgcagattttacaggttctaagtccgcatttttttgaattggggatttttctcgcgagatccactcccgcaaaaaaaattgagttcaaaatctcgcagcgaaatccacaaatttgattttttgtgctggatcccgagggattccattgaatttgagcaacttgggcataccatccgaacgaggcgtgactttcatcgggcggaaattcggggagaatgccgtcatcgaaagagaaacaacgaagtgatggacaattgctgagcaatgacggggccaattggcgcaaacggcgaaaaatgatggtgttcaaaa

SEQ ID NO: 9941 - DNA, 1595 bp, Heterodera glycines
agaagaagtcaactgcggcgtcaacataggcatcggaggaagaggcgcagaagaagaccacgacgactacatccgattcgacgaaaggaaagaaggaagagaagcccaccagaacatccgagacggacacggcagcgcagaagaagccaactgtgacgtcatcaaaggcatcggaggaagaggcgcagaaagaagaccacgacgactacatccgatccgacgaaaggaaagaaggaagagaagccggccaaaacatccgagacggacaaggcagcgcagaagaagaccacgacgactacatccgatgcgatgaaaggaaagaaggaagagaagccggccaaaacatccgaaagaaggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgaagcgacgaaaggaaagaaggaagagaagcccgccaaaacatccgagacggacaaggcagcgcagaagaagaccacgacgactacatccgatccgacgaaaggaaagaaggaagagaagccggccaaaacatccgagacggacaaggcagcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacgcggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgcggcagcgcagaagaagccaactgtgacgtcaacaaaggcatcggaggaagaggcgcagaagaagaccacgacgactacatccgatccgacgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgaggcagcgcagaagaagacaactgtgacgtcatcaaaggcatcggaggaagaggcgcagaagaagaccacgacgactacatccgatgcgacgaaaggaaagaaggaagagaagccggcccaaacatccgagacggac

SEQ ID NO: 9942 - DNA, 1861 bp, Heterodera glycines
acatacatatgatcatttttggacaaaatctgataagaaacgaccaaacattttcaaaaatttatcgaatagcaatttgaaaaaatgatgcgcattatgaaaaattgtccttttatattagagttgtgagcaatctcctaaaacaaaatttcatcaccatttcctggctataaaagagccaattttctgtttttttttattattctcacatatcttatcttggcgacactattgcctattctttactatggtggctttcaccattattcctcatctgctgctcttcactgtcttcatgtccatcatcctggtgatcctctctcaatgttgcggctgtacgccttcaaagaagaagcaaactgcgacgtcaacgaaggcagcgaaggacgaagcgcataagaagaccacgacgactacatccgaagcgatgaaaggaaagaaggaagagaagccggccaaaacatccgagacggacaaggcagcgcagaagaagaccacgacgactacatccgaagcgatgaaaggaaagaaggaagagaagccggccaaaacatccgagacggacaaggcagcgcagaagaagaccacgacgactacatccgaagcgatgaaaggaaagaaggaagagaagccggccaaaacatccgagacggacaaggcagcgcagaagaagccaactgtgacgtcaacaaaggcatcggaggaagaggcgcagaagaagaccacgacgactacatccgatccgacgaaaggaaagaaggaagagaagcccgccaaaacatccgagacggacgcggcagtggagacggacgaacggagcaaatactttaagaagatgtgataaacccaccgtatatgtgatccgtattgtatatatattgtgttgtattgtacataattccaccgtaatgtgatcccatgtatattgtattataccaagataatcccatcggtatgtgatcagtattgtatatatattgtgttgtattgtacagaattccatcgtaatgtgatcccttgtatatgtgttgtattgtacagtaaacaaattaaaccaaatctgtttttcatttcttagggttgtatttttctgaggtttgtaagcttaaaaaaataagcactaaaatattcttaaaattagaaaaataagtaataattaaggctcgaaattatacggactaaaaaacatcaaatatggacaaaaaactttttggaaaattttgcctttcggttggctcgtccagcaaatgttgagttgagctaaacacacaaacaacaaattgaaaacatatttatttatctcaattaattaattaaaattgagagatttcgcactttaactttttgtaccatttgaaagctcttgacgagatttttgtatgaagtcgaaccgcgccatctaaaaaccgacaggcataaaccggtttttaaccgattcaaatcttatagtaccaattcagtaccaaacgtaattcctgatttttagattaagctcgtcaagagctttcaattggtaccaaatttgtctggactcagtcgtttaaaaaacagttcgagtgcgaaatctcttatttcgagtgccgataggcgccgccgggaaaatttttgaaaataagcactaaaatattcttaaaattggaaataagtaataattaaggctcgaaattatatagactaaaaaacatcattaggccccgccaattggtatttttgacagattttttacataacagatttcactcaaaaatcataattttaaaataaaactacagaaaaacccataattggtgctgaaatggcaaaaatattcgaaaacctggccacatatgtacttttgctcaccttgaccagatttttttgt

SEQ ID NO: 9943 - DNA, 5288 bp, Heterodera glycines
  misc_feature (5163)..(5163): n is a, c, g, or t
  misc_feature (5197)..(5197): n is a, c, g, or t
cctcggtttgtgccatgggatcagccgggtcggtgtacacgctgcaagagtgggaacgtggagctggactacatcatccagccagagggagtgaccatcttctcttcccggctcaaggatgacggagagaactttctgccatttgatgagatcggtaagggtttggactactgcgaaaaagtaatcagcaacttaagtggactttggcgacaatgccaagtttcgcgtccggtcacggaacaaaatgtttaccctgccactgagacacccggaagtttaccaggctgcacaagtcgcagcggaagcgaatgactgcaggcagaagttccaccaatggctgagaacaatgatgatgatgatgataatgttgacccaaagtgataactcagtgtgttgataagccatttgtcatcattcgtgatggattacccgagaataaatgagcgtgaactcaaatttcccattccctccgggattgttgtcagcgggccctcctcttcgggtaagacgcagttggtccttcgcctgttggcacacgccagcgagatgtttgatcccccgccgaaggtgataggtaagccctctttgccatgatgatgtaatgggcgtcccattgggttaagtttgggcttacggtgagtactcctcgcagatccccgagctcgagaggcagggggtagtcccgcacgcaggcccaccctccgaagaaatgatgaaaaagttgccaaaaccctttcttattgtctacgatgaccttatgggtgacattgacgcgaagaagttggctgatctgtacaccaagaagtcccaccacaacaactttcggtgatattcgtcacccaaaacctgttcgacaaggcgatgagagtgccaaggtccaatgcgcagtacattttcctgatgcgtgcgcccagcgatatgctgagcattcgtaatttgtccagccaaatgtttcctcgcgcgcaagggtttctgatggacgcgtacaagcaggcgtgtgccgatccgtacgggtatctgttggtgacactacacgcaaacacagacaacctcttacgactgtggacaaacattttcccagacgacgaagaaaagattgtctttgtacccaaaaatggttaagaagcaaatggtcgtacagcgggtgttggacaactacgagtatctgaagtcccttgggaggacgacatctcacaagaagaggcgtcatttgttgagcagtgcaggttgtgaagagctgttggctctggtggagatttgcctaaacctctgagaaacagccgatcgcccaggaccaacaagaaagcgatcaagcagaaagaaatgaacgagaagaaggaccacctcttggccatcattatgtctgatccgcagagattcggcgctacggaccgtgggaaaatattaaatccaaagacggggcgggagttcatcgactcggacctaagctggtcaattgaacgcctagtggaccctcgcccggagaatgccccttcaccaagcggaaccaaagagttgatgaggaagctcgcacagaatccgctcgccagtagcctaattaatcgactattcgttgggtctggacaagtcaaacaaacgggaggatttgttccctctaaatggacgaaaaaataaacaaaatatacaccgacccggccaatcccggtgggtttgcgggtgcgagtgcactctatgcagcggtcaagaagaagcacccaaaactgaagaggaccgactttgatgactttttgcagcggaacaccacctacacgctgtttaagccaaagagggagaagttccgacgccttcgcacagtccccggagggttcatgaccggtgagtttgtccacgttattttcacgtgatcggctcagacgttcaggcggacttggcagacttccaagccctttcgcgaaagaacagcggctatcggtacctgctgttggcggtggatgtgttgtcgcggcgtatgttcggctcacccgtaaagagtaagaggccggcggacgttaaaagggcatttgaggaggtgtttggccaaatgccaaaacttccggaaacactgtacacggaccgtgggctggagtttgtggccaaacccatgcaggagttcttcgctgaaaatggcattaagaaatacgagaccagctcaaagaagaaggcagccgtcgcagagagagccattcgtacgctgaagacccggctgtacaaatatttctctgccaaaaacacctctgcgtgggtggatgtgttgcccaagtttctgtctgcgataaacaattctgtgtgccgcgcaacgggacttaggccaaacgaaatcagtgacgtcaatgcgagagaggtgtggaagagggtctatggcgaaggacttgtaccagcggacaagagcccaaagatcaaagcgggggagactgtcagaatccccgagcccaagcacatattcgagaagggtaaagttactcctccattttttctgtattttttttttgtgtttaaggctatattcccaactattctgaccatgtgtacaccgttgatgcggctcgcgcaaccaaaccccagcactatttgctcaaggactattatggcacaaaaatgaatagaaagttttatttgccagagctaacaaaagtacaagtggacgaaaacacaatgtataggatcgagaaaaaatacaaagaacgaatgagggatggaaaaaaggaaatattggtgaaatttatcggatttccggaaaaatattgggtcacagatgaggattttgaaaaataaaagtacaaaatgaataaattattcgcgcttacagagacaatcgtaggggttatgggccttacagtaatcccatgagctatacccaaaggggacaaccttaagtccacggtcccggagcacccccttattcacggtggggttgaactgcttggtgattggcacagttagaatgtcgccctgcttcgtgatgcggaagttcttcgtagggtagtcgaaccgcacatggttgccgggcgtgccccacttctccagcaccatttctttcatcttctcaaagttgatgcgggtgcaggcgttcgagtccagcgtgatgcctcgcagcttcagcttgtactcgtcctcgccggttgcgttgttccgaagccaaagggcgtaggccttgggtccagctgaaaacgattagaaatttattcaaattattttggacaaagtccttaccacagatgaactcgacgatggtatggttggggtactcgtccgcgagctccccaagctggttgccacccttcagcgggtctcccagtgcagtcttgaagtcatagaagatactgtcggtgtcctgaaaaacgaatattttattatgaacattttaattgcacactcttaccatgtataaaatgcgcgtgtcgtagcgctgaaccagattttcctgcctgtagaccaattgcagtgagttgagcaagtgcacacgggccgctgccgtagtccatagggcaatggcgacgttgctggtgtcgtgctccaccacgtgctcatctttcgccttgtagcacaccatccagaatttctccgtcagttggtcgatgctgctgatgtcgattttgacgtcgttcagaagcttcgcaaggtcggcgtggcagtcgatgatttccgtcttcgtcagccgattccgcaacgcaaagcggccccacagcgagttgaggcacagcttcgaaaggtaccgcatgccgggatttggcttgatgttgttggcgtcgagccgcaccgtacagcccttccatgggttgttgatgtattgctgctttctgcgctccctctcctcctcgtcaatgtcatctgcggcacagtcagcagggaaaccgttggctaaatgattattgattaatttaattttgattgctgataaaactaccctcaaattttatgcgcaggaatttgttgaggtaggagaggaagaggccgttactccagtcacaatacagcggccagacgtacgcccggtagacatgggtaactctgtagccggatcgcagcgccgcctcgagctcgatgtgtgggatggtcgttgagaatcctgcgaaggaaaaataaaatcattggaaaataaagccattggttacccctctcagcgtcctcaaagtgagggcagttgtacccagggtcgaccagaccctttgggtacatctccgcgcatttccggcagagtgggaagagggtcctgttgttacgccgcattgggatgaccggaatgtcgtagaggcagtgccgaggcgggacaacgaagcacttgatgatgccctccattttcacgccgtcgtcgtccacaatgtgttccttcgcagtccagttgacgtccttgtccatttggatgacctttggatgaccgacggggtagttggtgaacatgttccttaattattgattatttgtgattatttaatttattttctacctggacgggtacagactgttgaagtccttcactttaatggtccgcccagcctgtccttctttgtccgggatgatggatgctccgagccactcggggccagtccgacctgtaaacaaattttgcatattttaaccaaaattgggggaaatgacctccgaaaaaggcgtcatggaagtcaatcgggccggagtcgggcgtgttgtcgaagaatgccttcatcggtgggtccacttccagcattcgaccgagctggcactcccacacgatctccacctcgaaatcccgcgcaatttgccgaatcctcttctcatccctcgctcgaatggcaccggcagtctctccaccgccaacaattgtgtcatcctcggggaagcagtgcgggcacgcgtgccaataacacctgaagggagaaaaattagcataagtttggcaagtgtttctttacccgttcacttcaatcgccaagtttttgtcctcgccgatccgctccagcatgccgtccagcaggaagttgccatgtttgtactcgccgccagggctttccacatggcgaagagtccatccgttgtcgcgcatctcttcctcggcacgccacttgaggtacttgcgggcgatggcactctgcttcccacgcttctcgtagccaaggtgggggatgatggccaccctctctttgccgacgtgcgacaagaccacgaagaacttcatgcaggcggacnggatggtgatggagtcggtcagctcctggctagntgcagcggcgaacaactcccgcattttgaccatcccatggcgagaatttgacatctgaagaaaatgcatatttttcagattttccgatttt

SEQ ID NO: 9944 - DNA, 2455 bp, Heterodera glycines
atatttattatctaccaatattcgtggaaaattctctttgcgggatgagtgggaaacgaattttgaacagtgccgggccaagcgcagaacgacgattctcagcggaacattcgttggcattttgacggcacttttcgtcggcccaacggagtgccaaaaataatatttaaaatatattaattctaataatttaaaagaatcgaacgattagatatttaactaataaatgttaattgatgtataaatatttacagcctcccaaagttcaaattcgttgttgatcgccaactgattatgctcgagaatttcatccaaaatattttgatcaatttgcaaaaattcctctgatctgaacaataagcccacattttgacaaatgtaacccaagcagcgatgagcaaaatccttaaattcgaggcttaatttaatttggaagggcatctctgggcgaaaattatataaaaatttatttatttttaatatatattttatttcaacattttggttgagaaaacaagcttggccataagcgagcaaaacatttggcaattcgttaattggaaagtccaagaaggcctttagcagcaaagcgatgttatatttatttgcttaataaataaaaattaatattttttaaacattttcaccggcgtaaagcactgccatggcattttgtccgttcaattcgcttaaatcttccgcataaatgaagctcaacatcactttgaacgcttctgcttcaacatcggtcacttcaattacgtgaggacagtcggcagaggctaaaaaataatgaaaaattatttttagaaatattttcggtatttttttttgtttacttttagtctttgagtttttgtcatcaaaacggaacatcgacccaaacacagcagaagcgaacatcatcacgcatttgtgtgctttaaaaagctaaaaaaactcggaatagaaatggaactagttcaaaaataaaaaaaaaatgaggataaagattcaattaaattataaacatttccctggcggcgaagcaccgtctgaccctcatttttagggagtccaaaaatatggatataaaatcgcgaaatatggccataaaatatggaccaaaaatcgcaaaatatggacataaaatggcaaaaatcgcgaaatatggacataaatttttcaaaattgaatgtaaaatttcttcaaatttattggttgaaattgcatatgagatacatttccaaattttttgactcggtaagacgctttgacaaagacggctttcgttcggaaattggtctcgaattttttcggcaattacgtgcaatcattttaaaagaaaaaaaacataaaagctaaaatttattaatttttttagcgcaaaatcaataacaaaagcgaaattttcgcttttttgcttatttttgacataatttattaatttttaagaaaatttaaatttattctatattctcgagaaattttggcgaaaaaatgattttttgaaaaatttttcgggttttgggctcaaaaaggctaatttagctgctgggggccgttctaatagaggtttttttttaaaaatgccaaaatatggaccaaaatgccaaaatatggacataaatcgcgaaatatggaaaatattgatatagaaatccttcctagaagcttcaaaccaagctaaaaacatgtttttcgtgcgtttcaggcctcccacagtccaggaaaaaaatatggatttccatataattggactccctactcattttactaaaatttgaccagaaaatggcaaaaaatttggtttttttttggcaaaaacgaatacaatccctgcttttcctccgtgcgctgaaaattttagaacggaaccctggattaatcaacttttgtgggttcaactcacctccttttctttcccaaccaaaaagtgaacgtccgccccttcgcccgtgctcaacatcagcttcatccgatccaccaaactgctcgacatatgataagttgcgatggcaattgaattatttatggattaactgaaatcgcaaaaataaagctgtccattggcccaaaattttgatagggttgaaacccgcaaatggggagggaatttattcgttagtgtctctgaattctgaaaattcttcccgaagattctaactcataaatagggtgaggatttttagcggcaaaaaatcccaaaataattaactaaatagtgacagaaaaatgcgaaaatagtggtaaaataataaaaatcctcactctactcataaacaaaaaaaaaggggggggggggagtgggaggagggattgtcgcaaagctgagaggggagaaaggaaaggatgaatggaatcgaggtgaatgaagaacggacggatgaccaagaccatttgcatctgtccattgattgttgtcattggacagtaacgggcaaagcctaattttgttttatatgacaccagtgcc

SEQ ID NO: 9945 - DNA, 2508 bp, Heterodera glycines
ataagggtgggaatttaagtcactaaaaatcttcaaaaagtcgactaaaaaagtcataaaaatcccaaaaacatttaactttaattcccagccctactaatcatttttaaagcgatgttgagcacagctgaggacgcggatgtgtactttttggtgggagaggaaaaggaggcgagttttgaaatttaaaacatttaattttcaaaaacctcaaaataaatcagggatatcggcctaataatgcgtaaatttgttatttttgatgcaaaatacaaatcgtataaattaaaaaaaatttcccatcgaccgctattatctttcaacaccatcgaccaaatcacctcctaaaattctcaaaaaaatattattctctgcttaccgcctgaggcttcaaacaaatttaattttaattgtttctctttttaagcttttgcctgcccataaacggattttggcagtgcgcttccgacgtatttgaggcaatgttccgttttgactcccaaaacggaaaagcggaaaatggtatgaaaaacggataataaaataataaataattatttttatttaatcttttaaacattagcctctgccgttagtcccattgttgtccctgatattgaagaagcagtgttccgagtgatgttcaacttcatttatgcgcaagactcaagcggactaaacggacacaacgcaatggcattgctttacgctggtgggataattaatttttttaatgggattattaatttcctttttgtgattaaattaaataaaatttcatgcattttttgtttagccaaaaagtacaacatttctggtctgatcaaagcttgcttggattatccaattggtcaattgtccaatgttttccttgccattgaccatgctcgttttctcagcgaacatgtaaagtttggcactgattttgaagaatttttttttgtaaatgaatttaatcccaatttaatttttttttaaattgccttttaaggattttgctcttcgctgcttggatttcattgaccgaaacgcgaaaattttattgcaatcggaggaatttgcacaaattgatcagaatttattgtgtgaaatactcgaaagtgatcagttgagaatcagcgatgagctcacaatttggaataatgtaataattaatgtttaaaaatagaataaaaattattgttcaaatcatttgactcatttaaggcactccgttgggccgacgaaaagtgccgtcaaaatgccatcgaatgttccgctgagaatcgccgttctgcgcttgggccggcacttttcaaaattcgtttccctctcatcacatatgaggaatttacacaaaatattggtaaatatggaagaatttaatttaatattatcgataattcatccaaaccttggtcaaaaaggccgctttaataagggggcgttttaaaatatttttttgttgttggaaaatgcccaaataagcaccaaaacgcacataaatcgcgaaatatgcatatggaaaacgtcctagaatcttcctaacaagctacgtttcatatgcctttcacagttcatgaagaaaatgcctgtgcatataattgaacgctctattcataatttaaaaaagtttttaattttttttggcagttccttctggcgttttaacatcagaggaatctgtcggcatttgtcagttccatttgcctgggcttttatctccggtggcatttccaaaccatgcacggatttccacgtggaataatacccccaagggaaacgcagggactctcgcgttggaaattacgaaattttctcgatttgcgcgaagggacgagggaaagtgccgacttagcaatggcaaagtgcacataaaggcacttccgtggaaaatatgtgccaaaataaatacgacgaaaaacgaaaatggcaccaccgaaaagtgtttgggctttttccttcagtgcaccgcgccaagggcaggtgggataatgataattaatggtgttttaattctaattaattattttttattttattaagacccgaaatggagttgcaaatgttcagcgacatttcgaatcatttctcaaaagcgcggcacggagcatttaattggaaaacgcaatgatcacatttttaacaacaaaatgaacattttgggtttctcaaattttattactttttctgtaagaaacaattaagagatgtctttttttataattgaccataattaaggaattgatggacccgagcagaggattttatgacaaagacggggacaaagtgacattggccatcgatgtcattgtgaaggaagaaaaagcggataaattggattattcaaatccaaacaaaacaaacgggaaaattgtgatggaaattggcaaattgactgagttttcgcgagagatttgtttgagtgaacggagcagcgaaatcaaacaaataaagggactttcgtggaagattggcactgataattaatcagaataataaaagcagcgaaaagtgttggcattttac

SEQ ID NO: 9946 - DNA, 1635 bp, Heterodera glycines
ccgtcaatgctcaccgattgcccagcccttcgccatgttcatttctgtggcactttgttgcccgaatttccgcccgacgacagtgccaatgcgtcggatggccaagtggtgaccaaatggctgttcacgcctcatttcgacaatttgccgaaggcatttaacattgtgaagttaactgtggaccaatggacgacaattgtggaacaaatcaaagcggtgatttttgtccaattaattcgctttttaaatgttttgtcttttttaggccttttcttctgcttcttctcctgttaatttcggcatttctgttctgtttccgccgtcctcttcactttctgtcgttgtgccatttgaattgatcaacgaatttactcaagagaaattgacactgtccaaagaagacgaagatgaagaagaagcagaagatccaaaatatttttatctcatccgttctccaattgtgccggaagatcagaaaaagcagaagatcaatgaaatggggggccaatggaacaaaattgacatagtagccacagacgacgaattcatcaatcgatgaacaattgcatttaaatgttgttgtatttgatttttgcttacaaattcataaaagatgttaggctttaccacgcttagtaaattttaaaaaacgtacaggaaattgtttatttaattttttccttatcaagtcatacatatttttatgtttttgtgtgttttgatacctaaagactcaataaaaaaaaattttgcctatttttatccgagaaatttggcccatttttgcaacaagcattcctcaattttggctttgccggtcgcgatcatttggaatttcaccgacaattttctcaccgatccaatcatggacgacacccaactcgtctgtttttcaaaaaaaaatcgtcataacttttgttaaagtcacaaaataaacattcttggaatcattcaatagcccttaattctctataaccaagcaaaatgcaagaaaaattttattgcttttcaaaaaagttatgaccaaaaatcgtaaaaaaaaaatttcgttcgtaacttttttttcaaacttgatcaaattttttgaaacttgatgggtggatagagaattttttgggctatcgaatgataccaagaatgtttaatttggttgacttttacaaaagttatgacgactttttgtcgaaaaatagtacgagttgggtttttaccgtccatcattcttcgtatttaccaaatctcgaatggatcatctcaatttaaatttggctgacacattttcatcaaaagacttattgtttgattgattgcctttgatttgtgctttctttttgacgaaggaaaagttgacacgaacaaataagcaaagaatcacattttgattgattggctgatgaagcgctgcccaattattggaaaaaatgggtgaaatgatcggatattcggagaatgacaaaatgacaaggagcatgaacaggcagaatgaattgaatgtgatctgctgttcgattcaaaaacggcaattatatacaaaatatttcaatttaccttttaattgattttttgaaattttcaaataaaccccaaaatgggaaaaattggtttcatgggacggtttgcctcactcagttcggc

SEQ ID NO: 9947 - DNA, 3855 bp, Heterodera glycines
  misc_feature (2342)..(2342): n is a, c, g, or t
ttaaatttcagtttacccatatttgtttatttttgcaaaattttaagccgtctcgccaaaaaaagttgcaatggattcccaaagacgcaaatgaccgccgcaactggaagttgtgcgtcactttaaaagcggtacggttgctttaacactccatgttgcattttgggtcaaattttgaaaattttaaggaaattttatcgtctactaatttttcgaaaaatgcacccattaaaattttgagatttttcattcggaggacccgcctataggcctgggctttcaatatttctctcttttgtcagattatcccttcgctctccccactttctgcgccttctccgcccccaatgtcttccgcctcctctttttcgccgacaaattccgctagtgaaaatagcacaattcgctttgccttgcccatcaatcaggcgaaacaactgctgcattgccttgaacagctccaaattgatggtggcagcgacggaggctgtgccggcaattcggatccattgaatgtgcatcagcaaagattgtccggcccattgttcggcttcaaaaagagcgcattttatttggtgggtggcccaagaaatgagggataaagttcgataatttatgtataaatcaaaatcgacgcttcacggtcttaaaatttaagaacttgagttgaggacggtttttttgtcggaagcattttacccattcgggactcaatcgtcctatagcctatggtaaaaaaaattcaattttaaaaatagagctcacaatcaagcagccatttaaagccgtaattctgtttttgaaattagaagccatcattttttcttttatttttgcttcctttttcataaattcataaaaaagattttgcattctgtaaaagtaaaaattaacgattcctttatgaaattatttcaaaatttttgatggcgtcggatttgttgcactaatcctacaattcaaaaaaaatgcagtcatgcggatatataaagaatgattttacattttctcaaaaacacagagtgtctgccgtccgtccaaagcactgtcgggcaaaccgctcgtatttctgtctgaacaccaacttttgcccaacgaatttcacgcctggtacaagtgccacagattttgaatccgatcattgccctgtattttaatccattggcacttttcccaaaggcattcggtggtcaattcccttccattgtccctgtgctgtttgcccgaactgcgcaaatgtctccgattggtgcttgaacagcccgaggcgacttcctctgatcagcacagagacaatcaaagcagcaatgcatccacaaaacttgggcaaatgtttcttgcttagattacacaacattgtttttctattgtgaataaattttatgtccatttatttttatttgggcaatggtaaacaaaataattgaaggattcgtgatcggggaccccaaaaaccccagagaataaatttttatgactatcacaaaaaaaattttgcaaaacaaaagggtccccccttttgaaaaaattttcaaaaaggcccacttttacagtagcgcccaaaaatttatgtgtccaatcaaaattttcctaattcgaacatccttttgacataaggtaccaaccattgcaaaaaaaataataatttaaatattaaaaacgtaacaccaagttcacacacagggcattgaggcaacttggcgtgcagtgaaaaatggtcttcgtcatcttcacggcactaaccccgagcttttacaatcttatttgtatcagtatatgtttcggagatctaacaataacgaaaaaatttttcagcaaattctcgaagaaatacgtattcaataccctgtctaatcatcttttcgttgtattaatcagtcttcattttgacatttaagcatttaatgccaatattttaaataattaaataatttctaataattgattggacacataaatttttgattggacgcttaaacttttgattggacgcgtaaactgtgattggacgcgtaaactgtgattggacgcgtaaacttttgattggacgcgcaaactgtgattggacgcgtaaaagtcgattggacgcgtaaaagtcgattggacgcgtaaaatgcagtagagcctaactcgaatacgggttcgggattcgaatttggtctaaatggatgtcagattcgaaatcagcgacccagaaaatccactagaaattttttacatgatttgaaaataattttattttttatagtctgtaaagtgcataagtagtaccattttatctatgactcatcaagtacttgattttttacaaagttttaagaaaattagtcgggataaaaacnccttacacatatgttgtagagctcaaaaagagctttagaatgagctattaaatttctgaagaagtcaagtttttagatcacagaagagtcattggcgctaacggttggtcgaatgaatcaaaaaacaaattcattaatttattaccaaatttaaatttacattaattaaattttgaaattattaaatttattatttgaaatgagagaaagacagagaaaagcggtgggggtcggtttagtctggccgttttagtctggccggtttagtcagagggtcggtttagtcagagggtcgttttagtctggcaagctgtttttgtcctacattgatccaattctgatttgtttctcgaaaattctttaaaattaacaccataacagatttatcaatgtgttaacaacaaaaaaataacaaaacttgaaaaatgaatacgggcatatttcataatttcgagaaataccaacgagaaaattgatgatattatcaggattaacattggcatggtaattttgatcattttggtgagcagggttaatgttgttgatggtattgtaaccctgtaagagtcgaagaattcgtatcaacggcacgatattttcgcgttttttgaggagggacttcaccagcgatgcatcgtgcgatgtctgcatcaattgacttttctcatatcgaattgtgttgatgaagcggaaaacagttggatataaacaagcaaaagctcgttgaatgaaaaaaaaattagggtttactttgcctgaagctataaaaaggcggtgccaaactgaaggtttcgctttgtttttattttctaattgggatattcatttatattgtagctaaacatagatattttaagtttttccttatttataattgacaaaaaacatttgtaagaattatgggcgaaaacggcttgccagactaaaacgaccctctgactaaaccggccagactaaaacgaccctctgactaaaccggccagactaaaccgaccctctgactaaaccggccagactaaaacgaccctctgactaaaccggccagactaaaacgaccctctgactaaaccggccagactaaaccgaccctctgactaaaccggccagactaaaacgaccctctgactaaaccggccagactaaaacgaccctctgactaaaccggccagactaaaccgaccctctgactaaaccggccagactaaaccgaccctctgactaaaccggccagactaaaccgaccctctgactaaaccggccagactaaaccgaccctctgactaaaccggccagactaaaccgaccctctgactaaaccgaccagactaaaccgaccctctgactaaaccggccagactaaaccgaccctctgactaaaccgaccagactaaaccgaccctctgactaaaccggccagactaaaacgaccctctgactaaaccggccagactaaaacgaccctctgactaaaccggccagactaaaacggccagactaaactgacccagtccgt

SEQ ID NO: 9948 - DNA, 1230 bp, Heterodera glycines
gaccctcccgccccacccaaacccgtcaacgcggatcattctttggataggaatggacaggaatgtccgctcgatgaatccccccccccccgcttctcttagctttacctcaccatttttttacttcctcggcctctttcgttcgtcccttttgctgttcttgcgatgccactttctcgagttcacgtcaatttccatttctaatttctgtgccaccgatgggccgggggatgcgaactttgatggccgggggcgggggaagggggaaatgaatgaatgccgggggcgcgggagaggggggggggaagacgataccccaccagagaagaagcattgaggagagaaaggaaaagcgaaccccgaggcaaaaaggaaaagttaattgacttttagcggtgacatttttcgacaaatcctttttttgcctcatttaatttgttccgttcaaatgcatcattcgagcagtggcagcggtccttcgaacaggttcagttttgtgccaaaattgcttttagcaaccaaaatgcccaaaatgccttcaggcacattgacagtggcggtgccgtaccgtcggtaaaattggcaggacaaaatgccaaccgcggatggtcgcctgagcaagagcacagaaacagcacgcagctggactcgtatcagaacggcatgatgctgagaagaaggaaaagcggtgccgacgcaatgggcaacgaaatgcaaccagaggcgctgcatgtgcacggcaaccccgtgctgaaggtgatgttagacagtccagcaggcctaatgacccttaaatacccttaattgatgcattcatttggtgccacagatggcggagcagtgtcgcttgtgccgttgctggaagcgatggcagctcgcaattctggccaacgtcggcttcatgattgtgttcggcatccgttgcaactttggcgcagcaaagaatcacatggccaaggactatgttgacccctggggcaaaaaacatgtcagtgcaattagcaaataatctatataattgcctaattaccaatactaattctaagtcgagaagaaacattatcgagacttggtaaagaaattctcagcttaagccaccgacccaaaactgatcaaaattactcagtctatgattaaatatcctgtttagcctaattaaattttactgtctatttaattacttttgggtcactcaaactgattttttgatttattgtaatcattttgatc

SEQ ID NO: 9949 - DNA, 4129 bp, Heterodera glycines
  misc_feature (42)..(42): n is a, c, g, or t
  misc_feature (69)..(69): n is a, c, g, or t
acgcgtttcggtcgcgttccgacacttgggtaaacagaaganatatatatttaaccctgcggcgtttgnagaacatttcaaaaagtcccaaaatcaaaaccgataattgggaattggttagtctgaattcaaagaccgatcgctgactgaaattattggccaagactcttgggctcgggtaaaacattttggagaaacgtttctggggaacaatcatcaatcgatcggcgcccgggggaatgcgatttgttagaattttccgatgcgaattttaaaatttcattttcttttttaaacttaaggtggcactcgtccaaattgctcaggtctctctttctcctctccactcgcttttctcggccatttcctttcttttttctttgccttagggtctcgtccaagggttggcctatccggcaatgcatggtaataatatgttatcacttatcactaaatgtttttctcattttcttttgaggagtttggtgccattgggcgcctccgttggaacgctcaaagttggccaccacggctttcaccgggtacgaagtgaaactgaccgaaattcgaaatccccccacgggcttttcaggtcgtacgccggggctgtgtttgggctgccgttgagtgccttgttggtttcctacgtgcattggtaaggcattttttggcattcccaatcattgctaacaatatgcacttttttatttgccgttcccgcaggtcaatgcccttttacatttacggagttgccggcgtcatttggtccgttttttggttctcgatgactttcgaaaagccggcctttcacccaacgatcacagtgcaggaaaagcaatacattgaagcacaaattgggcccgtcaatcagtcacatccgacggtacattcacattcattttttaggtgggggggggaatggccaaaacgaagccgaaaggaccaccctcaagcacagattgaaaaaaagtagagagataccggacaagagagttggttgatattgtcaaaatgaccgagtgtgccaatctctaataattaaccaatcaaaagtgccaataatttggggtcagtgcggcacccacccgctgttcgactcgtctctgataaccgttcattttccgactttcccatgtcccccgacttgtccccgcttctgtttgccgctcccctaaaaatgcttctgacgtccctctcgccccgttcagttcggcaccataccatggcgtgccattctcacttccaagcccgtctgggccattatcgtggccaacttcgcgcgcagttggaacttctatttgttgctgcagaatcagctcacttacatgcgcgacgtgcttggcctgcgaatttcggacgtaaacaattacggattttaaggcttactgtacaggaattacgatttttgggtctcataatgacgattgtgatttgggttttttactcttgctaccatactcaccaagttgatactgtacttacttctcctttacaccattctaattttgcttggtttaaaaatgaatttctgttgatttttctgaagttgtcttcctcattttgtacttttcagagcggtctcatcgctgcgctgccccacgccgtgatggtctgttataaaaagaccaaaatcatcattaattgctattaaccaaattgattatgcattatgtaaccgtacttttctccctaattgtccacatttcccctcaagggctgtgtggttttaattggcggccgattggcggattatttgcgttccaacaaaatcctttccacaaccgccgtccgcaagctgttcaattgtgggggtaagcaaaaacatcttctgccgtggattctctacatagaattttggcttaggtttcggctgtgaagcgttgtttttgctgttcgtcgcttacaccaaaagtgagaggacagcgatgatcggtaagtgattgattggccagggtcaatcaacaacaaatttgcgtgaatatcttctgttttctcgctttcagcgatgatcatcgcggttggatgcaggtaaaaaatatgccgattgatcagggccaccggtccaattaggtatccggtccattcttataactaaaacctgatcaaacaaagtaaaatccgatctccgatttggccagtacaatttatcaatcgattgattgaagtggcaaatctgatttgaacatttcgagtaaacccaatcgactgattgtgcagacccatcggcctaaccaaatgattgtttaaagtcgattcgattgatcattgcccttgccattttgtgtgatcggtagcccctcggaattgggcaaattaattgcattcattttccatttcattttcagtggtttcgccatctccggtcggttgccgttctcgcttctgcatttatctttgtttgtccacaaaaactaaaaaatttctatgataggtttcaatgtcaatcatttggacattgcgccgcgttatgccgccattttaatgggcttttcgaacggaattggcactttggccggcctcacctgcccatttgtggtcgaatcactcacttccaaagggaatgccaacggatgggtcggttatcactaattaattacccaattaacgccatttgtttctctaaaattggcactttcatttcttcgtctatttacttctcccccctctttttaaaggtgactgtatttttgctggcctcactaatccacttcactggcatcactttttacgcggtgtacgcctcgggggaattgcaggtgggcgaaggggcggcgagggcaaatcgaatcgaagaacccggcaaaaggggaaatgctaatttgtccgggttttaccgttattgtttctggaaaagcacatttgtcactctccaaccaaaagtcaaacattggggcgtcgaggaaaacaattacaattaattagggcaaaaataggccgaaactgtccagacactttcgactacgtccaacattgagttaaatttaagttttcaatttttcttaattttaaagctatttaggccatcaaggcttgaaaaatttaaggtttgaacccaattttggactttggcacaaatgtcgagtaaccgcagtttttttgctagcgcattatttgctattttttataattaattagtcattttatcaattaggaatgggcggaaccaaagccaaatgaggaggaacaaacgctgcaatgggacgcgcaaaaggcggccgaagcgcgcgcattggaagcggcggcaaaacggggcgacacttacggcacaaacgaagcgacggcatttgcgccattgccccatctgacgacggggcaacaaccaccaatgaacagtgagtttcaagcaaaaggcactcactcactgatcagatcagcgaatgccatccaaaacataggacaaaacgtatgatcaacgaaggccggaattttgagaaattcggcgcgatcagactttctaaatcgggccgggacgaaatgccgtacattcacaattagaagcgttgagaaaatgaaattttagcaaaattctctgccgagttcatccccagtctctcccggcagaattccatttgttggtattgtgccaatgccaaagtccgaaaaggatagacaaaattcttgctttttgcctcctccacagattttcatcaatcgacggcacaaaaccaaaatggcggcaccgctgcaaccaatcccttcatgaccaattggggcgacgactttcaccacgctgggtgcagcagcggcaacaaaagtttcggcactgcttacggaggccagccgcagcagcacgcggtggacgacgactattaccagcagcaaagctacagtagtcgcagttacagtaatccgtcaacggatgaaaaaaggggcggcggaagaatgcaataaaaaataaaataaaattataatggaaaaatgcaaaggaaagagtgacaaaaaagcaaagaaaagaaacaaaaaaaattgtgtgtaaattgaatcattttattgtcaattcttaatttaaattttttgcttaatattcagttgatttagttttgattgtcccaaatttttttacgattaaatgggaaaaccttttttgggacaaattgaaaacaaattaccagggatcatttttttatgt

SEQ ID NO: 9950 - DNA, 823 bp, Heterodera glycines
tggatttttcgcgcgtagggggggaggacggtccgcttccatactaccaaaatccgaaattctatattgttgattgctgcgctcctaaaaatttcaatggtaattgatacttagcgaaacataaactcaagggtggggttagagttcaaactcatctatctccccgtccaccatctccgaaaaaaacaataacaataccccaaaaattcaatgttcgagaaatatcgttctcgaactcggcccctcgggccattagatgtgttgtcagtgtctgttatgccccctccccccactaataacttatcatcatcatcatcacgagactaatgagagaggcccggcggggggggggacggaggaggggactcgatcacctcaatcagcagcagagcagttgggctcccgggagggggtgatggggtgtctttttgccctccgaaaaaattaataatatttgttttcttatctgctcctgctcccactgtcgggtccccgcccccccccctaccttcggggcgaactttccgcggtgtgctcgaaccgccactacatcatgtattgtttttcaggatcatttttaacgcagaattcaaacaaaacgccacactagttcaaacaatggacacacacatacacgcactcatctttattatataggaagataggaaaattcccactgaagcgaaaacagaaataaaaaaactctcatttccctttcttttattaaaataaaaaatgcgatgtaaataatgaacagatgtgagactaattttcaattgttctctccctttcatttcttttctcttatttcttttacttttcc

SEQ ID NO: 9951 - DNA, 3439 bp, Heterodera glycines
  misc_feature (28)..(29): n is a, c, g, or t
  misc_feature (312)..(312): n is a, c, g, or t
  misc_feature (1139)..(1139): n is a, c, g, or t
aaaaccaataacaataccccaaaattcnnaatgttcgagaaatatcggtctcgaactcggcccctcggcccattagatgtgttgtcagtgtctgttatgccccctcccccccactaataacttatcatcatcatcatcacgagactaatgagagaggcccggcggggggggggacggaggaggggactcgatcacctcaatcagcagcagagcagttgggctcccgggagggggtgatggggtgtctttttgcctccgaaaaaattaataatatttgttttcttatctgctcctgctcccactgtcgggtcnccgcccccccccccctaccctcggggcgaactttccgcggtgtgcccgccccgcccctccagcaacggaatgggggtaggggcgtggcttcacccgtccgcccccgtgcgccattggctactccttcttttgctggagcaaaagggtggtgtggtgggggaaaatgatcaatttgccgcccccgccgggggcaaaagcgccgacgggcgatccgataagccatcaatcggtcggtcggtcggtttgatcagccacaacaaatattttgattgtacacactgctgctgctattggcggtgttttggatgttttgtccatacaacaactgtttctccactcccctctcactccctctgcttttgttgctgcttattgaaatgaggaaaagccacccccgggcaaaatgatttttggcatttcttaattaacattattaaaagtaaaatatttttgttattattttttgaattgaatttttttcataactaggtaaaatgagaaagggccataatactcaaaggcaaattattctgctgaaaattttttaatttattaattgtgaagcttaaatatttttatttccttaattttaaatattataaaaattgaattttaaatagtaataattaatttaaacaacttagaaaaaacattaagactttatctccatatcatccgctaaatcatcggataaatcgaataccctttattaaataaaattttcgaaaaagcgacgaaaaacctaacccattttctcgagtggcgtgggcgggattatccccatcattttcaacgctttcgcttttggttggtggcccattcacatntgggtctccccccccccccctcccattcattcataatactctctacacacatatttattgttttatgaatacaacaaatgcgaccggcattttcgttcatcgcatatgctttaagattatgtgctgctgctgctggcgggcgaatgggtcgcgcagctgccgcctctccccccggggggcattacggtaataattgtattctcccccgggcgtcgagtgggtggggggagaggcggcagaacgcccgccggggccactagaaaaagtcccccgtcccccgtcttcgtctccaccctccccctttttttctaatcggacctggagatctctgtgctgcgcatttcttctctgtgctcctccacctttcctaccttatatgtgtgtgtgtacacataataaatatacggagaaaatgtgaaaatttgaaaaggcagcagcagctgatcaggcgtaaaattgggcgcgttttaaaacatttaattttcaaatttttctgagtgatcaggcggtgagcaaagattttaatgaggtaatgggcgatggtaatgggcacgaacagcaggggtaaactgaacgcggacgcaaaaatgccgtggtcgtggatcaccaaaaaccaaaacgtttcaaaccggggataaggcaaacaagaatcccggttttcgaattataacaaatgccaaatgttgcggaggacgcgggttgcggtcgcgctctatcactgctaatgccggaatccgtccttcttcgccctttctacacaaaacatatggtccccatttgcttattctgttccccgctttttggcgtaatccccgtcaccccgaattgcccgacttgcaaatcatacgcttcttcgttatgtgcatccctaaagggctttttttgccttttagttaaatgccaatacgggcaatggctaagacaggaagtctgggacaattaatttttatcaatgaaaaaaaccaagttgttaatcgatctgattgtgaatgaatcgatcagatcactgggaagaaactgaaaatttaagtaagcttaattacgataatattcatttttgaagttgacaattttgacattttgccaaaaagtgcccttgacaaatggatgatcgcttaaggcttcacacatacacacacaacgagcatcattgtggcctaccaaaacatttgttgtttgtatagtgggcacacaaatgttatcattagcgtccattacgccccgtccgatcaccgcccgtcgtctgatcgaagcggcggcggcgacggcttatgggcgagcgccgggggagaatatggtgggggtgggctgctgggtgggaggctgtcacttccatctgtcagcagtcagtcagcaaaacaaaacatcgcccggggggaggtcgagaaaattggagtggcgagatggtgcgacctgatcaatgttttgttttttgcattttgaatgaaaattagagaaattctccctaaaaatcagtgtcagagtattattgatcggaaaattaataggaggttaaacaccctgataaataatagagattagtttgattggcatttggaaactgatcggattggaatgaagccaatgaacttcggccggaaaattaattcattgattatgaaacgaagaaaaacagatatgaatgtgttagtaattcccgctaaatatcattctcttgataattataaatggtatattttaatggacattaaatgtaatgatataccagggattaaaactgttcgagaccggatgtacgagaatttgtgaatgatttaaaaatgacaaatttgtattctacagagaccttaatctcgttaccgataaatagaagcatttcgtattaaaagcagaaagtgcaacagtttgacctaaaccttgaaatcacaaaaaaaactatcaaggaataaatcaaaacaattaaaattctggtgaaaatggtcgctggatttgacaaaaaatgctgcttaccggaaactaaacctagatcgattccattttggcaataaatcaatactggtcaagattatcaacatgccaataaagtttagtcaaaaaaatctattagaagatattttctgaatcagaaagacagacacataaattttggttttaaactgagcatccaatcactgacttatcgagagactcaatcggcacattgctctgatcaccgatcaaagaaatttgcagcaaaatcccattaaaaataaatcaaaacggatcgccaaaaagataaattccgatcactgtgaccgctttttctgatcaccaatggccacagtatctgaacaaagtgg

SEQ ID NO: 9952 - DNA, 2459 bp, Heterodera glycines
  misc_feature (48)..(48): n is a, c, g, or t
acaatttttgtcggtggccaactgtacttgggtctctctgcggccggnagggggagagactggaggacacagaattgttaacattataataccgtagggcaaagaattttataatatgcataatgtgggtaaatacctagacaaaataaatttattgtaattagcctaaattaagaaatttttgtacgattcgatggctttaagagttttctctattaacttggaaattggaaaaaaattataacaatgaaatattttttgatttatcttttagtaataaaattataaacttttaaacataagagattttattatagttgataatttttgaaattatattcatggaagtatatttgttttttttcaaaaaaaaattaattaattaattttggcaattttaggaattcaaatcaacaattctacacttttgaaaaaagggctttcttcttttttttaatagttttgctgttttgatattgaatcataaaataaaaaatcattaacaaaggaataaagaaatgcattaaaaatgggcaaaaaattaatatctatggaaaagaaattttaaaaatacaaatttaatatatttgtttaatcaattaatttagaagttattttaaaagtcgaccaataaaaaaaacgtacaattgttgttttacataattaaagaaaagggataagttcataaaaaaaaattaaatttttcataattaaagacaaaaaactcagaggagctgatagattgatgatagtaaattagggaaggatggggacaaattggacaatcatcattagcattagcaattagcattcgttgtgctttctctctctctctcctttgctaacacactcactcactaatcatcaattagtgtatctctgctctgttctgtgctcgtgcttttcgctgctgctgtgctttttgggggcgggcgtctgttggctccgcccacaaatcgcacgcatcgatcgatcgattggtcattggtccgcgtttgcctcgggcaaaactaatgatcagcagaaggtgctgatttgtcataatagtgccaaattggcgaacccagaacatatacatccattggactattaaattggtaaattttgtttcaatttgttaatagaaagatgttttgcctaaaatggcgaaattttgggttttaagcgaattttttttagtaattttaagcccatttttagaggattgatcaaaagaaaagcagaaaatttcaacgaagggaaaggtagaaaaaaattaataattttcttaacgagtaattagctttcttaagccaactaaaaaataccttaagtttcgaaatttcgctattttaattacctaatgaattttccaggcctcaaaagcgctgctttattaaatataatttagtgcctagcggacgacggaagcacttgccgaaaacgcagcaccaccacacctttgaccttgattggataagttgcaaaagggaagaagaattgcggaatgccacaaaaagagagaattatgcttggcattttgttttatttttttcaaaagcgccgcgccgccccttctcatgccaaatccgctcgagtgccgtccacttgagtcccgccaaacttttttatgtttttttgtttttcatacattgccgcaaggtcatcgcccatcatcatcatcgtcaccataaaatcttcgtggtcacagtgagtgagtgaatgagtgccgacgccgccaccgccgcggtgccaaaggaagtgccaattaaaattaaggccccgggggaggaacgggattacgcgagacggacgagagtttcccccgcccttccgctttattctctggtcatcaaaaggtaaagaaaaaacagaagccaattctcgagagtcattcacttttttcactctcgatacacagacaaagccccgggggaataatttatgcacaaattttgcttttcaaaaatggccccctgtgtccacacatcctcttaaccttgactttttggagggcttagcaagtgtcattgaaaattttcagattaaaatatgattttttaatggaaattaaaaaaaaaacaattcttatcggagttatatttccttattttcattaaaaaaattctatttttcacctaaatagattttatgtaagattccaaaaaatcggtgtgatttttttcaaaaacaatttttccatttaatttcagaatttttgggtgaaaaattctcgttatggttatagttgcaacatatttatgttcaccccacttgttaaattcaaaaatccttaattgtccattaaggctagaaaaaaaggattaaaactcttacaaaaacaaaaaatgttaattgaaaagctttagcaaattggataaaattcccattttagtttgagggaacgtctaacataacaaaattcaaaatttggctttggtggatcacccatttgcatatgacaagcccgttcaacatca

SEQ ID NO: 9953 - DNA, 3077 bp, Heterodera glycines
  misc_feature (71)..(71): n is a, c, g, or t
  misc_feature (88)..(88): n is a, c, g, or t
  misc_feature (100)..(100): n is a, c, g, or t
  misc_feature (155)..(155): n is a, c, g, or t
  misc_feature (194)..(194): n is a, c, g, or t
tgttcgctgacgatgaagcagccgcaccgctgccattgttgttgttgtgcccattgttctgctgatgatgntgagaataggtcgagtngacgaggaagangggagtggcagatgactaaagaaatgtgattatcatcaagaacgtgctgaatatntaaaacagcgctttccatctcaattcattttcgacaatnttaggagtatgatcagagaggacaacaccattcacctgctgatggctctgaccatcggcgttcgtctgctgattagtgctgctgctgttgcggttattatttgtgttgtagttgaacaggcgacggaccggcgtgttgttggacgcgtccaccaacggcgacttcgcaatggacgcgtatttcaccgcccagtcgtgctcactttcacgcaccgggatgtatcgatcgcccccgtccggtcgatattttgttggtgttgtctgaggagaacccctctgtattcaataacattcataaacaagacaaaaatatttttttataaaccaaaacgaattttaaaaaaaataaatgataacaaatttttttttaacttcattttcatatttttgcgctgaatattaccggtgttaaaaatttttgtggcgatggaggaggtctctggaaaaaggctcgcaaatcgtcattgttgtgcatcccacgcagttaatgaaaattcaaaaattgaaaccaactgaaaatggaataaaaaattgaatttttataggtaaggagtgaatagcgcgcaaattaattaaatgtatgaaggaatggaagcggagctttggaccgatactgccgccctaattagcgtagcccatcatcgccgatgtccttgagcatcgtttgtcaatcggcggacctatctcggggtgtttaacgatggcaaataaattgattgattgatagactcaataaacaagcgggaaaagatttttccgaccggaaagggaaaacgcaatggacacagtcgagtcatatcataattgtgtggtcagtcggcaactaataaatgagggcatcatttatgcacgcgggaaaaatgagtggttcaccagcaaagaaaagggagaaaggtcaattaaagtcaaggcgaaagaagcacaaacacttaatcattcaacaaatttgcattcaataaaaccaaaccaaaaattaatacgtttgacgattaatcgtttaagatatcacttatttttaatttcattaaaatttcattgttttaatacattttgaaaattacttacaaaaaaaaaacaaaatttcattgtgttaaacaaacgaataaaacgcaacagaataagcatagcaaatgctaaaattcccttcatcatttcgttcccgtggaaacgttgaaacgatcgataacaacagaagcgccccggggatatgaagaggaaaagcccaaaacattttgcggacaaaaagattgatgaaaaaaggacaaatggagaagagagtaaagaaaaagataaaaagctaacaaatcgataaaaaagaatcgtttcaaaattttatttttttgatttgcctatcaattgatattgggcaacggacaatgggacagcaaacaaacgaacacgaggaaggggcgggggagtttctgccttatctttggcttagcttttttttcctttacaaaacacgagactgggaattcctgtgtactatggattataccattttatttctttaaaaaaaaattataataagggaattaaaaaccaaaagcataataggcaattctcgtttttataccacgacaatacttttggtttactatttgtttgactttggcatttgatagtaccaattttttagttaattatgacgggtgaaagcgcatatgaacttgttttgttggttaaaccagaagtatttatttacaaaattcctccactaacgggcaacaagggctacaagtttgtttgtttatttgtttttttccagtttaattttttgtagggcagccgattggaaattggacagtcccgactgggtgggaaggctcaggctaatttcaatcggcgacaagctcgagattcgacttgaggacaaaacttcaggtttttatcgatactgacaatgagcatcttttatgacccctggtataaggcattttatttgttaaggtgaactgtttgcgaaagcgccgattggtcagctgaactctgtcgactatgaatcggtatccgactcatcccgctattttgttgtccgactgcgcaacgacaacgcccagaccgcatttgttggcatcggcttcgctgaccgagctgactcatttgacttgaatgtggcgatccaagatcatttcaaagcggtgaaaaagtgcgacgattcggcggaggataacgcagaaactgtgcccaagttggacttgagcttcaaagagggacagaccatcacggtcaacattggggtcagttgaagtcggacaacgcatttaaatcttgcaaaattttgggattcgttttatcttaaaaaaaataatttaagaaatatgtaggtattccgaattggtttttcaccacaatcccctcaatttaagaagaaaacgatcacttccaacaacaacagtagcagtgctgtgcccaaccttcggacatcgctcggcggtagcagtgccgtgccgcttttgccaccaccgcctgcctctgggaataaaattcgaaaatgacgtgtcattttttcacagattttgcttttcatttttctattgactgctgtgatttcattcgcataatttatgaccctaatggagagacttttgcactttctgttttttttttgttttccaattctaaattcaaaaataatgacctcccattaagattcttctcgctcaactgaagctcgaaaaatgcccacagtcttgtttctctccaatatttcttgcatctttgccatttttgcatatcttattttatccgtttgtcacattttttaatggttgaacaaggattaaattgaaaatttcgttttaaatcatttgttaacaataaactaaacttgtaaaataaaaagaatgttattagttcatttgttttgcactttgtttttaca

SEQ ID NO: 9954 - DNA, 4090 bp, Heterodera glycines
  misc_feature (39)..(39): n is a, c, g, or t
atagttcatttgttttgcactttgtttttacaggatttntattgttctctgtggcaatgggcggagcaactgtcaccgcggtgacgaggctgaagaaggactaccaaaagctggtcagggacccagtcccttacgcaattgcagcaccgcttccgtccaacattttggagtggtacgtggcggacgtgaagtttaaaatgcaataatttgaacgagttttaggcattatgtcgtcaccggtgctcccgacacgccttacgaaggtaggcgcgaaaagacctgataaagaggtcgcggaatgtgtttctaaaatagaatttcaggtggttactaccatggcaagcttattttcccgcaggactttccctttcgcccgccggcaatttgtcagtttcggattttcgttattgtcatttgatgattcatttcatcatttttagacatgatcaccccgagcggtcgcttccaaactaacaccagactgtgcctttccatctcagactttcacccggtgagttcagcaggcgtgaaattaattgggtagaaaagcgacagggaattttgaaaatttaatagttttatatcccgtttataatattgcattaaagtaaccaccatcaccctgtcgtaaagtaggacatcttttgttataggacacgtggaatccgtcctggtccgtttccaccattattatgggtctgatctcattcatgaacgagaactcaccaacacttggcgcattggtcagcactgacgaggagaagcgcgtttttgccttgtaagactttcacaaaataattcttcaattgtcgtgtcaaataaatattaaaacattttctggcgttcccgtgagctcaaccttaaaaatgcccagttttgcgagctgttcgtcggcctggccgaccaaattcgggccgaattggaggcggaaagggccgccgcatcggacaacgccgaggggcaaactgcttccggagagtcgacgaccaaaaagtgaaataatcagtaaaaatgtagtttcttcttcattctcaaaaaagggaagagaccttcggtgatccccttacaaatgaatttttatctcgtttttaccagattttggccaacaaatttcatggtgacaatgaggatgtttgggcccaaattttaaaattttcaacgatcattagtgatctttcagtgcataacccagaagatttttagcgtaaattctaaaaaatgcattccgagggaaagttaaactgcaatattaccaaataaacatttaattgaaaaaaggttaaaacggaatttcaggaactctcgacacgactcttcctcactgactgccaatttgttaatggtacgttcgattcaatttataatttcgctcattttcattgttaaggtcgcgggtgttgtcatccttttcttcgccgttcgctacgttattctcaacgcgacgactgtatgatcgaaaaatgtaaaactgatccgactttcccactgcttttttgccctattttttgctgctgctattattccctttctctgtgtttcaccgacgcattttaggcctattcagctgacagaacacttgcctattttaagggtcgtttatgtcgccaattgaaatgcgatttttatgttattcgatttcaatgtaaaaaataaaataaatgctgtccaaatatatttctgttttgcttcccataaggttggactggcccctttaatttggcatttttgaacagagtcgggcttggcctggtcttgtcatatgttttgtccacccaaaaattcgaaccctgtccatcgaaccacagtggtgtcctctccccaaacagtattttttgaaagtattaaccatattttatttcattgtctcatcatatcttttgtttcactcgacatattgcgcgtttctttccccgtattctcaggcccgaaaaaacaaactgctttacgggcttcacatattgtatcatttaatgttttaccaccctctgtgttcaaattaattaatttctaccgtttaaataaattgctgtcgaattaaaaaaatatttttttatttgaaatatgaattaagaattccttaagctattgcggatgttgtgaaagagctcttaaccagacaaaacgcaccgtcatggtgagccttaatgtattccttaaagcaacgagggagggatgggactgggggttcaatggcagttcgaacaaaggtcaaatgtttttttctctaaaaaaatgataaattcaattttttaaatagaaaaaaagcaaaaattattttaaggaaagtgataggtatttgtgaaaaatccagtttttattggaaatatttgaaaaaaaagtgcgaaatgcctattgtacgaaatgccatgcaccggtactgggctcttcgttcgaagaattggtgagaccatgactaatccttggccagggccccagttcccgtccaactgattttaattaaaaaaagtttcagcggttgcgtttggccgtcgtccctccgtccgttcgtcgccttttctcccaattggcctccctctcctcgcgtcagttgctgttcattttgttcctgatgctgttcctctccaccttttggctgggccgtctgtccgttcagttggccgaattggacaacggcgcaatgggaggcattggcgaacggaggacggagccatgtgagggaggggggcgggaaatgcagtgactcattcatgcccatagccagaaacaaatttcggggtggaatccgaaaacttttttggggcggagtcgttatttaaaaaaccaccaatatgatttgatggaaaattatttataacttagcttaaaagcaaccaaattttaattcttgatatcattcgatagccctaacaataagtgttctctattagactacaaaaatttcaaaaaatttcgttaagtttcaaaaaagttatggctagaggaactcaaaaaagcttgttttcaagcatctctgggcctaacttttttgaaacttgacgaaactttttaaaattttgcagactgatagagaacatttagggctaccgaatgatatcaacaattagaaatttggttgcttttgagctaaattataaatagtttttcatcaaatcatattgatgcttttttaaataacgagggcataggacccattttttttttgctctatggaccaagaaatttttcaccagttgaaatgatattttaaggcattgaacagttggccaaaacgcctccgctcagcacttatttgatggtttggctgctgttgttcatttttgcttcaaaactcatatttcaattcatgtttgtaaagatttttaggtgctgatcatgacagggcctgatcaatggggtgagtaatgcttttcctccgcccccgcccgactcggatttgctactccccagtatcgtttcctccccccccccaaaaaaaaatttttttttttttgattttcaaacagaattttttaaaaaaaattttacaaggaaactttattgaatttttttttataaagttgggcgtttttttaaaaattctgacttttccaaacaaatttttttttatataaatgggcacgattgtcttttaactgaaaaaacaaactgccggactctctgcaatttctgacttacaaattagataattgttttttattattccttcccattaattgttttttatttcttcctatttttcgtgactatttgtgtttgcttttgccagaactccgtcgcaccattcgccaaacttggcttcgtctgtccaccaaaacgccgcaccaattccggcatttgttccccgtcggcacgcgcaatttgagcagcgcgcggctgggccaactcaacgcggaacagacggagcacggggacttggcactgctgcacaatctgaccgactcatacgaacaattgtcccggaaaacgctgctttccattgggtaaataattttcaatggatggacgacgaattgtaagctaatttttaatatattttacatttttttaatctgtccaaatttctcaaaccctctctctcactttccgattcaacttatttgttggtattcaaaaatcggattcccccccc

SEQ ID NO: 9955 - DNA, 852 bp, Heterodera glycines
gaatgctccccttattcatatttttgcaatactaattttcttcatcacttttttcagttttgcgatcgattccgtccagttttccttcctgctcaaggcggacggggactctttcgtccgtttgggtgcccttttgcacgcgttgcgttccgtcgcccatccctttctctactggggctttttggacggacgcgcgcggccccaacgcgcggtgggcggcaagtggcgggaggagcagtggcgactgtgcgaccgctacttgccctaccaggtggggacaccacgcattaaatggggggacaaagttttggaaataggcgtaaattgccagaaaatgggcacaaaaatggcacatccctccccaacggacggttgggggcagggaaatttaggcactttttacgatttatatggccgtataatttaattttatatcaaaaatgggtatattttcttggaaaacataaaaattgaaatttctgctgctcgttccagaattagccgatttttacactgttctacaggtccatgcacacaatggaaatagaaaattatagttttacaaccaaaaaatggaaagtctgccttgtccttggggcccagttgacctccctccccccgatctgtgccacaaccccaaaatccaacaggagattaggaagcaacgaatactttgtgattcaatgacatttcgctttcattttcagctcggcggtggctacgtgctgtcccatgcgttggcctccttcctccacctgaaccgggaacggctgaagctgtaccgcaacgaggacgtggcggtgggcgcgtggctggccgggctcaaagtgcgttatgtgcacgacccgcgct

SEQ ID NO: 9956 - DNA, 2032 bp, Heterodera glycines
  misc_feature (2017)..(2017): n is a, c, g, or t
tttaatttgggtttcgaataaattttgtaaaaatgagacttttgacctaaaatgaggctttttacctgtaaataaagattttgaaaatttaaatctgctaagcctgtttttaccaatttttgttaaaattagttttttattgatttttaaaaaacacatttaaaatagaagtcattaggcctgtgatttggttatcgttgtcgggtggtggcacaccctctaatggactgtcagatataggcgaatattgttggttttggtgttgctgtgtttccgtctcttcgtcctcatctatgaatacatgggctgttagccttccttcactatcgataaattgccgcggttgatgttggcgtatttgtgatggttgctgttgcgacattgatgatgctgatgtgatggctgttgtggtggtggtgatggcggtgatgtagataccaaactttgttgtgttagtagttgtgattgaagttgttgttggggatgtattatcgatattgactgttgttgttgcggtggttgtggtattgatgcagatgccaaattttgttgtgttggtagttgcgattgatgttgttggtgctgtgatgacgaggttgacggttgatgtgatggtgcttgcgcagttacagcagcaacgacagatttaaaaagcgaatctgcagaagtttctgtggggctgaatgcgtgttttgttgtcaagagttgggcgtccgtttgtcgcaatgtctcggccgtttgtagaccaaattgttcattttgcgcgaatgccattgtctttttgcgttttgcaataggcgctaaggaaaaatgtcatcctaaaataaaaaacaagttacaaaaagggttaagacatatatgtccttacaatgttgacacggcaatttgtggtctcatcaaaaccatgtatttttagagctccatttgtatttcgaagcatactataattaattattttttcattaaaacaaggatttatatatttataacccaatgttaagaaagaaattttaataatttataactttaaaaattacatttttcgtgccagagtgatgtctatgtgtccttcatttctggtgcgcttgtttatttcttcgaggagtaaaagaagtgactcgccagccttaatgttatgtcaattttttcaaaataagattaataaaattacatgctcgagtacatccgttccaataaatactcggattccccttggaacccaattttccaaaaatggcactgtttttcgcatctaatacagctacagatgtcgtacagccgaagtgacgttatttcgtagaattccttaccttcgtcatgaaagtccctctggcattgctccatgtggcgatgcgagcaaagctgaaaaataagcggtttatttcgaagttcaggcgagcaaaacgcccgccttccggcgagcaaaacgcctgccttcccgcgagcaaaacgcccaccttccggcgagcaaacgcccgccttctggctagcaaacgcccgccttccggcgagcaaacggccgccttcccgcgagcaaaacgcccgccttccggcgagcaaaacgcccgccttccggcgagcaaacgcccgccttccggcgagctaacgcccgccttccggcgagaaatgcgcccgcctttcggcgagcaaaacgcccgccttccggcgagcaatgcgcccgccttttggcgagcaaaacgcccgccttccggcgagctaacgcccgccttccggcgagatcgcccgccttccggcgagaaatgcgcccgccttctggcgagcaatgcgcccgccttccggcgagcaaaacgcccgccttccggcgagcaatgcgcccgcctttcggcgagcaaaacgcccgccttcccgcgagcaaaacgcccgccttccggcgagcaaaaagagaaaaaccccattaagccacctcttgcgattgctgacgtcgtgtgcgagctcctccaatcaaagtcagagacaggtgaagcgtccacaagggctggatgttgtagtccgcgangggttcgaccattct

SEQ ID NO: 9957 - DNA, 1495 bp, Heterodera glycines
  misc_feature (16)..(16): n is a, c, g, or t
  misc_feature (103)..(103): n is a, c, g, or t
tttttttgaaacaagnccgcaaaaaaatcgttttgaaaagcaaaaaaccatctatcaattctatcaaaattttatgtatacttggatgttaaaaattcccccngtatgtacttggaaaatgacttggtacgatccgagccctgaactatcatatttattacaatttccaaaaaaatttccggcggcgcatgtcgccaccgccgaaccctcattttaccttgttttttgaaattttaagcccaaaatgggtagatttgtcattttttgtggtctgagaaaatgattaaaccggaaatacagaaattttgtggttttcatatcacaacctcttaatatatgacttagactattggtaaaatttttgaaaaaaatttcgaatttcgcttttcgcatattttggctattcgcatttcgcattttttttttcatttcgcatttttcaatttcgcaaatttcgctttttatggcctgattcttctaatttagaatattttagaaattttcattcattcgaccaatttcgaatcccgaagtcgaactgccaaaattagtcgaaaattcaacttttcccaatttccacactttcgtactaaacttgattaaaacaagcagaatcaatcacatttaaatggctttatacagatctgaaatatgtgaatttctgaaattaaatttttcattattgttcgaatttgagtccagaattcaaaaaaggagccagtttttgagttttgtacttagtaatatggtcagaatttttgcagggtctaaaatttttggcacgaacacatgttaaaatacggtagtgtcgaactaccgtaaaattgttggtaattttatccgattaaatttgttaatcaatctttaaagatatacacttgtgaagcagggatgggccgaggtttcgcttttcgcattttgcattattcgcatggcgtttttcgttatttcgcatttcgctttttggcgcaaaatgcgaaagttccacccctaagaatgaatatttttgtaactttaaatttttaaacgaatgcttccgtttattattattttgggctgcatgattaataattacctttttttgctattttatgaaaaaattcaatttttggcatttgatcaaaacaattattaatttttgttaaatttaacctaaaaataaaaaatctcagtgaaaatctgtgtgtaaaattgggaaaatttgactctctctattattttgtctctctaattatgtcccattttctcctgcctctgaccggacgaagtgagcagcaaaagagacgagccacccctaccgactgattggccttcaattttgcacgtctgtttaaaaaaggtaaatttttctcccggcatcgccaatggcaccgcacaccccccccccccccccaaaaaaaataactcacatttttcttaacaaattgacccaattttgtctttttttggtcaaaatcttttaacaaatcataagcaaattttcgaaattttcccg

SEQ ID NO: 9958 - DNA, 2114 bp, Heterodera glycines
gcgtgcgacggagatgccaaaaaagcagatggccattcgctccggtggtccgccaaagcaccgtagggttaaaaacgcacagaatttaaattaatttcattttaaaattattttcataaagttaaaaataaaatttatatttaagccttatttccaccaccagtagcagcagctgtgcaattggaagttggattggaaacaccacctccaccaccagcagcagcagcagcatcaacttttacaccgccgacaccaccaccatttcctactccatttcacaaacacttctcatttttaacaccgtcaccaccaccacctgcaacagttgatttggatcagattccacttcccccaacaccaccagcaacattttcattggatttttggctaccacccgcaccaccaccaccaccagcagcaacagttcatttggatatgaatcccacatcatcatcaaaggcggcagcagcagacgaaattgaacgtgaaaataggaaaaagcggcgaggcaatcggtggaacagcacacaggtcagattgggaatttattttttaaatttcaattcgattaaatttacttttttttatttttaactttgtattaggaattataaatttgtttttttttaaattgtaatgaaattatagaagcgccagactgtgcgcgtaaagaagggtggtgtgccggcaaaggtagtgccgcgccaccctgagccggacctctcggacgacgagtacgtcgtcaaggctattttggcctactgcgaggtcaaaagccgaggggtcaccagtaaatgctactacatagactgggccggtgagtcttccccccccccactgccctccaactgttttgattaaaaatttttaaagaccagcgtggtcaggagagctggattctgtccacatgcaacgacgcattagaaattaccggcgaacatctcgaggattcggctgtggatgccgcatacgacgcggtgtacggcgagccggtcgctgaccatctagcgagaaaaatcgtaatgagacccaaataccacgatcgtgagttttttttctcgacaaatttttaaaataatttaaattgtgaaattcagtccggcgtcgaatggtcggagtcaatgctgcaccgatttgccgtcagcactttgctttccacacttgtgtcacaaaggaccaatttgataaggtgggttgggggtctgctgctgtttgcctttgtctctctcgctctttcttatatttttctgggcattggttagcaggcatctcttggtatttgcccccttaccaatgctcttttctgtaaagtggagagcataaggcaggcatctcctggtatttgccccccttttgtttttcatttttcatcatttctctctctctctcatttttctgtgtattggtgtgcaggcatctcttggtatttgccccctcatcaatgctcgtttctggaaggtggagagcataaggcaggcatctcctggtatttgcccccttttgtttttcatcttttatttagtttttttgtctcgaaagtctgttgttttcaaagaaaatcattctaaaacttttataaaattaaggcggagcgcctttacaaagaattacttgtcagggaggggctcatcgaggatcccccctcccacggagctcaataaattggaggaaaggcgccttggaagcaacgtgcccacagtggccataattattaattattttcacctttacaattttaataaaaaataatgtttgagggtttgttgaaatgcaaaattgaaaaaattttacaaaaattaaaatccaattttaaaataattaggtatacaatcagataagcaaataaatggtctgcgatgttataatgaaaatgttttacaaaagtgcaagaaacagtcgtccaattttaaaataattaagtattatgatcaaataaatgatcaatggtgtcattgaaaatgttttacaaaaatgaaagaaaagttttccaattttaaaatattaagtaatacaatcagataagcaaataaataacatattatgggatagagtgacagacagaaaatgctgcaaataatgtgttagtgtaatggatacttactcattgttctgta

SEQ ID NO: 9959 - DNA, 2553 bp, Heterodera glycines
gttttgctccctaaaaatccttaataaaaattttaaaatgccttttttcatgccattttcgggattttatgccttttcatgcctctcaattttttggtgcctattatagtgcctttttcgcgatttttggtgcctttcttgcgagctctagaaatgacaattattgcacctttttcctaacgactcgtcacgctaattaagtcatttttatggtgtttttcatgaattttttgtccaaaaaatattttatttacatatttgtgggctttacacacatgtctcacttataatttacatcccttagaataataatgaatgataaaatgatatggacaaaaatgggagtaaattgactgacgaatcacagaataacggaatgattgaacagggaagatcagtgagtggtgaaacccaataaatcacattaacaaatggaaatggaatgaatgaaaagaatggggcggagatcaccggcttacaaatggatttggggggaccaattacaaatggatttggggggaccaattacaaatggatttgtgtgaatacaatgcaaaaactgatcagtcgttcttccaatcaaaattcgtgctgtaattttgtcgcggctgttttctgttcgctgtgtccccgttgaactgaaaattcgttggatcctctcaaaacacaacttcaatttgcacaccttttgtgagctctccagccgagccctgagaatgtggcgccaaattcggcaagcgatgccaccactgacaaagggattcaaatttgggtttttgaaacgattagaatgtttagcggacagtcacctaccgaatgcccaacttcatcagctcctctctggtgacaaactccaaaatgtccctttttgtgtaccgctctctctccaagagctcaatcgaataatcgtcacaaccgatgcgcaaaagccattcacgtaagggttcatcatcatcacttaatgagaaagatgtacatccgtaaattgaattataaatttggatacaaaaagttatgaaataataatttttgtagaaaattttaaaataaagaaaaaataagtgtgtgtgatgaaatttaaatgaaaatactaaaataaaaaattgttacaaaaatcattaaaaaattttaccggaaaaccggaaataggcggtaacataagtcgaccggtaaacggttatttactgggttttttacccccccatatctgttccccacctcctccccatatatcaggttttttttctgaaaaatttcggggagggggaataatctctccctttgtctccattctcttgtctgggtcctattttccgttctatgcttctctctctctctctctctctcttcgcctatcgttcggtcatcagatattctcagaacagatgatggacccctgctctcgtctcacctcagtctctccatgtcaatgccactgtcatcgacggaaaggagaggagaagcgaagtgagtgcctccccctgctccctgctgctggtggttgctgccgttgttcggcatttgcccttgtcccattgtctgttgtgatgccaacgttgcccacaattgctgctgctgcacgccgttcggattcccaggcgtcaaatcggaggccgaagtgcacagtgagcggatgcgttcctgccgctccacaaatgccacctccaacacactgagcaatttgcgctcgacactgaccaagtcgtcccagagactgacaattgttggtttcactttcagcatttggctgtttttaccttttgatttggtcagtgtacgccttgcccaacagatcgaaagacgaagccggcgccaaaagcgaagattgttgggggacgggcagcaactgatggaccgacgaacattgcttggaattggcgaagccttcgtcgcgactcgtcggctcttctgaaggaagggagaagcattggtcagtcaaagcagcaaaagtgccaaaatgtcacgtggtctaagaaattttatcgcttgctgaacggcgtttcgtatcaaatcgtccaaagtgaacatccaatggggcttgatcttttgcagtttgagcagcggttggacctttggtaaagtatgttaaaccagcagaaaaagcacttcgtttccgttaggattttaatgctaattcatcagacagtaagcgcatgaaaaatgggctaccgtattcggaaaaaggtaaagagcaatcatcagttggtgcaccggtgccatttggtcactgtgccgcgggtcgaactcgcgacaaatgccctccagcgtttgctggaggtgttcctgcgcaggtgtcacgtcaatggcagtcgacccaccgccttcttttggcaaaatgaaaagctgaaaaggggaacatgaaaagggaaggaatggagggaaattcattcacccgaagactttggaggaggcgagtcagtgccacgggggagagaagcgattcaccggcaccgaactcattcagcagctgctcatgccatttggcaatgatctgagtgtgatcgaatcagctgaccagacaaaaggatcggtttatgggtctcgaccccctcc

SEQ ID NO: 9960 - DNA, 2730 bp, Heterodera glycines
gctcgccctccttctgtagagtgaagaaaaagttggagaatgaattctcttcgggaatgctcaaagccgtggagggggaaacgccgagaaaaggggcgttgtcggagccgaaggaagggctggcagtgtggggcgtttggtggtcgcgaatgggacttaaggcatttgaaaatggaaataaaaattagagaaaacgaggcggaaatgacacagttaaaaagtgacgtaattatcgtgtaaatacatgattattagcttttccattcgctcgacctgttcggttgtgaaaattgcacagggattgccagtggacttgacggtttcggggctctcagctgatgtgcggtggcacactgatgcacaacgccgacattttggtcagaagcaaagcccaaaatggaggagccaaccgtggggacttttggggaagcggagaacggcccctgggggcacgggggggagggggcaaaggacgtggcagtgggattaatcactgaaagggatttgtgaacttaaataaatagcgaattcacttacgcgcagcggccgatgccatcgactgacagcaataggacggcatcgacaaacaaggttcaatgcgcaacttcaaattacgctcattgcccatccgacggtccgaccgttccatgggcggtcgatttcgcattgacacggaaggagtgacgtgtatttgctgagggacggaggagagggacggagtggccagagaagaatttggcaaatccactgaatggacaatgaatgggagaagagaagtgccgtggagcactcaccgatggccatggaagaagacgaacacgccgaagggatggccaaggcggaagagacagtcatgccactcatatgagaagcagaacgaaaaaactctgaaagaaacgcgcagtcacgaaagagagaacagaaaaacagcacttgggcatgacaatggcatcggaaaaggcaaaagtcgcattgatcagacaaattgccatagggaggggggggggggtaggaccaatcccacacattcgaatgccagcaaatattggaatttcaaaatgtccaaatcggtggtccctcctccgtcccatttggccttttgactctctcatgcactcactgctcgtgtgttttccgcctcctcccgtcgttgagctttcaattctcttcttcgtgtttgcatttcggctgctgaaatgcaaaaggtgtgggctgggcatactgtaaagggagtgacttacgcattactgtagtactgttggatgaaagggtcgcccagcaattcggcagcactcgaacgatcagcgggatcggggttgaagcagctgaagaaagaactgattggacaaaaaagacagacagaggaatgaccttttgatgaaattggaagccgactcactgagatgggtcggaattggcgggtgaatacggtgcattccgactgaacggtggacaaccgtatgaaccatttaaaatttcagagtggcgaaatgacccaaaagtgactgacctttaaacacagccgcttctggaagaccaagctgttgataaacgagtgctttggtcattaatgagcaattaattacctcgataaaaggcggctttcccgtgaccatttcgatcaaagtggcgcctaaatgataatcaattaagtattgtcacttttgtaattagcaccaaagctccaaatgtcagctggtgggccatatccctgaaattgggtgaaaatggtaaagggtcaaatcaaattcgctgcaccctttgcccgccggtgatcacttccggtgccatgtattggagagtgcctgaattaattaaaatggtagtaattccgtccaatggctgaccctttttcaattgacctttgaacgtgtcggtgaccgggttaaggccggcaagccgtttgcaagtgccaaagtcggatattttgcacagccccgagtattggttgaccagaacattttcccctttaatgtcccggtgaacaatcttttgagaatgctaaaagtggcaaatggaaagggacgggcgcaatggcccaccaaatatttgagaccctccagaatttgacgagcgtaaaatgccatcgtctgctcattgtccaacggaccccatttggaacggatcagcgaactcaaactgcctgtcattttgttccaattcagtccaaatgcctttgattttggcattttgcttttctcaccccccggcacatgctccatgaaaatgaggaagaaagagcccgcctcgcgtttctccaccttcgagccgaggtatttgacgatgttgtcgtgggagagcgtcgagtgcagctgaatctcctccatcagcggctgaacctcctcctcattcttcacttcgacttccttcaccacaatcgaccgctgtgtggtgatgtcccgggccgaatacacctgaaaaggcacaatgccaaagtaaccaaatttgaatggcataaaaggaggccgagtcagcggcatggaagaaaaccgagaaaagccggaacattattgtatgtaattgttggggagttccttttcaagactgatttgcgagtattggacccgattagtctctaatttatattcaaatcatgagtaattacggtgccgtaagtgccacggcccaacacaatgcgttccctgttgctgtcgacttcgtattcgaactgaatttctttgttggccattgcatccgagtgtccccctcccctcctctgcctgcccacct

SEQ ID NO: 9961 - DNA, 1351 bp, Heterodera glycines
aaacacgacgcatacaaagtggagacggtgagcaaagaatgtaataattaataaatgcccttttgttagccaatgatggataatcaaggaaaactctcggttcgactcttgaattgataaaccgaaacttttggattcgatttgcgtttctcgaggccattctcggccctgtaaattcattgaaatgtaaccgataccataacagatcggcgatgcttacatgatcgtcagcggagtgccgcgcgagaatggcaatgcgcacgtgcaacacattgccgaaattgcactcaaaatgcgaatggcaagtgatagtaaagcaaaaacattaggaaaagcatgctttatttaatacagaagcaaatcattatttaactcagtttgtgaccaatttcaaacttgcgcacaaaccggaagagattatgatggttcgcatcggttttcacagcggaccggtggccgcgggagtcgtaagagcattttcactggattttaaatgaccaacggcggcattttgacattaaaaacggaaaattccgtcggactttatttatttttaagcaagggacatattaacttcctaaaatttggcatgaataattgtcccatttcaaaggtcggtttggctgcgcctcgctactgtctgttcggtgacactgtaaatatggcgtcgagaatggtttttctccccacaaaaaaataaatttaaattataactaaaattatttttcttaggaatcgacgggaatggcaaataaaatacaggcatttttattttaaattttatacatttatttattatttgttttacattttatagatcagcgaaaattcgtacaatttgctcaagtgtttctacatccaattcgttgtggtcgaaaggggaaaagttgaaataaaagtgggtgagaagagaagacgagcgaaatgcgacgatggcattttaaaagcatttaattaaattaattagcgtattccctctcaaaaatggggctttcttttattttagggtacacggtatttaaagatacagtatttgattttctttttttccctgcaggggaagggtgagtgcaccacttattttttggagggaagagagaaccgtcggggcctctgatgatcagcgacggggcaatgggccaaaaaagtgagcggcggcgacggcgaaagacaccgcccgaggcgacggatcggtggaattgcgctttctcccaattaaaaacgttttttcgtatgcgacgcattttcattagtccagcagaaaaataatgatcaaaaaggagaatctgctgatcattttcacctaaaaacctcactcagataaccaatgcttttctcccaattctttttt

SEQ ID NO: 9962 - DNA, 1797 bp, Heterodera glycines
tgttaaaaatttgatttagtgatcccgaaagcgctgaaatttatgaaaaatataataatagaatacattttggatcgaataaaatgtagaaatatttgaagcaatttcgcaaaatgttcttatttttgaccctaaaatcttattttttggcctttattcttattttgaaaattttgaaatagaaaccctggatttagacaaaaacacccataaaaattgactattctggcataatttataatccttaaatttggtcatttttagacaatatctgtgcaattataccaaaaaggaattgaatcgaggcgatacatcgaataaaggaatgtggagccaaacacatcattcaaaaaaaaaaaaatttttttgtgatgttttttggagctaattaaaaacaaacccccacccccgtccccgggggcgagaaatttctcacccccgcgactctgacccccgcccccgcgaaaagccacccccgcccacggggctcgaaccctatttaattcaatgccatccctcagctgccgttttgctattctctatcatctgtctgtaaatggtccactgctcgtctggcgacatgcgcaagaactccctgttagccatgagctgtcccattaattcgattctctttccatcgtttgccgtttcattttgaggaccatttgctgctgctgattctaattactttgtaattgatcatatcgtaagtattgattgattgaattgtttgtccaacctttgtcagatgagtgtttttggctagcgaaattcggttgcgatgtctttgcccgtttcttcgtcttttgattttgcgccaaccattcagctccacttgttgccatcggtgtgatttctgaatttgccttttgttagtctttccaattaatcacttagtaatgccattgccataacctgtgggttggccactgagtgatggctgctgcctctgttgagattggcctccattttcggcacggtttggcactgccggtgccccatcctttagcgatttgtatatgtgccattgtgcttcctgtgacagttccgaatattctggctcggctaacatccgttccaacaatgctactcgctcggcatcccatcgaatgttttgctcatattgtcgtaacaaatgaagcatagcacacaactgtttttggtccgtaatgccgccaccccgggaagcgatgtcgtccgtaagccatttgaaagttgaaaattgttggccgggcgttaattggaggtaatcagtgcttgtcattaacagtcgcaaaagctctttttgtgccgattgttcggaacccgttccgcctgcattcatattctttgattttgctgctgtttgtgtattttcgcgattcatacaattgcaaatgggaaatgaagtgaaaagaatcggaaagagaaggaaaagcggcccaaaggcgcgattcatcccggagggcacaaaattcgaaattgctaaatcttttaatattattttaattttaaatgattttttttacaaaatatgtaaagaaatataagcagcagagctttcacgtgtaataagaaaataatgatgaaaaactataagaaatttacaatttaatgcaaatgtatgaggatgagaagtggcaactcaccataatttgcatgattattatttgctttataaaattttctcttcattgattaatgtaattcaatagagatattgccaattcattcatttttataattaaataataatgttttaataatttggatttggttttaaaaaagttcttaatgtagcacttcttctatcctgat

SEQ ID NO: 9963 - DNA, 3087 bp, Heterodera glycines
  misc_feature (57)..(57): n is a, c, g, or t
  misc_feature (69)..(69): n is a, c, g, or t
aaaatggattattattttttgtcatttttgcaatcattgaaaaaacaaaatgaaganaaatataataanaatgaaataaataaataatgatttaagatgagtccgcttccttcattatcatccaccactttcaacggaatttgcactcctgctcaaaaggaatgcataagttagcaattaattacgctaattgcgctttttgctcacaaaagttgcgtttccgaccaccttcagcatcagcttcttcaacttcttttgatgcatctcaattttcttctcaattatctgcaactttaaatccaattgcattacaattaaatgctccggggtcatttggccaaaactttttttttagggataaatttttgtgtttgagtggaaatgccatattgggctcacataggcctcagacctgtgaatgccttcatcattgtaagctttacttcccccctccatttgcctgcttaattcggctcagttcgcgttcctcggattccattgtggccaatgcgcgctcatatttctctaacagggcgtgccatggggccattttttggtttacaatctaaagaaacacagcaagacttgacaagatcggcccacttctgcagctcgagagtcttggtctcgaaacagagatttttacatcccaagggattggatttttggtgattaaaatggagaaaagtgccaacacttttgaaagtctcattggtctcgagtttatacccgagaaaagctcccgggcacttacttcgatcacatcgtcaacccaatcggcgaacacaaacaactgaaggagcaccaggacaacgagcagtgtaaagaaggaccgtcgcacaaatcggagaggcggcgaagggcccatttaaaggggaaaaagcgtcaaaaaattgggcggctcattagcaaaacgactaaaagagggaattaacgggggaaaaacagtgccgattagtttatttgtgttaaatttttcttcaattattcgtcggccataattaacattaaaattcataaaagttgcaaatgatatttgttgatctgagatgaagccgagcaaaaaaataaaaatatgtttttttttttggagttggcgagtgaaattttcactgatcaaacatttggacattttggagggacggaaaacaaacagagaaccgatcggacggaaagcagaagcattcgcagcaattccggttgctatgaatgggcaaaggaagaagagaaagcaaattaaatacacaaattatgtatttcgcactttccttttttggaaggttttcctcaaaaattacgattgcttttacaaaaataataatcaaaaatttaagtgtaataattaataaattaaacgatcaaaattcgataagcaatgagaagtggctcttctgcagtttacggatccgatcaaaacccacaggttcaaacacggggcattgaggcgattattgaaaatggttttcgtcatttcatggcacaacccaaacctttacagtactattatatttgtaccagtaaatgtttcggctatttgacaataagaaagaatttcaagcaaactctcgaagaaatatatattcaataccagtaaaagcaccttttaattacgtaatttaagaatagcacctcttttattccgtatgattaattaggaattaaacccaataaagtcgctttttcaacttatcttcgatgatttttaaatttaaacacaccaactttattcatttacttgctcaagacataaaggcatttatcataattatgcaattagcggaaaaaggcattttggaatttggctaaactgagggagcaattaaaaaatgattcaaaaagaattgttaatttttttgtgattttcactgctcctccagcagatgattttcggttttcgtatgtaaaatatggcgaatttgctcacttttgctcactttcgatcaaatgaatcgtcccattggatgacattcatgtccaccttttctgcaggattaatgcccccaaagtgggtactgctcgaaaaagtcgtcatgttcggtgtcgaccaaactgttccaaccgtcctaattgtgtagatgtacagttttgttggcactttttcattcagttgtttgaccagttcgaccaaattttcagtgaaagcgcttttcacagctcctttgttaaagtctagaataaattttgaaagattaaattgtcaaattcgaattccctaaatccactgttaattgctcgcctttctcgacatcgaccgcgacgaagtccttgtcctggtcaaatccgccttcttaatcgtgctaatgaagtgatccgtttgcgcttcggcgcttggactatttggcctcccctctgagtaattaaaaaataaatgaattttgaattgcaaagttgttatgaaatgattactgtgaaatgtttgctaattactcaaaataatgataagcgccacgcgttgaaatgctcgcctttttcatccctttgaaattggcttcaaaccgacggtcaacaaatgcgttcccttggatggccttcgaaatggcaatcatttattttcttccgtttatcccatagatgcggattttcttccaccactttcttccaattaatttcgcctttatggtgcgaaatgtcaatgaaaattctattgcattctgtgcaaaaaaagaactttcaaaaaagtgcaaatgaacaccaccaaataatttgtttaattgtgaaccgctggaaaacgatcgtaaggtgaaagttaaaaatgggcttttctggcggtgtctggacaactcatcatcagttggacaaaggacaaagccaatggacaatcggaatggacaattcgtcagtggaaaataagccagtaaattttataaggaattttttaataaaaaattatttaatttattttttgcacatttatctaatgaataatttgattaaatttctttaaaggctgaaaattacagtaggacaaccctcagggcaaacggtaacagtcatttaccattggttttttgccatttttattgaatcaaccgagcaaaaagggttttaaaaaattggcaagctaaggaaaaactcaaattaattgag

SEQ ID NO: 9964 - DNA, 5532 bp, Heterodera glycines
  misc_feature (4204)..(4205): n is a, c, g, or t
  misc_feature (4222)..(4222): n is a, c, g, or t
tttgcccaatttttgatgccacccagaaataacgggattcgaggatccccttcaacatatttttttaatttgttgctattttcaactgcatccctgtttccaactccaacttggatcttgagagatcccctttgagttgaaactttagcatccaaaatccaaaacaacaatctgtcgttgtacagctgttgggcagtgagaagggtttgcaagaatcccaaatcatccaaagttgctccctttcgccacacaatgatcgactgcacgctttcaatttgcaattctttcgagaaaaggtgtgcgtcccattcttcgggaaaatgacaaaattgccgtgcatccgcgttgatgagacaattacggagcacaccaccgtcctcttccccttgccccaatatcaaaattggggctttgatgaccttcaccgccggttcgtcgtcatggtaaatgtcgtcctcaaacagtgccgttggtgtcgttgttgaactgggttgttcggtcggttgtacttcatcaatttcgtaccactcttcctccatgctggctaggctaaccgtgtcttccattgttaacgctgaaatttcattaatgggattagggtcagactcgagggtctctatttccagtgggtataataaaatcgttgacctttccattatttttccgtcgggcatttttaatttggcagttcggttattgattatactttctattttatctaatttccatttattccggggacacggtttttggtcattgattagtaccacttgtcctatttttggaaacctttgttcatccacatttttggccttttcttgttcccttaatgccaataaatagtcatccctaaagacttcccaaaatttggtactcttatacattgttttcttgtgaacttcgaggagttcatccctttttgtttggttaatttgtgaatctaaatcgtctgtattctctgtttcattagtgtcactctgatactcaaatggttctccttctgatgcattgagaatatgtattgggcacaagggctccataatttcatcattctcaatgtatgtaattggtctctcattgactatcctttctacttggataagataagtcaataattcttcataatccaataattttttacctaaccctctgtataaatggtgtttgactagaccgattagtcgctcaaaaaatcccgagcgccaaggcgctaatggagaggcaaattgccatgtgatacccttatttgctgtaagttcttgtacctctctttcgttcatgatcattgaccatttctcttttcttctaattccctttgtctggtctgaatttgaccccaaaccttattttttctccaatgtgcttcagtaattttagccaatatcttatgagaaagaacaaattggctagcattgtcagaaattatcatttttggtactcttctacgcctcatgaatctctctaaagccaataagaatttttgtgccgtacaatctgtcactatctctaaatgtatggcacgtgtgactgtacacacaaatattgctccccaaaccttttgcgtttcttcattgacctttattgttattggaccaaaatagtctaagccaattgtttcaaaggcacttgaccctttaactcgatgaattggtaaggggggaggatttggataactgaaagccttggcttctaattttgcacaaatcccacattttgtatatggatttttcttaatgaccatcgtaatcattcttctgcattttggaatccagaatttcttcctcagataattgagagtctgagattttcgaccatgttctgtttccaaatgtgcgtcagaaataagcaaatcaagaatcggtatctgatgagacagataaataggatttactgtatcataatcaaaccctccttcttcaattcttcctttacacctcaatataccattatcgtctgtgaacatttgtaaattcctcctggtattttcatctggaggaaaattctcttgcatctctttgataattacttcctcagcctctcttaattcaatcgccgtgagaggcttaattctttttatagtttcacttcttgccttgagcaatttgcgttcctgaattggctcaatttgttgtacaaattgaagaggccccttgtaaattcgcctaatatacgccactgtatttctaatcctcttccactttgagaagtggttcacataaactgtgagaaaggaacccaatttcctttggtttctttcccttgccggattcgccagttcacaaacagtgacctcttgattttgatctgcccatacatttggatcaaattctctgattgtttgtggccactgtgtattttttagacttataaacggcggtcctttccaccataattcattggtttgtaaatcttccggacttgtgccacgagaggcaacgtctgccggatttgattgaccctcaatatgttcgacattccattgtctcattttttctacccgatttttaatgtatctttctaattttgacctttgacataatttaaccatttcgaagtcaaaagcattgcgtgtaattccaaaatcggaatggtccgatactttgatggaattattgctggaacaacaaggcttttaccaaatatgagattggcatttatttgattttgattaatgactctcaaatatattgccgttcccatggccttatgtgatgcgtctgagaacgcatgcaattcacacttacaatttttaatcatttctttcggaatgatattccttggtactgttattgactgatcttcccagtctttcatcagtgttatccattcatttagctcttcattagacaacgaggtgtcccatttgagctttttattcgtttctaccctttgccgaaataattttgctggcaaaattgccggggccgcaaatccgttcggatcaaaaggtttagcaatctgtgctaagaccttccttcttgtcaacttctcagacttaaacacgggaaaatgtatgaccagagtgtcattgttgatgtcccattttattcctaacaatttgactcctccttttaccacttggtcttcacttggtaatttctctatttccttggtacagttggacacaaattctctcacattcatacctgccttagaaaaaatctctttgagaagagagtaatatgactgaatttcttcagccctttctaaaccaagtattatgttgtccacataaatgtctctctctatttctcttacttttttgtccttgtatttggacaaatgaagtttgattgtcaaagagagatgagctggcgaacaaatgactccaaacgtgactctcgtaaaccgatactccacgaggggagaatcttctacaaatgggtctctgacccacaagaatcgcatcgcattcctatccttaggatgtatcaaaatctggtgaaatgccttggctatgtcacatgtcaagagaattggtttaattcgacttcgaattaaaatgcctgctaaatcattataatcattatctcccttttctaacacttggtctgtgaccgaacaatttaaaactttggactgaaaactccattttatcaataaccgaaactgctttctgggttaaggatcctgaatttcaaaaccccaaaaaaggggaaaaaaaaaccccaaaagggggaaagggggccccatttccccattttggaaacttttttaccccccccgtgtcaaaattaaaacttcttttttttttaaaagggggaaaattttgacaatttttggttttaaaaaaaaaaaaaaaaaaaaaaaaaaaaccccccaaccccccaaaaaaaaaaaaaaaaaaaaaaaaaaaaatttttttttccccccccccaaaaaagaaaaccccaattttttttgtaaaggggggggggggcccaaaaaaaaaaatttttctccccaaaaaaaaaaaatttaaaaaaaaaagggggggggggggggggggggggaaaaaaaattttcccccccccaaaaaaaaaaatttttttttttttttttttttttttttggggggggggggggcccccccaccccaaaaaacaaaaaaaaagggggggggggggggggggggggggggggggggggggcccccccccccccccccccccccccaccccccaaagggaagggggggagggggagccccctcctctgcgggggnnaaaaaaaaaaaaaaaanaaaaaaaaaaataaaaaaaaaatattttttttttttttttttttttttttttttaaaaaaaaaaaaaaaaaaaaggagaggaacttttttttttttttttatattttaataaacaacacaccccccctttttttttttttttttttttttttgaagaggaaggaaagaaaaaaaaaaacttttttttttgggttttttttctcccccccgccccggcgggcgggactacaatattttatattttttttaatgatgtggggggggggggggggggcggggggggggggggaaaaaaaaaaaaaaaaaaaaaaaaaaaaaaaaaaaaaaaaatatggggggggggggggggaaaattatggatctttctgtaatctgttcatttttcccttggatcgaggcttgcttttattaatttatttagtttgaggaacttcgtccatcccattgtgctttgatatggcctgccctatcttgatgcaccttacaaaatcactcagttcgcaaggagaaatcatacgtaaaactctaaaattagatatatggcttctagattgtgcgccattcattatcctccatttcaattttatattctttcctgtaatttacctccttcacacataaacattcattactttttttgaaactctttatacgcattaacgattgtgagatcgtaatcagttcccctcttgatatcatatttttttcgcatcaattcctttacattcttttgggatttctccatctaaatgtaatctctttcatttattttctgtccttttttatcaaagtgatcttagtgcaatggcataggataaacgctcttatatacgaggtttttgtttattattataattcactctggattattctctattgacttttcaacatatattcaatccttacgcgttattgctcagtcctttttcaactgactaacatcataatagggggggaaggcccacctcgaggccgcgaagcggccgagtgagtaccttcggtgcaggaaaattattaaggaagagagttcattatttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttaatgaaaattcaatcactcatttttcgagtagtgatcagaagcgcaccaaatgtgcaggggcctaaaaaggtcaaggaaaggcgtctct

SEQ ID NO: 9965 - DNA, 1603 bp, Heterodera glycines
tttgcaacaccttaaacattttcatttaattatactttttttaatttgattcacccggcctccggatttcttccggtcagatcgattggccctttttcgctgatttttgtttgacggcacactgacattactgtttgaacgtgccctttaacacaaggataattttaaacgtcagaaccaatcagttctaaccgaggtgccctcccgtggctgcttttgtccgtcgcacatacggataactcggacacattgccatcttgtggccctatttcttcattaaatgtcggctcattctccctgacaattggcactgtgcgattctcttcgtagatcaggccggaaatgcgcttgacgcccccacaatgatccaaactgcgaatggccggattattgatgccttgaatgctgccaatgcgcggcttaaaaacggcactttgattaaaataacccttattttcatccgaaaagcaaaaacttaagccccaagacttgaaatgttttcgcgcatctttaccgttttttccggaagtgatccgtcaataaatatttcaattggtggcaatcgaaatgcaccttgctgaccattttggacagaattagcgaatgagtgatgatcacccatgctaaaattggtgattaatatcatttttaagtaaaaaatggcggcgtgtaaataagaattactattacttttgcatgtgaaaaaaaaaataacaattgatcattttttgatcaaagaaaaaatcgcaaaaaatgttaaatttttgaccacaaaatctaatttttggatttgaaaaatttttgaatccagacccaaataaaaaatcattcgccagatattttaatttaactgaggttacctttccgaattttcttcctcaaggttattgttttccacgtccatgtttaatgccaaagcattttggaattcgtcgtgcagaacgatgttttggtttggtctccaggcatggtccatttcactttcctggtgttctccgttggtatttgcctaaaaatggagtttaatgtaaagaattaaagtttttctcgcggcggcacaacactgttcataaagatttgtgaaaaaatgcttcgcaaaagatgattttttaaataattaaaaatcaccgcctgacttaaaaatcacaaaaatttttaactatttttagtgacaatctattaacaaattatattttttccatcccaaaatctaattttctataaaattttgctaaaattgaagaattcgccttttttgaaggccaatttttaaataatattttaatattactgtagaattttcccttgttgagtttgccaaaaaacgaattgcactttcacaaaaactggtagttgacttaccgaatcgattgtgatgttctcaccaacaacgatatccgaaattgtgtccataaaattttcgagttcttcgttcgctccattgccagtttgttcgcaacgaatatttttataaggtgcaattttcatttttttcgacatattctaaataaaatatttgtaagcatttaaaacgggtaaaaatccaaaaaaatatcgaatcacaatatatgattgctgcgcagaattaaaaacgaaaaggcaa

SEQ ID NO: 9966 - DNA, 1433 bp, Heterodera glycines
gggggaatttgggggcggaataatggggttggggcggaataatgtgtctgatactactaacataatatttttgcagatgtggaagctgccaaacgcgaaagaaaacaaatcggaattgcaaaaattttttgggggtgggcataacggaccaacagtgaggaaacgatgcacggcaatggcatgaattcaatgcatttttcgtggcacattcgatgacagagtcggcactttgatgctcagcgatggcattggtgctgccaaacacgaccacatcaacgcttaactgaccagaaatggtggcatttgcgcgaagacatgcttttacctgaaattgaccgaaatttacaacttttatcaacttctaatcagcaaactgtttttgcaccaaaattcttcaaaatttccaaaaacaaagcatcaaatattcgaaaataaaacttccgatcttgctgtaatgatttaagttcaatcattccagtctgtccaatgtgctgtcgtcttggctccatggtccggccgtttccatttgacattttatgaggacatggacgatcgggagtagagaatcaagcgacgtgactcttttaaaattcggagatgaattatttttgataaaattccatttcataggggtgtatttttctgaaaatttttggatcgattcttaggagtgtatttttcgtttttattacatttttgttaataaattttttaaaaattgctgaaaatattaaaaaacatcaaaatgacgaaacagtgcaaaaaaaagcaccaaaatgccaaataagcaccaaaattaaaaatagaaaaatcagcaaaaatcagaatgaaaaaagtggagttagaagcctcaaaccaagttagaaatacgttttttatgcttattaacacgcccaattagcaaaaaaaaaaaacagcatatgctgcaaaatgagtaatttaatcattatgtttattcatcaaaatacaaatagcgccgagggatgtgttgagaaggacaaaaagggggcgggcggggagagagaaaacattggcaaacaatccaacggcaaatgattctcatccaatcggatctttggatcattatttcattttgaaatttataataaaatttcatttctgttgccggcgccacacgggtcacagtttaacaaccacggagccgggaggtgagacaaaaaatgggagagagacaaatggacgaaacgggggacaaaggaccaaaatggaagacaatttgggccaaatgtcggacaaataaacaaaaagagggacactaaggaaaaaaacagagacaaatgcaaaaaaggtgataattgctaaataaagtgaaaatggccaaaagagggcaaatggtcaaaaagtgggataatatcaaagagccaaattatcgatgaggatgttttaaatgaagttttgggctccattgcatt

SEQ ID NO: 9967 - DNA, 1394 bp, Heterodera glycines
tgtgcaagaattttgccgaaatggtcaaccgatttggttttgtgcccgccggcggacgcatttattacaacaaacggtcgcagccgccattcctcaccccgtagggcaaatttgaatgaaatttggttgaaatttccaactttcagtttggtctatgaatactttggtgcaactggtgacattgaatttcttaaggaaataatgccaacgcttgaaaaggtgttcccattcattagcataatttatcaattaattaactgataattaataaataattttaaaaaacaaaaaaatgttttctttatcaataaactaaaaataaataaattattaaagaagttataagtaatgaaataaattagagacaattatcagggtttcgaggtttttatattttatgcgttatgcaaaaccgaccgaaataataaaaaattgcctacctttgttcaaaagcaaccaaatttttaattcttcatatctttcggtagtccaaaatgttttctattagcctaccaaattttaaaataaaattcattatgtttcaaaacttatggccaataatgttcgaaaaaattgtttttgagttctattgactttttttggaaaactaaagtaaattttttgaaatttttcaggctaatagaaacacttagagagagctattgtatgacatcaagaattaaaaatatgattacttttgggcaaacttatgaataatttgaatatttttttcaaaaattttatttggtagttttttgagtaatggaccaagcgcccaagataacttaccattaattaattaactaattcattaaaccacctaaagcaattaattataattaattagttcattaaaaaaaattaattacgtataattttaaggaattattattttggcaaacaaagcgatcggttaaagtaaaagtgaagggaacgatgaaaatgttctatcagtacagagcggacacaaaagtttgtagcgtaaacaaaaatgaaatttttaaaatttttacaataaatttaaagttaccacgccctgaggcattttgccaagacgtgggcctcgtgaaaaacatttctgatccgatggaaaaggcgaagatttggcacgaaattgcgtcggcatccgaatcgggatgggatttcagttgtgagaaggaaaagaggggcaaaatgaatacaatttatttattattttaaaacccgttttaatagtaagaaattaatttaaataatttttattcgttttttaaaaagcgatttttatcttttacgaaaattatcaaaaatttaaaataaaatattaattatttttacaaaattgtttcaatcggaagaaaacaattaaaaattatatttttatcaaaaaaaatcattttttccgtaaatcaaaa

SEQ ID NO: 9968 - DNA, 974 bp, Heterodera glycines
agaaaactggggacattaacacccaagcaaaaaagcatttctcatactttacgaagcctttatgtttggagccaaatcattcctgaaaactagaagaaattgaattgcaaaaaaaaaaaacataacttatgtgcccgaattccagttataactcccaatatttgttcaaaaacctgacctctcatagcattaacaaaaatgtcaattgccaatatacctctccaaatctgccaattccaatctgggaaatgactttcaattcgcccatcggaattgtatcgtctttccatgccgcatttcgccggatggagaacatgttccacgagcgtcgctcaaatctgtcctttttcgggttgagctgctcatccgccgaattcgtgtcgtcgttcacaaaaatgtcactcattgaacgagtattgccaatttcgggtgcccaattttccttgaaaagagcatgtaaatgccaagaaagactcttcgtttaaaacctgggtttttgacatgaccatttgtgtgaccagttccttcaaatgcttttgtgtcaacccacaattgtcctgcactcgcaattttttcttgcattcgatgtgaacagccattctgtgaaaagacaaaggcacaattggcgatggcacaaatgaatcatggcactcattcattacttgcaactgcggcacttttcgtattgtacaaagaatccaaaagtgttggagcaaataacacatttcgtcttgctcggatttttgcgtcgctttgtttcccattgatgcggtatttgatgtgctctaactctgctatacattcatatgtttgctaaaacgtcaagaaaaaataaagaaagcaaagggttatcattttaaagctcttaataaggataagctttttttaagcaaatgctaagcgattcgatgcattagaaaaaagctatgggcgttagaaaatttgttttttgaataatttttcgaatcgaccca

SEQ ID NO: 9969 - DNA, 4593 bp, Heterodera glycines
aggggcaacgggaagaaaatgaaacaaaaagccagcaaaggcgaccgaaaaacatctttaggccggagcatagcagccccttcctttcttcgtgatagataagtcatcccactaattcaatttgatcagacaaaaagcaattgaacatgatataaattgtaccaattattgggagccttgtcaatctttgattattttggaaagttgcataattcaaaaataatttaagattaactattaataatttgaatatcagagtcattaattgttctgaagaaaggagagcggattgaagccgaattgtttaatagataatcaatatttttaggtatttttatgtatgttaattttttaataaaaaaaggttttaatagggaaatacaggtacaggcttttttaaaatatcgatctctactaataaccagggacggtcccaggattttggcttgggggggggtacctcccccgggcgacgacctttttttttttttgcttttcacacccgttttttttcatagcgcggtttttccaaaaaattttttggggggacagggggtccggcggtgccgataggcgccgccgggaaaatttttgcggtttgttaacagattttgtccaaaaaatgaccaaattttgtgattgagccacttttagcagattttcatcaaaaaatttgtagattttttgaaaaatttagcgaaatttcttggaaaatttggtgaggctaccaaaaatttttgaaaaatctgatttaattagtatttaagatcttttggatgattgagccgacgaaggataacctgaatttctacgagcaatggattctgagcggaaatgagaactcgaccttctttggaaagcacaccaagtgttcacgcatcagactccgccagggcgacacgctaatcatcccatcaggtcggttggtcaaaattggtccggtttaggatctttttatgacaatttttaacaataaatttgtcccaccattttttggcatgtatcaatccgaattgtgatttaattgggttttttcgaattttgtgtacattaaaaactaaatagtcataatttcggcacatttctgtggcttttttcaggatggattcattgcgtttatacgcccgtcgattcgctcgtttttggtggcaatttcctgcacagttactcaattccgatgcaaattcgcgtgtcaaagtccgaggatcgcatcaaggtgacggaaaccaatggcattttacaatcaaaaatttatgcacagatcggcagcaaatatcggttcccgcattttaaacaaatgttttcggtgtttcacggcgcaaatcgtgcgcaacgcaacgcaccgaatttaccagaaaaaatcgccggaagaagcgcacaacatcgagaattcaacggcaccatcagcagcagtggcggcacacaaaaatcgccagtcggcatcggaggaggaagcgaaaagcagcgaggaaagggacgatcgaggtcggtcatcaaaaatttaaaaaacacccaatttccaccgctatggggccagcctcctttcccaccggaaaattaaatcttcggaaatattacatttttccgaaaaccttccagaaagtcccagatgatgcttctgccgctgcttcccacggctctgacgcagcggacggcgaggaaaaagcagaaaattctgccgaaacggatgtcaaattgggcggatgacaatgggccaaaaagtgcgactgaattcggttggcgaggaaatttgctacgacgaattggtgggcaacgcatctgatgttagcaacttttttgtgtaaatataatttttgtcttttagggctcatttactttcaacccaattcaatcggttttcgaaaatgaaaccgaaatggaattcactccgacgcagaattatgacttaggtaagaaggtcaaaaaaagactgttcaccaccaactttgtcatgtcagattatctccgttcccttccctcgatggtggtcaatggcctcttcccccttctgcactttgccaagcggttgctgaagtccaagcaaccggaagtgatcgaaggcatcacgcggcctcgccatttggtcaaggagtttcaggtgagcagcagcggagggacgagacgcatttgtgtactgtgacatcgctttccttccaaatttacgcttaacaaataccaaaattatttaaaaacgatcaaatgatggtaaggtgtgcttgcctttggcattttaaaaatccaaaaattgattttttttttttcctgatggaaaactaaaaaaatgccgggactcaattttatttgtgtttttggaattgttacaattatttgatccaatttttcggtaaaaacttcatccctttaggcgctcctaggcaaaatcaacgaggttggcctcgtgtgcgtgcagctcgaggtgcaatttgcgccgaagtttcgctgtgaaagtgccgaattcactgtgccggcgccgatggagccgcccgttactttggtaacaaaattgcattaaaagcatttaattaagtattatacaccagggatggcacggaattccgatttccgacgtttttggggtcggaattccgatttccgaaaatttttggacccccggaattccgaaaattttttaggcctcggaatgccatccctgttatacacactcattttaaatttagtcagtgaaacagccaccgaaggatgacaaaagaaaaagtttgcgtttattttaacaattttgttttaatttgtttgtttccagtgaaaagacacggagcggttgaggaaacagtgcagaaaaagacactcaaaagtttgttgttacattttttagaaaaattatatattttcccaaaatattaccattttggaggttttttttgatatcatggtttcgaaaaacttcaaaacttgggacgggcacacttgaagaaccaaccaaatatcgctttttctacgacaattcccgcatttccagagaagaatgccggcactccgttgacgcccgcgaatggccctattttggtcgggggtttgccattgtccacgcatttgcacacgccctcgtcgtccggcagcttcaacccaatgggcgaaattgtgaagctcggacagaagccgatgcagtcggcgtggcgaaaggcctcaaatgtaagacggggaaaatgggggggggggggcgggggcaccccaatttaacttgatcgttttcggaaagaaattcaatgatatgaattttgttttttacaaaattcagtatgagttggttcggctcccccaatttgtttaaaaatgcactaataatttaacttaattagatggcaaaaccgccacccccgacgcacattcatcagctgaaaaagcgctttgattattcttcaacaaccaccaacaacaacaccatggatggtggtggacatcacaacgaagcggacaatgcgtttgacgaattcgcaacacaacaaaaggggacggaggagggcggcgccggacagcaaaacgcgaccgttgctgacgacgcggcgttcacgacacagtccacgtcatccttcgggacgttttgcaaagagcgcaaaatgggcagccaaagtgatgggggaaatgggacatttgcattcactaattgtcatgcatttgggttaaggaccccaccgaaagtcaataccgaaggtggcgcacaacaaactcatcgaaatccatgacgattcgcccgaattttcgcatcgatcgccactccaacgcctccgtggccaagaaacaaagacggccgcccacaatcagtttggcacaaattcatttcatcaaaggccggtgtcacacgcgtttacaccgtcgaacaacaacaggagcaacaaccaatggaataacggcaactttggagggaatagccactggaacaatggcaaatctgccaatggaacagcagcaaatttggcggagacgaccaatggaacaacggcaaatttgggggggacgacccatggaacagcggcaacaatcagtggggcagcggaggtttcggtggccaacaaccgtaccaaccgccaccgtcggaacccaccagcagcaccttcagcgaattcaagggcacatcacgaaacgacacgtttggggggaacaacaaccaatggaacaccagcaacaatcagtggggcagccgagggttcggtgaccaaccaccacccagccgaggagggttcagtaaccaaccagcaccgtaccagcagccacagcaacccatcagcagcaccgtcaacgaattgcatcacatttctcaaatgtttgttggctaccaataagatttgagaatgggttagcaaattttaaaccaaccaaaggcaaatgaacgatgaaacattattagggcacctcagagctctacagtatcgactggccgatacaggaattcaagattggtagaattagttagaatttctagctctgttggggtcttgagcaagcccaaattgtgaaatgaattatataggctggataaagttcggcgttaatttggagagaaattaaatttgataaaaaagtgaatttgtttggttgattatttttaagcgatgtaatttatgtaaaatttactaa

SEQ ID NO: 9970 - DNA, 4046 bp, Heterodera glycines
aaagtgagaaagtgcggagacagagtgagagaaggagagagagagagagcgagagagagaaacgagagagagagagaggaaagagtgagagagaaagtgagagagagcgagagagagcgcgcgcgagagagagagcgagagagagagagagaaattgggaccgaacgagaaagatatatgaaaatagtgtgaacaaaatataccaataaaaatacatataaaaatgagaggtgagcagagagtgtagtatattaatcaagggcgaacagtgatcagtgacacagaaaaagaatccctcaaaaatagcatgcaaacatagagagagacagagtgcgaaaggacagggcgaaatagtgcacaaataaatgatgcttaatcgttttccccgcgaccattttttatcctactaattcgccgccgctccccatcaacttttatcgcgatgaccaatcatatttggaacgcttgactggcttttcatcaatccgctctgctgcccaaccaccaaacttttgctgatcagtgagagatatgtgaaccgatttggacacggtccattgggcttgggaatggggcaattcgagaatggtgcgcgagagtggggttatcgcgcaatgagtcgagaaaaaaaggaaggtaaaagcgattagtgtgagagtgggattgactaattggtgggatggggggggggaaattgcgcgaaaactttattacaaaacacagtaattcgatgggatgacggaaatggaaaaaattgattttgccgaacccaaattgacgtttcttttttttttgaaaatttctcctggatgttgtggaaagcattacggtcggagaatttttttgaaattttatcatttggtggatagaaaattttaaatttaaattgaatttcgaaaaaattgaattacaaaaacgaaaaaacacagtaaccgatccaatttaaaaatacgggtcaattatagtaatcttcttaaatcatttttaaaaaccgttcgttattcaatagttttaaacagagttaaaaatttaatataagaaaattaaaatagcattttagaattaccgtaaaattgagtcgctacagtagccgagcaagctttctttaggcttgaaaatgcgctgttgttggacggtatttttccaagatgatgatgatggtcctctttatcatcatgatgatcatcatcaccatgtgcattgtttggatttgttggcattttcggtgccagctttggcatttgctcattcccagtttttctgtccatttctgaagctgttgctgctgctgtcaatttttgctgctgttgatggtggttattgtcattgctggcagttggtgctgtgcccgttgttgtactgcttgaacttggcggagtcgtcatcgttttgacattttgcttaaaaatttgattttttatttgaaaagaaagtcattttgagttccttaatctcctgtttaaatttatatgatctagagacgggcaagggatttattcggattaaaatgctgaaaaactgaaaacttcttaatctgtttttcgattaaaaacaaaatataaacggactgtttctgctctataatctaatcaaaccaataaaacttctctaatcatatcaattcagacatattcagtataattttaaagatttgcccatgaaataccgtattcctccataaaaaagtaccgttgtgtttgaatagggcgagcccatttatgctgcccccacccctctctaattaagtccatcctaattagtcttaatgatgatcttttgcctcaatatattcaaaatgaattgcaaatttgtaagaattaaatgttagctaaaactaataattaaaccacacctttgtgccaggcgcagtggcaataggcgtgaaaaactgccagccatgcactggccacaacattgaagatggcggcggaaaaattgttgccgcaggcactgtttctggtgttggcatggccgcagggaatgggaggaacattggcattggcacaatggggggagcagtgtcagaagcatttggtggtggggttggtgatgtgtgcggcttggacagcaaattttcaatggaaaagtttgtagccagcgaagaaattttcatttttgtaaaattttgtttgtttttgattaccttaaattaagcaaattagcctatattaattattgcaaaaatgtgaaattaatgataaatttatggcctcgtttcaatgggagaattcttttttggcattgtgttattgaagaaaagctaagggttactgtaatgccaaaaatggagaaatccttttctgtcaaattctttaatggttgcgcgcaaatcaaataagaacatgaaatttacgtaaaaaatatcatgggaaaataaacagataaatgccaaattcttattgtattcatttcaaaaatattcagaattccaagaatttgtttcgtattttcccaaaaagaattttgttggatttatggaaaattgagatttgctgcgtatttccatttataaaattgagtacaaaatttaaaattaatttggtgggaaattggatgccaaaataacaaatgaaaaacttggaaatctaactttattaaaagttaatgtcatttaaattccaaaaagtgagagcaattaatgtgtatcaattagttttaattcgtcaatttctaaaaaacaaaattacataaattttgatgaaaaattgaaaattggagaaaacttgatttgtttaaaatgaaatttcaaacaaaaaaaattaaaataatattaactgtgttcgagaatccaataaaattatgttttttaaattctataaaggcaaatcaaacaaacaaaatttatcggattggtttttgcccacaaaatccgagaagatttagcactcccaaccttagtgttccagcctaattttaaatatggcattttctgtgccaaaaaattatggcaacccaaaaaaaaattggggccacgacgaaaattcgttgggggataatttgaaggcggccggcaagacaattattattataaacaataatatggaggaggaggaggcgattgtggcaccgctgcaggtcgagtccagcgaaacccagctcaaccaattaattgtctattaactatcggtgtccctaaaatattttattttcccctttgttttgttgccgacagaaaatggcaccggcgccgccgcatttttgaatatttatttcaacggcacttccctttcgtgccggcggggaggatcaacccctcgccccccccccaccatgggctgagaggatatataatgatggagtgaaaggttgctcgggcgtgagaaaatcggtccccacccccgagggctgatgttgggcagggtcgagaggagacgagagtgggccccggtggcggcggcgccaccagtgtgcccatatttaaagcgattcgtcgccgtgggaccctatccgcccaatatcctatcctattccccaaaacccttaggggcaggtgtgatgcatttgggatggatgggatacctttttaaccactcccctcttccgggggatgagcaaatattatcatctttgtggcgctgggggcgctcccagcacattacaatccgacccgctgctgccggtgctcccccccccctttttttcaggatcgaaaggtatactgtatgcagtgggcccgcctctatcgccaaaaagccaaaaagacagaaaatggtgagtgccaacagcatcaaaaagtgccaaaattggtcaggctaatagggcattgcgtcgtgtgttgtgcttatgcgctgaaaaagttgcttatagacttataagaaaaggcttagcaaattctttggttggttagttgagtaaaattaatagcctaaaatctttttttttcaaaaaaaataatggattttttcccaaaattggtccaataattgttttttggcactagaattaaacataatttatttaataaccaattttaaaaattcaccatttatttcaaataagtttacaatatttttctgtttttttcatcatcggatatgggggggggg

SEQ ID NO: 9971 - DNA, 786 bp, Heterodera glycines
gggggggggagaggtgttttaagcttttcctccgctccgataccctatccattttgaagcttattagtgtaccgtggtgccccgccggcggaagggtggcggataaggcaaagtcggcccatccccgacgggaaggaggggggagggacggagggggggggggtgattttcccacgggccaaagcccattggtcgcgcacagattaccaccacctattattatcattaatttaccggcatcggcactggcgaattgctgttggttgcctttaattcacggcaaacccaacatcgtttagtttgattaagcaattcgcggaaccatggctggaccgttggtgagaaaatggaattaaaaatgttttccgtgccacgacctgcctcagcagtggagaggggggggggatgattttatacaagtggcataaataaaaataacacaaattttcaagaaatttattgtttgaataaaaaaaaaatttgatttttttatcgagtctaactgttttatgggtttaaattttttttcaagtaaaggcttttagtaattttgagttgaatttgctttgtgcgtttttacggtttgatattttaaccagtgaaagacatttttcactcaggttaatctttggacagattattcattggataatccagaagtgttttcagggaggggagagataaagcgggggtgtgttgatgaaagataattcatatattggcacaacacccgcaggcaaattcaatttgtccgaccaccggcaccgccagcaaatgttagcaatc

SEQ ID NO: 9972 - DNA, 1398 bp, Heterodera glycines
  misc_feature (1234)..(1234): n is a, c, g, or t
aaaattattttattttttgaccaatcattttcaaagttcgtttccatttttcgattgcttttcgatcgttttccgtttttggtttattttattgttcttttttgtcgatttgttcacttaggtcaaaaggaatggcaatttactcatttccctctaaaactccaaaaacaccgacccaaattggattggaggaatgaggctttttcgaaaataaattcaaggtcggcacccgcacgaatggaagaaggcaaaaagccaatggacgtgcggtgaacttaattgagtggaaaagggtgggaggggaagatggaccaggggaaagggggagagacagagatggggagagagagagagagaaagagtgggagagagagagagggggagagagagagagagaggtgagagagagagagagaggtgagagagagaacgaagatgaagaagggacagaagtaataatgaggcaaggaaaagaagtaaggaaaaatgagacgagaaggagaaataaaaagaaaaacgaagggaagtatgatgatgataatgagagtgatcaaagagaaagaaagaaaaaggaacgatgatcatgggaagaaaaagagagggagaggcaaagaggaagaaaaaagaaatgagaagagggaggaagaggagagagagggaggaagaggaagagagaaggaggaagaggaagaaacaagagagagaaaggggacgaaggaaaacgctgaagggcgtagtttttgtcagaaatttgaatccaaattgaatttaaaaatttccagcttagctgaggatagctctcactcacttcacatccacttcccacgtttcgctcctcccaaaacttccaattttgcattcccttccctcttatttcaaactcttcccgaaagagttgtgttggtcttcttggtcttcgtcattgttcttccttcccttcctcctccgctcaatggtttgttcctccgtccttttcagcactaactcaagagcactgccccttctcttcccctcccccctcttcttcttcctcccaatcgtccacctttcacccgtctccccctcactttccccactttctttcgtctttttcatcctccaattcattctctgtccactgacccttgcggtgtgtccccccaattcgtccattcatttccagtaatttttcccgaaggtcacaccttcccccgacccccccccccccccccctccatcgccccctttcacctgnctgccatccccctcgagggtcatttttattcacttttttgttacaatttctttcattccccgctgacccttccacccccccatttgaacaaatttatctttcccttatctcctttatcccccctggcttcccccctcttcctttccctttggtctccctctctc

SEQ ID NO: 9973 - DNA, 995 bp, Heterodera glycines
gagaaggagaaataaaaagaaaaacgaaggaaagtatgatgatgataatgagagtgctcaaagagaaagaaagaaaaaggaacgatgatcatgggaagaaaaagagagggagaggcaaagaggaagaaaaaagaaatgagaagagggaggaagaggagagagagggaggaagaggaagagagaaggaggaagaggaagaaacaagagagagaaaggggacgaaggaaaacgctgaagggcgtagtttttgtcagaaatttgaatccaaattgaatttaaaaatttccagcttagctgaggatagctctcactcacttcacatccacttcccacgtttcgctcctcccaaaacttccaattttgcattcccttccctcttatttcaaactcttcccgaaagagttgtgttggtcttcttggtcttcgtcattgttcttccttcccttcctcctccgctcaatggtttgttcctccgtccttttcagcactaactcaagagcactgccccttctcttccccctccccctcttcttcttcctccccctcttcttcttcctcccaatcgtccacctttcacccgtctccccctcactttccccactttctttcgtctttttcatcctccaattcattctctgtccactgacccttgcggtgtgtccccccaattcgtccattcatttccagtaatttttcccgaaggtcacacttcccgaccccccccccccccccctccatcgcccctttcacctgctgccatcccctcgagggtcattttattcactttttgttacaattctttcattctcgctgaccattcgacccccaatttgaccaaattatctttcctttatctcctttatccccctgccttcccccctcttccttctctttggtctctctctctcctcgtggggaatgccaatttcggtttccccttttatagcaacctaggaggagcgaacccgtggtgtataaatggcgatgatggcagg

SEQ ID NO: 9974 - DNA, 2204 bp, Heterodera glycines
cccaaaagttgacccaaaaattcagcagtagaagaatattaagccaatttatttgcatcttcccccttcattcttcccattcgtcctgaattgatgtgctcttccctccccttccctttgctcttccctcccctcccttccttcctttttcttcccttttttcttccttttcctcttctttcgttccccttcgtatcttccgtcatttttcaggtgctctacccatcgtcagatttcctcagttcttccactaataaaataacattgcgctcccacgggtccctccgcttggtctgcttttcgtccgtccgttcgttttcgccatgtccgccgcttcttccgcgtgttcgtcgcccccatgcgcctcctccccgtcgtcccattggtcttccgcttctgttcttccttcgtccccttcttcgcttcgtttccctccgtcctctcaccgtctcgtccatcggtcccttctgatcacttttgctctgctgatcattccctctcttctcttcatatcatcagtcgaagccgcccaacttagtagcaatcaacgcgatgccaactcagtccaacagcaggaactatcagtgtacgacaacgaaatcatcagtgagtgaaaatgggcaaatgggccaattaatgtgtaattgatcactctttgcggtgggaagggatggaatttgtggggaaaagaagtgatcgaacggacaatgagcagggagtgatcagtcaaaaaaagatcatcagcccactatcctttattcaaaattggttctcttccctcttcccaaaagtgagttcatccggaacggcttcctcccccccccccgcccacccgcgcagcgcctttttcggtcattgcctttgctaaataaaaccttgaacttttcgtccccgtgccctcctccccttctctgtccgttttatttgattttcgttttcggcggtggtccgatttgatgtaatgaaaaggcaattttgttggtgccccaatcagccgaagaatgaggttgacacaggcaaacaaaaactgtgaactgccgagcggaaatatttgcattggttcgtcgtgggaagtgccgacaacggatatgggctaattggaaatgaattgggggaataatggggacagaatgaggggagatgaggaggagaaaggacggaagaggaggaagacgactaatttgacggaggaaaatgggaacgggggaagggaaccaacggatcatccgaaagggcgacttaccaatgaatgatcggaaaatgactagaaatgatcggagagattggaaagtgccacagaaaaatgcctttcttttgtcaggtgagcccgaaattgagtgcggaccgggcattgtgcgctttaatgtgaggactcgcaaaggcaacgcgtcggcggtttacgtgcggggccaaagtcagaacgaggactgcactttccacaacacgcgcaacatcaccatcgaattggccaagtgcaacgtgcgacggaagcgggaggtgaacccgaacccgggcattgcctaccaaatgaccgtcgtcgtccaattgcacccggttagcctaattgtttggaattggaaaataaatcactcaaaaagtgttgcccaatttgcagctatttgtgaccagagtggacagagcttacaatgtgaattgcttctaccgagaacagagacaagacgtcagtgtggactttggagtgaagtgagtgccccggggggggggggggtaatgtagcaaattggggacgaaaagcaaagcgaaagaatgaagcacggatggaaggtgatggtggtggtgaccttctctgaattgtttatgggaatgcgcccaaaaatggagcgaaaatgcaataataatattttatttattcatcaaagtgccgagagtgcttaagggcctgggaaggtcaatgctacttaaaggggggtgggacaaatgggagacaaaagagggacaaataggagacaaaatagggacaaatgggagacaaaatagggacaaatgggagacaaaatagggacaaatgggagacaaaagagggacaaataggagacaaaatagggacaaatgggagacaaaatagggacaaatgggagacaaaagagggacaaataggagacaaaatagggacaaatgggagacaaaataaggacaaatgggagacaaaagagggacaaatgggagacaaaagagggacaaat

SEQ ID NO: 9975 - DNA, 1453 bp, Heterodera glycines
  misc_feature (6)..(7): n is a, c, g, or t
ctgcannggtcacaattgtaaaatacagtaaaaacaaattaaaaccaattataataagaaatacaaattatctaactaaactttgtgctgtaattaattcgtgttattatataattagtgatctaatttttgaccaaaaatcaacaaaaatgaccccataatgggaaaagaagagcaaaaaatgaagtatttagggagagatttaatttgtgacctaaaaattaataaaatatgaccatacaatgtgaaaaaaatgactttaaaaaatccaagaagttagggctgtgattgtgatcgtcacattccatcaagaaatccaaattaaaaaactgaattttgcttcattttttacagttatcaatttttaaaatataaatccccccccttcccgcttccccgtgccgtcctttccccgtgcgacctgctcgcgcggtgagttcagcccatgccccgtggttttgtcgtatttggcccgtgtgaatggtatctccgttctgccttcgcatgccttgtcaaacaccgggtcacagcgctccaccgggattttgtgcatctccagcggacaactattctgcgtcgactgcataatttcataggcgaccacttggcctataaaaagggtccaatttgaagacgttcaaacccagcgggggacgagcagcaacagaggcggaccgcaaatcgaaaaagacactaacggatccgatacgtggaaaaaatggagcaaatacgaaaagcggttgcgtttcgcccctgccagggaagtgcccaagacttcgctttggacagttgtaccggggtttagaaataccaggaaatcatgtcgatcattggtcccaaaatttttttaaattttttcggaaaatttcgaatatttttggaattttttttttttttttggtaatttaacttttatttggattttcggctttttaaccgaatttgggtccggggttcggaattttttctaaatgcaggacggattcgttcatcgtctcaaaaacgtagagcgacatttgcccatcgtcttgtgcctaatatcttttgcgaaacataatattctaattatatatttaattctttatacatttcatacaattatatgaacattatgcaaaataagtagatatctcacgttgagcgtccgtgcgactattactagaatataatgaagattttggtacagtgcaaacaattgagagaaattataaaaaaattgtcagagacaaaattttatataaataaaaatagtgattcctaatgtaaataataataatttgtattattagccctaaattaatgttcccaaaacaaatttaaaaaattttatcacatacaaaacaagttatttgaaattaaatagaaaaaattgcttttttaatttaaaaacaatgccaaaaataataattttttttaaaattaaattcccttattttttaaaaacgtgaaaaaa

SEQ ID NO: 9976 - DNA, 2758 bp, Heterodera glycines
  misc_feature (121)..(121): n is a, c, g, or t
  misc_feature (123)..(126): n is a, c, g, or t
  misc_feature (128)..(128): n is a, c, g, or t
  misc_feature (539)..(539): n is a, c, g, or t
  misc_feature (552)..(553): n is a, c, g, or t
  misc_feature (561)..(561): n is a, c, g, or t
ccccccccccccccccccccccccccccccccccccacaaataaaaaaaaaaaaaaaaaaaaaaaaaaaaaacaaacttttttttttttttttttttttaaattttattattttttttttnannnncncccccccccccccacacagagaagaagagaaagaaaaaaagaaaaccccctctttttttttttttttttttttttttttttgaaagagaagagagggggggggggggggtaaaaaaaaaaaaaattttttttttttttttggggtggaaaaaaaaaaaaaaaaccaccccccccccccccggcgggggggggggggggggggttttttttttttttttttttctctccccccgaaaaaaaaccccccccccccccttttgtaggggggggggggaaaaaaaaaaaaaaaaaaaaccccccccccccccccccccttttttttttttttttttttttttttttttttttttagaaagagaaaaaaaaaaaaaaaaaaaaaaaaaacccaaatttccccccgtttaaaatttngtttcataaaaannttgggccnaaaaatttttaatgaaaagggatggatttggagtaaagtaagggcgaaaaatatgggccaccaaagaaaaaatttgccgtaggcgccgtgcctcgggggtgcgttaattaattggactcactgaagaaggcgaacattgtggtcaaatttcggctgcttggcctaccggatgggcccttgaacatcagttctattaaaaaaatttaaattgttaaatttttaatggcattttgcctcaccagaaattgccctggccgatggaagagtcaaatccaagcggtaaacgccgtcctggtaattgcttggcgcgtcccggtgaagccgactgcccacgctgccccattgggggtgggccaaattctaagggattggaatttcaaaatgcgaaaaaaaacgaaatttaattttaagagattaaacaaaaatccaacattaaaccatccgtcgtatcgctgatattcagttacacgttcaagccctgaaggaaaataacagttgtttgcaatgaaatatttatttcattgaccaaatttttataaaatcaaatattttttaaaatcaaagaaatgtaattaaaatttttggcactttttggttaggcagccacactcccacaattaacctacgcgcataaatcgcttgttttcagtcttttttttttaaatttagggtgcgctgcatatccgtaaagtaccaaattcattaaattaaaaaaaaatttaaaataaaaaaatgaaatcaaaaaatttgaaataaattagctacaatttctttaatatttccttatgtcatctgtttgttttttcataaattattgaatgcatttttttattattttttgaataaaaaataaaaatttaaaattattataattaatcccaattattttatatttatacttttgcacattttcaccctaaatgctccacacaaacaatttctgattttcattttttgcaacctccgaaaaatgttcctcctttattgggtttatttatttgtgcgtcggggctaaaccggctgttgctgcaacgattgcagcagaacaattgaaggaataatcaattgtgacgacaaatttttattgcgtttgttttatggtggaaaaattgccaaaattggataataaattttaaaactcattaaaaaattgacgagttattaaaattcgatttaaaaatgtcgaatgcttcccttttttggcattaattagcaaaaactcaaaaaataaataaaagaaaagcgtctttatttaattaaaatgaaattaaatatttaaaaaggatttattttatttgcatttaccatggatttgtgtgttgtaaattgcaataagtgttaataaaattatccaattcgttgttggtattcgcctttgtttcaattgttttaacatatttttgaaaggaaaaaacatctaaaattcaaaaaaacaaatttaattgattactaaataaatagaaattaataaaaattattattaaaaagtaattagtgaattttttggtgtccatcgcgacgagagaaaagaaattgaaagtgatcaaagggaaataatagcacagatcgatcggaggggcagcgaaatgatgaagaaggcattcattcacattcattagaatgcgaagattcattccgccgccattcgcccgccagcggctctccccccccccccccctaacgcgtgagcagcaatttggatgaccaaagttctttgagtctgacgaatgcctttttgcatttgtacgctccaattccattctgtgtcctttttagcaaaacatcaagcggcttactgacgaggcgcatggttttaatgaattgttggtaatggttgaccattcccgaatatgaccgaagtgaagagacgtccgacagtgcgggcatctcattgatggcggagattttgctggggtcgggtctgcgcccgtttttgccgataatttgtccgagatattctaatttcatcttggaaatacgaacatttttcacgtatgacaccaattccccattcttgatatcgcgagaacatctttttccaatgaacagaatgtttttttggtccttggtgacgatgatgatgcctactaggcaggctgccgcgaagccagaatctgccaacatgaggtccattatcgactggaacatgccaggagctgtttttatgccagatggaaagcatttgactgcataattt

SEQ ID NO: 9977 - DNA, 1100 bp, Heterodera glycines
attctttttcaaaaattcagacagtccagaaatattcttttgaacttttcttttttgataattgtaatggttaagatgcaattgttccctgatggctcttttcgcaaagtccgtaacaacattgaccgattgtttgacaaatatatgaccgatttaatccgcggcattcggaacaacaaggaaaatgaggtgatgattgattgactgaatgcaaaagccatttgtacatttacaatttgggcacttttgctgggcctctgaaaaaaaaaattcaagggctcatccaattacaaatccttacaaaaaagcccccctttggaattttctctcgtgggcctccaacaacagccaaagtgccataatttatttacccaaaatgttataggcggaggaagaggggaggaagaacgaagaaagaagggggaagaagggaggaagagcggaggaagaggggaggagatggggagagagtgggagagagggggaggtaggtattactgagaatggctgttgcgcaagccattggagatgtatgagagggggaagagggagcaattgtgggagaggggagagaatgaggggtcagggtggagaggccgagggtgcaactaaatgacggttgcacaagccattgaggaagtgagagtggtgacagaagtagcagtagtgcgggtgcgcgggccatggagggccgaaacgaggccatagcaatgagaggaatgtcatagggagaactggccataaaaaaatgtgagccatggggaaaagtgaacatgtgaggaggagaagcactggaacgaataccgccgtttccgcttgcgcacttcactttcttataaagcagggttgttccgggtcatccgaatctcgaaactcgatatttttctcgtcccgaatcccgaaacccgacatttttctcgtcccgaatcccgaaacccgacatttttctcgtcccgaatcccgaaacccgacgtttttctcgtcccgaatcccgaaacccgacgttttctcgtcccgaatcccgaaacccgacgtttttctcgtcccgaatccggaaacccgacgtttttctcgtcccgaaacctgacccgatttttttc

SEQ ID NO: 9978 - DNA, 4414 bp, Heterodera glycines
aaatttctatttgaaaactacttccctgcccccttatacataagtcgaaattcggaaaatcgttttgttttaaaaatctttttctcaaaataaattatctcttccctaatttgtttgctaacgaaatacatgtctattttcaatagacttgcgctcagatgtagctgttttgatatcaaagatttttaaaatgaacacttcaacagctttcgaatgctactaaatttgtcggggaagattttttgtgagtttttggctctgtgccttcaattagttaattaccaaaaatttactattaaaaatatacaaaaccgccgcaaaaaaatcattaattttttcattgcaaaaccaaaagaagcattttttttctttattaatgatcaagaacagattaatacataaacaagaattgtggtcaaattattattctggcttctacggaaaggggaaaattttagaaattttttttggaaatgtttagaaattttctgcctaaaaaaggtatggcgaatcgtgtacgcctccgcccgagtgaatgccgccttcggtggcatcctcgcgcttgctgcgcaacatgcacccgtcacgttcgttgcgcaacacacgcatgttgctggcgttgcccaacaaatagccgtagatgctcagctcactgacaatgttggacagttgaggaacctcttttacgtatgggcggaccatgaaattctaataaataaaattttcaataaattaaattaatttttaaaattattaatactttcccattaacggggaggggaactggagatcgataaaattgaaccaatattttatattttttaaattaaaatgtaaaaatattggcaccagcggaaatggaggataataaaacaattaaaatagtattaaaattaataaattaaattttaaacttattagtaccagcccattaagggtgagggtgaagtggatatttgatgaaaaattaaaataacatttaatatttattaaaattttttcgcttctccatcccccacccgttaataatatgatatcataaatttgaaatttaattcaataaatttaatatattactttggaggggaaagtaaagtggaaaatagatcaaaaattatataataatatttaaaattaattaaattaaattttcacacactgtctcgcacacccctcttttttttcctttatcaccgaccactgttaattggataattattaattaattgtaccgcgcaccttcacaacaagtggccttaatctttccattaaaatgtgtgctgctcgcttattgggtttgaaagtgcgtaatttttcagcaatttcttcattccaaaaattgttgccgcctccttcttggcttggttttagcacgtaattaccaggattttcaatggcatcctttaaatttagggatttgcagcttaagcgatttaaaattggatttaagcattacagtaagatatgtgaaatggaaaaaatctttttgtccatgggatttcaaaaattattttaaacttattaattaatggttattatattaattacgctaatgattttcatggtttcatcatcatcttgctcaaggctccacatttttgcaaatgtttttcgtatatcgttgaccatttgtgcatattctggttcagggaaaaagtgttccaacatacctggttcagaaagggcctaaaaaattaatttctataattaatttaaacaaatttatgaaaaaacgatcattttttgaacgtcacctgttgaacttttttggcacatgtcaactcgagactaatagtcgggcttttcttaagaatttaattgatgaaaatttatatttacgtttcatttaaaggtgaaataattcgtttaattttaatattataataatattattatttatgtattttattaatacaattgccgtcgatttttcgattttgagccgtgcattatatgacttttgtattgggttcacaataattgttttgtaatacacaacagcgaccaagtgaccattgtatcgcaatgaattgtcttctggatcaagaaataatctaaaatattgaataattaaataatttgggggaaataatttatttatttaattcccaaatctaaaatgtttatcgctattatttggattaaatttaaataaaaaaattcactgatcatcgcattcgaaaattgaaagtttgacaatttggattttgtttcccgacaattgttccagccgcagttccaattggaactgttcaatgttgcgatcagcgtgaccagagacgacaacaacaattgcgtcattaacgccaaatgcaagccttaaattgtattttattgagagaaggagataaaaaaaaaatcgggagcatgaccaggattagaagggactactggaaaggatacttgaaaaggcaggaccatgattaggtcaggcctggaaaagatgtcctgggtatctgtgatccttatatgtttttttaaaattcgggaatagaaccaggatttaggagccgggcctggaatgttgtcttggatattggcaatttaaaatggtagggcaatcagattagtaaacctaaacaaaattattgtttttggcaaattattgaagcgataaaaattggctattttttaattggtactagaattggtattaccaagcctgatacagccccttggccacaatgccttccgcatcattgtccggcaaattggccgcttcgtatcccacctttgcaaacatttcacggtgaatgattgttgtacggtttgcaattgctgggcctcccatttgaccaatgttcaattccaccttttttgaaatattttatttatttaattaaatttaaattaaaataaataaataaaattttttaatttttaaatgcctgtttcaattggtattcttcttcatctgttccattgcttttgcgcaaatggcacatataatcctgtgaacaattaaatgaaaaatatttaaattttaattacccaaggaaataaaaattagggaaatgttaaaaaataaaaaattatttatttaaatttttaaacaaactgatcgagtcaaaaccaaagtgagcggctgactgatgattggcagattgtgaacctcacgaaacagtttcaaccagctttggatcgtaacatctgtggcggcaaccggctccaatgttttggttaaaaaatcgaaatcatttgaaacccgaaagtagagtaattgcattgccttaattcaaaaaaaaagtaaaaaaaattaattaatttcgaaaaaattgggcgctttttgaaaaatggtccacgaattttattaaaaataaatgggaagggattcttgtggtttgcaaatgtgataaaaactcgtgaaaacttgttttcagagggtttttagggtccttgatcacgaatgtgtggcttttgcttgtaccaatttctaatccataacccgaaaactaactcgaacaaaaatcgaaaattcaaattttctatttttatttattttttgaagtcttgattagaaagccagaattagtcaaaataggtgcaacatagccaaaaagctcaggaacaaattttaattactagacaattattttataaaaaaaaaatttttatcattccaaaagggtgccggattttaataaaattccaaatatacctatttttaaatagcgcaaaattttgtatatcaattaaaatttgaaaatatttctactttaatgaataaattgttaaaattaaattaactttttgaatttctagcgcctcgttgtaaattttgcgcgggaaaggtgacggaaacaaagtgaaaggcacaaaaacgcaggtatcacttctgcaaaaaaaaaatgccaaaaaaattataaaaatttttatttaaatcaccgtggaaattttttgtccgctcgccatgccatgccaatgtggtgggcccaattgatggcatcatccaccaaagcccgtagacttatttccactaaacaataaatgttgtgaaaatttttcttttagaaatcttttccctttttttaattaattatttttttgtaatcgaatgaaaaaacaatgcatttttttgccaataaataagcatggttttgtataaatttggacaaaatcctgggttaatttgcaaataaattaaattaaatttacattttatatttataaattttacctcttttcacttcgtcagttccattgctaattgcacttccaattatcaacagaaatgaaattgtcaaaaagatttgaagcattgtaataataggtgtaattatttggagaaagcagttaattaattagaattatatttatggcgcctaattaaaatttcaatgcttttttataaggcaaagctttcgtcagcttagaagaatctataactaattattatgacattttttatttttca

SEQ ID NO: 9979 - DNA, 5315 bp, Heterodera glycines
tataataacgctgcggacatctacatttttgaattgaaaaaaaattggtaattactctttctttttctccatattgaccatcatactcatactccccccacccttttcttcttccgccacccaccctttctcctccttcattttttttttcctttccttctccaaccctctcctccctctcttgatagtttaaactgaggcgggaaacgacaatctgatccccatcaagctagcttctgcaggtcctgctcgagcggccgcaccggaaaaagttgcacaaaaaacatttaactaacaaaacaataacacaaaacaagatacttcaaacatgtcgttagaaggaattttatgagatggatcaatgataacgaatatgtcacagatgaacctcttataatcattggagtaccttttttaataactgatgcacccctacaatcatatgaagaaccacattggaacattcactaaatataattaatgatcaagactagaaagcaaatgtcaagaactgagcagcgatttttcccaactaaaatgccaacggttcacgcacccgctagatacatatttatgccacttttcatgcatataatttatacctaaagatcacattagaaattcattattaatttttgaaaaatttaattattcgaaataaaaattggcatttatatgttttcgggttttgggtgggctgtaaatgcaaatcctactttctgtgtgaccacgacgcccatgggataattccccttaatgcaaaacatttccaaaactgcttactcgcgtcaaaaaaacgaccagcccaatgtcgctggttgaaatgtatttcattgaatttggctggcatcgttgcaaaaattttctccaccttaaccaattccattccgattgccgtcttgagactgtgtacactccgttctcgttcaggccgcccgatgctaaaatttgtcatgatgttggaggagattgagtttattaattaggccgtaatgcgaaaccaatggaaatcctttataaaaagtttggtgtttgtcagtaatcgtgctgggtcgtttcgtaaaaagtgccactatgggcgtttagtaaaagtgccaccttgggaatgtttcgtaaaagtgccactgtggtcgtttcgtaaaagtgccaagtcgtttcgtaaaagtgccaacttgggaatgtttcgtaaaggtgccactgtggtcgtttcgtaaaagtgccaactattttattcgattttgataacatataaaatgaatatataaaatatataatttatcaatggcaatttttattttttatctgtgcaaatacgtgtcatccgagacttatacatagatgttagcgagaattttttattttttacaaaaacgctatgattgtgataaaaaatttgcaattgcttatatgaaaacgttgattgtttgctaacaaaagtttgttttgtttatttttaatgagattcttatgtttagaatttgttatgctggtcagtccatattttggagaacgttttaaagaacattgaaaaataacggattttatttgattacagttttcaatattcatagtttactaattatataatatgtataacacaaacataaatttttgaattcataactctatactcaaccatatttttataatggttcttttacgaaacgaccacagtggcacttcacttttacgaaaatcccaaggtggcatttttacgaaacgacttggcaccgatcaaaatcacaacacctgctgttgtgttgttattttgttttgttgctgacaaaagacgtcgttgagaagcaatgcgacgatgagaaaaatgaacaacagaaaattattattgtttgaagccatggcaaaaaaaaaggagaggaaaactctgacaaatttgaaaaaattgtgaataataaatgcgaaaatttgagatacctattttctatataaaattttttagtgctaagtaaagaccttaaaaggtttctttgctacagaatacttacctattacatagaatggcattcgcgtcaaacgacccgttcctttttatacccgacaaacgccgattccgacttttttcccaccccgaattgctacgctaatattttagtataaaaatgcccttttttcttatcttcctcctcattccattctctcattcattcttcctgtattttctgttcattatgttgctgcaaatgtcaacagaaattttgtgtacgtttattattcccttattttccgcatttattttgctagacatttaagcttgtaaccaattttaacaatttcaacacgaatttttaaactgtagatttttggaacttcaaacttcacttttggattccctcgctttggtgcttttcccacttctttcagtcagttggtctgccttgtttcttcattggtcgattacttttgctgcaactttttgttcgtggattcaatttgatcaaatgtgatgatcagaaataaaattcaaaataataaaataaatgctttcattttcaattggcaaaaaatatatttttaaattaatataattttatgaggaaattttatattgttaactatattattttttaaataaagtaaatagaacctattgcataaatttatttttacagcaaataaaattaaaaaatttaaattgtttttaatattaaacataaattaacaataaccagataccgcacatcaacagaacttatctccaaccgtgtaacatagtcgaattttcttggaaataaatttttatattttacttagaaaatctataatttaaaaatatttttttatattactgtctgtagacgcccaataactgttcaacacaatattctcggcaaattcgatgattcacttagttaatctgttttttcccatatttatgccatttaaagataacaaaataaaatctttgtaacttacatcaaatatttcaataaatcaaaatggagaacaaacaaaaaataaaaaggaaaaggaaaaattataaatcaaaaagtaatgaagaaaaatttggaattgtgcaaaaatttattggaatggcaaatgaatacaaacaaaatcagaaaatgctaaaataatcgtacttttttataaaagattgtctagcaaattttccagaaaacttcatttattggcaaattttatttgaattaatttgttgcatatttcttagcatttggtcaacaaagaaaagagttatgatgctctaaacttgtctcagattaaaccggccagactgaactgtcccattccgcataaattgacgaagtttgaaaaaaatcattttttaataattttctactctactgatgatcaaaattgtaatgaaagtagggaaaaataaatatttttcatcagtaggataaaatgtttatttaatcgtggaattactttattttttatttaattacttacaatcttcttaaaattatttattctgagaaaacatattaaatatatatgtatttgccgtgaatgataaaaaagctgaataaatgtagattttgaagaaaataccaatgattcataaaaattggctgaaacagattatgatttctcgattattttttatgctaacacccaattatttcatccttttcttaattatgccaattggatgtaaattaatgtaaaatatttcttattttttaagaaacatccatttatagaaaaaaaattaaaaaatttttttctttaaaaaaagaaaaaataacaaaaaaaatggaaaaaaataactaaaaaaaaattaaatttaaaaaaatttccaaatcgataaattctcattttttcatttataaatattatagcaaataatttcacaatttccgtcattaaattaaattaattaacagaattattgtcaattgaaaatgcaatttcccctgttctcattttaattatatttttaatcaaccaaattaatcaaatcggaacggaaaagaaaaaattggaacaaaaatcatttgatgaaatatttggggaaagttgggaagaaaaagaagaaaaacaacgaattgaagagaaaaaaatagaaaaaattgtggcaaattccataaaataaaagaaaaaataaaggaaaaaggaaaaaaatattcagcaaaaaaatggaataaaattgaacagaaaatagcgaaaaaattggggacaaatcgacacaaaatttatgaatggattaaagaattaggacttaataaacaaattcataaaagcaaaaaatccaaaactgataaagaaaaaattgaaatttcataaaatctctttaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaataaaatcatttcgagacgacaaaaatgaaattatttccgctacttttattaattattttatttttaattgacaaaattggatcagaaaagaaaaaattgcaacaaaagtcatttggcgaaatatttggagaaaaatgggaagagaaagaagaagaaaaacgaaatgaactcaaaaaaagagaaataattggaaaattttataaaataaaagagaaaataaagcaaaaaggaagaaaatattcaaaaaaagaatggggaaaaattaatttgaaaatagcaaaaaaattgggaacaaatcgcaaatatatttatgaatggatcaaagaatttggtcttcaaaaacaaatgcataaaaattacaaatcaaaaactgatgaagaaaaattagaaatcgtgcaaaaattcattgaaataacaaatgaatataagcaaaaaagaaaaaaatatgccgaaatttgcaagaaaattggagttagtgaattcactattatgaaatggaagaaacaatttggcattcgcggtaaaataacggatgaagaaaaaatgggaaaaatgaaaatttattgggaaataaaaaaagaaaatccaaaaatgagtgacaatcaaattgctaaaacattgagaattagtctaaatagcattataagatggaaaaaacagttttgagaagaaacttcgtcgaaaaaagaatgatcctggctatttaacgcgataaagaaataaaaattccgatcaaatttgttttcccata

SEQ ID NO: 9980 - DNA, 4259 bp, Heterodera glycines
  misc_feature (22)..(22): n is a, c, g, or t
  misc_feature (67)..(67): n is a, c, g, or t
ggaaggatagagaggaggggangagagagtaagggagcggggaagagggaagattagagaggagggngagagagagtaagggagaggagagggagtgccgagaagtgccaccagggaaaagactcaaagcaaatgagagcaaaacgaaagactgacttgaatatggcgatgagcatattgatcagcaggatgttggccaccagcaaaaagatggtcatcagaacgggcggaatccatccccccggcacgcaattggtgccctcgtctccgcatgtgtcaatctctcccgcataaacctttcctcagaaacttctctttaacattaaattcctttcccaaatgacctctccgtaaagcataaaatagggcttgtagaaaatattgcgaaccaaaatccaagcccatttctcatgcggaaaagtgatggattggcgagataaaagcaaagggagggaaaagggaagatcaaagaaagaaatgatcagagaatgaacggaattaaatgatcaaaaaacaaaccaacgccaaaggccatcagagtgacctgtgaagaagggaagagcaattacaaaaatcgaagcataattaaacaaatggtcccaataattgaccgaccattagcagtacaattatgtaactcatcgccaacacctttaaaaggtttcgaataattttaatttgcgccattttaccattttgccagccattgtaatgtaaggtccgatgcgcgggtgaacactgagaaaatcaaacagtttcatgtgccaaagcacagagttagaggcaaggacagtgcgcgagagagtgtggacggtggacggattgagacggaagagaaagccgacgaaaaaagagaggacggcaacagtggtcagaatgttccagtatctactgtagaacacactgagcttctcaatcagagaggacgactcgagcacgaaaagctgaaagagttagaagaaacattttggaaaagggaaagggacagacgaaaccttgcggaagtgttccatggcgaaggaaaggacgtaaacgaacagaaaccattcgacgggggacacttcgctggggaattcgatcagcaggacgaaaatcagggcgagcatgaaagtggcgtaagagatggaccaagtccagaaggaagtgatcggggcgcaatagaaaagcacaaatttggacaaaaggcggcagatgggaaaggtcggccgacagagtacccgccgttggcactgaaagtggtggacggaggggagacggagcatcggcatgaaaatgaacggcaccaaccggagaggggaggggcgggggagcggtacttgatcgcaaaatcaaactaacgtcgattgtctcgtttttattgcattacatacaccatggacatacccagggagagggggcggggcggcggggcgtgtacatagggtacgacgtgccagggatgggtctcgtgccgtcccgtccccatttgtctgtcctttttcagtctgtccccattatccccgtccttttcccgtacatgcgccattggcaattgcatttctttacgatttcccaaacattgacaccgcacgaattgttgctgccgctcccctgccctcctcctccgttcctccatcagctgctcctcctcccgctcttcgctcatttctgacattttgctaaaatggcattttgtccgttttgccgtcgtcgtctctgtcccccgctgtttccctcctccgcactctgtgccctcctctttttcctcgtcactattgctttcctcctcttcataaacttcttcctcttcttcaagtgaagtgtcggcatttgaatggaagttatcaaaagaatttgttttgaagtcaagtaagagaatgctgcagcaaatgaaagtgccaatgaacagacagtcattagacgagtgattaggcgaaatgagacaattcattattaattacctcggtgggaacagaatgccaagcacaactttgaagttcgattgactgaacaaattgcgattggtgcttttacacgcaattgcaacgcgcaccttctgaagcgaagtccgccgtgccaaagttcggccaaaagaatttggcagcacgggtgggccaagaagcgtttgttgttggcgatgaccgccagcgaaaggcaagtgcgatggccccaattgggcagttcggccgtcagaaggcgcatggtcagctgagagtcctgctgatgacagttgtggagcaactccagggaccaatcgcggaactgaagaagtaggaggaagaagaagaagaagcagcgcattggcacgacgcaaaggaaaagcaaaggaaaagcaaaggaaaagcaaaggaaaagcaaaggaaaagcaaaggaaaagcgaatgcgacaaataccatccgcccctttgcatttttcattttcaaaatctaccatcctcacccccctgcattcttacaaaagccatccccaatttgtccctgaaattaaccccattgcccgcccatttcccaaaagtttgtcgctttgtccgaccactgaccgcgttggcacactctctgagttggttgctgacttccacttccgtgtagtcgtgcgctgcttcgcggctcatgcatttgtacaatcgaatggccaccaatgcttttgccattggctcttcgccgtactgccaaaagaatttggccatctgtcggtgcaaatgatcagcaggtgacacccattcgcaagttcacttcgtgtcgacgcgtcagcacagcccaaagcatcaattcgttgaagggaaagtcaaagtcccgcgtccgttttcgtccgtacggcgcgtcgtcgccgttcgccggcgcttcgtccgtccgttcgcttttcccctttctctccgctggggtggtcaaagcgcactttctctgaatgaattcgcaatttgcacctttcttaagggactcaatcgccttcgctcgctgttccctctcctccatcgggtcgccaatcgcctccaaacaaaggttcaatgagctgaaatttctcgtggcgcctttccgcagcgattgatttccaccgaatttggccctttcgtaacgcattttaaactcgcgcgttgtgtaggcggaacggtaagcgtttcccatgagtctgaggggggggggggaggcgaacggcactctctccgcttgtttcgtacgcctgttgctgccccataccgttcgatgatggctccaatttccggcagagtgatcactgtccgcttcgtcccgcgctcgccgcgtcgccgacgttccgcgcctctccgtccgcttttgcgcggcgcgtccttcgccggttccttcacacaatgtccgttcttttcgccctttgcttttccttctcattttaccgcgttatacaaccgctccaagcggtcgaaggtcaaaaaccgtttcagcgatagtccctgctccaaaaagagcttcacaaattccacccgactcatcagcaatgcctccatcatcggtttcgccagcgaagcggcgcccattggcagcgagcgaacgccgccattgccattttgaccccgaccaaatatttcagcgcgggcgatgtcctcacggccccagacgagcgtcattaacagctgatcgaccggggacagattttgggccttgaaaaattcaaaaaaaaaacaatggcacgaaaatgagaaatgccaaatcctgaaaggaattgcctggagaagggcacggagaatggcatggtccatttgggttggaattggaggagtttcggcgttgttatgaaggcaaaatatggtcagctattaggaaggtaaaggagcggaattgggcaaactgcgaaccaatccgtcccggtattgagcgcattggacgaggcggtcgagaatggcatcgctggaaggcatttgctcaagtggtgccgagttgcagctcaattgccgcatttggcacaacaaatgggaacggagttgagccggcaaaattctatgataaaatactcattggattggccatttcaaagttgtacttttgttctgacttttggtcggtcaaatgtcgcgccgcaaatgacaaaatgtccgaaacgcggccactgccctcacaaattatcaccggaacggacggagtgctgcaacgaaaaacaccacactcattcattaagcagagctcattaaggaacaaatacgaatatatataatgaccatctgaatgaaaatggccactttttgcgcagttttttggcccaccccgtgaggttcagccaattcattttgtttatggccaattatgggattg

SEQ ID NO: 9981 - DNA, 2247 bp, Heterodera glycines
ccccgtgaggtgacgatggatcaaattcagcgtgcaaagtccgccttccaaaacaacgctaacgatcggaattcgattgcttctgccgcctctgtccgtgcctcctcgcccgtcgtgcgcttccttcgccgctctgctggccaaaaattcctcaagccgtctgcgtaaaacgatgtccgccccgtaacggccgacggtgccattgtccgccaacagaaagtacgagtggcggtcgttaagtacaaggccgccggacgaaccacgccgggcagagcggaggaggacggactgccggacgaatgtctgtcgtagggcacttggacatttcggccgaggaggcgctcgcggtgctgaagaagtccccatggggcaatgccaacggtgacaatccgcgaacgcattctgaacgaatgcgaactttgtctgaagcgaccgttcaatgggagcgaacctcgccgaaatgcccgcctcgtcgagggcacgcccaatatgtttgactacgcccgagtccacctgaaaaggcctgtccatttggacggacaaacccaaaaaccccagcggtgagcacccacgcgcccgttgtttctgccgctttgagcaatccttcgcggaacactttgccaactctctcgggtactctgacaattttaaaagtcccgaaaagcaattggccggcaaagtcccactcgaagtcggccatccctccgtggactgtgatgaccaaccgcggcatactcagtccccattcgcgcaccaaaagacggaacacatcggcaggctcagagtcaaaggacaagcgcacataacgcgctttgtgcacgtgaggaccgccctaatcggagaagggaccgttcacttgccaaaggcattctttccacggcatttgatttgctcattcattcatttggcattcgttcgaatggcccttcaaaaagcaaaaaacaactttgcccaatcacctgaaattgaatgactccgtacgcatccgttgggtttggtgcggtgcatccgccaatagtccaacgggccctttcttcgtttgggcctttctccgctgagcggtccccgtcagtgccgcgacgaacgacaattgaagtggtaaagcgcgaaagtgccaattgcgaatgggaagcactgacacgtccgcaatggcaactgaaggcaatgaaatgctacaagagaaaggaaaagcaagggaaaagcaaaagccaagggaaaggaaaagctaaaggaaaggaaagcccaagggaacggccagcggaaggacggcacagaccgatcggagtgatcgccgacgggaatgaatttgatgcaatccctacgctgaaacactctttcaatccaagcgtaggaaggcggctgacggacccggcgttggaaaaggtcgcggtacttaacggcgtttgtctctctcaagtcgtcccgcccctcgcgactaacccccggcgacttttcttcgcactacgaatgtctctcccccgccgctcgccgtcgtttcgttcgtttctcttccaccgatcgttggttcccattgttgacttcggctgtgtttgattcctcccgaaatgctttttttgtgctgatggattggataaatggacgaagggattgaagcggcggaagccgccggcaaaatttggacaattccatcggaagacacagactgactccgagggcacaaattgacattcattcgatgcgtaaacgaatcaaatattcaataaaagtacagcggggaatgaatgattgatgggcaaaggaaggaaaatgtgaaaggggccatttgattgaaatggtaaggtttttggcggggggggggcgagtgattcatcgctactcaaagggcaaaaaacggagaattagcgcattttccgcctcccgtctttcccccccccctcccgcccaatcgcttcgtcaaaatttcgtcgtccaatgcctctactgctcattttcgtcccttagtctttccttatcaattgctcctttcccttctcattcattaacattttgttttcctcctctcaattttaccccatttctttgcttttgtatgtattcaattttagcaatgaacgacttggaaacagaaatgccagatttaagttccatttcggcgttagaaaacatttctttgttctaaggccagggtattttgcgcctattatgagtgtctttaaaattcaaaataatattttaaattcaaaaaataattaatctcattctcaaatttattattgtgagacaact

SEQ ID NO: 9982 - DNA, 1251 bp, Heterodera glycines
gcatgtcattacggtaaatggctgacagaatcacccaattgcaataaaacgattaattaattaactgagatggccaattggtacgcctctatcgctcgattaataacaaaccctccgtaatggaccacttttacaccaccgaacgactcgagcagcatctgatggcatcccaaggctatgtgatggagcgtaagagcctttgataaacggacagtttgagtttgacaacgaatgaaaggcttttccttttcagcggcgatgggctttttgggacggaatcaaatcgacccgaattgcacgtgcatacggcccttgtacagaatgtattccgaattcgcaagtgaattggcaattgtcaaattcccatgggttttacgccttggcattcgcagatgatcactttctgactgcctctgagcaggagaaggccattgcggagggactgctcggatatgtgcaccagcgcattttgggctattgcactaatgagccgggctgtggcgcgtatgtgccgttgtaccgctttttcagtgccgttaacaggggttgggtctttggcatttcatgggattcattcttttttagaacatttaatttatttaagaccatttttacacggcggatcaacaggtgtgaaacacgaaggaatggagtagtatcccatcatttatatgctcattaaggaaatgcattactataaaactcatgccgaactcacttacgcattcgaaaaaattgagtaagttttgcaacaaaaaaaggggggaaaggcaatgatcaaaaagctttgagtgattgtctgacccaatcaaaaggcattgatcattgatcggacccccctcaggtgctatgtgtggcaacacaattcctccgctagaggctgtcccgcggtgccattgctcggcgaaagggaacaaaggcgagacgtaaaaacggacgattttcggaggcagcgctaacctccaaaaacagagataaattgttaaaatctaagaagacaacttaatttattttttcctttatacggtattttccacttgaataaattttttttgtttaaattttgctattttcaaaagtcgcttaagcattaatcaaaaaaaaaaaaaagaatagcaaaactaaattattttacctaatttgtaagcactggcggaaaaatgaaacaaaaatgaaaacaacttcaaattgctctaaaaaataaatgtctttcgcggcgggcggatacaaattttgtaatacagtatgcaa

SEQ ID NO: 9983 - DNA, 1690 bp, Heterodera glycines
tttttgaatggagaaaaatgtgttttcttgagctggtagttggatttagtgcaattaaatgtttaaaggtttttaatgaaaaattgattgaacgcataaaaattttattggacgcataaaaaattgattggacgcataagagtcgattggacgcataaaagtcgattggacgcataaaagtcgattggacgcataaactgtacttgagccggaaatttttggaaatttcttttgaagttttgccaattaaaatgttttattttaaattgtaaatttatttttctatttactttctacttaatttttacttccaaataaaatttgaaatcataaaatttggtcattttgaacaaaatcttaaatttatcgctttttctttttgctaatcctaatattgtaattacttaaggtgcaaatgaccatttccatttttccgcgtatttgtccctcttttcctccttttctccggcattttccttcttcgtccgctaattcgctcgcttttcgtcgccacttttctctgaccggcccccgtcacagctttttcttcgattatttcactaaagttcgatttgaaagttataaaaaaggaaaagtcgctaaacgagtgaatccaaaggatttagcaccccaaggacatgccccctctccgcgactatttgccccgtccgacgtgggtaaaacatggcaatgaatttccgttgcgacagcttttaccaggacattatggttggttgtttgttgccatatcatcaaacgctgttgcggttaaattcttttccagatgatcccgagtggcaccccaaagaccgcggttacgccggttcaccgcgttttggcgacaaaatacccgaagacatgttcgtaaagatttactcaatttcaaacagaaatttcacccgaaaactgctggaataataataatgccatttgaattgaaccgttttcaagtggtagaaaatacggtttgactaattttgagggcaaaataagaccctaagaccgaagaatactttcttacaataaaacgaaactgcttattttctttgtctttttagcatgatatatcgtagaagtcccaccgaagaagaagtgccatttctccacaaggcaatgcacaaattgatgtccatggtattttggtgggttcattctttgtgtagagaaaacatttagcaactttttcgatgggctctcaaattgggaccgatttattccatgtcagtggtaaaaaagaaaaaagcgaattcaattggaggcacttttgaattaagtaatgcttagtatgttaatgctaacagattttataaatgctattgttagtctgcttcaaaatttaagcatatggaaatgtgagcttttttattggcacggaatggcagcaacaattatttaattgctgaccaaatcgctcaatatttacctcaaaaattcgtattttacgcatccccccagcgttgcttcttccagttactaattgttcaggtattgggttttctacacaatctattggcatcatcaagagcagtttacggtgagagcagggacggtttctacaaataaattttcttgatttcaaggagatttcgcaaaattttttgggaaagtttgggtgcggtagttttgaaggcggtaccaacaaggaaaaccgaacatcttcagcaaaaaaaaaactttattttttccttaa

SEQ ID NO: 9984 - DNA, 2255 bp, Heterodera glycines
ccccccccccctggccgtccctgggtgagacttcggttttcggttgtttgcccctcccaaaaaaaattctggttacggacctgtcccctccccttctgttggaaaaactttaaaagcttatttttataccgttaaatggattccattttaggaagtgcctaaagtttctacgcacacaaaagaacgaaaaagcttattccatttggttttgagatttttactagatttatggtgttttatttctaaaattggttacttttttccaatttttgtggttacgaatattttatatttgcgcattttcatataaaacatgcaattcttttcagggtgaatggtacttcccgtaccattacgaatggacggacgaggagctcggcgttccgcccgacgacgcgcctgacccggaggaacgccaattctggggccatccgggcgaactgatcggcacttaccgcgcatagaaagagccgtttacattaggagtcttcattaatgacgagttgatcgaaagcaaataaattgtttcggataggcccttttgcttttggcagtccgtaattttgtaaaaaaggagaaaaatggacattgttacgataaagttggatgtactttccgtttagtcatttccgtttgttcggtccttcgatttctgtcttcgttaaattgttaaccccataaatgttaactatttcaatactccgttcatttctttttgacgatcccccaggggtgtgccgagtttcgtgtcgtccgttttcggatttaaatttttaaaggaactatgtaacaataaaaaatgaaattcagaaaaatattgctccaagattgaaaaatcatagaaaccttaaaaaatttactcgatgttcaatttttccccggattcgcttattggcaccgaataatggcctggaccacctggatccaggacaaattcaggtccaagatgaattctataaattagacaaacaaaatagtttgttttcgtttcgtacgaaaatggttattttttcgttttcgtgtgccgtattcgtccaacaaaaagattttcttttttgagtttgcactttttgctgatccccttgggaagaggggcgattttggtcgcttgcttttcctctggggcatttctctccgtgggattaagcgtttgttctttgggttgcccttctctgttttctcctctcctcccacgctttgttttgtttacattcggttcctttggccaaatgtctcggctttgagtgtctctccgtgcgcattccttcgtcgattagcactctccgccgggggttgcataattttgtcttttatcggctgcggagcggaattttggcaatgcgcggaatttgcgcgccatggccgccacgcgatttggccgaagtgctcaaaattcttagggcgagtcctttggtcggccaacaagcgaaattctgatcagttgggacacgctaatcgacggattaattaaataattaatggacgagtgaaaaggatgaaaagaattctgacaatgaaaaggcatttgcatatttttgtttgccattgccttgcccgactctcattccttcggttttttgttcctttgcctttgctttccatgggttaattgccccgggtgttcgtcgtccttcgcgccgtcttttggcggtcgtcggctgcaaagtgcgcgtcccctccttcgccccccccccgccccctccccggggcactttttgtgcgtcgtttgccttttcataattaccctttggagatgagcacccacccgccctcctctttttcccattttcggctaatcaatcgcttttcgctgcttttctttacccccccccctccattctcatattttttgttctgtctctgctaatgaacgatcctttgggaatgaatatgaataaataattcatttttgtgccaatttctctgaattgaatgccgtcataaggcggcattgtttttggccaaatttgcaattcaatttggccacgctcatctcataattagccttcagcccttaaattcactttctcgtcaatggtttctcccctttaaaattcaatggatttttgggttatgtatcaaccgatcaaaggtattaatttcaattattcattctaattaaaaatccaaacaatttaattagaaagttttttggtggtaatttgttgttcggtaaggcgccgtgaaaattggcattccgagacgaaaaaattaaaagaaaaaaataattatcgagaatatcaaaatgacagtga

SEQ ID NO: 9985 - DNA, 3512 bp, Heterodera glycines
cctgttctgtgtgcgcatcccagcataaacaacattacggactttttgagcactgggcagcttggtgaagttgcaacgacaacaacaacaacaaccgcacttccgacaactgcggaggtgtcggcggcggcggcagaatgcgcacctccgcccgcgcatttgaccgcgtggatcgcggtgtgcacagcgctggtggcgcttttggtggttgcggaggtctgttaatttgagcatttaatcaatattccgttaaactcctatttctcaattaagcttgtgcgcgccgggttcaagttgcgccaatttttgaaggaccgcgccttcaaaaaagggattatgcgccgccatcgccagcgtgagtttctcactattaaatttttagcaaattaaatacaggaatgagcgccgcaaggcgcaaccgtcaaccggtgagcgcgccgactccgcttattttgccggcaatgttggccggagtttcgcttcgcccgacgggcgtcaatttgacggtggaccgggtaggaaattttaattaaaatctttatatattttaatttctcactcattaaaattacaatttaaatttaaaggcagaggggcagcgccgcgcggatggtacggacgaagagcccgtgtacgatgaggtgccgcttgacaccgtggaacaaaggcgtgatgaagaaaatggggaggaggatgaggaagaagatgacagtgatttttagtgaatcggcaagcgatcactcaccatttaaccaatcgatcgatttttcactttaaaataaaattttaaaaatgtttgaaaataggatcgctctacaaataaaataggaattcacaaaaataggtacaatcatcaaataaaatttgaaatatggaattagaagcatttaaagaatgtgggtgggcgctcgcgctatataaataactgcgcgtgtccccgtcggcccatttcactctgttcaatttttcaatgacgatcagcagcatgtcggataaaaaagcactgttcaagcgcgttatcgctgaggttgacctcactataagcacgggaggcataactttgagtgggccccgtctgtctgttccccgtttcattccgtttgaggaaaatgggcgttgccgcgcatgtaaaggaactgaggctgaggtggacacaatggtcaccaaggagggaatcaccttatggtgtacacggattgaaaaggcccagtttgtcccttttgacattgtctacgagcttcccggccattgtttctttcgcgtgaagaataaggcaagggtgttcagtgttccatacagcgaactgccgtcctcagacaagtgcgcccagtctctaccaccaccagtaaaacatcaacggacaccggacgacgaggaggagaagaatttgagacgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcaccaacttttgatcaacaacaacaacaacaacaacaacagctatcgtcaaaagaggaggagaaggaggaatgcataaacaacagcagtgctggagcagcaaccgaatctgctcccgatggtgatgtaatggacgatttcgtcaatagtattcaagcggcgacaagcaatatgcaatagcaaaaaagcgcaaaactcgctctgacctatatataaaagctgattgaccaattttattctccataaatattttcaagctctaactttataaaaaatgttaaattctcaaccgttcagtaataaagacatttgtttcaaattgccttgcggtataattatttccgggccatcctcatcgggcaaaacggaattcctactaaaatttattgctgagtgcaatgaactgatcgcacctagtcctatttctattctgtactgttttggtgagatgaattcggcggttccgccactgcaaaaggcgggagttgaggtgtattcgggcgtgccctcggaggagctgattaggcgccttcccaaaccgatgctgctcattctcgatgatctgatgttgtcaatagaggagcgctatctgtccgatttgttcaccaaaaaatcgcatcaccatcagtttgcggttgtgttcatcactcagaatttgtttgagcggaagatcaaggtggctcgcctttcggcgcagtatttggtgctaatgcgcgcgcccaactcactgctgtccattcgaaatattggagttcagctttttccgcgtcaactcgattttttccttgacgcctaccgcaaggcgaccgcccgcccctatggctatttgctaatcgatatgcacgcatcatctgatccagcgcttcgcctccgcaccaacatatttaaagaggagcaggaggaggacgagggaacagttgtgttcatccccaaaaatggagcggtataaacggcaacaacaacaacaacaacaagctaaagttagtcaactaataaaagaaaatgccaactggctttgcgcactgtcgaaagcaaaatgtgtgaaacgatgcgggagactgatcagaaaggcgaacactgatcagctgctgtcactggtggaagtgtgcttgaacattgttgcttcccgattccgactgacaactcggcagaagaaacgactaatgccctacgtggacacggtgcgccgcgtgagcagagcgaggagcgagaggggcgctaagcgagcgcttgtcatccagaaaggagaggggtttggcggactatttgcagccctcttaacacccgtcttaattgaattggcaaatcggttgtgacccgaaacacataaataccctcgtaaaattgtctcacacgcattcattcattaataaaaatggcaaaaaattcattctcgtaccacaagaaatttatcggggtctcacctctgtctcgcagacgggagacctcaatttggacgcggttcgccacgacctggaccgggccaggggtggacggacaacaacaaatccttcggcgaaaaatgtcaattataaccagcagctccggcgttatttacagatgagaaaggaacatgcggacagaccaactaaagttgagctgaccaagggaataagggtactgatgaatagaggtggcgaagaaggcgaggttgttgataccccacgccgtcttctcgctcctccagcacctcctccgccgcctggaagacctcctcgtcgtccaccgcccagtcctccgggtcccgggggtccttcgccaccaacaagtcccccacctcgtccacaacgctcctcgagaccgagcaggacttctcggagaagtggtcgtatggagcaatggaggaaaaggcgatacgatatacaacagcaacggcagccgccgccgctggtagtgcgagacctcctcgcataagctactgctgcgccactgtccgaaagtgacagatgatgatgatgatgatgaatatatgcta

SEQ ID NO: 9986 - DNA, 1772 bp, Heterodera glycines
  misc_feature (1727)..(1727): n is a, c, g, or t
cacctttttgaggatgaaaacccatttccaaaagtcattgaaattgtcccacttgaattgtgtgccgaggtctgttcacaaattccttgctaattcttcgcgcttgtgccaatgcgtcggcttccatctgtgccttttgcgggagtgaaatgtcaccgaccaattgggcacaaaacagccgcgcctgcatttccgaaatgggcataatggagccggtgggttggatgaggccaatgatggccaaagtgttctgaactcaacaagccgtacttgtgctgccgtattctcaatcagtgctttttttgtcttttccatcaaaaaattagctaaaaattgccttaggcgataagtcgtgcggaaacatcaatttgtacaaaagtgttttgttgtcctgcacagaaatcaatctgccattctccagctgaggaaagaaaaagttgtagccggtggcgaagattactgtatccacaccgtacacagtcgtaccatcgtcaaaagtctgaaactttgtttggtcatccaaaactacaaaatggtgtccccggggggtcgtattttgttttttgttgggttcgatttgtctgccgaagttcgtcccgtcggtcccttccgtttctcaccacgtccttctccgccaacttctgaatgttcggcttcatcaccaccgttccgctcgcgattcgattgggcagttcgtcgttcactgtgacgtgcgcctccaaaaagcgatgcgacgggcgaaggccgtaccgttcgtggtcaaagcgaaggttcaacttgcgctctatcaatctgaaggccgaggggaaggaactgtgaagtgcccgccccggcccaattaatgccatcctttgcctgttttggacgctgcgcggagtgatcgcccgcagggcaaatgcgaatcggttgagcagtaccgcgtcagtggggtggcccttctcccacactctgttgatcacccacgagccggtccgggtcgacaaatacacctttagggacacaattcgaccgatcttaatccatgggcccacctttttggcaactttgctcagttccaccgcaatatcgcccccggactgaaagtatgttaattagtccattgaatttattcattatatccgggaaatttacattgccaatgcccaccaccacaacagtttggtcttcgaatggttttgcggtgtgaaaggcgcgcgagtgaatgacttggccacggaagacagactgcccggggaaaggggggtttggccaccgttcggagcagtgatggccagtgcaaagcatgacgccgtctgaatcagttgcgaaaaagtaaaaatgccatgaaatccgaaacgtttaaaaaaagtgccggtgccttcgcccctaccgaaagtgtcgtccatcactttttgctcctcgtcctccgtcttccgataagtgactgtccatttgccattctgtgcaaattcctccacccgttgcacatttaacacttccgtttgaaattgaatgtgttttaaaagcccaaaatgggcggaatataagcgcaaataattgagcatttcccttcacaaaatgagagaaatggcaaattaattaattagagctcttttccaacggtttccacctgttgtgcatgtaattagctgcttctcgtgacggtggaaaatcactgtacgccgacatttctttggacgaattgatcaccgttgactgaccaggggaagggaaatgttttgggaaanaagtaatgcctttgccaaatcctccacttttagggcatcatatac

SEQ ID NO: 9987 - DNA, 3980 bp, Heterodera glycines
tcgctcccatctctcttcttcctccatccctctcgtgacccttcacctctctcttccttttctctccctcccctctctcttccccttctctccctcccctttctccctcccctctctcccttccccctctctcttcctcttttcttccccctttccctcccccccctcactttcatcactgtcccttctccttgtcccggattttccttgtagcgccacagccctccaatatccaacgacttttccatgcacaccgcgtccaagccgtattccaacgccgttttcagcgccggaaggcccgaagcgccagcaccaatgatcagaattttcattggatggaaagggcaaagaaatcactggcaaagggacagaagtgatttttgttgaaaatatcagagatatttaagagttaattttgcatttatatttttattttttgtattttgttgcgtaattttatgaaattttttttcttggcaattgaaaattataaaaagaatattaagccccaaaaatagaaatataaaagtcggaaatagcttttcattcttccatcattttatttggtccaattcagcggaaagccgaggcaattagcagcaccgttaaggaaacaacaacaagttattaattagttaattaatgtacataggcaaaaaagggatgacaaatggacgaccgatggatggaaatgatcgattgaaattgcaatggaattgaaaggaggggaattatcattatcatatcaaaacagcaaaagtatggccaaaacatcgcaaagagcgaaaaaacggcggcgattggtcaaatgggccaagacaaaaaaagtaatttgaaaaggcagcgccattaaaaatgaacaaaaaataaaaaagaaaaaacggacaatgcaaaaaaaagagtaaaatttgacaaaaaaaaataatggaaaatgaaaaagagagaagagaattgcgaagtttgtgcattgttatttatttccaataggtaattaattagtgagaagcgtggtttggtttgagtgaaggcaatgcgcgaaacgaatggccgtttccgtcccaatcatttcaatttggggacggaggaaagggccgaaaaaaaaataaaataaccaccgaaaaatgacaaattaacgacagaaaaaggaaaatgaaaagagaaatgggaaaacgagaagaaccgaagaagaagaaacactttgaaactgacaatttgaaatggaaaagaattgaaatgattggctgaataaaaagcaatgctttcgcttttttcccattgtttcgctttgcttttatttaatccctttaatctttgccccccccccctttcatccgtcgccgctcatcgctttatcttcgaccgattcgccacagaaattgagaaaattgagcaaagtttccaccgaagtcgcacagtgacaacaaacactttgcccatcaaatgtaaaaatattacacagttcttcgatttgcgccttttcatttaatgacggctaattgttgagatggtaaaaacgaaatgaaaaagtgagcggaaaagacaaaagacacttctcaaggggggattaattatgccaaaatgacctttgggatgtcatattccattgattccctttcgcatcacttcatttggcattttttgatcaacgattagatggttcaattaattcttggcctcctttgaccagtgaatattcgttagccctttgatttatcgccccgggcaaatcttcggcggggattggcccctcgggcaaaagcaaaatattttcttcggccaaatgacaaaaaaagaacacacgacagctgctgttggttgaataagggcgaaaacggtggcaaaatgtctctgaaaataacgggacacaaataaaagaaagtgggcacagtcttagctttgctttactttgctttgcttctgtcaggcaattgtatatttatttgttttctcttcctttaaattggccattttccgttcctttggccttttctctcctccgtccctttgaatatgtttctccgtttgctgctggttcatctgctgttcgtcctggtccgtcctcaattcgaccatggcgattccttcagtttttcgaattcggtggaatacgaagaagcgaatgaatcggacgaaatcaccgaccctttgcccgggctcagcttcgaactgaacttcaagcacttttctggccagtctttggcaccgttttccaataattggccctcttaaggctttctgcaagtgtcccccacccatttcctccattattggttcgtcacctcccaaaaagactcatccaaagacccattggtgatgaacagaagcaaatgaagccgtaatttggttggagctgtccttttgaaggtgttttggttcaacggtgggcccggctgttcttcgctggacggactcgtcaacgaaatgggcccttatttggtgaacccggatggacaaacgctgcgagagaatcccttctcctggaacaaatttgcatcggcgagtgctttgaactgttggaactgatcaccgtgccattctgtctctgtgttggttcagatggtttacatcgaagcgccagcgggggtcggcttttcctacgccaccgacggaaacacaacaacaaacgacgacttggtcgggttgaaggggtcggcagaccaatcaaataaacacatcatctgaagtcgggaggggagggaatccacgaagtcgagaaatgagtgactgctccgactccctttggttggccaatgctatgccaatcattctttcttggcacaatttgtcataaaatttgcctattaggccaatcgactgattctctgatcattttatccctttttaatcagacttcgctcgaaaattacgaggccatcaaacagttcttcgccaaacacccgtctttccgtaatcactccgtttttatcaccggcgaatcgtacggcggcgtttatgtgccgacgctaaccgcgcgaattgtggacggacaagcggaattccccataaatttgaaggtcgatccttttattaattgagcaatgcgttggcatttcctttagggaatggccatcggaaatgggtatatgaacgcgaatttgaacattgacacttccgctcggtttgcttatggccacggaataattggtaattggagagacggacaattggaacaaaatgccaaattggaaaacagatgagaaaatatggaacgaattggagcagcggtgctgtagaggatgcattggtgggcaatttggccaattaatggggagggaggggagagagtggcccatttgtgataattaaaatggaatggaattctctaattccccaccccccaaaaaaaaagatggctgtgatttgacggcgttgaaagactcttgcgaacggatggtcgggtcttttcctaaaaaggcattctttcgtttttcttttaggtggacgacattttcgaattcctttggcacggcggattgaatccctacgatttgttcgtccattaattgcccaattagcccggcccggcggcttttcctttggctctcctctccctttgaaggtaccgcgattgcgacccgagcccgggccgaaattccatccgcatggaagtgctcaaaaatgggctcgtccctccgaaaatgcttcgccgtttcttttccaatgtgacacgaaacttccgccggcgtctgcaagtattcgtgtcgattacaaccatttcaatacgtaccattcacttgaaaggataccgtacaaggagcacaaaacgttggcacaccgtccgtgccatgtttaaacggtaaaacgattgaaaaaagaattaaaatggtatttgaatgccttttagatacggatttgaccacatatatgaatcttcccgaaggttccgcacaataaaccaacaataataccaaatttattaagtgcgaaaggcactaaacattccggacagtgtgggacatgggacatttgcaggttggcat

SEQ ID NO: 9988 - DNA, 1627 bp, Heterodera glycines
  misc_feature (80)..(80): n is a, c, g, or t
  misc_feature (97)..(98): n is a, c, g, or t
  misc_feature (226)..(226): n is a, c, g, or t
gcagggtgagcagagaatgcaattagggcaattaaaatgccaccgaaatgacatttccaaagaattaattcgattttatnggaataataactcattnnaagagaaacaaaattaattttattgcaaatattacacgtttgcacgtgaaaagtgaaattttctttttcagcatccttctgtcacattgttacaaaagtttgataaagtgaaacatttggaagtgccncaattaacgttcaaatttgcgaatttaaaaattaatttagaaattgtcacaatgccaatcagtaaaacgttgccttgtggaaattataatcatgaacaatttgcaaaattaaaaaatgaaattgtcaatgaaattaaagaaaaatttgtaaaaaattctcaatttgaagaaagcgaaaggaaatgtttcgaagaattaaaatcaaaacttaaagtgttagcaggtaaataaacaacaattaacgaaaaatgatagaattaaatcacttaaattcacagattattcattttatgcaaaaattgagggggaatatttaattgggaattggacggacgaaaaggaaaaggaaaaggaaaaggaagggccaaaaaaggtggacaaattccggcaaattctcgcctatttggaattgtgggcaaaaagtaatgaattcattaataattaattgagtattagagaaaaggtattatttaaatacatatttagacaaccaaattttggacgatttgatgggatttttgaacacgaaaatgcttttgacaatgctaaccaaaatattccttttgtacccaaatgggtcaatgccttttttggtcgagaaattcttcttgacttattccacctggtgagcaattattgttaattggcatcattagcgtttattactttcaaggaattggcctttgcccgtccaattagccgaaataaattatgaaagggacggcggatttttgagttggtcgccctttcgggaatggttcataaaacggcagacgacgcacgcacatttgcgcacgacaatttgccaacaactcacaatgccaataattacgccaacattcccggaacaaaacgttggcgccaatttgaacggggcaacggccaaagtcattttgaacgaactgagaattggtaaaatattaaatgagatttaggttaattatcttgatttgtcttaaaagctttatttttttagcttttgatcagataaaaaccgttaataaaaacaggacgaaaattattttgccgctgaagggaaaacaatttatagaaaaggtattaatttaattttttttatgtaaacaatattaataattattatttcaaatattaaattatatttttatttaattaattttaatttcccctttttctttccttttctccatttatttctctcattatctaattaatttctttctctcagttctcccatttccttttggtcgtttgttccgccccccaaattaacattaatcgtttccaaatgtttgtgatgcaacgcattggcgtcgaattggccaattttgtgctgtcttcgccccctttggccaaacgcgtgcatttgctgcacgtcaatccgacggagtgcaaaacgaagcaatcgctttgacacttcgg

SEQ ID NO: 9989 - DNA, 2598 bp, Heterodera glycines
  misc_feature (45)..(45): n is a, c, g, or t
tgttggctttgtctgaaagtgcattcattgatcaaaataactgtntaaaaggagttcatctcccctttttgccacttttttccccatttccattctttttgatgttttgccgctttcccctccctttttccttcgcctgcccccttttgtttctgctgctctcttcaaatttggtgcttcgtgttggcggtaagattaacaaatgaatgatttggcaaatttcaaatgaaattcaaaaagcatgaaatattttcaatggtttttttggtccattaggtgtctttaaactgttggatagacaagcaaaacttgtgaacaaccctaagcatggtgtggtgtaccttttccaatttccgagaacatcgacaacgccaagccaagcgccgtacaatttgatggtcgagacttggctgcactggaagaaaatcccattccatgtaacacttttgtttgaatgagaatggttcggctgattgattcactccgaccaaataatattttgataaatttgccttcactttggtcatccccccccccaattcccttcacagcgaatcagcaaccaattgttcctcggctcccactcaaaaggtacggcaccgtttgcctatttcaatggcaaatacattgacggatcgaaagaaatcatcgaaacggttggcaaatataagccggttgtagatgaaaagaagttgatggacaagattctcgagatgttcaagtgggtttcatggcattttcaaaacaattctttcgttttacttaataaggtaaatttgtcacaattacagtattttgatggtcgatcgtgcggctggcttagaatggatggcccaagatgaagcacttgtggagatcattgtgccacaaatgctcacagatgaacggcttaaagcgcagcttgaagccgtcaagagtaaatacagtatgaaggtgtacgaaaacttctggagacgatattttgacgcgttcaacggaggaaaagaaaaagagcaatttgtgaaggattttttgaaggaggtgaacacagaaattgacgcattttgaccattcactatttgtctgttctcaggaaacggaatcgaatttgacggatgaagagcgatggaccgatttcagtgagtcgcttcgcaaagtgataaatggcacaatggaagtggtactaacggagaaggtgaacggaaaaccgaacagttccaatcagacgggaaacagtcaagcgaaggtaaacggacagaaagaaaggcataattaacagccaaaaaatgcttaaggcattttgcctatcaaaaagttttgctttctttttctcttaattaaaaagtcagccgaaaaatcaaaaattaatatgcgcaaatccgttaataaaatcaagccaaattttccataatttttctggcgtcggctctctctctctctctatttctctctctctttctctctccctctctctctatatttctctctctctctttctctctccctctctctctatatttctctctctctctctctctctttccttttctctcccccctttctctctctctttctccttctctctctctccctctctttctctctctatttctctctctctttctctctccctctctctctatatttctctctctctctctctttccttttctctccccctttctctctctctctccttctctcctccttctctctctccctccctctctctccctctattttaattggatattttgtaaataagtgaagtgaaatttgatgtaaaatttattaattttttaattttaatttcattttatttatttttttccttatttgatgaaaaacaatagataggtggttaatatttataatatttcgctagagaaagtagcaaaaacttagaaaaaattttttgaaatttttgcgggaacggggaggagaatgcgaaaaatgggatttttcttcgacttttggttggggattcaaggaaggtgtcaaggcttttcagagtgtttatttatttccaaattaaataaaagaaaaaaaagggacacaaacaatatttggagaaaacgacttcatcaaattaatacaattaaaattcgaatgaatgaaaaggtgggaaaaaacggtcacaaataaattaacataatgccacacaattataaaaataaaaacaagagtcaaaaagtccaacagaaagggtttcccgcctcgcacaatttttgagtaaactgagaattttttgagcttttaaaaatgaaatagcaggcaggccccagggggaagcgggggtgggggaattccccctccctaaatgaaaattaaagttttttttatgaaaaattgcaatttttgattactattttattaacaaattcctttaaaatttgcttgactttccccggcgatctctaatggcaccgccggacgcccatcctactatatttcttgaaaatttaactccaaaacgaaaaaaattggtcacgtttcagcgaaaaacggcacaaaatttctactttttctctccggcgctgaaattttcgtacattaacattggagaaaagttttagcctgaaaaaaagaatctcttcagatcccctctccgaaattttt

SEQ ID NO: 9990 - DNA, 1984 bp, Heterodera glycines
agtagggatgtgcgagagtctcggttctcggttcccgactcgggaaatttctcgggtttttcgcttcccggtctcgggtttttagtctcggaaaacgataaatttttacactgttaaggatgatcctttcggggagtgggtcgccggtaaagggagaaacgaggaaaaattattgaaatttttaataagttttcttaacaaaactctttaaaaatcccaaaaaaaatttccggcggtgcctatcggcgccgccggcccataaattcccctaagatttcaaaatttgaatataaaagttaaaaatctatctttttttgttgataaaatcagcaaaatattatcatttttatttttggaattttatgcaatttcgtaacaaatgtcattaaaattttcaaaaattttcccgtcggggcctaacggcaccaccggaccccgattttattatatttttgaaaaatggagaccaaaatggcaaaaaatagtaattttttggtgaaaaaccgtttctcggggtcatttctcggtctcgtttctcggttcccggtaaaaatcacttctcgcacatccctaactgttagcccttatccaaattatttttctacaatttcaagtcatttgaaagaaaatggagtaatttcaaacaaaagtcattggtatttttcagcccgacgctgcccttttcggcattttgacccaattcttcgagacgccattgaacgtctttaaagggttttctaaaaaagaaggtccactttatgaattcactaaagaggtcaaaaaaactctgggttttgctgataacagcaaatgggaggcgctcacgaaaaggccgtggcaactgaacttcgacactgaatttatttttggattcaccggtgatgactcatcaaaatacaacggtaggcggggaatacggtaaagcatgcgtgtgaattttaatgtaaataaaaataaatattgtaaaattcttttaaagcatagagaaataattgcacttcccggcttaaaggtccctataaacttgaattgtttaacggtttggaaacaattgaccagtgcatttcgtccgataattcttctgtcgtcttttcggacacttgcaaagcacagtatccgcctgaggttgtcgagtcagcgaaagcgttgctgcacattgtaaatgaacagagaaactcatcatcaaaagcaagttagagtaacgggaaagcgattaaccaaggatgaagcccaattcgaactgcccgaccctttcaaaaatagtcataatttttctcaaattattcatatcttcgatatgtgttgggccgtttcataaaaattgccaacgtaggagtttcaataattcgcaacgttcgttcaattaattaaaattggtttttaaatttttttcaaacaattattttaatattcataactcttgacttcgccccaattggctgattttatgaaacgatttagcacctcttcgatagcgcccatcataaaattggtgtacgaaagtttcgtcagtgaatcttatgaattgtaaaaaatacaaatttgagaatgaaaaactattcaaatcaattcggaaaaatactttagaaaatttgtaaattatttatttgattccctcgaccctgccgggcgcacccgtacttttaaagcaaaaaaaagatcaaaaataataaactaaaagacagttttaaattggtttcgtgaagaaatatcaggtaccttcaaagattctgaattagcacgcaaaatttcaaaattagaccaagttttatttgaaaatatttgaaactggcaacatattcatctttttatgcaagtgtataatatagaacctcaagtgctaacaaatgctatgcctatttggttgattttgagaatagttatgatggtttttcgagaaaaaaaacaataggggcggagctgtgtgaattgtttcccccccccccctttacgaaattaaggcggggtgggggggggggggtca

SEQ ID NO: 9991 - DNA, 1738 bp, Heterodera glycines
ggcagtcagcgcaagtccggagaaggcaacggagttggccaaccggcccgatctgaccaatgagtactgatcagctaatcatgagcaatgactgatcagtatcgatcgactgaccggccgatcatcgattgagtgctcttagattctgtctttcctttcctaagttttcctttgcttgtttttttccatttcattagatagtctttcttttcattcaaactgcgtccattgtgaatgttttccaatggataaaagggtggatctgtcattgatgagcttatgtgtcaattgcttaattatagtaatttataatatgaaaccctttcttaacagggccaatgctttttagtttataattgcctcggccttaattatgttcgcggtttgtctccctatgcacgaaaagtgtgccgcagtggaggcagtccgccaattggtttgcctctcctcagtgccaaattcaattggccattcggctcttggccaaactcagtctcttcctccttttggcattccgcggctccattgttttggccgatgcctttcctttggctgtttttcagctccatcttctgctgttcctctcttcgatcatctgttcgactttgagccgtggacggcggcgtgtgactcatttcagtgatcaccgattgattgctaggggcctgtaatttgtgattgaaaattaatgattgtttgttaaataattgccaatgtttgcctggggcacttctcgctgattaacatttaacgacgactgatagcgcatttgtacgggcgattttgcccgagggtttgccgagccggcgtgtcgctcgcgttcatcggactgagaaacggtcggcggcccaatcggacgcgtgcgacaaatggaaaagcctaattaatctctttattatgaaaatcaaaattgataattttaccagtttcggccgagcgcttcacaaactctgcgcatcgcaattcggccttctgttgtattgaaattaggagagatttaagttttataaaataaaaaaaaaaaaatcgtaaatggtgaaaaaagaatgcattaaaaagtgattaccactaataagctgatccaaagaaaaagcccaaaaaggaaagcaattaggatcagatgaccgaccaaactcaatgcgccgggcttagcgaaaacaccgattaagcaaataatcaccagccaaacagcaaaagcgcaaaaaactctaaaaatatgaataatataaattattactattatttatttttattatttaaatttatttaaaaatgcgaaattcattgagtttattatcaaatattatcatgaaatggttcaataatggtggtgaactaaacatgaacttaacttgctgcaatgtgtgggatcagcagctgccagcgctgtctgcgaattccatagaaaagcagcaaaatggtcaccatttggaggaaagtccagcccagccacaacattctcaagctgcacatcgcattgtgcagcagcagcagacagctgaaacgaacgcatttatttgcttctttttaattgcaattttttctctcttttttgtgtccaataatttatttgtgttagaatttttgcgtgttaaaaatgcctcaaaataagtaataaaaattgagaaatattcaaaattctctttttttcaaatcaattaaaagtagagatcggaccggtcgaatcgaccgacttttttgacaaatcagttgggcatttttttacaaaatcattaaa

SEQ ID NO: 9992 - DNA, 3266 bp, Heterodera glycines
  misc_feature (262)..(262): n is a, c, g, or t
  misc_feature (268)..(269): n is a, c, g, or t
attttgttttgtgtaattttgttagttcgttgttttatgtaatttggagaataatttggatatgtgctgtgctgtgcagatttgagttttaatattaattgacggagttggatatttggcgacaaataaccattggtcaaagtcttaaatattaattgtccctattcttccgacctaattaaaagactgtccccgtgtttccctgtctaattaactacaagcaattaaagcagcggaggaaagttactatttgccaaagggngcgccnnatcagaaactgctcgtgcggaacctaaatttgtattaagtttatcaatgacaagtgacaaaagtaccaggattgcccaagggttgctggccataatttggtgccaaagcagatgcacggaagtcggtggacgtgcggcaaaattagtgcctacaatttgtaatagatttatcacggataagataaagtgataaagtaccaggaagacggccgaattgatgttggccataattaaggccgttattgggattagctgccaattgctgtgccggaacagaagcgacggtaaccgaaggagctgcgccaaaatgaagaccaaagggttgttggccataattagtgccgtaattgggtgccaaaggctgggctggagcaaaggctgtagaagttggtggacgtgctgcaaaatgaaggcctgcattagcacttcatttatcactgataagagcaagtgataaaagtaccagaaggatggccgaaagcgtattggccataattaatgccgtaattgggtgccaaaggctgtgccaaagctgaagctgcggcagttggtggacgtacggcaagcatatttgctggaattttttacgtttattgataagattaatgaaaaggaccgaccagaagaatggctgataaggcaaaatttgtgccgtgattcggtgccaaaggctgtgccagagcagaagctgcggaaaacgggtgaccgcagcaaaacaactgtctgtaaattcatttaaatgccattttggtgaattgaaatgagtctttttaaatttgttccgatttatttggactttttttcatttcatcaaaatttaatggcaattttattattttaaaaattatcttttcgagtttaagttaaaaataataacaaaaataccataattcagtaattttaataggtatagtattaacgcctgtaatttaagaaatggtagttcatcctaactcttgctatttgcaatttttagtgttttttgccgatttttgtgccgaaaaatgtcattcctacttatcacttggataagatgaaagcaattactcaatccgtaattatatgcgtttatgtctccttgtaacttttaaattcgtcaaaagttttgggaattttgtgggccccgtccactccatccctaattagcatgtacatgtaatataaatattaaaataactttttatttcgactgatgggattcagtgactgtgagaaaaacccgtaaaatgtgaaaatgacaaatgaacacaaatcaaaaagcataattgagtagaaagtaaagtacaaaatcctaagatgacatacatatgtaaaacatttggaattttaaatctgctggaaatcgttggcactttttttgtctattttgaattcgttacaattgccaatgtttcggtaccaaaaaaatagtgtaaattgtccaaatgcttcgtgccacaaaagtgtgatgaagcatgtaaaaacaaagtttgtgaggggaggggcacttcgattcaataaaaaataaaagtgaaaagcattttgaaacggcgtgccattgctcgcattgttccattctctgatcacagtgtcccaaaaaatgccatttcaaatgtttttttccgttgccagtgccaccatttcgcccccgtttatacgttgtgagtttggcacagcgtttgtggtggtcgattctgtggaggatagcttcaaaatgttcagcagatgagacgcctcgtcggtggacggtgtccgaagactggacgattttctgtgaggaaatgccaaattagggagggcggagagtaatgttttggtaccgagaatcgaggctcgaatgagccaaaatgctcatcattagagaccgacttttgaggcatatgcctttttttctgcgcacttgtttcgatatattaagcataaataacgcattttccacttggtttgaggctcctacgttgactttttatgcttttttttgcctttttcgggatttccgtgccttaaatgccttttttggcatttttcctttttgatgccttttttggcgttttttccgaaaaattccataaaaaatgcaataaaatcgggaaaacacacccataagaaatgacgtgaaaatttttcagaaaatacacccctaagaattaaaaaattttctcaaaaattgatcgccaaaatttcattttttttttcttgataaaaaagttaaggtttaaattttcatattctaaaaacattataaaatatttattaatcatttaaataaccaacattaaattatttggttaagttttacctgttttgctccctaaaaatccttaataaaaaaattttaaatgccttttttcatgcctttttttcaattttttcgtgccttttatagtgcctttttcgcgatttttgctgcctttttagtcggtctctagtcatcatttaatggacacgaggaattagtaaaaaaaattggggaggcgagtttttaaaattgaccatgagaccagggtgccatcgccaaaactaaaaaagcgggcacaacaaattcaaaatccggcataattttaaaaactcaacaaatgccggttgctgtacctctgcctgagactcgagaccgaaaatagcccggcttgcccccgagacggggcggagtcgttatttaaaaaacatcataaatttttacgaaaaattatatataaaacaactaaatttttatttctgaatatcattcgatagccctaagtcttctctatcagtctgtaaaatttcaaaaattttattaagtttcaaaaaagttatgaccaaaagaattcaaaaacctcgtttttcaaaatttttggctataacttttttttaaattaataaaaatgtttgaaaaattgcaagctaataaagaacacttagttctatcgaattataccaattggttgcttttgagcaaagttataagcaaaattatttattttgatggttttttaaataacgcttataatgatggtttttaaataacaacatagcacc

SEQ ID NO: 9993 - DNA, 1212 bp, Heterodera glycines
ccatctgatatgtagacaaaatatgaaatttctccaatataatcattaacctaccgtaacccaggggtgcactttgatctaaaattaattgaaaataattcttaaaattataattgaaagcggttaagaaattttctaaggcataagcactcatttcgggtcggtcacaatttggctcacggaatcttttggcatcaaaatttaaaacgtcacaattttttttcttcgacaattaaattattatttttttctcggaatcattcggtaggtctaattacctaaactatatcaattaacagctgtaggctaatgaaatttgttaggcgctcagataaaatcaattaatttaatttggatggtaaataaacaatttttagcatttaacgccaaaatggcccgtctcccgcccattctgattgatgtgccgaggaaattttaacgaattttcatataaaaattgcaaaaaacaaaaaaaaattctggggctagtgctgtaaaatggctgtggcatttcacctgagtgatgtcgaagcgcaagccagggtctttcattagcattctgtgaaaaaatgtgaccccatttttggcattttaaactttttttgcttacccgagaattaattctttgagctgttcactgatttcggcactttccgagaacacaatttcctgtgttttgatctttttgtgcaatgcttaaatgataagcataaaaatatgccccatttttggcttttttgctttaccgatcacatatttatcccaaaatgggacattgccgatgaccaaagcgtacagtgtgatgctacaaaatgggcaaaaatgtgatgatcggaatgcaaaaactgaatattggaattttcactcccggaaacattgaaattttaagaaattttggaaaatccgcactttttgaaaaatgaaatatgaaaattaattaaggcattgataatgatgatgataaatgtttaattaaattgaattacccaagtgaccaaatgtcttgtgcccttccgctgtaaaaatgggacgaattctcggacaaagcctttaaaaagggacaatttttattacaaaattattataacaaaatattattattatttaaacttatttaaaattcctgtttaaaaaagtaaaaaatctaatttaatttttaccttttttatcttagcttattaaaatctcacagttttttttaataacaatttc

SEQ ID NO: 9994 - DNA, 1919 bp, Heterodera glycines
  misc_feature (1814)..(1814): n is a, c, g, or t
tggacgtgtgttttgaccttgttcattttattttaaatttttgaatttctttcaaacaaaccatcaatttgggatgaaaaatcaatgccaatattttcaccatcctttataaataattaattattaggttttttaattattattttgcaatgtaatttatagatttttttaccacattttcgccaatttcgacacgacttgtgccacttttttgtgccattttgctgccaaacatttcgccaagactttcgggtcccgaaaaattttcaattaaatcaggattggctaataattctccgatcatgtccaggccttttgggtcttgtagtagagcaattgcagtctgagttcaaaatgcttgttaaataatttaaaaaagaattaaaaaaaacgaaaatattcatttacaaataaattaaattgcattttgaaaaaatttacctgaaaatttgagaaaaattcacttttccggaattggtctaatgctttgtaaatgtcggcacagctaagtcggttgcaaatgccaatgaatggtatttctggcaacggttcctcgtcaaaattgccacttttcgccttgcgcaataatgcatccaaaatttggctgaattccctgctggccttatctgctaatggatttcaaattttatacaatttcagtttctatggccactttttttttcgggtatatccaagaaattgtctgttgcttttggcacataattttttgtatataaaaattctcttagtttacgttgataccaagaatgtatgggtggttcaagtaagaaaagttatggccaaataaactgaagaattacagaatttaattcaattacctaagctgtctttcataaatttttaaaattttttttattagcaacttaatcctgctacctcaaaaatttatttaattaattaaaatcccccaaagaaataattgtcgtcacttttttgttattttgacaaatttcttaatattattgtaataaaactatcagaatcgacttacaaaaattatatggaaaaagccaattgcgtttaggtatattttggtatttcccctaactaaaaatccgcaccctatttcaaattcagtttatttagtttatgaattaattttcacattttaaattttttcttatatgcccaccgttcaaatttggagcggcttgtttcttggccaaatcctccttgcgtttatcgttgacaaaattgaaaatttctgtcaataagccacctctgccgaacaatgcttgtttccattctttacctacacattaaaaaaaaaaattaaattgctaaaaatatttttatgttctaacaaataccaattgcctcatgaaatgatggcgccatttcattgagttttgctgtttctgttcgtcgctgttcttctaaatgatcaaattacaccataattagcattatatatttttttcattttgggttttccaaaatggaaaaatttacaaaattatgtttgggtttatataatgataaataaaaaaaaccacgggtggcacaacccggaaacccaaacaatgaaattaaaaattttactcgcaattgtcatcggtcgagcatcgatgcttgatataattggtgggtcattagcgaaagaaggacgtcgaatggttggacttcgcacaaaggcagtgttgtcaaaatgggtctatgtattaaaacaaaattttacaacttttgttttttttatcattttattatttaaaagtgacagtgatttttgggcgctgaattctttaagaaattaatttttcatagtcagtcaaatacaactttttggttatcgntcaaaagctttaggccatggatgacccgatttcaaaaaaatgaaagtctggatgccgatttccgaaattttgcaaaaattcgggaatttaatttttttaaatttt

SEQ ID NO: 9995 - DNA, 2951 bp, Heterodera glycines
agtttatgaattaattttcacattttaaattttttcttatatgcccaccgttcaaatttggagcggcttgtttcttggccaaatcctccttgcgtttatcgttgacaaaattgaaaatttctgtcaataagccacctctgccgaacaatgcttgtttccattctttacctacacattaaaaaaaaaattaaattgctaaaaatatttttatattctaacaaataccaattgcctcatgaaatgatggcgccatttcattgagttttgctgtttctgttcgtcgctgttcttctaaatgataaaattacaccataattagcattatacatttttttaaatttatttattatttcatatttaataatgttttgattttgctgaaaatagacattggcacatctttttaattgccgatttttgtgggttttccaaaatggaaaaatttacaaaattatgtttgggtttatataatgataaataaaaaaaaaccacgggtggcacaacccggaaacccaaacaatgaaattaaaaattttactcgcaattgtcatcggtcgagcatcgatgcttgatataattggtgggtcattagcaaaagaaggacgtcgaatggttggacttcgcacaaaggcagtgttgtcaaaatgggtctatgtattaaaacaaaattttacaacttttgttttttttatcattttattatttaaaagtgacagtgatttttgggcgctgaattctttaagaaaattaatttttcatagtcagtcaaatacaactttttggttatcgttcaaaagctttaggccatggatgacccgatttccaaaaaaatggaagtctggattccgatttccgaaatttttgcaaaaattcgggaatttatttttttaaattttttgccaattcaaaatcgtttattattgtgaaataattattttgtatgtggctttctacttcgtttttgtttccaaatgaaactaaaaagcataaaatttgccatccctgctctaatgttagaagatatttataagcaagtgctgagctaagcatttaagcaattcatcaaaaaagttcgcggctgaaaatctaataagtcagaatttttgcatattttaatttacagttttttacatgcctgcaatgctttgtcatttttgagagcttaataatgctaattaagagcttccgggtgattccatgtttgttggatttggtaacgtgtgttatatttcttcggcacccatacggttgcgcccaaatgtctcaccattctgccaaaaatttccctgtgttgttctttcaaatttttatttgtagcacttcggcgctcaattcgctgtttttctttaaaaaaaattagatttcatatttaaaatgtatttatttttactttttttattattttcgcccgttcctaagccaattttttccatgaattgaacaatggactgaaccagttccattcgcccgatttgttcaatgaacgtcaatgatggcgtagaatctgcgatcagagtgatcagataagagagagagagagaggggggaatgcatttggatgacgtcagactggcttactggctttaagcaactaatttttgtgttattactcaacgctattccttctatttatttatgacctaaccaaactaattatatattttttggtggcaaaaaaaaatcaggaaaaaattggaaatattttgaaaaatatcggaattatgaagcattcattttcaaataaatattcaagtttttaaataatattttttgaattttccaaatctgataaaattcagtagaaaattgaaaaatattaccgagcataaaattccaaaaaataataaaaagcgcacaaaaaatgaaagttgttttaacaattttttcaaaaaatgccaaatctgacgaaaatggcactattaaatgagcatacagtagttagtatttttcaatgcttagctttccttacattcattgttggtgggttgggttgattgcaatttttgttgataattgaattctgtccgctgttgcttggcgctgctgtagctttcggccactattggcgctgccatttggccatgaataattgccataaaaatgattaaatgataataataaaaaatggacatttcgccagcctaaaaagcattcgtttttaaataaatatcgatacatgaaaatgctttccgtttggttgtgaattgttttcctcatgaattatgacaaatgtgtgtgtgcgcgtgaggattttcgggaccttgacctcattttgggacagaatttaagagccacgtttttttaatgatattattttaccgacccataaaatcaggggctcccaaatgtgaggctctaaagtttttaatttccaaaatcttcgaaaactgtcaagtttccaaatccattaataaatcgcatttaaaattcagaaaattttccccggctgcgcttattggcaccgcccctcgaacctccatttttttaaggttttccaaaaaataaactaaaaagtctcagtaatattttttttctccctgttgtcattttgaatcttttctatttatctaacacagaaacatacaactattttccccccttaatttatttattttttgcaatttaattcattaaaaattttaaattatgtaaattgggtggcaaaaaaaatttttttgttgtagccagtaaaattggtaatgatcaaaagggaaccgcccacttcggcgccggccttttcggcgccgttgctaacaacttttttcctgttcaaccaaattaaaattttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcat

SEQ ID NO: 9996 - DNA, 1706 bp, Heterodera glycines
atacctaaaactgattttaattgtgatgtaattttaagccctctaaagtccaaagtttcctctcttttttaggaaaatttaatgttcacaaaaaacactaattatggagtaattaagaataagttgatcccattctaaccgctgacccacaaaatgtccagcccacgaaatttccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactacgtttttggataatatgaaaacgaaaaatttggctgccgcatggcgcccaaacggcggcgcccaatcggcggcgcccaatcgtacccgcgcccaatcggcggcgcccaaacggcgtcgcccaatcgacccccaccgtgtgggggtgccattctaacacactatttcattgatttcttttttcttgtaatttctctcattttggaggcgtactttctcttcaatcgaaaaaaatatttacttttttactagcctttttccctacgataaatatgcaccaaaatatgcaaattgatagagaataataaaacgaaaattttttacgctcgctttttatatgtacatatctccaactaatggacttttattaattccataattaatacacacaatgcaaaaaattacattgacttttagcatcattacaaaattatttaagcattttggttggattatatcctaataggtatgtacagtttggggtaatactaccgatggtaggacccctttttgaaaaaatattttaactttttaaaagtcactgaaaatatttttctaagggttttcggggtcgctgaactcgaatctgacattcatttgaccaatttcgaaacccggacccgaacccgaacaaaaagtcgaaaatctaaaattttcaaaattctcaatttcgttagatcctacatagaatgaattattttaattgttagaatagttttagactaaattttgcatgttttattcatttaggaacaaaattgagattttttgaaaattttagattttcgactttttgttccagttcgggtccgggattcgaaattggtcatttttgagatgatcaattttgacaccctctctaactctgtggatagacccatcattcaaaaggcaattcggtagagaattttgtgctctttccaatgggcctgctcaaattttccataaaaatgttcccaaccccctaggaatttttttgaaaaatttccggatttcaagccattttcgggttttcagatcaccatgaaggagtgatctggtcaagttggtataagacttttttgatcagcatcaaaagttagcctagcaggaattgtttcagaattttttttctaaataaaattgatttttcattgcttaaacattttgatgcaatacttttgcaccgccgccaaaaaggggggttgtttgggtcatggactcatgaccgattttctcgatagcgtagaaagtaatactaatgtcgtttacagaccattaaaaaaatagtttttaaatcatacatttaaacatttctagggggttttcggggtcgttgattacgaatctgacat

SEQ ID NO: 9997 - DNA, 1830 bp, Heterodera glycines
aggatctaacgaaattgagaattttgaaaattttagattttctactttttattcgggtccgggtttcgaaattggtcaaaatgatgtcagattcgtgttcaacgaccccgaaagcccttagaaacatattttcagtgacttttaaaaagttaaatattttttcaaaaaggggtcctaccatcggtagtattagccagtttggtgcaaaaatatatggacaaaggaattcgatgaaaaaaaaagtcgtgtaaaatcccaaaaaaaaaaaaatggatgtatgttgccaaaaactctcttcgcacaagttgccattaatttattgatcatgtaaatagacgaacatttcttcattttcaatttcaaaatttaattttagaaaataatttcactaaaaatgaatgaaaaaaacacaattaacaccaacaacagtttaaaagccaaaggtggcactctcgatgagaaattacagccaacagccaacggagagacagaagtgttcattcagacgaaaccatccaggttctatttacgacattatttatgttcctagctgattttttgggactgaagctgggcacaccatattttgaaaaaattaaaaaaaaatgaaatttcgaccttttgttcgagttcgatttagctcaaatcaatgcactttttccctgcccagcgaccacccaaaataccttttttatcggcttaaattttttttcaaaaatcttttctacaaatggtggcaacctcttgcttcagttattgcctggtttttttttccatttttcgcggattttattcggtcattttcctgatattttggatttccctccatttttatagggccaaaaccgcatgttcccgtgtggacgatgtgtccctgctgtccttcatctcattttcttggatgttcccgtggatgtggcgggccttccgcggccaactgagtcccgtcgagtcgtctgcccaatggacatgctccattttcgactcggccaatgtcaacatgacaaggttttgttgttcatcagttaggtatatgaaaaaaaatgagtcgctatattttacgcaacagcgcctgatacaaaaattccggcgctaattaaaaagtgacagattttgaaaattttttcacttttttttggtcaattttttttttgttgtttgttttgatatagaatgatgaacacattaagcattgagcataatttggcgaataaaagcccccccccccccctttggttttttgataaaattcaaaatctttcacttttttttgttggtttttttttgtcattcgtaccatctgtttaaaaaaacaaattctgtatcaaaactaacaaaaaaaaaaattttgacaaaaaaaaagtgaaatttttttcaaaatctgtcactttttaactagcgccaaaattcccttaaaatttgactcaaaaattggcccgcaggcttttttgtgagaccagagcggaattttttttttttttttacctacttttgcaacaaattaaccttttcttgtacaatatttaatatatttttttcatagaaatgacgaaatatccgttttttccccgtttgaatttcataattttcatcccaggttggaacatttgtggaatgaggagatcaaaagtgccgctgcctttgcccgtccgccctcacttttccgtgccgtgcttcgctttatccgttttcgcttgatggtctcttttttcagcattcctaatttttgttttaaggatttcaaaaacggctgccataacttttgatttgttttttttgtttttgcgttgtaaaattatccacgatttggtttctcttcggatttttaaa

SEQ ID NO: 9998 - DNA, 915 bp, Heterodera glycines
  misc_feature (884)..(884): n is a, c, g, or t
tcatgacttttattttctttcatattgtcaaccttttcgccaatgatgcccagcgtatttttgtcgcgctcacatttgccccgcttgtactcgtcggtccgtttgtgctcattggtggccttgtctatttgctgttcgtcattggtgtgctgtcactgctcggcattgccgtcttttttgtcttcgacatcattcaggcaccttttttcaaaaaaaaaaaaaaaattaacaaaaaaatttttgggattccgaattttgaaaaaaagaaaaagaattttttttttttttgctaaactcttctcttttgctcaggctgtcctcggtgttaccatggtcaaatttcggaaccgtgccattgcacaaaccgagcgccggatggcattggttggtgaactgatccgttgcatcaaatgcatcaaactgaacggatgggaggagctgttctacgacagagtgcgaggtgacgaacaaaatatttaatttaaacaaaaagtttgctaaaatagactcccctccgttttttttttaaaaaaagcggcagtaaaaaaaaatttgaaaaaatccattagcatttggaccctttggaaaaaactgaaaaatttatcatctatttttttttttgaaattcttgaagatttttttaaagattttcctaatttatcagctgttcgtcgtgctgagcagcgttcgttgggctgggccggctatgcccaaagtttggcggttgcatccggcgccattgtgccggtggtggcaaccattgtgatgacgttggccattgtgctgaacggacacgacttacgggccagcgatgtgtgtttttggagggctaatttttttagaaatttttaatcctttgagcggattaagaattaatgccttanaatttgaaaatcgattaaaaaaaaagttttt

SEQ ID NO: 9999 - DNA, 2127 bp, Heterodera glycines
ttatctcatcactatagtaacataaaaagatttgtactatagctaaacgaatattttcagtgaatttttggacaaaaataaaagagaaaattgcgaattaaaaaacgcaagagaattaagaattgaaaaacaaatcaaattatttataagttaattaaaccaactaatgaatgaaaaatgggcaaatatatatgaaatttacaatggtgttagatcgtttcctaaaactgcaaaactatcaaaaaaaaaatatttaatcttttttaataaaaagtttacgccatttgtttgccaacactatcatcaaaatcaagctcaaaaatagtttatttttagaacttataataataataattttatatgcaaagcgtgacgccgccaaaataaaaacaacaataagataaagcaaaatggtcacatatgagagtggttcataaatgtgtaaaacgatccaaatcaattgagtcaagaagtttagaaaaaacagttgaattttgtaacctaacttctttaggtaataacctatagaagcgagaagcacgaacaaaaaatgaacggtatctaatattagttgagcaaaaagttggcttaattaaattacccagtctactagaaaaattgggttgaggtttattatatttaatttggacaaatccattagttatttaatggaaaagtcttagatcaattttaaatctccttttttggagagactccatgttataaattgaaagcaattcgtcatagttaggtatgtcaacataaaaatttgagcgtctaaaaacaattcttaaaaaagttttctgaacattttctatttttctaatattttcttcaaatgcggattaaaaacgggggatgcaaattctaaaattggcctacaataaacattaaataaattaatgagtattttagggttacttgatccaatagattttaatagcgcatataccgttttaatagattttttacaaataatatcaatgtgcttgtcccattttaaatcatgagtgaaatgaacacctaagtcccgaacagattcgttttcatcaactttaggaagttggcgatcagaaataaaataattattttttggatttttattgcctagatgtaataccaagcatttttttgctgcgattttaaggccatttgtttatttgtcaataaagaaaaagtccacaaaagggaaaaatccgcttacagtgaggacaaaacattaaaatgtcctcaagaaagcgcataaacaattaaaaacgagatcgccgccaaaaaataaaatataatgtgagatcaataaaaaaataaaaataatgaccaaatcactttttgtttaatgaattaataattcgacttttatttttccggtctattttacaggaatagagatagttttaattttatttttaaattgatttaatgaggttatttctataaaccttttatcgagttggttccaaattttagttacccgccctgcaaaagtataaattttttgccaagtttatatttcgaattaagtctaaaaaagggaatgttaaagcgttcataaggtttgaatatttcaaagggattcagatctgttcggccataaattattttatgagccatgaacagatcagacagctttcgcctgcattctactcgtgagtataaatgaaaatgatttatttaaatttaactgaatgttacaaaaaatcctaaataaagcgagagataatcaaagaaatataatcttaattcttcaatatagtattattaaaaaataaggggcgaactaaaaggatactactaatttttaattacctaatacaaacactatcatataaagaataagtaatagcgaaaattcaagaaaagcaatgttgtacaatttttacttgccaattttgtgggtttgttaaataacaaacttgtcaaaaaggtcaaaagacggcactgactcccaaaactcggaagatgccaggtaatccaaacaaaatacaaccattgggggaatataactaatcaacattttgtgatcaaacagttggccgtcgattcggacgaccaaatcactagggctgggaattcaattcaatcactaattggtaataatttctttattgtttttaatgaattagagca

SEQ ID NO: 10000 - DNA, 3517 bp, Heterodera glycines
  misc_feature (18)..(18): n is a, c, g, or t
  misc_feature (51)..(51): n is a, c, g, or t
  misc_feature (149)..(149): n is a, c, g, or t
tatttgtgtgacatgatnggaaaatgcaaattatttatcaatatttatgcncaaatccctaattgtatccacaacatttattatatttccaccaattttatatatttctttggggtttttattccccaaatgaagtacaaaagtttttntaattgagattctgatctgccatttatttgcccattctgataaattatgcaatgctttatgcataatttctgtttcggttcttgctttataacaaatatacaatttaacatcatcagcatataatttaattcttactcctgatggcaaagcatcaggaagatcgttaatataaatcaaaaataataaaggtccaaggacagagccctgggggacgccagagccaacttttttactggaggataaatcatccccaattttaacacgaaaagtcctattactcaaaaagtcctttatccacatcaaaagtttgccccttagacctatttttttcaatttgtataaaagtaattcatggggcactgagtcaaatgctttttgaaaatcaatataaatactgtcaacattttttccatttattattgcctcgtaccaatcttccacaactgttattagttgactcgttgtagacctatttctaacaaaaccaaattgaaattccgaaatttttttgttttttaatagaaaattgtaaatatttttgcttaaaattctttccattaccctgcagagtgagcaggttaatgaaattggcctatagttttcgggattatttttgtcaccctttttaaaaagcggaaaaacaattgattctttccagatgtctggaagtgaacaaatgtctaatgagatcctaaacaagtcagtaataacagttgacagggacgaatggcaaatttttaaaattttatagctaatattatcgggagaagtgccatttttattcggaagttttttcagaagattttgggtctcgatgatgttaaaatttatatccgatataaagcattgatcaatttctataatattacccaagcatggattgcttgggtcggtttcactattattaaatgaattggcaaataaggtggcaaataattcagatttctcagcactgttatgatagcatttattttcataaattagattaggtatttcaaagggattgacattgaatttttggggtcggggtcacttcggcgcggccacttcggcgcgggtatttcggcgcgaggttttttcggcgcgagctttttcggcgcgggctctttcggcgcggccacttcggcgccctatataaaatggctttttcggcgccagtgtttaaaaatccaaaaaaattttcaaaaaagttttaatttgcctttcattgtgcaaacatgtataccgcattattatataagtttaacaaatgaacaacaaaatcacgggtccataacactattatttgaaattcccctgagaaactcaacaatattttgggcatcaaaattttcaataatgttcaaaatgcgcttgtcagccttccgaaacttctttttcttctttggaggttcttcgccgttcacgcagctcacatagtcagcgtcgcgcgcacgctgatccattcgaaggacatcgatgaatcgccaaattgacgggtagcgacagctgaagattgtttggagtcgacggtgcgctgcttccgcgatgtcgtttgttcgctgctcttcgttgacagtccgttcacttcgatagcgctaaacgggagacaatttctttttttttgggaactgaaacttacattttgaagtccttcggaaatcaggcgcttgtgcatgttgtgcactaaatgaaaaaggcaccctcgaagctgagcgcccggaaacactgcggccgcagcgtccatcgccgcttgttcgaagtccattgtgatggacgttggagagaaggctggccatgcgtcaatgatcattctgaacattttttcgtagaccatcgcaactttcctgtcagaagacatgtggcgattgggaaagtccattttccttttctgaaatttttctggaagaaattcaaaaaccaaacaaaacaaactttgaaaggaggacgtaaacttgtgaaaatggatgtggtgcgatggaaaaagttccatctgcgaacacttcgaccattgcatgcgtccatttgcgtaagagttcttggcaaaaatcagaatcctgaatataagcggaattttaaaatatgtcacattaattaataccgatgttgggaattgtcggcattaagtgaaaaaacgccagagtcagatagtaggtattgctcctcctcaactccttcaccgcgcttgtacacctgatatgcttggccaatttggaggtcgtgaatagaatttggagccgctggtgcagctacaatttcatggcgtacacgtttgacaatctaaaaacaaagcaaaaaataatagtatgtgtctgcttttcgttaccttcttaattccattggcacttggcaactgagcaagcaccggtgttgaaacgttgaccattgcatttgcacggagttgtgaaggcaattccatgcattccgccgcacgcctcttgatccccgtgacaattttttttgctttcacattggcaatgtttgcttcgtgtgtgtgttcggtgaccattttgacaaaattgttgttcatgtcggtgtgaattcgcctcgacattcgttccttcgttcgcatcgccagaatttcaaactaatatcaacattaaatttgtcgaaaatgtaaaggaatccatcgttaattaatttatccttgtgacgatttgtttcaacttcagacattattaataagtaaccaaatattgcttaagatataaagatagacaatatagatttaataaattatggtacacgagaagtataacaaatttttttttaattatggcggcgaaatggacatttttcttcgggcggcgaactggccgcggcgaaaaagtccgcggcgaaaaagccggcggcgaaaaaaccccgcggcgaaaaacccgcggcgaaatggccgcggcgaagtggccgcggcgaaccgggcggttcccgaagtaaatgttgtttttcctaataataaaaatattagatagtacgccaaaaggagacaaaaaattagagaaaaaagataatgtttttctctggcactctctatttattggtacacatctcgttttttcggacggtgtgtagcacgaacattcccccgctagcaagttattaaaaattttttgggtaaaatataatctacagcacatcttcgaagctacagtaccactgaaacatttcaaatcgataattgggtcaaatcgagcgcaaaaatgaatttatcgattaaattaaataaaagcacaaaagaataaataatcaagaaaatttaaaggaaatgaattaaggttaaacgacggagacaaagtgattataacaaaaattaaccaaataaaacgtgagaaagtaagaccgaaaaatataaatgttttgtttagttatgggaaagaaaatttttgtaaag

SEQ ID NO: 10001 - DNA, 2096 bp, Heterodera glycines
  misc_feature (7)..(7): n is a, c, g, or t
tgttacnggtattattgcggaatcgaaaagaaaacgctcatttgagattgggtacggtattggagggcgagtgttgtgacattatgggttactgttgatacgcattgactgaccgtcaaatcgcaatgggctcgccgcgggtgccgtcgcaccgttgtccagtgaaaaggcggccgtcgcgctttgctggccgctccgtcggacgcgtctgtgctggtggtggagacggcgacggaggaaactgttttgcaggtggtggtgctgtagctggcttttatagccgtgctaaacataatttggccattcgattgtcggcattcccattggcacggccccaccaaagggaaaaaaggggggcatacaaaattcatagggacggacagatcactgatcgggccaatgaattttttgttgttgtttttgcggaatcgattttctctaatccccgaccaatttgatcacatgtttgatggatccttgatcatttgcttctctctctctcttatcctccaatcactctgtctgcattttcccatttgtccacctttaattcctcgccgtcgtaaccgccgaacacgtgctggtcgtacgggtcgtcctcgttggggcagcacgagtagtccaagccgttgaagaagcacaccgacttggccgggcattggttcatacccggcagacacatcaccggacgcccttcacaaaatcaaagttggcatttccatggtcaaattcgagaatgaatcaccgtctttgtatcgcatggcactgagtccgttcggacacatcggaattgagtgtggcgattgttccgcttgattttgaccgttagccaacatatctttggagaatgactccaaaatgccgtcgccgaagccttaaaaatgcatttcaaatgccattgtgcctttccggtcacttttttggtcagtccccccaatgctttgctctttgctcgatggcacgtgatttggcagtccttggacagcaaccgttggagaagcagcaaccaccgctgctgatgcttctgcctctttgggctggtcaactgagtcggaatggacttcgtaattggattatccttctctttcggcttacatcgtttgcccgtttgataatcgatcactgcgggcggcgacgggccgagcattggcggcaaattgtcgggcactttttgcgggaattttggcaacggttgggcaccgtacgcggaggacagcgcgtaaccggcgctaccggccattgccggcggcaaaggtggcggcgcctgcggtggggcggagggcgcggcagcggagccggggaatgctgcgggtggcatttcggcactaaagagcaacaaatgaacttagtctctcccgtggctaaagtctctcccgtggctatccctccgcacatcgcttgcgctggtcccggcattcccaccgccccttccgcgtcttccgtctgcgcgatggaagcggctttcgcgagcggaaggtcattttcgtggcccagctgttcctgttgcgcttcctcaccaccgatgctgtgcctttcgttgccattttgcggatgttctccgtgcactgctccaacttcttcactcttttgccggtcggccgagagtggcactgtcggtgcctttgatgttccccgtgcgtttgtcaccacaacatttttgggccgaagaattcccggcacttgtgcaactgttctcagggaaaggaaagcatcgtcgactttggcattgcttttccgctgcttacatttgcacatcgcttcacattcttcgctggtgccgaatcgattttcattgcccgcctcgccttgccacacaaattgctcacaactaaagccaaaaacattttcaaattgtcatctttgattgcgccgactcgtgccaaggaggaataatttccattggcatttataaatggcactgaccgttttggcccggcacagccaataaatgcccttacaaaactttacaatggataaaaaacaactcaaatcaattctcttgctttaatttttgaggaaaacaattctttagtgccattcactgttttggcttcgctttgtcattgttcttaaaattgcttaccgtaaatttcgga

SEQ ID NO: 10002 - DNA, 2732 bp, Heterodera glycines
gtcgctttgtcattagttcttaaaaattgcttaccgtaaatttttcgacgttgaagtaccattggacatggtatcctccgccggtgccctcctccttctccaaggcgcaccgctccggcaacatttggtgactgttcgccaccgaagtcgtcgctcgactgcacttcgcctcgcacttgtcttggtccgcaaaattgttctgattgccatggcatccgccgaatgaaaactgctcgcaaaggccggactgagcattgaagaacctgcccaagggaaaaaaatttgttttgcctagggcaaaacaaacgcccaactgagcgctgaccatttcggcgcgaattgacggcatgggccggcatctggtggaagcgaacagacgacctcagcagccgatgagtcccgggcattgtcgagaatgtccggctgtggcaacattttttgctgatggaccgaagatggagacggcacagaaacaacggaggatgaggcgggaacgagggggaccagctcaggaagagcggacgaagtttggggaagctgttcaacagcagaagaagcggatggggttaagccaagcggcggcaaacgctggtgaggggggagaacggcaccagcaaaagacggagaagctaataagggaaaagcatcgaaccaagtgctgatcagcggagtgatcagtttgtgcgggtcgtgaaaggtggaagagtgggtgcaaaagcataattagcaagcttattgtgccaatagtgatcgaattggtgggtggggtgggtaaatgataacctgatcaataatgatcaaaatggatgactcactcgcgtgtccgtttccctccctccctggctgataattgatcatcaaagccttcccccgtttcttttttctcacccgatccgttgttgctcaccaccaccgtcttctcctgctgttccggcatggcctgtgccgcttctccattcggctgtcgttgcttcggtgggtttgtctccgcccccgcggcggtgccgcctgtctctttgtcgtcgccttccgtcggcatttcaccaccgacctcctctctctgctgcttttccgtggtgccgttctgctgcatatgttgctgctcctcctcctccagcgtcgtactgatcggctgcagttgcgaactgtcgtcgatcagtccgccccaaaccggcaccattttgcgtgccacctcttcccgtccactcccaacatcgctgctcccgcctgaccgtagctgttgcaaatggtgcatggtaaacaggtcggacagtgagccttccggagctccggccgaagcggagggcggagaggcggaagacgcggcggatggggcggttggaggtgcgccgccgttgccactgccctccaatgagacagtgggcggcgaattcggcactgagacggacggaacagcggcaacaactgattgatcagcggaatgaggtgagaagtgatcagcctcagcagttgttgctgttggaacaagctgcttctgctgattgtgagctttactttgttcagattgctgtggttgctgaccctcttcaacatgttgccgttgttgttcaatgatcggattcgatgggcgtattatatcctgatcagatgataatgactcatttttattcagtttctgttgttgctgttgttcttccacattctgttgctgttttccttcttccatagcaagcttttgagcaggtacttcgtgctgatgaactgttatcttttcctgttttttctgctgtctctgttgttttcccccgtttacgttttgcctttgtttctcttccatccattggatttgctgcggttgttctccctgtactgcttggccttgatgtgcttgtttcggttgtgtgttttgtccattttccatttgccctatatttaggaaccctttttggacttggaccggttgaattttctgcggttgttctccctgtactgcttggccttgatgtgcttgtttcggttgtgtgttttgtccattttccatttgtcctatattttcggccccctttttggcttgtaccggctgaatttgctgcggttgttctcccagtacttcttgaacttgttgctgctgatgttgcactttttctctgttctgctgcctctctttttccttttcctctctgccttcactctttccttccgtctgtccctctctttctctgttgtttctcgctccttccttctctgctgccggtctctcttccgctggtgaaatgtagacttgctctggctctgtctcctccccactctctttccagccctctttttcgtctggctccaactcggtcagtgtctcttccaactttgtctgtctgtccgtctcttccgtgtcccctttcctttgctttccctttctcttttcctctctgccattgctttgggtctccaaaaagatcatatcaccgtcatattccacaccttcttccatctgtccctctcggttcttttcgctctccttgttcactgttgtcttttgctcctctctgtgtctgtcactctccgtctgtcccgcactctttctgcctacctctgtcgccttttcaatttgtactcctccgacttggacaggtatctgcacgtgctgttgctgctccatctcctctgacgacttcctcaatttgctcagttctattgtggtcactcctcccggccctctcccccttttgctgctccattttttgccccattttgggccgcggcatttttttgcc

SEQ ID NO: 10003 - DNA, 1040 bp, Heterodera glycines
  misc_feature (14)..(14): n is a, c, g, or t
  misc_feature (1029)..(1030): n is a, c, g, or t
ttggactgctgttngtccaagtacagcttggttttgctgtcgtgaaattggctgatttattgtttgtacttggattacttgctgttcttgtggctcatttggtttttgctcttggactgcttgctgtccttgaatcggccgatttgtttgttgtccttgtactgcttggttttgatgtccttgaattggcctatttgtttgttgcccttgtacagcttggttttgcagcaattgaatttgctgattcatttgttgcccttgaactgtttgctttccttgctgctgtccttgtacagcttggttttgatgtccttgaattgtttgttgcccttggactgcttggttatgttgtcctgtttgttgtccttgtactgcttggttttgatgttcttgaattgcctgattcgtttgttgcccttgtacagcttggttttgatgtctttgaattgtttgttgcccttggactgcttggttatgttgtcctgtttgttgtccttgtactgcttggttttgatgtccttgaattggcctatttgtttgttgcccttgtacagcttggttttgcagcacttgaatttgctgattcatttgttgcccttgaactgtttgctttccttgttgctgtccttgtacagcttggttttgctgcccttgaatttgctgatttgtttgttgcccttgtacagcttggttttgcagcacttgaatttgctgattcatttgttgcccttgaactgtttgctttccttgctgctttccttgtacagcttggttttgctgtccttcagttggctgtacatcttgtactgcttgtggtccttcgtgtgggtcttcttcagttgactgttcaacttgttgtccttgtatagttttactttgttcagtttggtgtcgatgaccttgtctaatttgttgctgtcctggattagtttgaacaatttttttctcttgttcagtttgcatttcttctccttgtactatttggtgtttctgattttgtccaaccatgttgtttcccttgtacggttnntggtttggct

SEQ ID NO: 10004 - DNA, 2258 bp, Heterodera glycines
ggtggcgaaatttcggccagcgaaatttttgggtaccttctgagtttcggtgtttccgaaacaaccaatcaaccaccttttggcggcaccactttctcgtctcggcattttcttccgtcttttagagggtgttgcttccgctgacactgccaatgccgtggcggcgtccgccgccgccggtggcccgtgcgttgcgtgcaccaccgacacccttgcggtgttgaccgttgttgatgcgattacggcgggactgaccacctcgtctaccagcgcgccgaccagcacgccgggcaccgacgcaagtggctgcagaatagtgacgcccacctgtcccggcgatcaagtggtaagcagcaggggacatcggcatggccatacaaataagggtcgtatttgtacgggccgttttcgtgcgagcacaagtttttcgctataacttattttctttgccaaccaaatccaataatcttggtatcattcgtcggaggaaagatggaaattttgaccatttttaacagattttcaatgaaaattggccatttttatgtcaattttgctctatgaaaatcatcatttcaaaaagtaaaattcattgatcccccttgaaataaacgactgagagaacccgtagaaggagcgcccatagctcagttggtttagagcatggcacggattgccggggttgtgggttcgagtcccaccgggcgagttaccttttatgttctacagtatgcaagctcattgcagagggttcaaaacccacagataaacaatttttaaattaaaataataagcttttttttactctttgggccaagggccaaaattttttttaaccagcatatgtaattgaaaattataggcgccggagagcaaaaacaagaatttgtagccgcctttcgccaaaaaaaacaactaatttttgcaatttttggggctaaaatttcaaaaaataaagtaaaatgggggtcaggcagtgccgacaggcgccggcgtgaaaaattttgaatttttaatgcattttattaagaaattgatttaatataatttttttaattaccaattttttctggaaattttttttatttttcattgggttggggggcaactgccctcctgggtacgagtctgcatgttctgcatttcatttgcttaattttaaatccactccagctgctcatcagcgttccgatcacggacgggacgggcacaacagcaaccgattttgaagtgtacatgtccggttccctcacgctgatttgcgacgcgcaaacgcgatggctggagatgaacggcgggcgggccggcacggcagtgaacggatacgcgtgtgtggctgccgaaattccacctggagcactcgtcggttggtggtggtgcagtagtgatatattcgagatcgaaatttgccgagactcgaggcttcgtttaccccgagactcgggaggagaccgagaccccacaaaaacagaattttctcgggtccgactaatatagtgggtgggaaatcaagccgattttcttattattttacgccattcattggattttgagtgcttaaaaacgtggccacagaatttttaacatacttttttgtaacctcgttcattgttttagaagcaagtgaaattttgaaggaaaatattttgcatttgatggaatttctttcaaaatccagaattttattatgaattcaaaatttcttcaagttagaaaatttacgttttaatttttacaaaaagacggattttttttttttacaaaatttgtacgtgaatccccgccgatcgtcggcggtagagccatagaaaatttaagaaactcatcgaataacatcaccataccccaaacaggcgacgccgcgggagcaggcgcaccggccgttgcggaaagtaatttcaccatgtttgggtaccatgtagataatataagatataaccagggttcccaatcatatgggacataaaatcccaaaatatggaccataaatcgcgaaatatggacataaatttttccaaattttgagggcataattctcaaaaacttcttcattcattaaaatgtaatgtaagttattaaaaacatttcttaagaaaaaataataaaaaaagctaaaatttactaaattttagcgaacaaacaaactgaaaagcaaaattttggctttttgcttatttttacaaaaatataccattttttaagaaaattgatttaaataataatcttgggaaaatttttctaaaaaattaattttccgg

SEQ ID NO: 10005 - DNA, 1104 bp, Heterodera glycines
ttttccggaaatttttcagaccttaaaggccaaaaagacaatttagctgatgggggccgttctaatagagtttgtatgcctaaatatggacataatgtcaaaatatggacggataactatggtcaaagaataaaaaggatttccatataattgggagccctaggtacatatataaccatcgggccgggtttatatgccgaattttaaattaaaacatttaatataaaattaatatattttaaatttcaacaaaaaatgtcgctttccaaaacaatttttgtggctgaattttgttgttgttttttttcatatacaaactgtctactactgaactccttcaatttttttttcaacagacattatggttaccgctcctaccgctgctgcggacgtcgccgcgtctgtcgccgcgtctgtcgcctcggccgccggcggcggcggttcatgcaccgcgtgctcgtcttctgttaacctggccgtgttgaccagggaagaagtggcggcggccaactcgataagaaacgcacgacttgcagaggaaccggtcaaccaaattagcacgtcgggtggatgtacaacactgacgcccacctgtcccccgggtgaatctgtaagttttttttctttgagattttttctagtaagaatatttttcacttgtttcaccactttcaatttaattaaaaatctactaaaataaaaaaatctttattttttgaatgttaaaaaaattttcacggctttgaacagtatccttgttgatacggtgttatggcattagtcaaaaaccatcaaaaaaagtcacttccttctaatattttcttagaaaatattaacattttttaaatcaaaaattttgacaagaaaaaaaattgagggatgaattttttgcgaaaattttccaatttttaggggtgcatttttttaattttagctcggtcttaggggtgcatttttttgaaaatttttaggtcgattcttaggggtgtatttttcatttgtattgcattcttgttaataaatttaccaaaaatcgcgaaataagggcgaaaataggagcgaaacgccaaaatagggacaaaaacttattttaggggcgaacac

SEQ ID NO: 10006 - DNA, 1298 bp, Heterodera glycines
aaaacggaaaaataccgaaaaatttgaaaaaaaaacgaccggtccgatttttaattttttagggggcgacatccaaaatagggattcctagggtcgaataggggcgttaaagcgaaagtttatcatccgcgccctagtcataactttagttaattttgagcgaagttatgaataattttttgtcaaaatttttacatttaacaggtggtcgtccgcgttacccaagagaacaaccagcccatccttgaaacttacgattcccttcaaatcacgctgatttgtaacgcacaaacgcaatggatctctcagaacggcgtgcgcaacggtcgtccggtgaccgcatacgcgtgcgtaacgcaaaatattgcaggcggagctggtgggtggatttagtcatgaatagaggccagcgtgggacgggttcccagtccgcaatcccgcatttttggaaaatgcgggattaattccacgagatcccgtcccgcataaaaataccatcaaatgaaaaattgaaccttcttgctattattcggttgccctagagtagagcggtcatcggtaattgtaaaaaaaaaccggtaccgggacttttcgggttgaaaaaccgggactttttggctgggaaaaccgggaaaaacccgggactagtcccggtcaaaaccggtacttaggtactaagttgtacgtttttcagtaccagtaccggtcccgctctactctagattgccccaaaaattctctatcccgcattttttagaaattgggtaatttttatttaataatcccgcaaaatgctgtcccatcaaaattttgaataccaaatctcgtcgggaccagtaaatttggttgtttttttgtgtgagagcccgtgagattcgcagtgttattttttctgaaaatttcaaagacctaaaaataaatttgaaagtgcgaatttttgagaaaaacatttaaaaaatttcccatctttaggtgttgcatttacaccggtgacaagagatgccagtgccgcagcgtccgctgcggcgggccgatgcaccggctgcaacccgaatctcgctcgtgtgttgctgcccgaagtgatcaccacacaaagtccggccaacccaaaggtcgagctgtggagagccggaaaagacacctgcggaaaattgagcatttgtatcagggatgggctttcgttttagcgtttccgcaaatttgccttttttggcactttcgcgtttcgcattttggcgcgaaacgcgaatattacacccctaagaataagggatgaaattacaatgaaaattttcaaa

SEQ ID NO: 10007 - DNA, 1061 bp, Heterodera glycines
aagaaagagaaaatcaatttacattcattgttcatttttaatggaggcaatggggcgttggtcaaataactgatcagaagagtaaacacattaagttgattagattatctctaccttagttatcaattgcccctttttattacgtaaattttcgaatttacatacagaaggaaattaaaataaatacatagcgtaaatagataatatgtctgtacaacagctgcagttttggcgctgggctcgatagaaaaaccatagggggaggggtgcttattagttttattacagaaatcttttttcaaaataaataacatttaaatgatcaaaacagcggcaaattaaatatgtgcatactagaagaatgcatgtgcataaaattcgttgccctaatgatcagcgacaatacaatttagcaatttcaaaaaaaaatcagatcaaaaaggccccctttggtttttttattggcccataaacaataaaagtgcataagttttaatatttacgtagaaaaactcaaaagccatgtaataaatccgacgccaaaatacgaaatcaaaacaccgaagaaaaatgctctttcgattcggacttcctgctcagaaaagcgccttttcatctcacgctcattcttttccaattgtttgatctgaaatgacaaaattaaggacaaacgcaaaagaaaaacaattgaaaaaattgaccagaatattttttgccgcaattatttcgttgtttgggtcctgctcattgttaactgtgcccatcgatgcgattatggcctcaattgcgtagtttttgactcgttgacggttcaaaaggcaacgcgcacgacaaagcggacattcgatggaaatctgaactttatttactttgtccaccaaatattcattgcttctgacttggttcagtccgactcgattctccacagcgtttcttatcgcaatattttcaattccactcagacaatccggacaatgggaatgacctgaaacatgcaaacaattattattaatgttttgtatgtaagtaatgacagcaccacacggaagcacttcgggagc

SEQ ID NO: 10008 - DNA, 2416 bp, Heterodera glycines
  misc_feature (22)..(22): n is a, c, g, or t
gtgatttccttttgcataatgncgcttctttcttcattcgctgtctccctttttgctctttttcctcctttgtcctccttttctcccaccgtttgtccattctttcgccggtttcttttttttctttttccattttattcctttcttttacatttttcctttttcagcgatggctgacttttggcttctctttttggcctgtcttctcgcctttttcgtcggtgtttctcttttgattgccttttgctgtttttcgtgctacgcttgtttttgcggttcttccgattgttgctccgccgattcaaaataaaatgtgtttttttaccatctttgtttttttttgttcattctctccaaattctatggcctttcttcacattttctgtttaattaattttgtctaattattgtgtaaatgtgacattttctcatgtgcataatgtaaattgttaattgttggattatcttaataataaccgaaatattttattctttgcatttcatggaaatgaatttgccacagtttaaagtttgagagattttagatttttatttgtaaatttcttgtcattgttttattttttcttaaacaagactttcatcattttccgccttcttttcgccctcaacaattcctcgtcaattctctgtttttcttaaatttattaaattatttgcatttttcattttgctttgcctctgaatatgcggaacatctcatgggtttgcttttggcattgcatcgatcttagtgccaactttttctcctccaatctcacgcgtctcgccagtcccgaagtgccaattcgattttggcaactgccgggaacaaatattcatttgtcagttcttcaaacggacctttcaaggctttcacaacatcgccccaattttgtgcagtgccggtgcaaaagggcaatgcgttcggagcactgcaaatggccgttcattttcggcgaggtcaaaacggacaattcctttggacacgaccccttcaatttcaatttgagttggctattgtgagccgggcatttgctcgtccgaccttcgtccgtgttgtgccttcgcgcactttttcctccaggcattgttcggctccatgctccaattccgcgcgtgccgagtccactctctttttatttgttaagtcgaaaagagtagagcattttcacctcgaacaatggcaaaagacgcgcgttgcatcggccgaagcgtcgccgcggcggacccggcacgggacgacccgtctcagcaggcgaaggacggcacagatcggactgaacactgcgcaggagaaacatgcaggagatgaacagttgacagtggttggacgaaggcggagactgtgaaaaaaaaattggtgggaaagcgaaaggcgaaatgaccgaagggaggggggaggggtcgacccgtctctgctgcttctccaactgacgcaccaaaagctcgcgaattctttccatctcttttttatcactaaaaatacttttggctaccgtagcgaatgtaccgtagtacaacgaagaaagaccttgggaaaagtgtgacaagttggggtggcgggcgcttaaggggggacaaaggtcggattttggccattcctttgattggcgaacgacggattgacgacggcagaagagacttcttctgacaaaaggtaaatcagtgcaaaatgtactaaaaacgaacgaatgaagtgacccccaatttgggaagagagtccgagcgaagtttcatttggtgggccataaaaagaactttgccacgatagccgagggaactgcgaacagaggacgaactgtgaagggacggccgaccaacactctgagagttttgcagaattgaaactgctgctggatatttataagtgaatcgtttttttttttgctaattagtgacgaaacgccaaaagggcccattcaaatggatggaaattctgcataacgttttccccactcactttgctgcccgctaactcttctgccaactttccctgctccgcctccattttcggccgttccctgcgcgtctcccccacgtgcttcggcaccactccgtacacacggctccgaacgcgtccgctggaccgcgacttccccccgaatctttgaattggagttttgatagttgccactgcagttggtgctgtttctgtggttgtccgtgttgcgcttgtcgtgtcaatctgtcaaagggtgcgtttggttgccaatgcttttcctcaaatgccgtgccttttccgtatgcttttcctcgccctttttgtcctccttcgctttcctttccatttcgaatttcactttagtttccgatgtctctgctatctttgccgatttcgatgtcactttcgctccattgtccacgtccacaacagtgccgttctctccctcttccattggcttttgctatgtttctc

SEQ ID NO: 10009 - DNA, 1991 bp, Heterodera glycines
  misc_feature (124)..(124): n is a, c, g, or t
  misc_feature (1965)..(1965): n is a, c, g, or t
ccgtccgttcgttttttgcttcgcttactttgctgctttccgatgccattcgccttcctccgtcgtcgtgtcaattgtctgtgtcattgcctggggcgtgctcagttgcgcttccaattcgccncacgtatttggccctcggggatagggtttggtccaaatttgcggaaacattgccgcgggaggtgtggaggatggcacagtcaaagggatgagagaaggagagggcgcgagagggaggggagtcgttgacacggaggaagagagcggaagagacagagagagttccgcctctcttaatcggggccataagtgccacagaaaatcaaagcccccacaccccccccccggcaaattctaacatttgcgacagcccaattcggtctttttccgctgcttttgctccgtccgtttgctttttgcccctgccaaatgcatccgtccgaccgcgcaaatgccaaaaacgcgcgcgtcttcttgcagccaatgcaaaagagtgcgacaatttgggacgagcggaatataactgagggaaagagagtatgtgagggaaagatggtggagagagaaagagagcgggaggagagagagagagaaacggagagagaaatgagggaaagaaacagtcgaatgtcagcggccccatttttcgaaaatttactcgcattcgatggaagtcgagtcgcgagggcagtgcgaacccttccggttgtcgatgagcaatcattcgcagcaccgaagtccgaaaaacttttttggggcgtgcggacaaattggacagacgcaaagactttttacggccaattttaacaattttcatcggagttttctgagcaatttaattgatttttattgccaaatttccaaaattaattccttttttccggcatttgctttttttcattttttaccgttttctcttccgtttttgtctgttgtgaactgtcaatcgttgacaatacggggaatacggtagtcgtagaagataggggcgatactgtagcagagggagggaaaggcgcggaaaaaggcgcaattggcaaaggggacggagaagtgggcaaaatccttttgagaattgatgggaatttaaaaaaaccatatccacagcagtaacatttgttactcgagaacaaacatttaaaacggtgcctaccgtattcctgtttgtaaaatttgcctaccgtatccttttccttggctttttctgccagaaaatccaatcgttttctgctgcgttttccttatgattgatttgtgtgcgagcagaatataactgaagtgaataattatcgctttcattgtaatttctgtatttttttatcattttcctttattttctgataaatcttcttctatcacttttgatcattttaccattttcttcccttcttttgatcattttccccctctcaccctcaatcggcttaaattcgtccgattggtccaatttataatttgctgctgtttttgtgcggtcaaatgcaatggaatggcgtctgttttgtgctcagatttcgtttttgcggctgagaaaatgccaacgggtcgatggtcggccataaattgggagaggcggcgactgaaaaggcggcgtttccctttggcattttctcattccttccccaatttcttttctcctccgtctcattacgttaatttgcgctgctttctcttctccgttttctgcccaaaaaaggcaatgttccgtccatttttttccaccaatcgtttttttgcgtgcgtttttgtgatgaaaacacgcggcaaaagggaggcggttgggactgaatgtacgcgcgcggagacgggcggggcgggtggaccgaccggtaatgggcctcaaagaaagcggagaaattcgggaagtgcccatttataaagaccgatgtccccaggagacaaaatgtccgtctcggaaaggggagacgagtcgacgcccgctgaattggttgggccaagcgngatgctgcgtttgacggcactgcaaa

SEQ ID NO: 10010 - DNA, 4754 bp, Heterodera glycines
tggacatattttccccgcccaataaatcggcagaatttcaaacgatgaaaaagcaaagaaaaagaacagcaaaaatagttggaagaagaagtaactcatttgtcagctttggcatttttattattctcaccaatcatttgggtaaccgaacgatttgtggttcagaagaattgaatggacaaaacggaggcctaacatttaaaaataattgcattattaacccattacattaatcatttttcatttgtcaattggtttctgttcggtctctcttaaaagataaacgaaataattaaatatataaataaatcaaaccagaaactgtttattaaaaacacacaaaatgagcacacacatccctaggctcaagtaagccgaagcctagacctaaagcttagactaagtttaagcctatttacgatttgtctatttaaaatgcaagcttattcccctcaaggtcgcgcgagaatgacgccgtttaccaataatttgggtacatttttgaattttagtgcattttgaattgaccaaccacgcccatcgcgggtcacttcacatgcgaatgtcgctctccgcccagcgaggcttggcttgcctttcccatgccatgccatcctccgccaaccttttcatccgtcccccaaattgtgccattcatttcctctgctttcgtttacatttgccattccgtcgccttttctctctgcgcatttccccatttttcgcgatgcaatcttcacaaatttgcgtcgctgctgctgctcatcagaaagagcactaccgttggctccccgccgaacttgtcactgaattgcttttgttcgtgccgagctcaatttggcgagcgagtcgtctgctgaagtgccactcgcttttccttcgtctgctgaccaatgccaaaattgcgcctaattggtttcgtccgtacaacataatggtaattaagtgggaagcaattacggaatttaatggtccggatttagcgacaagaattgcaattcgcctgtcaaaaagtgatgcctctcaacaaatggccaattcttctgcgctgccacgagcattgtatccccgtcgactttttgttggcacataattacgtcaaatccggccaaaggaatgggccaatgatgtaactcattctgttgttggatgaacagcattttgcagtgaatgcactccaacaaattgtaaagaaaaaccgtgccaagtgaacttattactaagatttgccctttttctagtgttgggttatttttggaaattggatttttcataaatttactgacggtgtccaaatgagaccgctgggctcaaaaagcgtccactttttccccttattttagccacaaaataagcaatttttgaaagtgctcaaaatcatatctgtgtttattaaaaaaaattatttgctttattttctattcatttcatttttatttgagtattattgaagtattgtatttgtcaaaaagtcattttaaattagttttaaaaaaaaattattcttttgattttaaagaaaatcaaaacactttttttgatttaaaaaatttctctaacaaataagaaagttttattcgacaaagacaaaaatgcgaaatcaaaggcaaaatgaggtcgacagcgtaaaataacaaatctcttaagaattttttggtgttttattctagtttttccggcttattactcaaaaaagaatttaaagttttgttttcaaataattcaatgaatttattttgatgaattctttacggcaccaaaggggaggatattatgtcaaaatatggtaactatgaaaacatggacataaatcgcgaaagtccaggaaaacaatatggattttcaaataccgattaacccgattaaataattttcgttttaaattagcgtcaacaatttcgcgagagaatgcctcacttttgcatagttgtaaacggtgctgggacgtttcttaaaaaccgccacattgggcgtttcttaaaaccgccaactcatatgattatgtatataaatatatatatatatatatatatatatattagaagtttacataacaataaaaaatttaaaatacatatgcatatctagtgacggtaaaataaaataattatttttatccttctttaaaacgttctccaaaaatatgaactgaccagcataatatattctaaaaaataaaatatttaagatatgagttggagaacagacttttgttagaaagcaattaggatattcattaaggcaattgcaaaatttaatatcacaatcgtaacgtttctgatatttatttatgtagcacacatcgtggttatagcaacaattatcaactgcaaaattttcgaatataaaattgctaattcgtaatttgttacttttttgaaagttgcaaaaccagattacaggagctattagacaagagtctaatagagaggtgccacaataagtcccacagaatttctttgcaactttcaaaagggaatgaatttttataaagattatcacagaaataaaacaaaataattaatttatctttgttggctgtttaatcagttcaaaatgtccatcattataatacaaaaatactgatgctgttgtttctttttgactcagattcgtaagctaaatttttaatatgaatttgtataatcaaagagtctaaccgattattattgtatatttaatttaacggatatacatacataatcatatgagttggcggttttaagaaacgccctgacggttttaagaaacgccctggcggttttaagaaacgcccaaagtggcggttttaagaaacgccctggcggttttaagaaacgaccaaagtggcggttttaagaaacgcccaatgtggcggttttaagaaacgcccaaagtggcggttttaagaaacgcccacctggcggttttaagaaacgccctggcggttttaagaaacgaccaaagtggcggttttaagaaacgcccaatgtggcggttttaagaaacgccctggcggttttaagaaacgcccaaagtggcggttttaagaaacgcccacctggcggttttaagaaacgccctggcggttttaagaaacgcccaaagtggcggttttaagaaacgcccaaagtggcggttttaagaaacgcccaatgtggcggtttttaagaaacgcccaatgtggcggttttaagaaacgcccaaagtggcggttttaagaaacgccctggcggttttaagaaacgcccaatgtggcggttttaagaaacgcccaatgtggcggttttaagaaacgccctggcggttttaagaaacgcccaaagtggcggttttaagaaacgcccacctggcggttttaagaaacgccctggcggttttaagaaacgcccaaagtggcggttttaagaaacgcccaaagtggcggttttaagaaacgcccaaagtggcggttttaagaaacgcccaatgtggcggtttttaagaaacgacctagcaccgttgtaaactctgtgctcatgtccaaagtattgcaagtggaatttgtgccgctcgacacagctgtcagtttttcattaaaatattaacaaaagaattatttcgaaataatgaaaaaataaattattaaaattaaatctgccacctgttcctaaattagccttttcgttttaaatttgttaaatgtgaaatattctaaaaccccaacagaagccctttgtccataaattggctcatttttcacttaatgtttccaatttttgcagccttatgtcattttgctgtgaagttttgcccgacttgtgatgaatattacttaatgagcctctccaaagtaattagcgacgttcgcaatttcatggacaatgttttgctcgaccaaatgaatcggcagaattaagcgtttacaaatccgccaaaataatcttacattatataaattttattcttattcaaacatcttattgaataatctattttttgttgtgaagaccagtaaagcattctaaaaatattttgtaaccaaattcataaaaatttattttataatgacgatcaatcacataaccatagcaattctgctctattaaaatattctatggaataaaatttacttatcaaataatgatgaaaaaattttgttgatcagtagagctgctggctgggacttttatgtgctaaaaaccctgaaatatgtaataaaatatgtgccaaaaaatactgaaatatatactaaatatgtgttaaaaatgggaaaatcaagtgttttttttcataaaaatctcagctctattgatgtgtctcaaaaaaaaaagaaataaattgacaccagtgaataaaatgtttgcctcaatttaatttattttcaaaaaaacaaataagaaatgtattccattattttgatattttttcgcccataaaaccggtgtttgaaatggaaacaaacatttatttaggattttaagtgcataattgaaatttatagacattattttacacgataatgaacaattggacgtaataaatagggccgcaacttttagtgaaaaaactttcttttttttgctcaattgatttgaagaaaggagctcaaaaaacgcatttctgcattaaaatttttcaattctgatgtcattatcagtcactagaaatcactattttggcgtatcgtcactattttttcactatttcgacattttttggaaaattccttaacaaaaatgcaataaaaccaaaaaatacacccctaagaatcgacctaaaaaaatttaaaaaaa

SEQ ID NO: 10011 - DNA, 3183 bp, Heterodera glycines
  misc_feature (2973)..(2973): n is a, c, g, or t
ctgcagcctcgcctgcggttcttcctcaatttcgtcctattgacgcaccaagcaacaatggttgcaactcttcttcagctccatcattatgttgatgaaccctataattaaaacaaaagtcataaatctaaacaactttttaaaaaattgcaattctttgcttgccattaatgctgcctttcacgcctttgctgagctcctcgtagttcctggtcagcaccaatttataatattgtttctgttgagcggtcatgtccacgcgaagaatttgctcaactttggccggcagagatttctcgacatcctttttcactcgtcgcaacaaaaaaggctccaattttctgtgcaatgacgaaattcctttgtggtcacggtcttggtgtgcccgttcgaattcacaccaatcgttaaacctgaaaattagttttgaatatattccattcaaatctatgtaaaaatgcaactttttattaaagtactagtaaatgaaagttcatcacccacttttctggcataatgaagctcaaaagagcccacagttctctgagtgagttctgcaatggagtacccgtgacaagcaaacgatgattggtgtgaaaactgtacagagtttgatacagaagcgagtcgtcgtttttgagccgatgagcttcgtcaactacgagacaagtccatgtgaatttgccgagataaagctaaaaattcaaggttttatcttatgtttatggaagattaccttatccttaaggcagatttcatatgttgttatcacaacattggccttgcataactttgcatgttcatcaacatctaactcatggatgcgaatctaaaaatctgacaattcagttaattgtaagaatggaatttaatggaaaagccgtttgtttttgttatacccatatcaccatttacccacctgttccctggaattgacgtcgcccatataaatgactgtgttcaatcggcttccccacaaggtgaactcgttctgccacgatggtaaagtggataacggcacaacgacgagaaaggggccatgcatatcatgcagatggaaaagcgacgaaatgaaactaattgtctgaatcgttttgcccaggcccatttcatccgccagaatgctgctgttgcttctaaataaatttacataaaatgaatgtcaacttcagtcagctcacttggaccaagcgtaaagcagccaattcagcccctccagctgatagtcacgcaattccatttcagagtcaactggcctaaggaagtcaggcatagactcaagtttttgaaatttgggccgtcttttataggcctaaagtcaaagctttccatttcaaataacaaaaaccgacggttccaaaccgggtacgatttctttggctgtgtatccgattgttcgcgcacttcaaattcagctattttgtggtcgaattcgcgtcgaatcagcccttcgtcctcccaagtgcactccgaatagggcaatccattccatttgatcagatactcagtcgccgcctcgccgttatcgctgattttgtcaagggacgcctgctctccgataatacgctccacttgcttatattgctggaaggaggagccaattactcccaggaaacaaagagcacagtgttgtttacctcaatcaactcatcgttcatgccgagttcgcagttgtacagttcgatgtattctttgtcggccctttggcgcctatatttgggtttcattagtccgtttaactaatgccacaaacaaaccatacgtccacctccgcttcgcgtttgctgtaattctccacctaaattgtttattatatgaagacaaaactgttgaagtaagaccttcttgaagcccttcacattcgcggcctttaaactcgcctcggattcccatgtgttgtggaggtgggaccaactgcaaaacagcaaaggtatagaaagagcaggacattgaacaagggttagcatattatgtacatcgttcccattaacgagaacaattattgtcagtgcttttgatttttgacccccctcccccaagtcaatgtcgatgcaattaactcatcttaataggtcccttctttcttgaagagattctattattcatttatttttacttaaaacggttacaatttccttataattttattgtgttttgttttaaaccagtgtaaacaaaaaatattaggcggaaaaatgttttgaatgtcacaatgtttttggcaaaatacgaaatgcatacccaagccatttgattaagtactggcgctccaaatgtccgctctcaatttctaaatattatcttcatccactcaatcaatttaaagttccatgtctcaccggaaactctctcattcgggtcagctttgtcttgcacattataccatgtggtgccagacccggtagcgccgggcaccccatcccgatggcgcaacacgcgctcaatctgggttttaaaaagcgcctttaaaacgaataaattaattatccaagcaacaaaggagtggtcggtcctatcgcactttaagtttccaagcaattttttggcgtccattgccaattcattcggaaatgggcgctcataacttttttcttaattagctaaattaaatgagtttggtatcattcggaagcttaaagattagatgtcatattgactagactttaaccggtcaaattattttcaaaaaagtttgaaaattttttattttttcgcgttgtgtttgggcttacgaatgatagaaaattcgttttgtttggttagctaatgcccgtagatttacgaaaggaaagttattggacaactaaagtgcaatagagccggagtttcaaagaattacacttttataccgtatcagattcggggcggttgttgaagattttcattttcaatcaatgacatcattttttaatcttataaattcaatttttactgcttgatttagggttttcaggtcctacgaattataaaaangggttgggtacgtatttcgaacgaagaaaaaggacaaaaaggcaaaaaacaacaaaattgaccgattttggtaaaggaaagggctgacatttgttgttacattgtttgaattgtcagaatgttcgtccgaatagcccatttggcatatgaaaatgtttttttttgttcattaacagacccgaaagctaaatactctacagaaaatggctc

SEQ ID NO: 10012 - DNA, 1263 bp, Heterodera glycines
gaaaatccgatgtaaatccgaaatgtttgaagtgaaactgtgcacagcagtaataaattacgcgtggggaaggtcgaacaaaacaatgattgagctcgagtcagaaacgaaaccgaattcggcttcacgggaatcgttgtcttttgagaagccaattgagagactgtttcatggtcatgtgacagcagcgaacttaattttccaagaaaacgaagacatttcaacaagccgagcaacgaaagagcgctaaattcaaatactaccccaaacagcccaaagaaaacgagtccattcctttgtccaataaattattctttatttcctttacaaacaaattgaaaataaaattacaattgaaacggcggaaaataagtcaggggacagcatgacaatagccctcaattgggagttgggagctttataaggcacaacaacggatcggattcacaatcccatcatgccatgaagagaaagcaattcggaattcagattttaaaactgcgaatgctgttttactatttctaaaaccaaaaagaagcatctcttcatgcgcataatgtttaagtaataaaagaaaagagccagaaagtcaaataaattaaaacaattttggtgtacgagctgcagcattgattaacattaaaacgagaacccattactaagccccaacgatgttttaacacgtataaaatgcacaccgaccaaattttttaatcggcacacattaggggaggagggaaaaaatcactggttgttcaaaccatgcaaatattttgacccatcagagttcctcagcctttgccttcttcttctttttcccgtcacgcccatagcccttcagagggtcggtggattgttcggcgatgaacttgatgaagtccttcacttcacggcctccttgataaggaaccgggttggccttgtccttctttggcagccagaaaatggtcggaaatctaaaaacaaatattaaatgccaaagcatagataggaaatttaaaaaaaagcaatcacccgcgaacttcgaattgtggaggcacatcatctaaaaaggtgaattgtaaattaaagaataatagcaaatggattgagtattcacttgcagtcgcatcaaatttagcgatgacaacgtcctcatcggccatctgattatcaatagtaatgcaatgaaggttctttcattattccaaaattcactcactttccgagccaattcttcgaaaaacggagcgagggctttgcaatgcccacaccatggagcat

SEQ ID NO: 10013 - DNA, 1305 bp, Heterodera glycines
aggtcatcattttgccgaaaattagttaaaaatgaaggaatggtcatttatttttatttctctttttattctttgtcatttattcaacagaaacatttttcttataaaaagataaaatataagcttgttttatcaaacaaaaatgtcatttttgaccaattcaataaattatggagatgctttcacacaagcagcagcaaaaggaggtcaaaaaagatgagaaaagtggaggaaaataagaaaaatataaaacccaaatttttagaagtgaatggcgatgcaattaatttggataattatggacaattatttgacggaaaaaacagtgaatcgatcactgatcaacgacagcttaaggtgggcgaaagaaaaacaaacaaaaaaacagacagaaacaattgggaaaatatttttagtattatgtgcaacccaaaagagattttgctaatttaaattcaggaatttcgtgaaaagtttgccagaatggaaatggaattggaaatggccaaattggaactcgaaactgtgagttttgctataaaaatattttattttctgttttccctatttgtcttaagaagacacttgaacaaaagttaaagcagcagcaggaactgattggattgaaggaaaaattggccaaaattgaacaggaaaaggagaaaaatggtaaaaataataaataaaggaattaataaaattattttatggaaatatttatttaaatattcgataaaattaatgaatttaaatttacagatgccaaatatttgactgttcatcatagggaaaaggaaaggggtaaaaagttacaaattattagggttgtaaattatatggattaatatcttttttctgcgcatatgctatggagaaaggggctcaaaaatagcatttctgcattaaaattttttgatttgtgaaggtttttagtccatataaatccatattttgggggttttcgagaataaatgcatatttcgccatttttgcctttttagtccatatttcggccattttggcaaattttcataataaaaatgcaagaaaagcgaaaaatacacccctaaagatggactttttggaaatttttaaaaattgcacccccaaaaatatgaaaaatttgagttttcgtcgtcatttgacatttttaataaatattttcgccattttttgcgaactttctctttttttaaatgagaatttttgaaattttggcaaatttggaaatattttttatacggtggacgacaataaaaaaaatttgcatttttatgttttaaatccatttattggttgtttatt

SEQ ID NO: 10014 - DNA, 1732 bp, Heterodera glycines
gaagaaagggaaactgcaataaacgaaggtaacaaaaaaaacaataaaaactttaatgttttttttgaattattcgacatttggaaaatattttggtaaggcaaaaattcaaatctgaaaacagacaatcatggttatatgtccaataaatatacaggaaattcaattgtaaagattgaatttatttttatatatctcatttattttgccagccaaagacaaaaaataatcccaatgacttttatgttttaaaattatctcaaaccttttattcttaaaaacacagtcatttgtttaagaaccttaagataaatttcaaaaacgagtattataggcatcgaaaattctgaaaaaattcacccgtaaagattttacgatttggaaaatatgggtcatagtcgccaactcatgcttaaaaacggtctgaattgatgtaaaaaaagttcgaaatgggttggaaaatagaaatattggcgttctccggggtcataagtgtcaaatccagccggtacttaatcgtccactttgtaaaaacggtttaaattattttttgcaacaaaactaatccgtttgcacgacctagccgagccctgatgattattactcaaatttaaattaacgctaaaaggcagcacacattcgaattttgagtatggcgactatgaccgatatttgcctgttatgctttttcatattgtgagcagtttgtgctatttcagatggacatagatagcaggggtgtgacttgtctcagaaaagacgagagcgagagtttggcgagaggcgagagtccccaaaaagacgagagcgagagtttggcgagaggcgagagtccccaaaaaaacgagagcgagagtttggcgagaggcgagagtccccaaaaacacgagagttggcgagaggcgagaggacgagaggcgagagtttttcaatttttttctgtagccttattttttaatttaaaaaacttcaaaatcgtatattaaattaggggtacgggcctgggtatttgggcaaataccgggtcagggtattgccgggtacagaaagccgggtcagagttctagtttttaaaccgagtccaagtcatgaaaaatccaaacaaaaatctttaaaaatttttcatgaaaattaaaaaatattttcatgaaatatatttattttagaaacaaaatttattatttgtccattttttccacctttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgttttttcaaaaaaacttttttggaacattgggtgcggggtccggcggtgccgaatcggcaccgccaataggcgccgccggaaaaattctaaaattttgagtgtaatatattaacagaagttgtcaaaaaatgatcaaagttttggttaaatttgcagttttaggctgtgtaaaaaagaaaaaataataatttttaattgaaaaattttttattaattaaaatttcgattgaaaaataatttatagaaattatttaaaaaatgctgtaccgttggggaattgaacccaagagaacagtaaagaaagggagaagggttagacagctgactctatttgaattggagatatccgaaaa

SEQ ID NO: 10015 - DNA, 2254 bp, Heterodera glycines
ggaaaaattataaaatttgtagtgtaatatattatcagaacttgtcaaaaaatgatcaaagttttggttaattttgcagttttaggctgtttaaaaaaagaaaaaataataatttttaaattgaaataatttttattaattaaaatttcaattgaaaaataatttaaagaaattatttaaaaaattctgtaccgttggggaattgaacccaagagaaaaataatgaaaggcagaaggtttagccagagaccatatttgaattggagctatccaaaaatagagaaaacattaaggaaggaaagaaagagatttaagattttttttcgcgtaaatttgaaaatttttctggatgctcaaaagttcaatctttaggggtgtattttcaactctcgcctctcgtcccaaaaaacgagaggcgagagtaccaaaaatcggcgagagttggcgagaggcgagagacgagaggcgagagttgtcccaccccctgatagatagtaatattttgcagaaaaattttaccaacagcctaggaatttttttctagaattttcccgattttcactgtattttggggtgtcccggtcactagtctttcagaatatttcctatacttaaattaggtattggtcgattaaacattttgttgctaaaaaataaaaacttttaaaaaaaaacataaaataacactttaatcaatttaaataaataattggatttatattttaagcttctgatgaggaacgattcttacaattacaaaataatcagaagattattttggaaaaaatcagtgaaattgaaaaacaacaaaaagaacagtcaaaaggcgaggagaaattaaaacaaaaataaatttgtcaaattttatatatttcatttaaatttttggttttaagccactgcggatcaattgtcaaaaattatggaaaaaatcagtgaaatggaaaagcagcaaaaacagcagcagaacgataacacgagcaaaggcgaggaattaagggtaaaacaaaactatttttattgattttatatttaagcaattttattttaatacaatttaatgttttattttaaggcacttttaaatttccaacagaatcattgggatgccaatgcttgtcatgagaaactcgaaatcattggcgacaaaaaactcattgtccattataagcaaaatgatattggtatttttccatattttacttatttatgtatttatctttaaaagattggtgttccgtctttgctaaatatccgattttgctgaataataattggtccgacactttttactacgaaatttcagtcaaaaatatgaaaaggtaagataaataatatttttaattttatataccaaatttaacagagaaatattaaaagtgaatgattattaataaaattgttatattcctttatttatactttttcagtttaattaccttcggattcgctgttaaacagcagaacaaattcgatggaataattcttagccacaagggcacttacgcatattataatcgtggcgatatttggattaacggaaaaggaaagggaagaaatggcaaatattcctacggtgttggcgataccgtaggaattggtgtcaattcggccactcgacagatcattttcactaaaaatggacttcgtttgggttggtaaataaataatgaatttaagaatcttaaatataattttttatttatttgattttatataaatcttttccttaactttttcacagattcctctgaatttttcgttgctcaatcttttgctgatgattcatttcatccatttgtttctatttggcattatggtggccaagatcaaattgaggcaaattttgggcccaatttcaaattcgatttggcaactctctgagggtgaaatattcaccaaagctgatcaatctgttctttttactgatcaatttgttcgtttaatcttttttttaagagtattcttggaatcagggaatataaatatcggtatgtacatgtgtatgaggtagagaattgatgactttgaaatagggttcggtccggtgggaaaaatattggaaatttcaattgaatagtaaataagttagaatcaaaaattttactcatttaaaaaaaattttcatttcgacgcgtcgtggttattaataaagcctccaaatttcaaattgcggataccgctgcgggattgtaactcacaatttttgcgggaaaggaccacgcgggattattctgttaacaaatttcactca

SEQ ID NO: 10016 - DNA, 1705 bp, Heterodera glycines
tgcatttcagaccctaggagctcaggaaaaaatatgccttctatgaatggttaatataaacatatgtatgttgttattgtaaataataatggttataccttccctaaaggaacagttggcgaatatttatgttttcgaggaattagtggtagagaaaaaaacacaccaaagagattatgtcgagagaagaagcacattgaatcactggtaaaaaaacatttcaaaatgtcaaatcagagaatgctttcttagtagcaaatgtgagggcaaaaagtttcttctccacaaatatttatgcttgttttaaaaatgcttaaaattaataatatacaacacaaattgattaattggccacatattcttttgcccatgggttcattaaaacgtattaaaattgggctgacttttggcaaattgcgcctgtcatctgaatttcgcagcccgcgtcgttccattggccatctgcactgaacatgtgcacgcactcctcttttgcgccggctgaagcatttgcaatttatttatacattaaattgttaaaaaaatgaacgaggaatttttgttttgttgtatattgaattgtaataattcattttttaacattaagtcaacccaacttgggtcggtgaatttgttggtacccgacggttgtcctcctccccaagggtatttgtttctgccgccagttgtcatcacagcagttgtaatctcgggctaaatatatttttcattttgtttaatttaaacatttttaacttacaacattgccaaatgttgctgaagaaccgtttgtccatgtgctttggtagcgattgccgacgtggacacggcgaagaccgatcatgaaaagtaaaaaatattgtaattagtaaaaaataaagtaaatatttcaccaaaatgtgttgaaaagtgttgttgccaaatgatatgttttttgtgaacgtgcaagcggccgcgtaatcattctgccaatgaaccgattctcggcttcgctctcgatactgacgagttgagctttagggtcttccgccttacaagcggccaccgcttgactaaagcgcgattatggtttattgggaggtaattaaaagcataattaggatagtaattaaaatattccactaatattttctcatggaaattttttttttcttggataagttcccactcacgtctgattcatcagtccttcgataactttgtaacaattgccattataatttgtccatccaaatccactgcacaccgacgcacaagactcggaaattgttgacgactcttcagtgactgatgataaaccttcagatgttgacgattcttccgtgactgatgataaatcatcaaatgttgacgactcttccgtgactgatgataaatcatcaaatgttgacgattcttccgtgactgatgataaatcttcagatgttgacgactcttccgtgactgatgataaatcatcaaatgttgacgattcttccgtgactgatgataaggcctcagatgttgacgattcttccgtgactgatgataaatcatcaaatgttgacgactgttccgtgactgatgataaatcatcaaatgttgacgactgttccgtgactgatgataaatcatcaaatgttgacgactgttccgtgactgatgataaatcatctaaatgttgacgactcttccgtgactgatgataaatcatctaaatgttgac

SEQ ID NO: 10017 - DNA, 1249 bp, Heterodera glycines
tcagatgttgacgactcttccgtgactgatgataaatcatcaaatgttgacgactcttccgtgactgatgataaatcatcaaatgttgacgattcttccgtgactgatgataaatcttcagatgttgacgactcttcagtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactgttccgtgactgatgataaatcatcaaatgttgacgattcttccgtgactgatgataaatcttcagatgttgacgactcttccgtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactcttccgtgactgatgataaatcatcaaatgttgacgattcttccgtgactgatgataaatcttcagatgttgacgactcttcagtgactgatgataaatcatcaaatgttgacgactcttccgtgactgatgataaatcatcaaatgttgacgactgttcagtgactgatgataaatcttcagatgttgacgactcttccgtgactgatgataaatcatcaaatgttgacgactcttccgtgactgatgataaatcttcagatgttgacgactcttcagtgactgatgataaatcttcagatgttgacgattcttccgagactgatgataaggcctcagatgttgacgattttttagggaccgatgttgaaacttcacataatgaaagatcttccgactgtgaatctttagatgatttggaatcatccgatgatgaatcttttgatgatgattcagatgatgaagaatgctccgatgaagaatgctgaataggtaatctaattaattcttattatcttaataggctcccggaaatgcgtcaggaaaaaatgcgtcagtagaaattgcatcagtgaaaatgttgatgtcataaaaacaaattccttaggtttagggctcatcgatcacgaatccgttattcatttctgccaattccgaactccggaccggaattcgaacaaaaagtagaaagtccaaattttagaatttagcaattttggttcaaaa

SEQ ID NO: 10018 - DNA, 2950 bp, Heterodera glycines
ttccaaatgtcgttgtgaaattgctcgcgccgagaagctcccgctctctaaatttctttgcgggacggattggctccgaaacaacaaaatcggtgggttcctcattcggctctcgcaaaatttgcattgcgtcgctgtccaatatgacgccttgctgtcgcgttcgctggcgagtttggtgcggcgagcgtggggataaccatttttaaccgtcttggttctcgaatttttcacacaaaaatctgtggtttaaccgtcttggttctggcgaattcaaaccacttttctcaaccgtcttggttctgctgggtttcactcaaaattggcgagtgttgttcccagtctttgggctcacacaacaagaaaataattcgtcgctccccagtctttgggcaaagcaacgagtaatggcactgttgatttcaattaaaattcaaaaccttcttccttgtgtcaaaaatgggacggcaatgcgcttgttcagctgaagtccaggagcgccatgtagagaaaagcgagagagtcgggggctctaatattcgctgctcaatcaaattaaacacacaagcaaatacaaacacaatttatttccaaaataaaatcaaacaccacaataaaattcaggaggagagacgataataaacataaaaatatcttcatgaattcaaaaacataaagtctgaaaaagaactaaaacaattcacaaacaataataagaacaaaacgccaataaatttaaaactaaaataaatattcgtcattatcacatcccgcccccaacaaaaaaggcgtctctgccgtcaaaatttccttgattcggcccgaaaggaagggttctcagctgacacattgccgtccgccgtcgacgatccaacaaatttagggattggccccgatggagtcgcataatagatggtttttctcttccatccgcctcctttctctcgattttcgtttacattgccaatttgtcgaaaatttgccgaaattcgatgcccagcttttcctaattccttgtacgatccaccaaaatttctgaagatcgggttcgttttgccattctttttaccagtggtcgactttttcgggtccaattccttcccgccctccaaaaattcaattgtccccaattgagaactccgtcctctaacatttcggcagacttttccatttttttgaacctctaaaatcgacttttctgttttgcattctacatctttcctactcttttcactccctttttccccaaattttttctccaattttcctcctttctgtgccgaatttttcccgttttttgcttgccacttcgatcgattcttttgttgtgacgacttttgctgacttttcggaattttggcaacattatcatctgcgactttttgttcttggctgatggctacatcatttttccgagccttttctgttcgttctttccctagcaaacatggcgtggaattttgaatcaaagtcaaaccataaatgatgtttactgccttattgtcattgttcgatgccggtttgaaatcgacaattgtgtcggacaattcgtcaaaaagtttaaaacccaggtccgaaagtgaatttgttccgaagagcaaatcgtagccgaacgatgtttgggccacgtggagacgaactgacacggtccttcccattcttctcaccggcaacgaaacaattccgtagcatttgacttcctccccatttatgtcgatgacgcgcaaggtctgacggcttgggttcaaaaattctttgctcgacgttgaaatgttcaaaattttgttcaaaaatgcagcagaaatcaacgaaatctgtgctcctccgtctaacattgcgttggcatgctgcccaagaattgaaacatttgctaacaaaattttaccgactatttcccttttctctttagcactctgcgcatcttttgctttcacgtcttcaaataatttttccaccttttcacttacagcacttattcctccaatcaaaacatttgagtgacacgccggcgatttttctgtttgttcgaccaaataattttgtcgaagaaaatttctcggttgttgggtatgattcggaaaattttgttgtgatttttggctttcattggtatagggaatcctgtccgctcccgtagccgatgcattatattgtggtggggcataatttgactgatcgcgtcgtgggtaccaacaattacgggaaacatgcccttcctggccgcaattgtagcatttgaaagaccggacaaaattctcaggttgattcgatgatcggaaattaaattgtcggcggtgttcaaaattttggcaaaaattcgtgtctctttgttcggctgcttttgctgcattttgggtgatctccgcgcgcgctgccatggccacgaattcgtcaaaaatcatgtcaggcttccgtgccatttccaaagtgagtgccaagttcggattttttagcgaccggatcagatgccgaattgaataatcgtcgtacaaatgttcgccatgtccgggataggcccttctcaccagtgatgaaacgcggtcggctaagtcgtcaatgctttcgccgttcattctgcataccccggtcattagctcatcaaatgcacacgttgatttggcatccgtcgagtcaagttgttgtttcatagcccttcggatgttttcataccgaaacgggttgttggcaactgcagaattgtaggcccgctctgccctacccgaacatttcgatttaagtgcccttaaacgcctttcgtttggccaatcttcgctgaccgcgtcaaattgtcggaagaacgcattaacttgatcagctcctgcgtttcctttcaactctggcaattggtgaagaatcattgagtaggaaaaaatgtcgagactcttgatggttcgagccattatcatgtttgggtcgattggcggcgctggcagattctctccttggtctt

SEQ ID NO: 10019 - DNA, 2292 bp, Heterodera glycines
  misc_feature (2167)..(2167): n is a, c, g, or t
  misc_feature (2191)..(2191): n is a, c, g, or t
atacgaattgacgacacgatatggaaattcggcgggtaaatgctgtcccctattgtcagctctacccacattcagataagcatggcgacttgattcgaataacggtgagttcggtgatcgggcccaaccatcctcaaagtttccattgtctccaaaaagatggccattcggtggcaaatttcttatttcgacagcattccgttctcccatatttcttccaaaattttcgagatgccccgaacctgcattaaccattggtgccaccaacgctaagtgctcactcatcctttcttcgtttgctgccggttcaaattcatgaacattcacttccaaatgtcgttgtcgaaattgctcgccgccgagaatgctcccgctctctaaaatttcatttgcgggacggattgcctccgaaacaacaaaattcggtggttcctcattcggctctcgcaaaatttgcattccgtcgctgtccaatatgacgccttgctgtcgcgttcgctggcgagtttggtgcggcgagcgtgggataaccatttttaaccgtcttggttctcgaatttttcacacaaaaatctttggtttaaccgtcttggttctggcgaattcaaaaaccacttttctcaaccgtcttggttctgctgggtttcactcaaaattggcgagtgttgttcccagtctttgggctcacacaacaagaaaataattcgtcgctccccagtctttgggcaaagcaacgagtaatggcactgttgatttcaattaaaattcaaaaccttcttccttgtgtcaaaaatgggacggcaatgcgcttgttcagctgaagcccaggagcgccatgtagagaaaaacgagagagtcgggggctctaatattcgctgctcaatcaaattaaacacacaagcaaatacaaacacaatttatttccaaattaaaatcaaacaccacaataaaattcaggaggagagacgataataaacataaaaatatcttcatgaattcaaaaacataaagtctgaaaaagaactaaaacaattcacaaacaataataagaacaaaacgccaataaatttaaaactaaaataaatattcgtcattatcacaaattgagccaagagatttatgctacttaataggcaggtaattttgaatttatttttttctgataggatttttaacaaaaacaccaaatcaccaccaatttgttaaagattttcaccaaaaatgcccatttatttttaaaaatgctttatgagtttttaattaattcaatacaaaaataattatgaaataaaaaagcacataaaattattgatgaataaaaatatttttaagcaaaaattatataaagtttttgactatatgtcataaggcaaaattgaaaaaccctgaccccgaccccgaacgatttgtcaaccccgaccccgacgcttccaaccctgacaaccccgaattttccaaccccgacgtcggggtcgcaaccctatttatacttatggaaaaataacaagcaaaaagaatattttaataactcaaaaaaagatttcagaatcaaataattttcgtgatatggcattataatatgctcgaaacataatttttcagaacatattagcaaaattgaacgaaacgcataaattcgaatttttcagattttaagagtgttaaaaagcagggaaataaagactctaacagcagcctataaaacttttgtacgacctcaattagaatatgctacagaagtttggaaccctaacttaaaaaagatatagataaaattgacgagtacatttagaaaatgtggttttgtgtacaaataaagtaattatttgtaaaattagattttttattgaaattaaaaacagctcttaaagattcagactttgaacattacttttagattttctcaaattttttatatatttcagaaaattactttttattcataattaagtaaatttttatgattaactaattattaattatgtaaatctttttttactgtttatctatttagtttttactcatggaattggaactaaatttggtgttccttttataattttttgctcttcagtatcagcaaatatttgacgagtcgaactttacaaatgcaaaatatttgaagtaaaaaacagttattgtaattaaaagattgaaagaatattanaaatttttctacgatttataccgngagccatggtagattatgaaaaataaaataacggatcgcatcagaatttacctttttttggtatttagcaccaggaggtatgatataccaatataaattat

SEQ ID NO: 10020 - DNA, 1716 bp, Heterodera glycines
tcgtttttaaattactttcttcgaagaatgtttaaagcggattttgagtttaattatttttggctaatttttcaggacttttttggatttatttagtacttttttgccatttttatgtgactttttgattattttttcatgacttttttgtattttttgtgactttttcgtgactttttggcgatttttcatgattttttaagtcgactttttctagatttttcgtgacttaaattcccatccctagatattatgctcaatttgttaacggattttctttaaaaactgataaatatgtgtcaattaaaaataatatgaggaatcatattttgtcgatatgaaacctatgagtggtaaagaagattagccaataggccattttcacaattggtaatgtcacttttatataatatattaattatttttttcaaaatttttgcgtttacccaaattttcttcacaaattttcactgaaacccccatttttaccagtctattttaatacccggttggacccggacctgtcgggtaccgggtattggatattcaaaaccaggtccaggtccgggtattgggcaaaaaccgggtacccgggtctgggacccggtcgggtacccggacccggcctacactagttgaaattcgtgatcagcgagcgacccaaaaaactcctataaataatttttaaaaacaggtaagtggatttgaacccatggcccgaaaacccatttttaaccaatcgtttaactcagttccgtttttttactctgttgagtatgggaaaatttccggttttttgaggccatataattaatgaatttaaatggacagagtagagtaggttttttaattgaaaattttatcataatatttacatttttaataatcagtagaatagtgattttggaaaaaatttggcatttataaatgggaaaaaataatgatttcttatttcacctaaaaatttttattttatatatatttttaaaatttaatttttagttttttgtaaagttatgaaattattatatccattattgtttaaataagaaataagaaattcaaatattcaagtttctattattttcgtgaacagcaacatttttcggcgctaaaatttcatttttggccattttacaccaattttctgatataatgaaatttcataaaatctctttaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgaaattaaacaggatttccttattttattaagtaaaataatgatttattcagttttttaatcagaaaaaaatcattaaaatgcctcaaaaaatgaattgccatttaattgaagaaaaataaaataaaatcatttcgagacgacaaaaatgaaattatttccgctactattattaattatattatttttaattgacaaaatcggatcagaaaggaaaaaattgcaacaacaaaagtcatttggcgaaatatttggagaaaaatggcaagaaaaagaagaagaaaaactaaatgaactcaaaaaaagagaaataattgcaaaatattataaaataaaagagaaaataaaggaaaaaggaagaaaatattca

SEQ ID NO: 10021 - DNA, 1981 bp, Heterodera glycines
  misc_feature (1970)..(1971): n is a, c, g, or t
ggggctttcttttttggaaggattttttttctactgatggaaaaaggaattttttcgtttcgttggtcctttcctttggcccccttttgtcatttgatgaaagttaatcccatgttttaagtgtttgtcacaaaatctgtaaatggtcggatggaaatttctgggaatgtatgaccaaatgaaaaggacggcggccttttgcaaatgtttttttttcgacttttttgttcatctatggggcgacgacaaattcaaccattggcgtacgatgggtttcagcgggtcgaaggtttatgcatcggctcttcagcaacaccgaaagttggcgttctgtgcaaaagaccgtaactgaagggagtaatgaatcagtccaagaatctagttaatgcaaggggaaagggacatcagttagcacaccagcgatatggatggcatttagcaattaaagcattaaaaaagcctactttataccgtctttcacagccaagttcagcttgaaattggggaagtcggagcagtgaatgtcaaactcgaagctgaaaatgggagagtttgtacatgagacgattgtatagttttggcatttaactattggttcaattgaaagtccaaagaatcgagcaccatctaccagtgcattatcgccagaaaggaaataggcatgccatgaagaactattgccgaatacaacgaaaaaatccaaaaatcactgaaaaataattggaagaaacaatttgaagaataaatgattcgaagaacaattcgcttttttaaaattattatttaaaattgtaattcttttgtttacctttattttaaatattttatgcaaatttaaatgatctgggcaattttttgttaattttgagatttttaaacaaattattacatacaaaaatttttttccaatttatggaaacaaaggtttacacagaaaacattttttacaataatatatttgcttgactgatcacagatgccaataaaatggtgaatgacggacgattgattaatcgctcagattgatcaaatcgaaaaatattaagcagaaaaagctatcatgaaatatttatgattgggattcgggattccacatggattttgttttgttttcgagaattttggtcatttctcggaaaattggatatcgaagcgatcgatgggagtgaaaaacataagaaaaaattttgtgatcatgaagattttttcaagaaaaagtgctattttattattcaatacagcataaaaaagcatttttcgtgagtcaacgaattttcgtccaagcaatcatcaaaaaaaacagttaagttatggtgaatttttgtacagacaaataaaacaaaccggatgaaagtcttggaattttggattgaattccaggatcaatgattcagaatcccgattaatatttattgattattgatctgattattaaaaaatcattttgacaaatcaaaaaattaaagaaaatttgtacaaaaaaagaaagaaaagacagaccaaaagtgatcaaatgaggatgggatagataataccggaaaaatgaacaaataagcgactaaatagtgatcgacgaacaaattggtgccaaaaaaggcacacaaccatttttcaataacttatcattaggtttgtaattgggcaaaatggagttgaaattcgtgatcagcgagcgacccaaaaaactcctataaattgtggacaaataaaacatattaaaaaatggattaaagaattaggacttcatcaaaaattaattaaaactgattctcaaacaagtgaaattgtacaaaaattcattgaaatgaaaaatgaatataagctaaagggaaagaatttgtcaaaagaatggcaccaaaattatgccgaaatttgtaagaaaactggaattggatatgggacaattgacaaatgtaagagcaaacttggcattcgctgtaaactaacttgtgatgaaaaaatggaaaaannatattggcaa

SEQ ID NO: 10022 - DNA, 1170 bp, Heterodera glycines
  misc_feature (1096)..(1096): n is a, c, g, or t
  misc_feature (1126)..(1126): n is a, c, g, or t
  misc_feature (1157)..(1157): n is a, c, g, or t
atctgggcgattttttgttgattttgagaattttaaaccccaccagatattcacaattttttttttctatttatggaaacaaaattttcatagtaaatattttttatacgataatatatttgctcgactgatcacagatgccaataaaatagtttgtggtaaattggccatggaaaatgggatgacaaaaacttgagaaaatgcgttttttatgtggttaaatggcccaataagaatgttttgacaaaatgcgtgctgaatgaataaattaaaagtttttttgtagcataaacatccaatgtcagaagcataaaaaatggattgggaatgacagaggatttattgatcgatcagactgatcaaaacaatgttatggagaaaaaactattataataattacgattgggattcgggattcgacaaggacccttttttgcttcccgaaaaattggacatcaaagcgatcgatgggagggaaaaacatgagaaaaaattttgtgatcataaagatttgcttacaatagtaatgaaaatttttatatgaatatgcaatttgattttacatataattcattatttattgaaaactttattaatttcgtaattttcttattttaaattaccaaatcaaaataaaacatcataaaaatgattaaattaagaagaaaaatcattgacactaatgaagttattcttttcaataaaatataatcaaatatttcaaaaaataatttgataataataaataaaataaaataaaataggaatatattcatgcattaatttttaaataatacatttaaaaattcttaaatattcattgtaattgtatttataattatcctaattaatccaatccaatcaacaaataaaaaattggaacaaaaatcatttgccgaaatttttggagaaaaacggaaagaaaaagaagaaaaattggaagaaaaaagagaaataattcaaaattccataaaataaaagagaaaatcaagcaaaaaaaaaggaaaaaaattattatgtcaaatgaatataatacaaaagggagaaaatattcgccaaatgaatggcaccaaaattatgccgaaatttgtattanaattggagtaagccatgtaacaattaatanatggaagaaacaatttggtattagcaagaanatgataactgatg

SEQ ID NO: 10023 - DNA, 1901 bp, Heterodera glycines
  misc_feature (1740)..(1740): n is a, c, g, or t
  misc_feature (1761)..(1761): n is a, c, g, or t
  misc_feature (1844)..(1844): n is a, c, g, or t
atgataactgatgaagaagaaattgagaaaatgaaaaaatattgggaaataaaaaaagaaaaaccaaaaatgagtgaaaaggaaattgctaaaaaattgaaaattcatagaaatagcataagaaaatggaagaaacaatttggagaaaaagaacaaagatttgttgggattttaaatttgaaaatcttctttaaattattaattttctttatttgttcaaaatatgattagggctggaaattatacggaaccatatttgtttcctggactatggacggcctgaatttcatctttcttaaaaatcgatagatttctttagagttgtacgggaccgggacctggacacggacaactgagtacctagctcccggttttgaccagttttgaccgggaccgggaaattcccgttttttcccggttttcccagccaaaaagtcccggtttttcaaccaaaaaagtcccggtcccggtttttcccaaaattcccggtcccgaccaaccctagatttcttcataaatagtcaaaaaaaaagagttatatttctgttttttggtcttttttcacgaaaaaataataaatcttacattaattgttttgtttgttttttcttctaaaccgatataattcggaatatttatgcccatatttttgcaattttatgtacatattttgcgattttgatccatattttgcgattttattttatattaatatattcccagtcctaataatgatcattgaattttcattttttgtggattttgaaaaaattagagcagccaaaaatttttgattatgaaaataaaaacttctttgcaaagaagttatttgcttgattgatcacatatgcccataaaattctggtgatgatttggccatagaaaatgggacgcaaaaaaagggggaaaatgcattttttgaataacagaagcacacatcgcgtgaaaatgggaagattgataccgaataaattgaaaaataaaaagccataaaaaattaaatcaagcctagtcgaaaatgaacattaaatgttaaagcattcaagactcttggtccgagtgcattttgaaaaaaaaataggaaaattctaagaaaaaaatactcaaatgaaaaattaaagaatgacgaagaaagggaagaagcacagcctgggaaatcgatggccaaaaaattgtgtgatcacaaagatttattatttgaaaaatgctaattgacgcctcgtcaccgcataaatatgggaacgaaaaattagcataggcgaatgatgattgacagcatatttgtggccaaatggaccaccaaaattgggggaagaaaaaaaattccattagaaattaattggataaaatattaaagaaaaattaagaattatttaaattattaaaaataaaataaattaaactaatttttcattaaaattaaaaaagtacggtccgttagattttgtccaaaaaattataaatttttgtgaggttgggttggattttaattactagtcttgcggtgcaaatctgagaatgagcggtatcgggaaacaaattaacaaaatttcaaaagtcaaaagcatgtccaatattcggaaaaaaaggaattttcgactgcaaagattcagactcaccaaataaggacaaataaggaaaaggacatttggaataaggcccaattaattagcaaaaatgttttgattggaatgaatattgcacttacaaaaatgaaggccaaacaaaaatttatattgngtgggagccaattaaaaatgngattaattttttgaaagaaaatgggacacgacgggcagtggcaggggtggcggcgtcatttgcgcattggtggcgaagaatgnggggcggacaaaacatcgacggcagcagcgagcgaagcgcggggggggggggggggg

SEQ ID NO: 10024 - DNA, 2499 bp, Heterodera glycines
  misc_feature (6)..(6): n is a, c, g, or t
  misc_feature (25)..(26): n is a, c, g, or t
cccccngtttcgatagattgtcacnncgctcctttcgggttcaccatgaacacggtgggcacttcgagtgcgtcgtaggcaattttgtcactttcctggttgccaaagccggcaaaaaacggcgcgagattgaacaattcctttaaattatcaaaaaaaagaggttttttatgccattcgaaccagccaatttcactactgtataaaattgtcgttttacattactgtactaactactgtaacctccttaacagcaatccatgtcatgatgctttcactgctgtgctcactttttgacacatacagtaacatcttccgcgttaattttgctcactcacctttctcgactgtagctttttttcatttgttccctactgtaacctctctaattcgcttactgtaatctcgacgatctcttggtgttgctctgttgagctcaccccttttataactgctgtacccctggcgccatccccccccccccccttcttcatataacatttccagttcaacctttcaactactgtatcccgttaagttacggtatttgtatatacagtaccttcagtcgctgcatgcatacaattttgacccgctgcgggtctttcaccgccgttttcactgccttttccaacggttcataggaaagcaaaagtgcgcctgagggcatgttcaattctttcaaaaaatcccttgtcattgtgccggccgcggcgggccgtgccgaaagataaaccagctgatagcctcgctctttgatctgttcatacaactcgcgcacacttttctgcatccaaacttttcctggatcaaaaatgtatttacgacaggacggcaggcaccaaaattttaaaaaactcactccttctctttctttcgctctctctcttttctctctctctctcgctcactctctctattttttctctccttctctattctctctcattctctctctcgctctctttctcactccttctttttctctctctctctttgtctccttctctttctctcgctctctctctttctcactccttctttttctcaatctctctctgtctccttctctttctctctctcttttctctccttctctttccttctttctctctctctctctcgctcctatacatatcaaatgtctgtcaactaactgttgtttctctgtctgtctggttagtatctaacactttgtcaaggcttgcctggggctcgattccgtgacttgtggcccaggtgaaaatttggccaaaaacaatcgatattccaaaatccagccggaaacctcatggcttaccaagtagcatgccgcgaaggtcacttttcgtcaccgtgccgtcaatgtccgagacgaccagcttcgcattgttgtccaaataatacagggtacagttcacactcagcatctgtcccttcgcatttttggccgaaaattgtaccgaatatggaccggttgtcttcaaaatgttgctcaacggtgccagtttggcattccgttcatatacatccccattttcgtccgtccgcaatcccatgccgtcaattgatttgccattgactgcaatttggacgggcacgccctcctcctctgccgccttttggtgcccatttttggcaacaatttctgtgccaaagtgtaccaggatgggcgaagatgccaatgttccgtcactgcgtttgaacacgataaaatcggaagcacctgaaagttgtggagtttcttcccaacctctgatgaggtgtgccaatatataatttcagtaagctcaagaattttcaaaaattcatgtggtgtcaaaaaagccgagactttgaaaatttcaaatgaaaattataatctccatgctttactaagaggcgatgtcgagaaaatccattatattttcaagttttatcaaaattgactattttgaaaaatttaaaaccgatgcgctaccaattggaagaagaacacaaaatcttaaagagcggagtagtcccgtatgcgggaaataattagatgatggataaccgtagagatgatcatggcgaatggtccgcggcgagttgggcggttccccacttacactggtaaatgccttttttgtattttttattttgatcagccataatacgcttcattcccaacaaaaatgaacaaatttggtatctaaaaaaagattttgaaaaggagaatctttttctaagtgaatgctaagcaatttgacatctcagaaaaaagttgtgagagtttcaaatgttcatcacgttataactcaagtcctaggcagctctttctaaccaaaatgctaaatttatttttttctattgattctaaatgttcaaagtgattttgtacccttataaccaaaattattagaatttgcgaatttcatgaattttaatgtgttagagacatgaaaatagtacgccaaaaggagaggaaaagaaattcacaaaatttttcaccacaataacttttgagtgagccttatttttgtattaaatttcccttat

SEQ ID NO: 10025 - DNA, 1971 bp, Heterodera glycines
  misc_feature (17)..(17): n is a, c, g, or t
  misc_feature (65)..(65): n is a, c, g, or t
gttccgtcactgcgttngaacacgataaaatggaagcacctgaaagtgtgggagttcttcccacnctctgatgaggtgtgccaatatatatttcagtaagctcaagaattttcaaaaattcatgtggtgtcaaaaaagccgagaatttgaaaatttcaaacgaaaattataatcccaatgctttactaagaggcgatgtcgagaaaatccattatattttcaagttttaacaaaattgactattttgaaaaatttaaaaccgatgcgctgccaattggaaaaagagcaaaaaattttaaaaaacgctttactaccgtatgccgggaataattaaataatggataaccctaaaaataatgataccaaatgattactttacttgtatgctgggcttaattaaatctaatggctttggagtcaacatttttaccctgcaaatcgttcctacatttttttaaatcaatttttggtaattaatattaattattcgttaattgttttatagcttctcaccatgtattttcatatgtttgaacacttctgacattgtgtcatcaattagattggcgcaaagaattggatttgtatcaaaaattgttacaaaaataataattaaacatattatttttgtacaaattgggtttgggttgttgataagcaccattctgatcactttcaacttctaaaaaggtttaaaaaatttaaaaaaaggactgaattaaaattggtttaattattatttttttaaataatttaattgtttaaattaaattagagctggtcgggaccgggactggtactgaaaaaacgggtacaactgagtacccagtcccggttttgaccagttttgaccgggactagtcccgggtttttcccggttttcccagccaaaaagtcccgatttttcaatccgaaaattcccggtcccggtttttgtcaaaaatcccggtcccgaccagctctaaattaaattgaataattaataatgtacccttgaagaagggcctaaaaattagagagaccggaccggatatggtcttgccgcctagactcccggtcaatcccgagtgttttcgagaaaccccacgagtttcggcggcaaaaccaaatttttttttgtcccggaaatcccgattccgttctttccaaaatttctgatcaaatgtaaaaatcctaaaaatattgaacggaaggaactcgggttggatttttctgaaatttcgacaccaaatctaaatagggacaacaaaatattttcgagaaatttatgcttcaagtgtttaaaatccagtgaatatgactttttgtttttaaatttaggcagccttgtgctttggtggccattttttgattggcgccccggttggagagagctttatcaatttttttcaattttaaagcctcagtctatgggctatcatcggtgggtggcttaatttaaactaatttcatttttaagagtcaaaaatggatttatttgtttgcattaacatgaatgcacacagcaatgcaaacaattgcccgaggggggggggggcggcgatgaatctcaaaatccaaaatcacagcctaatcccaaaacttggccaagtgtttgcgtttgtttcaaaatttgaccatatttcctaatcaatcacatcactttttttaccaaattaataggcggcaaatttcgaaatgcgatggcgaaattttttgttgttgcacttttccatttaataatcttcacaaagtttgcccattccgttggatccagcgaaccgccaattccgcagaaaatcatgggggaaaaaacggtttttgagaccatggtttagcagtgatggaaattccaacgtctaactttgggaaataaatccgaggcttcaaaaaatttcgggaacggaattccgactccaaaaaggaaattggaattccgtgccatccctggtcacacttcattcccatttacgcgtcataaatttattgaaa

SEQ ID NO: 10026 - DNA, 3086 bp, Heterodera glycines
aattccctatttttcagtatgattgtaagacttcgttcaggcctaagaatccattcgtatctatggattctgaaggaatgggtggtgggtgggtggtcaggttcggatcctttcgatctaataattttatgcattttgggttttttttaaactttattgtgaatttttaaacaattcatctgcttcaaaagttacagtgccttaaaaaacggaaatatttttttggcgccgaaacgaccctggcgccgaaacggcgtcgccgaaacgaccctcgcgccgaaacggcggcgccgaaacggcggcgccgaaacgacccgttcccgtacaattggtatctaaatgttggggattaatcgaaggctttacttttagaagtttttgtctaactaattttgggttctcaagacaacagacaaaaagtcgggttctattcacaagtttacgggtccaatcaaagacaatactcagtttcttaggccatcacttttctcttacttgaccaatccaaacattcttggtgtcaatcgaaagcttgaagtctacataagcttaaatataaactcaattctgtggctaaaaccaacagacaacaattattcttgaatacacttgaaaatgcttaatttcgaatttggttttttttcaaaaatgcaagcaaatgttcttttcttgtttacacataaattcattaaactttaagctttcaattgaatataggtatgtaccacgaatgtttggaatgaccgagtgagaacaaaagttatggtcaaagaaacgcgtaaatttgcagtaaagtcgaagtttttgtctaactaattttgggttctcaagacaacagacaaattcttgagtaaactcgtaagagctgaatttttttcttattgtcagtttttgctcttgttttttaattcttgaggactacacttttgaatggaaccaagaaaaccgcatttgaatgagggatttgataaaaaaaagtagatgtgaaatattgggaatgtgggtcgttttggcggcgccggcgttccgacaccagcccgagttttaggacaaacttttttagttgccgacaaaatccaacaagcttggtatcaatcgcaacaagcgtatcatgttttggaagctattgcttcgcgatcaaacaatttcaaaaaagtcataaaatgagaattcaaaatagtcgaaatctttctttataacttttttgcatgcttaaaatagttacttgggttttttgtaagactaatagaggcatgtgaagagctttcacaatgatgtcaagattgttggatttggtttacaatgaaaaaagttgtaaatagtactttaagattttttttcgcgtaaatttgaaaatttttctggctgctcaaaagttcaatctttaggggtgtattttcaactctcgcctctcgtcccaaaaaacgagaggcgagagttgtcccacccctggtgtgtaccacaccaaatgctttttttggtctagcttttttgtacgaaagcaaatttttttgaaattaattcaggaatgagtagattttattttcgatcaccaaaaaattcgtgaaaatgtgtgtttttggcatggttgcaaaaaaactcaagaaatttttgtttaataaatttcaagaaaaaattctggtaaaaatgaattttttgcaaaaatttaccaatttttccattttttttttctaagttcgttattttttttttttgtaaaaaataaataggaaatctcaattatggaattatataattcatgtattaaaatgatcttttcctttttgactaaaattttatgggtttacaaatttttttcaaaaaatcaaactaattttctgaaattttttgtccatatttcagcatttttgccatattttgtccatattttgcgattttttcgtccatattataatccatattttgggttttttgtccatataaatccggtccctgttaatcaaataacttatttttttgctgacttaaatgaactcaaaaatacttaaaaagtgttcaactatttgactgttttttggtatttttatgacttgttttttttgttaaaactacgcgccaaaattatttcggaggcataaatgccacaatttgagctaagatctcttcgaatgggtctgctctgcgccacgggttttgacattttcgcgccagagaaattcgcacaaatacgagtcaagcatttggcgatgtgtgccgtgttgttttttcaccgccacagtcacatgcgcgctctctatggataatccccttttcttgtaggaaatgtgctgcggtaaattcatttgttgtttttttgaagagggttataaaattaaagctcattttattatcaatattgggggaaggatcgggttgggaagaatgaggggaagcacccttaggtaacgcgtattgcgctaatttattcataaaaatggtgggaaggcagaaccctttcgttattttatgcaatgggaataaagattatcacaattctacgcgcccgctgttgattttttaaaaattcaaattttggcctcaaaacggaaaagtacccaaaagacgaactaatcagaggggggagtagtatagaaatgcaaataagagaaaagaaaacaatgaccagtggggcaaggcataggacaaactaagccataaataaaaagcaaaaaataaataaaaaacaacaaacagaaagcactgcactgaatggccaattgtgcgacatgcgtaagcattggaaagaccaacagaacgaattggcaacgcgtcaacagcagatcgatacgttgagagaaaagctgacaaaatcggagagagaagcgcaaagagaaaaagtgcaaaagggggagagagagaaaatggagcaattaaatgcctaaattaggacaatttggaacgcaaattgcaacaatgggaagagacggcgagaagagaaaaggcgcaaatggaagccaaattaatcggagagaagaatgagcacagcaaagcactgatcagacgggagacggagaacaaagtgcgcgagcaaagggcggagggaatgttacggcaaaatgggcattttccaacaaaatatttctcac

SEQ ID NO: 10027 - DNA, 2881 bp, Heterodera glycines
ttttggtccagctggaagaaaaaaattttggtaaaatttttttttttatcaaattttttatgcaaagttagcattaaataaatagagaactatttaatttcttgtgccgagaaaagtctgaaaaagacaatgaaaatgagtaataaaatagaacataaattgaaatttcagaaatttagttaatccgctataaatttccctttaaagagcatatattcacattatgtctttgaatttaaaacttttttaaatggtggctgtatatatctagaaaatggaatactagcatgttgaatactgcagaaatgtttggccctcgacgaaaaacaatgaaacttttagccaagcattaaatgtctatttgactaagggtggaaattataaattacccaggaactacagtgaggtaaagtccgtatctttcagttggatgtgcataacgaaaataaatgcggaagtcaaaataaagacactgtgttttgtttctaattctgaaaatagggcatcaatggcctatgatattcattaataaactttagcgatattttaaaatttctcaattatattggccaattttataaatttgtttcattttggtcgggttattgtgggaagcaaaaatagtacggcttttaggcatttattattttggtcaactgagagaaaaaattttcggtaaaattttatttttatcaaattctttatgcaaagttagcatttaaataaatagagaactatttaatttcttgtgccgagaaaagtctgaaaaagacaatgaaaatgagtaataaaatagaacataaattgaaatttcagaaatttagttaatccgctataaatttccctttaaagagcatatattcacattatgtctttgaatttaaaacttttttaaatggtggctgtatatatctagaaaatggaatactagcatgttgaatactgcagaaatgtttggccctcgacgaaaaacaatgaaacttttagccaagcattaaatgtctatttgactaagggtggaaattataaattacccaggaactacagtgaggtaaagtccgtatctttcagttggatgtgcataacgaaaataaatgcggaagtcaaaataaagacactgtgttttgtttctaattctgaaaatagggcatcaatggcctatgatattcattaataaactttagcgatattttaaaatttctcaattatattggccaattttataaatttgtttcatattggtcgggttattgtgggaagcaaaaatagtacggcttttaggcatttattattttggtcaactgagagaaaaaattttcggtaaaattttatttttatcaaattctttatgcaaagttagcatttaaataaatagagaactatttaatttcttgtgccgagaaaagtctgaaaaagacaatgaaaatgagtaataaaatagaacataaattgaaatttcagaaatttagttaatccgctataaatttccctttaaagagcatatattcacattatgtctttgaatttaaaacttttttaaatggtggctgtatatatctagaaaatggaatactagcatgttgaatactgcagaaatgtttggccctcgacgaaaaacaatgaaacttttagccaagcattaaatgtctatttgactaagggtggaaattataaattacccaggaactacagtgagttaaagtccgtatctttcagttggatgtgcataacgaaaataaatgctgaagtcaaaataaagacactgtgttttgtttctaattccgaaaatagggcatcaatggcccatgatattcattaataaactttagcgatattttaaaatttctcaattatattggccaattttataaatttgtttcattttggtcgggttattgtgggaagcaaaaatagtacggcttttaggcatttattattttggtcaactgagagaaaaaattttcggtaaaattttatttttatcaaattctttatgcaaagttagcatttaaataaatagagaactatttaatttcttgtgccgagaaaaatctgaaaaagacaatgaaaatgagtaataaaatagaacataaattgaaatttcattctttcccctggttcaatccctctacagaaattagattattttcaattttttttttgtatactcgtgggtttcctataaagaaaatatgattcctcatagttttttttaaattgatacatattttatcattttttaaatgaaaatcctaccaattgagcttaataatcgcaaaaaccaacctttttttgttgaaaatctgttaacaaattgcacccaaatttttaaaatttccctcggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgattttttttttaaatttttaaaatttttttgaatttttaaaatttcccggttggtcccggttcccggtttttcttgcggtcccggtcccggtcccgaaaaaaatagaggtcccggtcccggtcccggcttctcaggtcccggcaagtcccggtcccggttttggcaaaaattcccggtcccgtggcactctaaaataaagcaatttttgtaaaatgttttggcatttttctaatttatttatatctttttgtaagaaggattccaaatttcaggtgcatattctaaaagaggacgaa

SEQ ID NO: 10028 - DNA, 2720 bp, Heterodera glycines
aatgcttcatttaatttttttttttaaatgataatttttttaattccttttagcaaatggttaaaatttcaagatattccattattgattccaacaatctgccgctcattgcttttccaacattggacgatataaatttgagatggctttttttagcttcgttagactttgtactttcgaatgataccaaaaagataggatttgttcgaacatgaacaaagttattgtataaaaagcatgtattgtcaattgattggacccataaagtgggcaaaggtctagtttactggtcccgttttttttttatttgaaaagcctggaaacatttttctagggctattttatggtgctgagcacgaatccggcattatttttgacaaattctgaacccctaacccggattcgaactttgtggatccgatcaccggcgcccatacaagccatgtcgagtgcttttggaagaacttgaaaatgaagttcaaggcgatgtcggggactagccgcgaattgttgcccagttattgtgacgaatatatgtggagacagtttacggaaaaaaatcattggcggcattcgacaacattgttgatcaaatttcccattattaccccgtgaatgcgtgatcaaatgatcgcttatatgcagcaaatcacatttatttaggcatattatatgcacaataaaaaaaaattttttgtttgaaaatatgttcgaatccgggttaggggttcagaatttgtcaaaaataatgccggattcgtgctcagcaccataaaatagccctagaaaaatttttccaggcttttcaaataaaaaaaacgggaccagtaaactagtttgccgcaaatggtgccatttgaattggtgaacgaatggacgaaggaaaagctgacattggccaaggcaaacgaaaatgaattggacaattggataatgaaacgatgcaaaattattggggagaaagaggaaaattgggacaacaattgcaacaatgtgttcttttggcttgttggtggcattgattgcattgggtgagcaattaaaaaaaggcatttgattttgtttaaataattcaaattgcgcttaattaaggccattgtctccgccaccggcagaagaaacgggacaaagcatcacaaaagtggcgtcttctgctgacgatgaatgagtgacggacaaaagaacgaaacaatggtgattagtggaagaagaaatgattatttaagaatggccaaccgatcataattcatcagtgatcaaatgcaatttatgatgaaaacctctcaatttcggtaaataaatcggacatgtaaaaatggcaaaaaatatatgtacgaaacaaaaattttgagatttgcacaaaataatcaacaaaaattgacttttcaggcagggatttccgggatcactgatcactagggcttccaattatatggaaatccatatttttttcctggacacgcaagaaaaacatgtttttagcttggtttgaagcttctaggatggatttctatatccatatttttccatatttcgcgatttatgtccatattttggcatttttctacaaaacccctattagaacggccctcgtcagctaaattggccgttttgaccccaaagactggaaaattttccgaaaaagacattttttaacaaaattttgtcgaaaaaattgattaaatttaaattttcttagaaattggttatttatgtcaaaaataagcaaaaaggaaaatttcggtttttttttgttggttttcattaaaaatagctttttttcttttaaaacgagttcttataccgtatttagccattttagatgtattttaattgaatttaatgaatttgaagaatatttttgaaaatttacccctcaattcggaaaatttatgtccatatttttgctattttatgttcatatttcgcgatttttcctaggttttattgccatattcagagattttatatccatatttttggaagccctactaatcactagggctgggacaaatattttgataaaaaagccagaaatatttacgaaaaaatatttttctgtaagtttttggcgggccaggacgttttcgcgtggttgcatataaaagagaagtgcaaaagcaactctaagcacacttattgatgtcaacagaagttcaactaatataagaaaagaaaatttacaaaagcctaaacttaggcctagtctaacaataagccattgttcgagttgcctgtgtatgagttgtcatgataaccttaggtttaacaacgaaatttatagttaaaaactttattgaatacctaacaaaaaaaagtttttctcttagttattaagacaactataataccatgagaccagggatggcacggaatttcgatttccgaaaatttttggggcctcggaatgccatccctgccatggacacaaaatgtcatgggacgcgtaaaatgtcatgggacgcgtaaagtgttgttgggacgcgtaaaatgtcatgggacgcgtaaaatgtcatgggacgcgtaaaatgttatgggacgcgtaaaatgtcatgggacgcgtaaaatgttatgggacgcgtaatatgttatgggacgcgtaaaatgttatgtgacgcgtaaaatgtcatgggacgcgtactatgttatgcgacgcgtaaaatgtcatgtgacgcgtaaaatgttatgggacgcgtaaaatgtcctgggacgcgtaaaat

SEQ ID NO: 10029 - DNA, 1133 bp, Heterodera glycines
ggctcttatgcagtttaacccacataaattttttttctcatttcatgattaaaaatgccaattaataggttttcggggtcgctggtcacgaatccggcatccgtttcgaccaattccgaactccggacccgaattcgaacaaaaaaattgagtttttttaatcaataatagttttttcagggtaaaagcttctaattcattatcaactatttaggtgtaaaacaatgtttcaatttttaattaaataaaaataagcaatttgcgccgaaaattgacaaactaaagccattctcataatgctattttgaaaaaacgaaaaaaaacttttttatattgatcccaaatccgcaccgtccatataattttgcagaaatttgaattttattttaaaaaatatatttaattttattgtcgaaacggcattgtcgaaaaggtattgtcgaaacggtcattgtcgaaatgtccaggagccacgaaaagggacatttttctacgggcggcaaactggccgcggcgaaaagtccacagcgaaaaagccgcggcgaagagtcgggggcgtttgggcccccgtttttgggccccagggtcgtttgggccccagggtcgtttggccccagggtcgtttggccccagggtcgtttgggccccaagtacagaaaaatgaaaaatcacagtaaaaacaactttttaaatttcagcataaaaatgtaaaaattaacagaaattcacgggttcataaggtaatttggacaataaaacaaaaaatcacgggttcattcgatagttgcgagaaattccccggagaaacacaaataatgtgaaattgattttttgaactcgcatctccaaaattttgtcatcccatcagaactcattttagcgaacgtgtaaaagtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacattttt

SEQ ID NO: 10030 - DNA, 2169 bp, Heterodera glycines
cagcaactcgagcattctggggacagaaaaagaagaactataagaagtcgcgcaagcggaccagccgtcgctgcaactccgacattgtgcacccgtcggacgaagtgtcgtcgcagcagcaacagtcgtcgtcatcgtccaccttgtcgcagcacaaccaccacaacgactgtgacgagtcatgcccgtggattgtgtggaaacactgaccgccacgcggacaccggcggacgggagcagcagggagaagacaaaacaaccaaaaaaagaccatgttgtgttgctgttttgttgtttaggaacgtcgtgttttacccatggacatccctctttgtctcttttctttaatttattttagtcgctattttcaaacagacacacaaacacctcccctttctcggacctcctctctatctctccccctccacacacacacactccccctcgttttctttgccaacccaatacaaaatgctatctcttctcctctctcgttcgctctctgttgttcgtgcgcgtacattattacacactctctcgtcgttcgtttgatgattatgatttacctaattgtttttcttttttgttttgtttttttttgaccacatttaggcggtccacaaacatctcaagttgtataacttatgtatttatcaaatttgtctccgatcgatgtaatgttatttttattattttcttttttatttatgtaatgcctattcgattttttttactatcagtttacacacacactttcgcctctccattcctcctccacacattgtagcgcattgatcaattctctgaccgattaattgattgattcaaatgataaaattcaaaaaaaaatgctttatcatcattattgttctctcttcctctcgctcgctctcccattgaacacggatatttattttgtcttcgtttattagtttcttgacacatccatcacacatacaattgacggacaaacaaacacgggaataaacacttgtcatccctacaaaatgtgaatgaataaaatcaatcacctgaccaccatcgcaccgcttaatatgcatgaaatttgaaaatgatgctttttgttgttcctcatcatttggcaatcattcttgtcccaattctcatgccatggattgtcgaattggatgaacttgatatattttttaacatttaaaatgctttcagtgaaagtcaatttatgtggtattaagttcgacaatcttttggctggtttgacttagttcggtgtataatttactaataaattgagcatttggcgccatttgaccagttgaattttccttcaacggattcttggattgtcatgtaaaagaatgtggaatttttgattgccccctaaaatgcggaattttaaaaagtgtcgttttttgaatggccagacattggcttaattagggttaatccacatgctttgcatcgtcgatttgtacatccgaaaacccattagaagaaaggcctcctctttttctccatttttctttcgtttattgctgtaaaacgtgtcgtcgttctcatttgtttgtagaacaccttattctagtgcgagtcatgcaacaaaagtgaccatttttccttaacattcattgtacgattttgttccgtattttaattttcccattaatttatctaatttgtcatttttcacacactccatttcatagggattgttttttttagaattgccgataaaacaattttttatttgcttttttttgccttttgtttctcgaggccttttgcttgtgattgggtcgattcgttggaaaaaatgcgaaatttttcaagcgaaacgcattgaaacaggcattgttgggggggggggtgcaaataatacaaataaagcacttggaaaagcaatggaatgtttggaataggttagtgggattttcaaaaacaatggtaaattttttgtataattcagaatgaaaaaaacactgtgaaaatgccttccgccaaaaaacctatcggaaccatgctaaagactaaaaaagcttttctgtcagataatgtcggcggtaacttagtggacaaaatcctaatataatgtgaactaatttggatatatgatgtgtagcaaagtttactgatatgtcccgtcttcgcatgctctctactggcgggcctctccacgcgggggactgggtc

SEQ ID NO: 10031 - DNA, 992 bp, Heterodera glycines
caaagctcggtcaacctccagaacagattattcgtgtcaaggtgtgttgtattaggcattccgcagctcactttagcagaacaaataaatcttcaatgtcatttccctctgatcatacctccccgaagagattccctatgatcagatcactttccactgggggagctttatttttcaaccctaattttttcaaaaacccaacaaaatcggtttacctcagttgggccggcacgattgggccccagaacttgtttggctattttttctttgtcaaccaaattcaacattgttagtatcattcgaaagcttaatatgtttagaagctttttctaagctattgcttcaccattagacaattaccaaaaaagttatacatgaaaattgcgaaaaagtcgaaattttgaagttttttcttaataaaattttttccagtcttgaaaattgtaaggctaatagagcatgtgaagagctttcgaatagtaccaacaattttggattacaaagaaaaaagctatagtgaaaaagcatgctgggacccaacggtgccggcccaactgagcgagtccgaacaaaatggcgatttttcgtaaactttttgccaaaaataacaaatttttccaatgcttttaataaaaaatgatatatttttttcaatttcggcaacgatttcattaaataaaatattttcaacggtctgggaatagtgaaaatgataacaaaataataaaaatttaaacttggtatccaaatatttgtcgaagcatcgctttgttctcagctaatcgatttcttaaaattccctaatattctgtgtttctgattaattccaaaattcttgttcgtttaggaataaaacgaattttttgttggccgattcttgggacatgggagcacagcaacggaatataaattcacgaaaatacagatttttttaatcagttcggagttgaaagggcctcaataaccgaaaatttgcccattctcgacagagg

SEQ ID NO: 10032 - DNA, 4972 bp, Heterodera glycines
  misc_feature (92)..(92): n is a, c, g, or t
ccaatttaacaaaaccgcttatatcaaaggcataaaaattaagtcttatgtctaaaccggtttacctcagtgggcaagcacgggttgggccncagcatgtcatacatgaaaatttcaaaaaagtcgaaatttttgaagttttttcttaataagatttttttaggctttaaaatcttttggcttttagtaaggctaatagagcatgttaagaactttcgaatgataccaagattgttggatttggatgacaaagaaaaaagttgtagaaagttaaagtggaaaaatatgctggggccttcagtcccaaagccattttgccacttcagtcccgggtctgtaactcttcagggagtggttcccgccaaaaaattctttcattagagaccgaggggagtcgattgatatataatttctatacattttcaatcccgtcagtattcttcactttttcctttaattttctttgttcttgagtggcacttttcaatattttcagttggaccgtaggaaagtgttcagaactttggcccgcgcgggcattgaccacccgcggcattgcgtgttggtcagaaacgaaaaaggcgaatgtctgtttgggttccaaattttgaatttgaaagcttgttaagtaatcggagacgaattatgtgaatttgccgatcacattgaagtcaacggaatgactttcaataagcctttcgttgaaaaacccataaatgcggaggaccacaacatttacatctactacccgagttcggtggggggcggttcgcaaaggctgttcagaaaggtggccgaatcaaatttggccaatttgtgacactactttcggttgaggtcaatgatcggagcagttggtattccccggtgagcaccgttcgcacgcagggttcttatatttacgaggagttcatccctgccgatgggacagatgtcaaagtgtacgcagtggggccgtactatgcgcatgccgaggcgagaaaggcgccgggattagacggtaaatttaattgggatacttttgataataaatctcaatctcttttctcagggaaagttgaaagagacgcggatgggaaggttttgtgtgtattttagcatttttaaagtgaaacaatcctctttaaggaagttcgataccccgttattctaagtgctaaagagaagacaattgcgcgaagagttgtgttggcatttggggtaacaatggcactttggccgatttgctgacgataattgacgcgacatacgctttttttagcaaagtgtctgcggattcgatttgctaagagccaacggctgttcgtatgtgtgcgatgttaatggattttcgtttgtaaaaacgtcgaccaaatattacgaagataccgctaaaatactcggcaataccattttgaggcgtttagcctcttcgctgagcattccttggcacattcctttccaagatggtcagcctttcgtttggtcaagtattaattaccaaaaatttccttcttcagacgacccgccattagtgtcgacgcccagtggcaaaataatggaacttcgctgtgtgttggctgttattcggcatggagacagaacccccaaacagaaaatgaaagttgcggtgagggatgagcggttttggacatgttcaaaaagtatgatggaccgagaaagcgcgaattgaagctaaaaaagccgacgcaactgatggaaattctcgaaattgtgacaatttaatatttaaagttcttttaactggatttattctgctaaggtgagacatttgcttcaagaaagtctggagaaacggcaaacactgctcacaattagcagcaaaaatatggcgcgttttcttaaagacaaacgcgacgatttggccccagcagaggaaacttcggtgatgaacgaattggaaaagtgcgaggaggtcatcaaaacgtgggagcaaatgcgcgcggttttggaaatgttcgtaaacaaggcaattgtgaagattattggtcccacaaaaaaaataataaaaaagccatttttaggggttatttgatgcgctgagcacgaatttgatcttttttgactttgtttcgagccccaaaccctgattcgaacaatttttaaatttattttttatttaaaaataaattatttttaaaaagtcatcgaaataaaagtctttcctgaggttttcaaggtcgctgatcacgaatcagatacgcagaaaataaatcacaggcagtgttaacagcaaaaataagtcattctatgcggatattttattgtacgggctgatcttgatccaattccccccccccaaggattcgaatagatgcaataattagctggaaatattctgattagcagagtgattgaaattattctgatggaccctaagagcggttatgagacgcgcaagattatgggtaattattctgatgtactataattatcggaattatatctgacgagaacctgaaaaatagtaattattctgacgtgtaccagaatgagcggaattattctgacgtgtaccagaataagcggaattattctgatgtaccagaataagcggaatgattctgacgcgtgcaagaataagcggaattattctgacgcgtgcaagaataagcggaattattctgatgtacctgaataagcggaattattctgatgtaccagaataagcggaattattctgacgcgtgcaagaataagtggaattatactgagaataagcggaattattctgacgtgtaccagaataagcggaattattctgacgcgtgcaagaataagcggaattattctgacgtgtaccagaataagcggaattattctgatgtaccagaataagcggaattattctgacgcttgcaagaataagtggaattatactgagaataagcggaattattctgacgtgtaccagaataagcggaattattctgacgcgtgcaagaataagcggaattattctgacgtgtaccagaataagcggaattattctgacgcgtgcaagaataagcggaattattctgattaccagaataagcggaattattctgatgtaccagaatagcggttctgacgcgtgcaagaataagcggaattattctgatgtaccagaataagcggaattattctgacgtgtaccagaataagcggaattattctgacgtgtaccagaatgagcggaattattctgacgtgtaccagaataagcggaattattctgatgtaccagaataagcggaatgattctgacgcgtgcaagaataagcggaattattctgacgcgtgcaagaataagcggaattattctgacgcgtgcaagaataagcggaattattctgacgtgtaccagaataagcggaattattctgatgtaccagaataagcggaattattctgatgtaccagaatagcggttctgacgcgtgcaagaataagcggaattattctgatgtacctgaataagcggaattattctgatgtaccagaataagcggaattattctgatgtaccagaataagcggttctgacgcgtgcaagaataagcggaattattctgatatatcgacgaaaaataccaaatttaaaatactaaaatgattctaagactatttaattaatttttatggcattttttgcctatttcatactttacgggtattttttccaaaaaataaccataatttttttttacatatttggcgttttttgtacatattttggggtttttctttcatatttatgtacatatttgggccactttttgtatatatttttggcagccctacttatttgaatcctaatgaaattttttgaaattttgcaggctaatagaggacacataaggatagcgaatgataacaagataaaagatttgatcagaattttttatgatcaaaataattttatttttaattaaaaaatttctgttagaaattatttttgttttttatttttttgctattaatcgatagccctacgtgtcctctattagcctgcaaaatttcaaaaaattttattgagtttaaaaaaagttatggtcaaaaatgtgtgaaaacttgttaccttgcgtacttttggccatagctttgctcaaacttgaccaaattttttgaaatttagatgacttgtagagaaatgttagggctatcgaatgataccaagaatgtctaatttggttgacattgacaaaagttttgagcagttttttgttgaaaatttccatggttttttaaataacgccctttttcaatgctaatgttagtcccagcgtaatataataatgaaaatatagaaaaaaggatggcatttacgtcaaacaatgatcgatgaatcgccattttcttgccatttatccaatatccacgttcttttgccaccctctatctactgctttacttccatcttttctctttttttgtctataaatttcgatttgcacaattacaattattcatttatgcaaatatttattttgttttattttatttcccctttttcattttagcattatgcttttcctcctcctctccgtttgcctttttgttggactttttctgcccgtccatcccacagattctgcccaaagttcggccagtagcagcggacaattatcatcgtcaaattttgaaaaattgtaggaaaataaataataaatgaataataattaatttccattaaaaattcacacattttatgttcatcggaatggcggatgccgtcacatttgtccaagcttttgaccacctttcccgttcaattcaaaccaaaagtgccaacacaccggtgagctatcagaaggaagcaaacaaaatcgatctgattttcaacatggctgctaataaaggaacttacgaaggtgagcaaattaaataaaaccaattaattaattacacggcgattcaattttgggctcccagtgcaaataagcttattattatttagtaatcagaacgccaaaactttgcaaaactt

SEQ ID NO: 10033 - DNA, 1568 bp, Heterodera glycines
  misc_feature (1528)..(1528): n is a, c, g, or t
gggagggacaacgaaacgaagacgacacgacgaggacaacgataacgagacggacgacatggctttggaatgttttgtccccccgggggaaagcgccgatcgtacgccccccaacccccctcaccggatgattagggaaaggaagggggggggtgaccaaccaacagaagcggaagaagcaatgttagtcaaagaattacagaggcttcccagatgaactgctctgcccaatgttttaagtttaaaatatcaattttaaattgaaaaaataaaactaaatttaatggttaaaattgggaaacttttttaaaagaataatatttctttggatcttttgttattgtttgagaattatctctttcttttcttttcaattctcagttcattagaaattcctttgttgttttaaaatgagtgtaattctccaattctccatttgttaaaataatgaccgcatgaaaaattatttaaaaaagatttcaagcgattttacaacaattaaatatctccgccctttttaattcgagaaaataaattttttaacattttcatttggcttccccctgccatttgccttaatgatccaataagtcacgaaatgattgtccaccatgtcaatctatgcccccgcgggcaaattggcggggacttgatttccgcacctcccccgccccctcctcgccgcttttccccgcacttcgcccattgatcgataaccttccgccgccgtcgttctcgtcaattttagcccatcatctatctcatctcatctcatcatcatcatcttcgttcgcccgctaagcaaaatttgcataaataaatcattccctcgttttttgttgccatttttgcgctattcattttatgttaattattattggccaattaaatatacaaaattttctaaatattgtttttaaatattttcttttttaaatttatttgtggtttcaaaatgacccattgtaaaattgcaaaaagtacaatgatttcttgtgtctcttgtcgctgattaaaatccaattttgctaaaaggttgtcgcaatttggcaaattatttccagcagacgatggcatttgtgtggtagatttttggactaaaattttttttagccttttacaaataacaattttataatttttttttcattttttgacaatttttcaaattaatttttatcagtcaaaaaacagcaaaataaatttttaattgattatttgtaaatttttttaatttttttattttacaacattcattatttttatattctgtaaatatataaatatttataatatacagaaattttgttttcgttttccggcatttcccggaatatgtgtcaaagaaatgccaaaatattgtgaaaacatttaattaaatggactattatattttggatgagaaaacaacaaaagatggcacagcgaaattaaaatgaaaacaaaaatatttttgtttaattttttctccatttaataatgatcatttaaattatcaccccattaatccctaagatgcttataaatnttacggtacacaaattgtttttctttttttggcatttaaa

SEQ ID NO: 10034 - DNA, 4131 bp, Heterodera glycines
  misc_feature (3954)..(3954): n is a, c, g, or t
  misc_feature (4070)..(4070): n is a, c, g, or t
  misc_feature (4075)..(4076): n is a, c, g, or t
cgaccagaacaataagtcaaaggaacgtccgtcaatttgcgaagaatcctttgtcattgacatcaccgccatcgaaagtggtttggagagaaagaggttggccggaaaaggaagaaacaacagctttgaaattccgtacaacatcagcgatggagcgacatacaatttggaaaataacgacaatttttgcctgttccgtgcatttgaatggcttcgcatgaaaaatgttttgcaacaacaacgattttccgaatacaaacgtaatgaaagaaggcagctgagcgacattataaccttatgtcgggcttgtgggatcaacatgagcctaccttttttctccattgaagaatatggggagagaatccaggtaattctaattacgcaataaatatagttcttcttctaaggcttattatgaccgacttcaccctggaatgtatcgccttttctgcttcggaacttttgggaaaatgaagccactgtggaagtccaaagacatcgtgtataaacaggagctctgtgtgcttttcactgaaggtgatgcggggcaagcaggccactacgacccaatcaaatcaacaggcagattatttggtgccaagacaagctattgttttggggtaatatatgtgtgtaaattgagtataatgcaaatatttagtgcgaaatgccatacacacaccagacccgtcacaacggaaattgcaaatggaaatgtcgcaattgtcaacgagtaggcaaaacctttcgtgggacctgcagggatagtgacttttgtttgtcttgcctcggctgtggaaaggtatccgcataatttaattaaataaacaaacccttgtgcagacctttgagagccgtgaatgctttgaacaccatgcaaaggttatcaaagcaacaatcaagaagggggacaaagaagtgaaaatagagaaatcaatgtgcaaaagctccagaaaatgcgtgaaatgcggcgttatttaccgcgcaatggtctcttccttatctttcgttttaattatgtcagttttcagcaccaggacaaagagagaggtcacgtctgcggtcataagttctgccgcgtgtgtctcggattccatgcacctcgtgactgctacattccgtaccgcccaaagaagaagacagagaagcgaatcatattcttcgactttgagtgcacgacggatttccagccagatcctgaaattgcccgtttcaaacatcaggtaaaaaaattcccatatttcagtaacatagacaagttttaggtgaatttctgctatgcacacgtgacttgcacgagttgcatcgagaagggaatctggaaccagtcgctggagcagaaatgcggaatctgtggcgactaccggacgtacgcgtgggcaccattcgacttctacaacaccgaagttgagcgccgcttccgtgttgacgacccactggcatcattcaccaaatggcttttgaacttcgagactgagacgctgggactcgatcacaacgagcgtggaaagaaacgcaagcgcaccgttaaacagaataacaacaacaatggacaggcctgtttctttgacaacgaagccgaagatgatgaagacagcgacggcaatgatgttgagaacaactacatgctcggatacgatgaaggcggagaaaaaccaagatccgtgaagacctacgcctacgcacatgctggtatttacgaattaaataatcaataaacaataattcaggctcgcggtatgaccatgtgctcatctttggcgagatgctacgcatgggtgttcgccctgatcttgtccgtcaaggaaaccatctgctggagatgaaggcacataagaagggtgccatcacgacaactatcttccgggacaggtaaaaattatggaaaaatggcattatttattatattgacaaatttcagctacaaactcattccactgaagttggcctctttcgtaaagacgtttggcttgaacatcgatggagtggaaaataaaaaatattttccgcataagtttaataaggtgaaaaaatgaaaaaaaatatatatatatcaaaatccaataaaattttaggccgtcaattatggaaacgtcttggaaactcttccaccgcttgaggattactcaccaggcagccacttcccagaggagcggatcaaattggagaaatggcacgctgacaacattaacacacgctttgacttgcgagagatcatcgcagactactgcaaaactggtaaaattatgatacatttcaaagtattctgcgaaacttcagatgttcaaatcctggtacatggtgttttgaaaatgcgagagctcttcatggccgagacaatgcatgatttaacagattcaatcaccatcccggtagctgagaaacgtgattttttccaataattttaaatttcagtctgcctgcatgaaatactttgtagcactgtcgtaccaggataatgaacgcattgccattgtcccccatcttggttatgaaaagaggggaaagcagagcacaattgctcgcaagtacctcaaatggcgtgcgggggaagagatgcgaaacaacggctggacactccgcttcattgaaagccccgggggcgagtacaaatatggcaactatagcctagacggaatgatggagcgccctggaatggcgaaaaacctcgcgatcgaagtgcaagggtacgtattttatttaataaaaataccatcaatgtccgattatttaagctgctattggcatgcttgccccaactgttttcctgatgaggaggcgattgttggcggtggagagacagcaggtgcgatccgtgcgagggatgccaagcgtatcaaacaaatcgccagggactttgaagtagagatcatttgggagtgccacctgatgcgtatgctggaggaagatcctgcaatgaaggccttcttcgataacacgccggactcaggccctattgaattccgggacgccttctttggcggtaaaattcggctagttttttgtaaaacattccaaaatttaggtcgaactggacccgattggttggccatgggcatgatgaagccaaacggagagaagctgaaccgcagcatcaagatcaaagacttcaatagtctgtatccatcacggtgagctttataaaaaaattaaaattatgtcaattcaaaggaacatgttcaccaaatacccgattggccaccccaccctgctcaaaatggacaaaaacgtggaatggaccaagccggagcatatgattgataatgatggaataccgattgaggggatcatcaagtgttttgtggtgccaccccgccactgcttgttagacatcccggtaatcccgttccgaatgaacaacagaactctcttcatgctctgtcggaggtgctctgaaatgtatccaaaaggccttgtggaccctgattacaactgtcctcattttgaggaccatgaacgaggtaattctgtgtaaataattaaaatataatgcctatttaggtttttcaaccaccattacacacattgaattggaagctgctctgagagcagggtaccgagtcacgcgggtcttcagtgcgtacgtgtggcgacgtgcatgtgattggagcgacacattgtttcactcgtacctcttcaaatttttgaagataaaagaagaaggttggttgtttgtaacataaaattattataaaatgcttaagcatccgggtaccctgccaaatgtttggtggatgggatctcggaggaggagagggaagaaagacaacagcagcacattgacagctgctacgcaaagagcaaagtgcgtcttgaggcagccagaattaagccaaatccggggctccgctatattgcaaagctatgtctcaattccctatggggacgcttcgcactaaggtaaataactcaacaaaaaacataaaaactactgcacaggaatcggctgaccanaaccgaaattgtcgacagcaacgcagacctcggaaagctgctcaacgatgataagattgactcagtagcctcgacaactgacccgatcgggtctggatggtctgctataagacaanggatnngacatgtgtcgagcatgacacaagcaacgtaaaacatattgacttttactttaaa

SEQ ID NO: 10035 - DNA, 1652 bp, Heterodera glycines
  misc_feature (45)..(45): n is a, c, g, or t
aaattattattttgcgcaaaattgtccctctaaaatttatttttnagaaaaaataatgaaaaatttgctgcccgaacgggcagagagtgcgtgcccctcattaattagcgagttaagtagggctgttaatgagctgcagcgacactgggaagtgcatggaaccacttattttttaattaattaatgccagtggcatttttttggcatttttatttttttgcaaaaatttgtttttacgtaatttttaaaacaagttgagcacatttcagtgtcttgaagaagaattgtacacaaaatggacggacgaagaaattggcgaattcatttattcattgtgtatttaaaaatgggctaattagcgagtgatatttattttatattttattttaattagtattaaatgatatggattttgaaatttaatttattaaacataaattaatttaaacatattaacttatttaaatgttaactaaattaagaaatgattaaaatgtttgcattattgaataatataaaatctaaatattaataatcgcataaatggaaccaattaaattatttaaatctttactaaaagctattttaaaatgattgattattaacagggctgcaaaaaatattcaaatgaatattttttcctggcttctccatgctctaaatagtaagaaaaacactttcttttttgtgtttgcgtataaaagtcggaacttttatttgcatatttttgcatattttaagtttttatgcatatttaatgcatattttgccattttttgtacatattttcagattttttgcatattttgccatttttcgtcaaatattttcagatttgaatatctcttaggaaaaatttttgaaaatacctaaaattaaatcaaaatctgaattgatgcgcgagtggttaacagtgagtttcactgccgaaaacccttgagaaattttgatttgaaattgcaaaaacaagcgatataatttatgaggaataaaattttttatttattttttttgtgcatatttggcaattttatttgcatatttatgtacatattttggtcatttttcgtgcatattttttgcagccctgattattaataataaaaatttaaatctattatataaacgaacataactatcgcctttttcccaaaaaataaattttaaaaacacaaattttgatttttaaatttagcaccaaattttaaaaatggtgcgtctaacgccaacaatagtttttgttttggcattgtgttgtgcctggcttttaaccgatgcccaaaactacggagcgatgattgcaaaatcgcaaaacaagcgggagacggaccaggaggagacgagtgcaacaacagaagcaacgacgaaggaaacagaagtgacagttggcgagcagcaggacgaagtcattaattaatatatgctaattaaaatggaaaaattaattattatttttgggcattagggctaaatagtgtaccaattcaactaatgacaatcgagacttaaaatgattcgagaacaagagagtttgtttcgagaattcggcatcgaaaaattgacccacctgagacgcgagacagccaattaaaagaatttactaaattcaaaactcaatggatttgttatgctaaatcaaaatataaattttg

SEQ ID NO: 10036 - DNA, 2963 bp, Heterodera glycines
  misc_feature (2818)..(2818): n is a, c, g, or t
  misc_feature (2830)..(2830): n is a, c, g, or t
  misc_feature (2852)..(2852): n is a, c, g, or t
  misc_feature (2859)..(2859): n is a, c, g, or t
gtccttttttcattatgaaaatgagttaaagcagaacatccgaaatgacatttgatcagcaacttttacaattgtttaataaattgtttttgacaaattttaatttaaaattttgaaaaaaatttaggcgacggaaagccaaacacaaacgaatgcaaattgaagccaaaacctggccaaaattacgctgaaccgttgcgaaaagctgtgcgaaaagaataccgacagttgagcgacgaggagaggggaaaatatgtgagaaaattggggggagggcattaaaaattaattaataattaaattgaaaaataataaaataataaaaattaaatacagtatgacacaaaattgtccatttttggctaatccattattcaatcaatcgtaaagccatcatccaaaggacattttgttgagaattttgtgctctttcatgagggtttaaataatttttacgaaaattttttccaacccccataagaattttattttctgaaattttcccggtttcaagtaattttctggttttcaaatcaccatgaaggaatgatctgaccaaattagtaaaagaatttttttttgattagcttccaaaaaataggctcacttgaattatctcagatttttggggcggctttttctccaatcttgtggttttttgaaagtgaacatatcattttaaatcttattcttttggcattctgcttggcttgcacaatttcaaacaaaatttgtccggtagaactgtttaatgcccaaattcaagggtgaacggtatcattttgtgtcatactgtacctttgaattatttatataattaaaaaaaataatttccatttaagcatgccgcgttgaaagccttgaaggcgagcaaacagtacgacacactcgcgatcatccacaaaaatgtggacgggtcgggcgccgcacattcggggcccgcctttttgccgtggcacagggaatatttgaaaaggtgaaaattaaaaaatataatgtatttaattaaaattagaatcacaaataattatttccccgaagaaacatggctgagaaatttcgtaaatccgccaaaatcgctttttttagcaaattgtcatataccttttcttagatttactaaatcacaaccttcatggaattatttgatagacctaacttttctcaatagtccgaaattttcaaaaactgaccaaaaacttaaaaaaatgatttttctttttccttaggtaattaattagattgtgtttttattttaaatatttttgtggacaaattacctaacttgtttacaagaaaatattgtgttcaactgatttaatagaaaatataattacaaactattaaatgtagcaattaaatccaattaaattaatattagcaataaaaaattaatattaaaaaaaaaattaaaaggtacgaaatcgcactgcgacaaattgacccaaccgtcgcattgccttattgggactcgtcgctggaaggccatttgccgacgccggcggattccattctgttcactgaaaatgtaaagaatttaattagaaatttaaaatttaatagtatttaaatttaattacagccgaaaaaagtcaataaaatataaatgttttaagtttgctggtgaaaacaacaaaaaaggcgaaattgtgagcggcgactttgtcaactggagaacctttgacgtaattaacccctagtgaatttaattaattaatcaattaatgcattaactttttttaaaagtaccaattttacaaattttccgagaaaaactgatcataacatctcttagacacaacaaaattaaataatcttggcttcatacgatagttagtgggttgctctattaactaaaaattttcaggaaattttattcaatttttaaaaaaaccatggcaattttttcaatcttttcgctaacaacattctggaaactgtctgaaattttctggaatttatttggctaatagagcaaaccaagagctaattttccaagaaaaatctgaagaaaattggcacttttacgaaacgaccgagcaccactttttaattaattaattaattaattaattaattaattaattaattaagatttatcacatttcagggaacccgaaacctgaagcgatttgtgggtgaaatgggcactttgcccaccgacgaagggtaattaaggggcaattaatttttaacctttcttgtattcaattaaaatatattttaattccagtgtcgaatcattcatcaaccacgacaaaattgagattatgtttggctattccgcgcctcaaagagtcatatttaaaaaaaattttttttttttttgagtttaatttttagggctgcccatttttcgaggtccgatacaacgtcattgaagtgaaaatccgttgatctaattacctaattaattaattaattttttaagtatttccacggtggcccgcatatattcgtcggaggagagtaaattatttcggactttttaaatccattaaacgttaaatgccattggttttaccaattttagaagaatttaatttttgaatcattgccaagaattttgggtatttttttaatttttgggcccaccgatgtttttgggggttttcggggtcgtgaatctggcactaattttgactattccctaacccaaactcgaaaaaaatatccaaaattctaatttttcaagttgcgactttttgttgaagtttggttagggattagaattggttaaattaacgtcatattcgtgatcagggacctcaaaagtattttttggggagcctaaagtaaaaaagtaccaatttttgantttgaaattttnaattttcatttaatattttaanttaactnatcaaagtttgaattccgttgattaaagtatgcatttaattatttttaattacctaattaccttggagagtaaagcgaaggcgacatgggcgacattccaaccg

SEQ ID NO: 10037 - DNA, 3484 bp, Heterodera glycines
gtcgaatttactcactgtcgaaatggtccagtgtcgaaaatgctggaaaacagtgagagtttttgaaatagttcagtgtcgaaatttctctatgtcgaaaacgtagtgtcgaaattacttagtgtcgaaaatactcagtgtcgaattagcgatgggtttgaggaaaacgggtgttacataaataaataaattaacccaattttttctttttattcagcaatgcgcaagtccccagcatttctctgccggaccaatgcatccgttccaggcattttttatatttaattttttatagaaaaaacgattattatttattttaaaattttaatcataaaactttaattaaaatattttttttcaatttagccttggcagaacattgacggattggtgaacaaatacacggacaacatgtacgaatttgcgccccgtccgagctgctcaatgggcccggactgtggatcgaagtaaaaatatttgaaaacataaaaatttattaaattaacaaatattattaaaattttgataaataataattttaatatttaaataaaataacaaatttaatatttaattaacaactatttttaaaatttgatagaataataaaatgaatatttaaattaacaaatattattaaaaattttcactatttttaggtatttgttctgcgaccgttcccatggcaagccccgatgtgcggccaaagtccgaccgaatggcaattgtgccggattcactaatggcacgaaaaatttgcatttaaaattttatttataatttaaattataaaaatgatgtttaattcaggtgaagatgtttgtctgaatggcgaatgccaatatgggaaatgtgtgaaaaaggtagcaaaaattaatcagacaaagtcacagcggtgaataagggctctgaaaattgcggcatttttgatggaaaaatcgcgaaaatctcctgaattttaatcgcaaaaattttagttttgtttttaaattttataaaaaatatttattcaattcttagggttgcgacaaacttcgtattgtgtaaaaatttcttttttttcaatccaaagcaaaacaaattatcgaaaatttcccctacacacgcaaaaaaattaaatcaaagaaaaatgttttaaaaaaaaaatttttttggaaaaactccctggtttgggttcttaattttagaattttttgagcctaaaaaccggcccggcaccggcaaaaccaaaacaacaaaaaccgacaataattaaattattttcagtccccaccgccaaccacgccaaaaccaccgccaattgtgacagtgtcacccattgaggtaggtggtcaaaaaaaaacccagagttattatgaagaatatatattccatacatagtctggcttttatttaaccaaccactaattacggaaaatccctaattatctccataattacaaccataatccgtcattatcatagcaccaagatgtgtacagcaaaaaatttgctggcggagatatatttttttaattttttaatccgtcccttccaaaatagaaaaatcccagaagaaattacacacatgtgtgctttgattttttggttttattttacagtaatacaattttcattttttgttaattttttaaacttttaattccctaattatttaatacgctaattaagtcgccctgctttaatgagcacgaatgttgcgcgaaatgggcagccgacggacagtgcgaatcgaacagcgaatacatgagccaattttgcaaagccagctgcaaaaaagtaaataaatgttgttcaattagtttttaattgatttttaattatgcttaattaaatgtaaattttaacattaattctttagtgccaatattcgtacaacatgcaagagggtaaaaattcaataatgataaacaatattaattttatttattattttatattgaaaaatttaaacccatcatttttatgcttaatttgatatgccagcagttcatattgttcagaatgtgctgatcgtcataaaaattgcaaagctttgtcctaccaaatgaaatgcgattcaagctggatggtatccgttttaatcaatttaaattttatgaatttttatttaatttataaactaattattaaaaaaatataaataatttttataaaattattccgtgtaattgcattttaaggctgaaaactgtcgaaaatattgcaacaaatgcatgtaaaacgtatgcaaacatgcgctggcggttccccggggggagaaaaacgtaaaaaaaattcggaaattaattttattaatttttattaaaatatattagccacgctttcatatggcggcaacaatggtggctgtaaatcaaaccaatgctacaacgaaaatatttgttgtcaggtgaaaaagaaaaataaaatttctaaaaataaaattttttgatttttttaaatttagaacttttaaatacaaaaaataataattggttattgtacttatcaaaaaatatttaattacaaatttataatcctttatttttatgggtggaattaattgtgcaattaattggggtaattaataataaaattattgtacagcactgggcaatgaacggtggatgtaagaagaattcggaatggatgaactgcaactgtaaagtgagctgtggccaatgcatcccacgaaactacaaatacggaagtaagtaattaatatatgaattaattataattacctagttcattaattatttattatttatttaattatgcataataattaaatgtgtatgtgcacggttaacttttcatcacttattcattaattatacatatatattcgaatccacaaattaattatgtaattcggttaattaagcgaatcctcaaatatgaaattttcagaattattaactaattgactaattagcaattattggcaatttgtttttagcgtgctccgactatcacccgaaatgcttcaaatgggcaaagcatggtcaatgcaaatccaacggatgggtgttggcgaactgtcgccgcagttgcaactcatgcgcaagcatttggcacatcaaaaaggtatttaaatatattttttaaaattttaattgattaaaagtttatattctggcagaaattcagtttttttaataatttaatataaatttaattatctttattaatgtttaataaatttaaagatgtgtgccgatgggagggggaagcgcagtgttgatgaccatcacttatgggcagacgcaatggaagagacggtaattaattaattaattaattacttaattaggccgaataaaaatgaaaattatgattctaaaatatttaaaaaatttcttttccattctcattagccaatttctctgttgcgcatggcgcgcgaggcggagaaggagcagaaggaagagaaaaaggaggaaaagaaagaagagggaaagcaggaagagaaaaaagaggaaaaaactgaagagaaaaa

SEQ ID NO: 10038 - DNA, 4414 bp, Heterodera glycines
attctttcgcccattccaaattgtttcttccatttttgaattgttccataacttactccaattttcttacaaatttcttcataattttgactccattcttttgtcgaatattttcttcctttttgcttatattcatttttcattgcattaaatttttgaacaatttcaattttttgttcatcctgggcatcgtcatgaacatgtttttgcggcagggcatccacagttattatgactgatgctttttgaacggcaaaatgactacgggagtgaataatattcacaatttaagatttttgtggccaaaaacatcagtcactttaaatcggcatgccgacacatccatatagtaaatgacttaccaattaccgccccgagttgatttaccggtacttccggatttggtcacccgttgaatgcttcttccattgtaaattactcattggcatactccaattttcttgcaaatttctgcataatttaaattctgtataaattttgttgctattcttttttcgaatattttcctcattttgtttatattattttttcattgccataaattatttaacaatttaaattttttgttcatcagtttttgatttgttatgactagggatacgatttataggtttttcactatttttttcctgtgctccacgtggcctgaaacacacgaaaaacgtgttttttcggctgttgttaaactacttttcgagttattagcaactattttgggggttttttagaaactaaaaactaatttttatttctttttcgggattttcgtgcctttacttttttcaattttttggtccctattatagtgcctttttcgagatttttggtgttttgttgcctttttagtcgtgctctagtaatcattcaaaaaaattaatttacaacatccccgatgttgaagcagcagcattcaaggtgatgttgagcttcattacgtagatgatttgagtgaattgaacgaagacaatactggcagtgctttacgccgatgaattattttgtaaattaaatatgtaaaatattatttaatttttaattagccaaaaagtacaatatccctaaccttgtcgctctttatttacaagtttccatttcaaaactgcgcaatgttttctttgcatatgctcaggctcgccttttcgacttggagttgcggccatcaatcgcttagcttctgcttaatcatctgttctaaacatgaaaagcattcgaatgataccaagttttaagaaattggccgactaaacaaaagttatggccacatcaatttaaaattgtacgagttgacattgacccatgtaatttaggactttgtgcattgttatttgagttacattgacaaaaatgctgacactttgttcaaagctgatgcttttttgcaaactgaccaaaatttattgtgtgaactttttggacgtgacgatttgcaaatccgtgaagaaatttcactttggaaagctgtacattaatagaaaaagcaaataattaattagggctatcgaatggcaccaacaatgttaaatttggttggcaaagaaaaaagttatagccaaaaacttgttctcgtacgaaaacggcccgtgcaaaaacgaccccgacccccctttttgatggtttttatataacgagtcgcaaatcagcatctttgattttcatcattttcacattttaaaagttctgaaaatagataaactaatttatccctattaaattttcagtgttatggcattttttaccttagggattttgagtctaaagccgacctatttttagttgggcattagggtccgaaacttggtgtttatctgtgccgaaataagcaagaaagtttctcgaacccaactttgattataaataatggtatttaatccttttgttgatttttaaataaaacctttaacgaaaaaggcagattcaagcacttttgatgaaaccaatttttaaatttataaaaaaatgaaatttttttttaaaatatatataaaaagcaaatcaattttttatcggaatggttaattaaaaatgcggacatggagctaaaattatctccttaatgttttaatccccattaaagaacaaaatgtttcttccatctttcaattgctctaatatttactccaattttcatacaaatttcttggttcgagaatttatgtatatattgaaaaatttaattttgctttcggccaaatcgttgtccaagctctaatctcaaaaagttaattattttttaaatacataatcggaattccagtttttttttagcaagaaccccgggattaatgtggaaatttttgataaatcagaaattattacacgacgaaaccacggctttttctctatattttataaagaccaagcaattttttagtccagaattaacgtaacatgatcagatgaagctggccatccactcaatattaaacagactgatcaaattgaaggactaagaaaaatcatatacaaaatgattaataaaataaacacaaacaaagagaaatgaaaagttcagttaatgaaaaaacatatgctgaaacaaatgccggatgaagctgttggtattggcaccaccatggcacggatattattggcattgtatggctcgtcccttctatattctctataccattcctactaatcatatacaaaacagggatgggctttcgctttcgcgtttcgcattttggcgcgaaacgcgacataagaatgagagatgaaattctcaaaaaattttcaaaattcaacctaggctaactttcagtgaaacctgtttaaaaatggtcaaaattttcaaattttccaccggcggcacctatcggcactgccgtgccccccaaaaaaaaatcgatcactaaaaattaattttatccaaccctaaaaacattaaaaaattatcaagtacgaagccgaatgggcttggaaaatttttcagaaaaaatattaagctagcagtcatttttcgaaagaaaaagcgaacagtgaaatcaaaaatcttttagcacacacagtgatgaacaatctcccgaccacataacattcttggagccccaactgcaaccttcacaaaaaattgggaccaataaaaattaaaaaatggctaaaagtaattttaattttctaaaaatgtgtaaaaagcatttaatatttttcataaagaaaaatgctaataatagaacgaaatgttaatctctttaatgtatccaatcctcatttattcttccccaaagcgtttcttccatttgtcaatggtccgtcgattaattttcaatatttttgcaattttctcgtcactcatttttgggttttctcctttcatttgccaatacattttcattttctccattttttctttctcatttattctttcattcattccaaattgtttcttccattttttaattaaatcatggccaactccaattttcttcccaattacggcataatttctcttccattcttttttcgaatattttcttcctttttgtttatattcatttttcattgcattaaatttttgcacaatttcaattttttgttcatccgttttcaatttgctttggtatttgtataatcccaattctttgatccattggtaaattttctttcgatttgtgcccaattttttcgctattttccattcaattttattccattcttttgttgaatattttcttcctttttgtttgatcctttctttaatctgatagtatttttgaacaatttctctttttttctgttcattttctttttctttttcttcccatttttctccaaatatttcttcaaatgttttttgctccaattttttcttttccgctgcaatttcaatttgacaaattaaaaatacaattaaaaagaaaaataggaataatttcattgttgacaatttttctttttcttaaaaattaaaaattataatttattcgatatgaaaaaaagaaataaataataataaaaatatttctcaaaaatgaatttttctcttccttataaatttacattaatggtaaaatattgataggatcactatatccattaaattgtaaagtgaattttttctctctactgaatgatcgaaattaataattttataataataataataatataaataaaaactgtttcaccattaattaaaattctaattctaactagagaccggacaagagggtcggtcggtcggtttcggtataaaacccgaaaaaaaaccgaaaaaaaaaccgaagaaaaattttcggtatatcgtttcggtttcggtttttttttgaatttttatattttttcgcaaaaaaagcaataaaccattcttattaatagagaccggacaagagggtcggtcggtcggtttccgtataaaaaccgaaaaaaaccgaaaaactcaaaaaattttcgg

SEQ ID NO: 10039 - DNA, 1318 bp, Heterodera glycines
aattttcgtcgctaccccaaactcagaacattcttataaataacgcactcttgctggcgctaacgaaatcagatgattaaagctaaaaaaaaggaagacgagcatttaaaaataaaaattgagtttttcgttaaaaaattttgttgatcactacccgatcggggtccccgacccccgacaattgagcttccccccccgacccgacccccgacatgtcgcccctgagggctcgggcttaactctagaagtagggctggccgggcacggattcccaacccgcacgcccggttttttaatacccgagcccggttttttgaaaatccaatacccggtacccgacccggtaggtccgggtacccggatatcaaaaccaaattttttaaataataactaccttattttaatagaattttattttaaaaaatattatatttttacaatagccccgtaagaaatttagaagaatttaaccatgtatttcttgataacatttttggttcaaattctgtaaacatattagctaaaatcaaaaaatttggtcattttgaataaaatatgtcaacaaatcagaagtaaattctcaaaatttttttccaggcggcgcctatcggcaccaccggatcgcccctgctctcgaaaagttttttggaaaaagcgcaccgcaaaaaaaagtggcttaaataacaataaaaattgggcaattaataaagcgtttatttgtgaaatattatattttttatgcttttttaaaagattaaacttttattttcatgcaaaaaaaattaaaaaagattttgggtttttttaatacccggttttaccgggtacccgacccggtaccggtttaccggagcaattccacatagttttttaaatgcctataaatgcactcattttacatttgcttaaacactttttaacataaataaaacataaatctgatatttattcacgaaatttcataaatagcagccacttgagaccaaaaattaaaaaaacaccacgtccttgaaatcgcttacgccatgaaaattcttccacgtatttttcgagaattgcacatccatatggatacttacttacttatcttttttgttggcgtaatacaacttcatttctagcccacattcgcaaattctttagtgtggagtaattgcattctcggatccattcttcaaattcagtatctggtttttgcaggagagtaaataagttacgaatattgaagtcttttaaaattccatgcttaaaaaattaactgtaaaatgagtatatttataggcatttaaaaatctatgtgcaattgctccggtaaacc

SEQ ID NO: 10040 - DNA, 4181 bp, Heterodera glycines
ctacctcaaaattagaatatttctgataaatcagaacaattgaagccatgtaataaaatgaaaatttgtattaataatgcgcaaataccagggatacggtgcattcactaaatagacatcaattgtgcctccaaatgtccattttcgcgttttgaagtgcgtgtcgacaagcccatcaaattggagcgaaaggagtgccaaagtgaggccgacttcggcagggcaaagccacgggaaaatgtgcagccaaatgtcgtggcaaatattgctaaaaaagcagaactaaatttttcagttgaacattgatgccgttggcgcaaacatttttatttgtcatcaaaattaaataaatttggtaagaatgtaaagcgctaacttgactattgcctgcgaaatttacagtagttttaaattctttttattatataattgactgtacatatgaattttttatatttaatataatttgcataaataaaacttatagtttaagtaataatgaattaaattgtaatttttgtcaagagatatatcgctttcactttttctatacaaatatttattgtgcactcaaaaacactaacaaaggaaggtcctagggtgtccgtggaatttccgaatgaaatttggtgggtggatagagcacccatgggttcttaagaaaagtgtttttattttctgctaaatgagcatgagtgccgagttatgacgtgccaaagtttttggatttttccaattaaataaaagaaataattgtttctctccgttaaaagtgtataatgatgtaaaggtagtgcgttagtcaaaattttttgggtcccaggttcgaatcctctacatgcaaatccattttagacttttatttttgttattttatgcaaaatcaattataaaaagaatttttaatgaaacaaaaactttaattttatttaattttaaaattcattaaagataatggtgcaataaatagcctttcagttaaaaataaattaatttttgtcaaaactttatgagtaacttatttgtcaaaattaataaaaaaaaaaaagaattttatgtcatattttatgataataataataattgattttggcataaaaagcaaaactaaaaatttaaaaatgaatttgcgtgtaggggatacgaacctggggttcagggaacgctgtctagagcactaccgctgcgccgctggacattgtaaagccatgcaaggaattatttattttgtttattcattaaaaaaactttggcacgtcataactcggcactcatgctcatttagcagaaaataaaaacacttttcttaagaacccatgggtgttctatccacccaccaaatttcattcggaaatcccacggacacccttaaggccacatttttgtaagtttcctagataagattctcgaatcgcgtgggaaagtcctgttaactaaagccgggtgtatttaaacaattagataaatttggtggctttacaataacgccctttttgtaaattagccaaaagcggtattgggaggggagtgcccctcctgtgaccgaagatggcactccctaatgatgtttgagagctttggtcaagcatttttgggtctcaaaaaatactaaaatcccacatttttcttgaacttttcagccttttcactgccgtcggtgacattttgctccacttttttgcggcgcttttattgcagaatgacaaacaaatttagcaaattaaaaaaaaattatttttctttctaaaaattaagcatttttagtcactataattgctatcgccaaagaatggcactttccaagcgcattaaggaagagaaaaataatttatgcgtcgatggacaaccaaaacaccaaaaccaacgaaaatgaacgagtgaatggagtcgataaaaagagacgcgcaaatggacaaatggaggaattgtggagaaaaaggcacaaaaaaaagatagtaaaagatggcactgaatggatgacacaaccgaaacatgatgggattgtttgtcaaaaatgaagacaaaagttgaaattgaaagaaataaaacggacggtattaaaaggatggcatttgaaaagcgataaaacggcacggaatgaatggcacagattggaaaggaaatgtatgagtatgggacattaattaattcgagtagagatggacggacgaccaaaggcggtacagaatggaattcgagtttgatgaatgaataaaaaggacaaaagtaggagtatcttttaatagctttaattgttctctatcaaaatataattttttttaaatttttcttaagtataaaaaaagttacaaaaaaatgctgacttatgattttttgaaattttatgaaaataattttttttgtacttaagtaaaaaatttttaaaaattatattctgatagagaacaattaaagctattgaatgataccatgaaatattaatttggtagaattcgagctaagttatgaatttatatgtgttaaccattttttgttttcaaacccattggcggatttaggaaacgcgcatgggtggcggtttttaggaaatgcaccagcagcacctgcaaaaagtgcgaatgagtgatgattcatttcagtacggaagagttattctaatgattaattaattatttttatttataattgaataattagttaataataaaagtgtatttggctctgtttcagtttacacgaccataaaaaattactcgaccatgtaataatttgacaaatttaaggcaccgtaacttttttaagaagcatcctaattaaacattcttggtattatttaatagccctagtgtcctttattttcctttaaaatttcagaaaatttggttgagtttcaaaaaaattctggtcaaaaaggttaccaaagcaattttttaaatttacaagccacaacttttttgaagcacaacaaaattttttgaaaccttaaaagcaaatagaggacacttagggctatcaaaagataccaagattgtttaatttagatgcttttacaaaaagttatggcactgatcaaaaattgataatttttatggtgatcaattattcaaccaagtataactttctatgtacaaatcacagaatcaccattccaaaagcaattcggtagcaaattttgtgctttttccagtggcttgcccattttctctagaaaaatttcccagccccctagggattttgaaaatttccttgagtcaagattttttgggggacactgtatttctctcacaaaaatgtttgtttgagaaatatttaaataataaattgaaattataattatggacagcaaatataattaatagattaaaatagttaaataacacaccatcccgaaaaacgagaagtgtaccaataaatagatagtgccagagaaaaacaatatatttttttctctaattttttgactccttttggcgtactatctatattttcattattaggaaaaacaacattcacttcgctatgtttagcttcttttctatatgttagatccacaccaaattttgcaaatcgatagagaaaaaaattctgcatcgatttctatgtttattatcatcgcttaaatgttgtcttaaaaagttataagataaaaaagttaaattattattctttttaaagatttaatggctaaaagaactttattacggaagcgacagaccaaaaatgcacgccatacgcgtgagaacaagcgggaggagagaaaagcgcagacgcagagggcgagacaaggccgatgggccaagaaaagtgagttttttcatcaattttatctcaaaaaaatcatttttttgtattccagccgctacacaaccaaatcccaatgccgaaatagcactgcaggacgaagcagggccgtcaacatctgctgcatcaacagaagaagcgatggagcctccgccaccaactccaggaccagtgccaacgccggagatggacgaggaaattttggaatttggcttttcgctgccatcgacatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctccgcgagcaggtgcgcaatcgaga

SEQ ID NO: 10041 - DNA, 1376 bp, Heterodera glycines
ttctaagctattgcttcgcgattagtcaattaccaaaaaagttataacatgaaattgcaaaaaagccaaaaatttggaagttttttcttaataaatttttacaggctagaaaatctttttgctttttgtaaggctaaaatagagcaagtgaagagctttcgaatgataccaagatcgttagatttggttaacaacaaaaaaagttatcgtccgaaaacttgggctggcgccaaaacgtcggcgccaaaacggcctagtcccatttgcggggtccttttaaccaaaattcttaaaataaattttaaccgaatgtcagaaaaaatgaaggagttgagggataagaaataaaaaattttcagcaaaagtaaaaataatcagcctgtcggcacaccctgggatacatttcttaatttaaacttcttgcaaaaatttggtttttaaaaaattggaagataccaaatttgaaaaaattgtaattttttttttcattttttagatgttcacctcgtttatcgactcaaaaattctgtcagcccaaaatccgcgcacaaaaacaataaatgtacaaatatttgatgagaaaattgccgctttgtcgtcaacagaaagccaaaaagaaaaaacaatggaagccaaaaattgtcagaaaaattgttttaaaaatttataaattttacaaattttcagccctaaggctggcaaaattggagtttccgaggccaaggcctggcagttcgtcggttcagccacgaaaatatggtggctttcttccaattccggcacaatctgtgctcgagccaccggccccagctgttgtgccaaacaacagaaatttcttggcaaataatgccggcacaaaaaatgaacaacagagacagggcgatgaggaaatggtggaggaaccatttaatgacgaggcatggccaaccaaaccacctgttaatgaatgataaacagattaaatgattatttaaaatttaaggaaaatctgaaatctgaaataaagccccccccccaacctagatccccccaatgaaataaaaagccaccttttgtgggggggggggggttgaaatctctattttagaaaatatggtattcaaatattttttaaattgtttgattatttcctttattgtagaatcgtcaatctggcaatccgattatgcgccaaaatttgaaaaaaacggatgcttcagtggtgccaaatgccgttgttggtgaaacaaaacaagcgcagcacggtggtgcaattgccgctgctcaaaagagcgctccgatgaatatggcacatcaaaattggcgttttgttgagcaattgttgaaggagaccaaaggtgatcagagagacattttacaaagcatggaccaattga

SEQ ID NO: 10042 - DNA, 2236 bp, Heterodera glycines
acttatagttcaaaaactaggctggcgcgaaaacgacccggtacgaaaacgtcctggcccgatatccccctattaataattggcagtaaaactctaatgtcaaaaaatgaattaattattcaagcaaaaacgaagcgcattttggtggccaaaatgggcaatgaagcagtgcatttgggacatgggcacctccacctgggcatttcgggtgttgaagaagtgaatttttaaaaattttcataatattttattattactttagtaattaccttaatatattaataattatataattattatattccgattaattcattgtcagaatacattggtggcttcattttgtgatctgttggagcgaatttggtctcatggattgaagaaaaagcaggtcatcctaatttttttaaatctgccaatcaaacaaaaaaaaatcttttttcgaattcgaaaattatttggttcttttcgagagttcctgtttaaaaaacaaataattcaaaataatattatttcatatattaaacagttgtttaatgaacaaatttttatatttgtcagaagcacaaaagcttgaaaaatttaagcaatttcagagggctaaaaatccaaaaaatttccaaatttcagggaaaatcggccctgtggaattacattatcgcctaccatgaatgggagaagaaaagtaacagggaagcgagccgtaaagccagctttacagctggtgggacgaacggtgaatcacagtcaggtacagtaattgggcagccatctttaccactatcatactctaattaccgtaataaaatttaatctttggtaaaataccaaatggtctaattttaattaagaatctgtcctttggattgtttttcggagacgtataaaacgtaagggaaaatttggaatataccttcaagcaaatgcttttgtcgcatgagaaattccatttatttaaaatgcatttcagtcccgctttttcagtattattcttgtgaaattacagtatcttaaaccttgactcgtgtactggatggagtactgtattattttttccctagtcaaatgcctgaaaatttttcgagagaactcttttctgcttttttttaagtggtggtttattaatttgtgttttggcattatactgtaaatatatattatacaattttgtaattgttttcgttggtggtttgtccattttttgttgcaatttgtcacactgtacacaggtgaggaggaggatgaggacaaagtgtcgacaaccgttggaacagaatcggacgacaatggcacgcccaaggcggcattggtcgatctgataagttccatcagacggatggcgtccgcgggaggtgcagatgatggcgacgaagcgtcattgtcatcggcggcgagttctggtacagtcgcggcgacgacgccaacagtgccggactggtctcagtcgctgttaagagcggctaatgtgatttgcgagcgcatatccggtgccggaggatccgctagcagttccggcggcgacattggcggtgctagcgatagcataggcgactacagtaaaaagtcggcgacacttccgccacgcccgccaccgcctcggccaagcggcagcagcaggtcacgtcaggcggcgacagaagcggaaccgcatcctcaactgcaacagcagcagagaaggagcagaacgccaacgccaaattcaaaaaagaatgcgcaagtgccggcaaaagcgagcgcaaccgcgaccgggacggcagcgattgtggtggaaaagagtgcgcaaaaagaggagacgcgggaaaagaacacagagacaagcggcggcggcgacggaacgccatcaacctatcgaaaattcatttacaagggcccgccgttgaaggagatgaacaacaacaacaatggccggagatcagtgagcagtcagcggagaacggcagcgacttctgcacatggtggcggccttttgacaaatctgatcaccggtactgtgtgtctcttatcccgattagttaaaggaattattgtatggatcagacagtggtgctatatatatgtcgtacagtatgccgttctgactttgatcaatttaagagcattataatctgataactggtataatactcgtcactaattagttgaggccttatgtatttattttgtacagtatgctattagtgtaaaattttagtgtactatataataatttatgaggaataaaattttaaaaaatgaa

SEQ ID NO: 10043 - DNA, 4088 bp, Heterodera glycines
  misc_feature (116)..(116): n is a, c, g, or t
  misc_feature (128)..(128): n is a, c, g, or t
  misc_feature (149)..(149): n is a, c, g, or t
  misc_feature (186)..(186): n is a, c, g, or t
tcctatttttagttttattttttatctattttaagaaggtatgttttaaaataaaattaaaataaaatagttaataaatccacaaattattcttcatttttattataaatttaaanaagaatcctttntagtttattttcttatatatntaataatacaattattatgttgaaatcttttgttgtntaaattgaatatttaaaaaattatatttgcttgatctcagccaaagaacatcagcacgcaatgccgttgatgatatttcgttaattagtaattttgcatttcgacttttagtatttgcagttaactagttacctaaaataattaaacgggattcctttttagacaatttactaataattattcgaaattttcaattttactagcacaaattttttttatttactcattattaaatattaatcttattgttttgatttaaaatttattatgcattaaattattggcaattagtaaacattcgtaaatagtttctcaaatcttgccttttttaccgttgaaattttgaatgcataaattttttttatgttcattaaagttttataatttgaatttcattgtgaattagtaataattgttaatatttagtttttttaattttattttttaaatatttaatttaatttatttattttcttttatattatattaataaaaaatgttgattagattttttaaacatattataaatatttttctcgatgaaaaattccgcaaagtttcataattctccgtagttacccatttttagtgcaaatctctctccgtctgtccctttctctgctcttagcttatgggtccgtctcagtgtcgtggcaattatattttgcctgtctttttcccccttttccaatttattgtttaattcattttattttattttttgtatgcttttaccaccacacggtcttgctgaaattgctcaattcgctcactcaattcaaccgtatccaaacaaaaaattagttttttttgaaaaaacgaccccaaatgttttgtatcctgggtttgggtacggtatcaaaatcttttgagtttggatacagtatcaacaattgaatgttaagaatttgctgttttttagatttccaaattccgaggaattaaatgtccagtccgagcgattcaaagttcgcctgctcaaccaataaaagttcgtttgggattcctcccgccgccgttcgttcctttctgtttgcttctgtactccgccccttcgcttccatccttatatactgttaccatttgccctccccattctattaccgtgtccccacacatatccaccgtatcccttttttgtgcctttctcccatttctttcatccattttctcaaaagttatttagtattactattatttttattgtcctttatccagtaaatttcaacaaaatttcattcttagttccttccaatttattgtgccttttgtatcggaacatttcaataaattgtcggtttcttaaaagggaaattaaaattccatttttatttccaaaccgacaaaagaaaagtgacgccattgcaccaatttaaacaattaattaattaattctctccaatactttcggggtgacaattacgtcactgatgcacatttcgaattgtttttaaagaatggactaatgagaatgaccgtagaaggaaaataaataccgtaacccgtcacaatttgcttgaaaattaatagccacacgtatttgaggaatgataaattcttaattggggttgcacggatatcccaaaattgcgaatgggtgggccgatttgggacgaagggacagtccgacactcattcatcaaaagttaattcgtcatttattcggcggaaatttacgtataaaacagtattgggggtaattagctacagattattgggttggtcagagagagagagaggcataacgcgcaaattcggacatccgatggacgaatggccaaaatggcgaaatgccatgcatttgtcacatccgtcattcaatccaatccatttgatgacctgggagtaagcctatataacaacaaacaataagcagcatagtcgaggattaaatttttgacgaagtaacgattttttgcttttgttttttggtggattcattcggtgatcagagagagagagaacaacgcatattcacagagttagcagagaaacaaaaaaaaaggaggaaagagtgtgaggaaaagggagaatggtagagaacaagagaaattctgtttaattaaaattattaaaaaaaaacaaacacaaattttacagaaattaacaaacaaacaacgagtcagtggaaggacaagcgtattaacaagtggtaaagcccggggaacggacatagaacagaagcagcaattccttccttgtgggacaccgtgccaattaggcacgagaggaggcggtaattgtgctgttcatatgtgaattggttggacaaatttacactgggcacaagagagggaccaatgggagaaagggataacaaacggtggcaaaacaaaatgtgatcgaattcggccgaaatatcgcgctagccttatcaagcggttcaagttaataatgtcaacaaaaacaaacaaaaaagaaaaaacaaaaaggagtaaaaacaaatggttgaacattcgcaaaacaaaagacgacggccgacgctctgtgcccattcctagtcgattctgatcagaactacccgatttgctggtatttgtacagatacagacggtaatccttgctgcaggggagggaatgtcggacaataaaatgcttaaattgggacgacaaaagaacggaccttgccaacacaaccgaatcgtcgatcaacgccacgtcgtaacattgcgcgtgcttcaccttcgactcaaaggcactcagcagagtgccgtcctggcggggaaagggaacggttaatcaattggttgttgctttcgagggactacctgactgaagacggtcaagttgaaattgttatgattatccgcctgaatttaaaagagcaaataaaatcgaactgctgcccgtggtgtacagaccaccacaatctcgccaagttggttgatgccgaccccaatcggataattagtcaccccctcgccaccgatctgacgcaaaaattggccctcgtaattgaacaccttaacaaatacatcaacaattatattcatccattgaagcgccaacaaaagtgcactgactttgatggaatgtgcccggttgtcactgattagaatttcttctttgtcggtggtgcaaacgccgttgggaaactccaaatagcctaaacgacgaaaagcaaattaaatggggtatttgcgattgctaattgtaaaagtacgtgaacagctgaatttgtgcagaatgttgccgaacatgtcgaagatgagcacgcgcatcactttgcactccaccaccacaattcggccctgactgtccacacagacgccgcgcgggtgttgcaggatggaagcgccgaatttgcgaatgaattggccgtattggttgctgttggaagagaaaaagttaaacggttggataaaaccaaaaatgagaaagagcatcatggcattttgtgaaggactgactaaatttgaatttggtgcgtcggggagcgctcagtgacgacaaaatcgccggtgacgcgattgacagaaacgcggtttgggtagaggagttggccatctgaaagagaaacaatgttcggattttgacacaatttcccattaatttaccgcgtttgccacattcgccgaattggaatttgaagcggccctcgcgatcgaacacctttaataaacaacctaaaacggaaaattgcacagttttcacctgaattcggtggttgttcgtgtccgcgacaataatgtcgcactgcgcattcaccgccactccgctgggttcggtgaattggccttcgatgaccccaaattcaccgaatttacaatggtaagtcatcttttggcgctgaaagtgccaattctattccggtgaaatgaaagaacgagtgagagtgacctttatttgggaccgcggcggggggagcatcggaatcgaagcagccaatccatcacttccgc

SEQ ID NO: 10044 - DNA, 2129 bp, Heterodera glycines
tcattgattttacggatttgctccagcgcatttttgaacaatgtctgattctttggtcgacgcgcctccgtcccgggtgagcgcaaagtgtcacgtttatgcgccgcagcagcagccgaagacgcgtggctcagaataccgcgcggtgtcccaccgctaagcgcagtctatgaaagaattcgctgtttacaacttccaaaactatttattagtcgtaatttctgtcgcaattttgcacaatattaaaatatccaataaaaatttcctaaaaaaaaatccacccaattttgtaataattttagaaagttgactccaaatgacaaacattggtcattttcatcggaaaatggcaaaaaaaaaaccctgctttttgcctgaatccatatcccaccatcgttttcggccaaatacgactcaaaatcacctgcactgacgacaacgaaggcatcggcggcggtggtggaggcggtggttgaagaagtgctacaaacaaaaattttggaaaattacaaaaaaatctctgaaatcattgcacaaaattattaccctgccagtcgtcctggttgctgctgctgctgttcgaatgatacccaaaggaggcgttgcgctgttgttgcttgagcaacgcggccggcgcgtacccagcggaaccgcctggcgttgggatgtacggcgtcggcggctttccggcgggcggcagtttgcctggcgacagcagcgaattgagcggtgagggcgcactgcgcttggcggtcggcagtccgcaagtgcgtcggtatttgtccaccagggccaacaccgcttcgtccgctccgtcaaatttgtctgcggaggacggctcgtgcggggttctaattagttaaattgaatgggattagcatatttctttattatagccaccaccccttccattagtgccgcactcaacagggaggagagcaactcgtttcacaggggtcagtccccccgtccggcgcccgaaagaatttttttttaaattgtcaagtttagaattttttttaaaaataaaaaatttttcacaatcaacatttttttgggtatttttaatagaaatttagtatttcaacataaagttttgaaaattgttagaaaatggcccaaaaaagtttttaaaatttttttataaaaatttttagaactctgtaaaaaacaaattttccttaaccaaaaaaatatgacaaaaaaagtcaattttaaatgtttttgggtttaagatttctttttggccggttgcgttttatttctaatgatccgatcacaagggcgtaggcaggggggctgagggctgatcagtttctgaaaaaaaagttaagcctaaactttttggcatgtttaaaaagcaattaaaaattttattcatctccctttttgatagtaaaagcatcacagagcctattttaacttgtacataaaatttgatgcagtttcagagcactttctgaaaaaatatttatgagttaattttgcaaaaaataaataaacagttaaaaactcagaatttctagaaaaatttaaaaccaattacaattgtcattttttcaggttaagttagtcctgtaccggggagtatgcctataaaatttggtacgattttattgcttattgaaagagctagaaccgaacaaaatctttttaatttaagcctaaactttttggcatgtttaaaaagcaattaaaaattttattcatctccctttttgatagtaaaagcatcagagagccttatttaacttgtacataaaatttgatgcgtttcagagcactttctgaaaaaatatttatgaattaattttgcaaaaaataataaacagtgaaaaactcagaatttctaaaaaaatttaaaaccaattacaattgtcattttgtcatgttaagttagtcctgttccggtgagtatgcctataaaatttggtacgattttattgcttattgaaagagctagagccgaaaaaaatttttttaatctaagcctaaactttttagcatgtttaaagcactaaaaaattttattcatctccctttttgatagtaaaaacatccaaaaagccttatccaacttgtaaataaattttggagcgtttcagaaaccctttctgaaaaaaatattt

SEQ ID NO: 10045 - DNA, 4364 bp, Heterodera glycines
  misc_feature (4288)..(4288): n is a, c, g, or t
cttttaagccgcccgccttatgacgaacgaaggggggggggggggggtgtccgaggcctcttacgacgagaggggtgtgtcgagacaccccttgcgcatgtatgtcatccctgtaacggaaatataacactcaaaaatgtctaacttccggtccatccccgccttgccaaatggataggtccaatagcaaaaatgaaaaaaaaacactcacaatttctttggccttcaatttgtcgtaaatgcgtgcaaagagtggcgaaaatgtgttggtcaggtagaagtaggaagcctgcatcggtgtcgtacggctggttgatgaactgctcgatgatgatgacggggaggaacgcggtaagcacacaaataaatgcggacgccgcaacagcgtgccatggaaacgagcgttgaacaattcggcaatcggcgcatacttttgacagtcggcggacgtgaccaacaatttgatgtccaatgaggcggaactgaaacaggaagtggaaataattgtgaaacagtaaatctggggcagtcttggtacggcttcgaatgaaaggtcgacagattatctaatttttaaatttcgacttttagttcgagttcgggattcgtaaaaggccaccgaaatgtcagattcgtgaccaacgacctcgaagacccatattctcgatttgtatcataatttaaaaaattttgcaaaccaaaaggattgaccgtggtaaaattgatgaaaatgacttcttttttgaaaaaacctagtgcaaaatttcttaccacggtcgcatctctcattttttaccaagaatttacctataattcaagggacacgattaaattatatataatttgattaatgagccaaactaccctatttaaagtagccaattctattttttatattacgccagaaggcactttgccaacaaaaaaagaaaaattcaatgcaaaaaacatacaatccatttggtttggcactgtcacggaacggcgagtacagatcaacactttcaacagtttggtcttcaaatctaagcgagccggtccacacgttgagcggattacggatgggaggaacggcggtgcctctgcttgcggtcgaatcctttttgttgtcaacaacagcacgagatgaggaagcagcttaagataccaacttaatgctatgtaaccaaaaaagagcaacaattaagaaaccctattaagcgtgaggatataggaatggaaatgatataattcaaaaaactttacactaaagcattgaatgagcataattgttgataaatgaaaataaaataattaggtaattacattgggaatggttagggtggggggatttgagaagcaaaacggagaaattaaattcgattaaatgacaccaaattatcaagattttccaaattgtacatatatatgaaattaagcactacatttctgtaaactcgtagaaaaattttttagattcccttgaaatttccccaaatgttcgaacctatgagcttcgcttttgcagtttatttttcagaaaattagctaatcttaagatataaatcttccttttttgactatgactgagaccaaccaaaatatgtagtgggtatctaatccaaaactcaacatcaacattgtctcaatttccacaatcataaaattaatccttactcctagagagggcaatcgcatacattaacaattgacaatatgtaattaggcttggatgaaattggaatcatttccatatgggcaaactttgggaggcaaaactcataatgatgaacccaatcaaataaattttgtttcattcaccgctattttaatcgcttaataagcaatactaaacggtaaaatttagtaaattctaaaatgcatttctataaagaacagcataacacataaaaaataatcgactctctaactgcataattacacttagcaatgcaactttctataaggttgtctctttagtttgttgggataaatggtacagtatactacagtaatgcaaaaacataacaccagcaatgaaatccggtgagcataaattcaaaaattaatgcgcactcacatttggcgtcatcttccgccgtcgccgccgccgccccatgtctttctttcttcttttcctcctccgttgcatttcgacgctttggaatgacataaccgccgggaccaccgggattgatgacaaatgatgccatttctgtttgacactgactgtaccaattggaaagcaaaagcccaaggccgttgaatatgagaaaaaaaatatgtgtatgtgggagtgaagcaataaacaatcaagcctaagtcttaagagacacatgaaataagtcaaaatgtgtaaatgatatgtgatatgataatggagatgaaagcaatttaaaatacctaatttattattattacagaaaaacaaaaatgcaattttatatttttatatatttcatttaattaagagccatttttctatgcaatacaaagaaaagcagagttaattacataagaaaataataaatattaatgcattttttacatttcttgcctccatgcaccccacctgccccttcccttctcccctgaacactttggtcgctgttttttgggaaatctttgaatgaaaggtgcgcaaacatatgaatgaatgagtgtgcttgcatacagcagaagcatacctaattttaataagcattaattataatattcaaagcgaaaagcattgtggaaaatggaatcggaagacaaaatattttaatttttagtgatgatgtcattataaatcaattattgaataccaacgtaaaatatgtatgacaacaaaaaattttgaatgttaatatgtttaacttttttgtcggcaaatctcccccctcccccttaactcgtgtacatttatgttcatccattaccattaaatgttatgtataaaaatcgatggattaactaatgcgcaaccggtacccactgtttcaatttacgactttacctacataatagtcaaaatttaaatgcaaacctatctaatttgaaatgataaacaaagaaaatcaatcaaatttttaggaattaatactaaattatgcaattaacacaaaaaagaagagacaattttaaaaaacgggttaaatcatccaaatgactgcgattttaagcaaccactacattttttggtggctatttgctcatttaattgcaaaaaaaaaaaacgaaaatcgattagcgaagtcgattaaaattttattttgtaaaaccaccttatgcaaaggaaaatggagaaaaacaccttctttcaacacacgcaaaatatttaggatggcctaaaatctattgaatgttaggagaaatgaaaaagaggcaaaagaggaggcccaaatgcaaacgcgattgacgtggatggaaagcaatgagagtggagagaaagaaatcaaatgcacacaaagggcagagagagggtaaagatgaagggggagagaaaggaattcgcaagaaatacttggagaaagatagacatgcatggaaatagttaagggagaaaagaaaaagagtaaagagagaaaaaagaggcgtacgctttcttcacgcgtgtgcgaagagcagagaagaaaggaaagagaacaaggaaaaaaatgacgagagagaaagtgaaaagataggggaaaaagaaaaagagggcacacatagaaaaagagagaagagagagagagatacgagagacatacacaacaaaaggaaaaagcacgctaagtgttcatatgtattcgcccattagttcaatataatatgatgacatttgatgacatacgtacaaatttaaaagttcgaaaattttaataaacaagagcggaaaatattaatctgagggcccaaacacaaaagggattcgatttagaacggcttaaaatgatgagaaaaatgcaaattaggggagcgcttgccatttttcatgttaaaaaattcggatactgaagtttctattttcaacggggacttaatcgtccgacgtttaataatgcacgaagtcttaaatggcttaaatttattcaaatacaacaagcaagcagcatcttttctaatctgtaaaagttgaaatttgatttttaaattatctctgaaaaataataatttaatttttgacaatttataatcgccacttgaccattatttacctaattgattatttcgttattttgttctactaaaaattacaactttaatttgatcagactgtcaggcgtaattattacgcactcaatattacaacaatgcaataaatacatatacattacatacatacatnaacatataatagcatcattaaggatcatttttttgagcatcgttttttcctattagcgtttgctgaccatcgactg

SEQ ID NO: 10046 - DNA, 7114 bp, Heterodera glycines
  misc_feature (103)..(103): n is a, c, g, or t
  misc_feature (255)..(255): n is a, c, g, or t
ttcatgaaaatcagttgtcgaaaaatcttttcagacttcaatacaaaggactcgtcgtcttccaatgactcactaattgggagcgacataaatcccggttaancgttcgaattagacgtttggtctccccgtaggtctttaaaagtaaatctattgcatcatcatacccactctcactaattggaataccctgaatgattgcactggctttgccttcaatgcatgagtctaaataactgaacttatcaattttgnggacatgagagtcctcatgaattattgtacgaaagtaatcccaaaatggtatccactgagatggactaccatcaaatctcttaagctcagtttttggcaaatttttacgcattggcacgctccttgagaggggtacaatgccggaggtagtgtcaccatccgtgttgtgagttatgtctaacctctcttctaatgcctcaattttgtccctcaaaattggaatgagaacgtcagctgccctttgtttctcattaatttgtaactcctgcattaattcctgcatttccgtttctttacggattgcattgtctcgactcagtttgccaatatactcattagccaaacccaaattatcttcaatcttttgtaccaccctttctaagtcattcagaaagtttctgaatttgtacagccttctttggcattgattcggtagggcatttattcccaggtcaggtggaatttcggtacccaataatgctcccaatttgctggcacaccccctaattaatgcctggatgggggctgtcattgctcaaatcaatgaccaaattcgaaagttcggagatgagactccaatttaataatcaataaccgaactgtgaccgaacaatttaaaaatttggaactgaaactccaatttaatcaataaccaaaagactctgattttaccaagtgcggatggtttggacaatttgggttacaaacaaaaaacaaaaaaacaaaacaacaaaaaataaaaaagatttagaccctcggaaatgagattccgaaaatttggactaaatgggattggacaaaaaaaaagtgaattggaaatgaaatgccgataattttttgacaaatttaaattgggcaatttaaatgtttgacttttcgaagatgagacttcgaaattttcagtccgaaatgaacttgattgccttttttaggaggaggaaggaacagaaattaaagaactgattaattctggatgagaccagattaatcagacctccccttgggaaaaaaattgaacccgcctgtgcacaacaggtcgccagttgtctggggcaggcacgtcttagtaaatggggatggcctgcgcgctgagacgtgcaccaagacagtgcactcaattggttctcgattcgtcaattgtccgatgcgtccaatgtccaattcggtgcgtcaaatgtccaaatgttcagtgcgtccaatgtccaaattgttcactgcgtccaatgtccaatttgttcagctcgtccaatttccaatttgttagtgcttccaatttccaatttgttcaacgcgtccaatttccaatttgtccaatgtcagatacttttcacttgtaaaaaggggaaaacaattatgaaattttgattagacaaaattaattaaaaaataatttaggctggaaccggttttccgccacaatttgaaattaagcagtttagttttgtgtggcggaaaacttgctcagaaaacctccggtttgctggttgcaaaacacaaatttcaataaaattccaatgaagaaatttaattttaaaaatgtgatgagaattgcaaaaggcggaattgtcgattaaaaacaattttttaagtgaatgatgtgagaggaggagatgggaaagaatgaatggcttaaatatggcggatgagccgccgtcaatttgcaagagatatgtgtcggagataataggagaggaaatgagaaatagaatttaacaatttaaatgattgaaagcatttaaaattaaagcataattaatgcaaagaaaatgagaatttgggcagaaaaaaaaatgaatgtccctgatcatcgaattaagtgataaaaaaatttgtcagattggcaagtcctccccattcgcaacttcctcctcatgtcctcctcactttcttctccctccattttcgccattcttctttcgttctcgtttgcactcgctcaactcgtccaaccgtgtggccctcgttgactgccttgtgccaaattcgtcgctcgcttcgctccgccaagttgagattggcttcgttgtccaacttctccccaattcgccgatcgcttccctccgccaagttgagattggctttgtcgtccaacttctcctggtttgggaaatgttgagttaattggtccgaaaatgggtgtgtttcggacatagagcatcaatcgcacttattgcctttgttgttgcaattggacagctaaaagcatatctatgccaaatgccgatgccattttgacagcattaatgattgcaacctttacatctttgttatatttttattttttttgtttgaaaattttcagttttcatttttttgtttaaaattaacttaattattacgagtgggtttcaatttataaattaatatggctgtctttcggcttttttgaaaatggcatcaagcatattcattaaaatgaaaccatattttggttttcagtagtttttagcacatattctggggattttttttttaattttttttacaaaagtagctttttttgcactcaaattcttgtcaaaatgtacaaaaattttcaaaaattttagttttttctctttttgcactttttgaccgttttaatgacttttttcatttttaaggcaaaatttaaattttatcaatgaaaacagaaaaataaataaatatttgaagcgagaaaaatatttacgtcacaaagaattgaaatgtttttgattagaattgtactagcgaaatggataaaaaatgtgatttttttgataaattcacttattttttgacagtttttttttcaatttttggcacatatgttggccttttttgagctttttagcacatattttggagcttttttggcacatataaatccattccctggcaattacaacaaaaaatagaacaaaaaaaacaaccttcaaacattatgcataatacttttaactcttacataagcaacaaattggaaaatgaatgaaatgccgaataatatataaatttttaagaaatttaaattcatcaaaacctaacaatgaatggccctgaaagcttaaaaatattctcagtcaatccgcgacaccttcactttttctcttgaattcagatttatatctttctaaagatctttttgtaatatttaaaatttccgcaatttggcgatcgttgagctttgggttttggtttttcaattgataagttttattttttccgttttttccgcaaatgtataatgcttctgccctgtaatatattaaataataaaaatttttaaatttaattaataaataacaatttgtttaaaaatttcaccctttgaaagaatttgatttaagccaattttcttgtcccatttttcaattgtctgaaaaatcacaccaaacttttgtttaatttttgctctaaattctttccattctttgcgtgaatgttttccaatttgcataaattctttctttattttaaaatatttttcaacaatttctcttttttcatcatcagttttttgctttttcaccatttttccactttttaattgtttcttccaataaaaaattgttctgatatttgtgtccaaatgttttgctattatttttttgcatttttctctttttccctccaattttccatttaatttcatttttaattttgcatatatttgatcaaattgctttaacattatccttttttcttcaactgaataatttttgttcttcatcattccaaattctcttttccatttgtaaattttcgtttgatttgttcccaatttttttgcaatttttctttcaattttcacccattctttctttgaatatttctttcccatttgcttaactttctccttaattttatgaaattgttccacagtttctcttttatttttattagtttcatttgaaaatttatcacaactttgtccattatttgttggcattggcaattggtcgcccaattcatcataatctgtggacatttcttcactctcctcttctttcacttccacattttcatcaaaaatctgatcaaattgtcgaacattttgtccaaattggttattctgatcagcaatttctccatgcattatttgatcattttgacagatgttttcttctgctccgtcgtcccatctttggccaaatatttcagcaaaacttttttcttggattattttgccagcctcaatttggttaattgcttttttgaatattaatgcgcataataataaaaatattaataatattttcatttttttgtaaaaatataatgaattatttttataaaaatatttttcgcaatgaattttgtaattattaattttatagcatggcttaatttttcttcaatcaatattaaccacatttagtcatctatcatcaatacgatacaacattttaataataattcaatttattattatattttcttttctcagcgaatattggaagtaattaatatgagctaacaataattaagcggggttttaagtctcttatcacaaattaacaattttttctcatcttatgtaatctgatcaaagattcaaccaaatggaaatgaatttgaacagattttatgcaatttattgccataactgatacgtttaatgatttatattttattacgtttaatgatatgtaattatgtcaaatttatgatcaaataaaatcagtgtcaaaataaatgtcattatattagtgatcagcgaccatgaaaatactaattttaaaatttattcgagaaacgagtttttattaagagctttcccatcaatttttgcagaaaataaatgatttaaaatcacacataattgtgtcattctgagaattatcaagaatcatgaggtctttctgagctgccgacaggcgccaccggattaaaatttggattctgcaaattttattaattaaattaaaaattaaaagaactaataataataaaaaaaatccatattaaaatagaggattgaacttataggatgtgggaattgataaaaaagagttgtattttttttggcaatttcgacgaacacgacaaattgctacaaatgtttcgataaaaattagtcataatttgtagaagaaaaattactcaaaaattatttaattcattagggtaagcaagctaaactctcaaaatgactaaggaagaattgagaacttaagagtttaaaccttaattagatgccaatattgataattttaattccatctacaaaaagtttatttttcacgaccctcaaactgactaccaaataaatcagtattttccattttaattattttaaatttaactacccaaatggtttattgtatatcccgatttatctaatgttatactgtataccattttgcgctttgaattttggcatttatttatgttttgagaaataaaattaaaacacattttcttctaaaatagagttgaattttaattaaacaattcatttcatctcgaaaaattgtggtggttttattggccttctgtcgtattcaaaacatttccactttttccttaaattcggatttgtattttattaaggacattagctcaatgttcaacaattcggcgattttcacatcggaaaattttggagtttcctttttcataaggtaatattgcttcattatttccattttttcgacaattgtgaacctttttcgctctgtaatatatttaaattgaaaaatttattttaaatttaaaaataaaagtttaattgaatttaccttttaaattattttgtttaattcctaatttcttggccaatttttcaatcgtccaataactcacaccaaacatttgtttaatttttgcattaaatgccttccattccttctgggaatgttttccattttgcataaatttaatttttacttttaaatatttttcaacaatttctcttttttcatcatcagttttttgatttttcaccatttttccaacttttatttctttcttccatctttgaatactgctgatatttgtgcccaaatgttttgctattattttttggcattttcttccttttccttccaattttccatttaatttcatttttaatttgccatatatttgatcaaattgctttaacattattcttttttcttcaactgaataatttttgttcgtcatcattccaagttcgctcttccatttgtaaattttcattttatttgcacctaattttgtggcaatttttctttcaattttttgccattctttctttgaatatttctttcccatttgcttaactttctccttaattttatgaaatttttcaacaatttctcttttctttttattaattgcttttgaaaaattatcataaatttgtccattatttgttggcattggcaattggccgcccaattcatcacaatttctggatatttcttcactctgctcttctttcacttccaaatgatcaaattgttgatcatattggttctgatcaactgtttctccatgcattatttgataaatttggcagatgttttcttctgctctcgtcgtatcatctttggccaagatatttcatcataacttcattctagacttattttgtacagcttatttctgatcaattgcattttcgaaaattaatgcgcataataataaaaatcttagtagacattttcatgatggtttgttattcaataaggtttaattttcatggcggatttcatttttccaatgagtgtgtaattattaattgtacaattgtctaatgtataattttaaggagttcaatttaccggtcccctccttgataggattggaaaacacaaagattttctaatattatttaaatttcaaataaaatttattgagttttaaaatcgagataataatgtttgtgcttgttatggatttattaatt

SEQ ID NO: 10047 - DNA, 4350 bp, Heterodera glycines
  misc_feature (52)..(52): n is a, c, g, or t
  misc_feature (2375)..(2375): n is a, c, g, or t
  misc_feature (4295)..(4295): n is a, c, g, or t
ctaaacaaaaaagaggtaaaaatgaggattcgctttccattaaaagaatcgnccaaacggacatcgctgatccatcaattttatttaataagactggcaaaaattgaacatttttgggtcaaagaaatataaagaaattattgtcgtttccggaccccaaccaataagcggaatttgtttcaatttttaaaattttgccattcttgtggtatttcttcaaccctgaatttggatttaattttttcaataaaaatgggtaattttttttaattttaagcaattttcttagcaaatttcattaaacttttcctggctgcgcctaacggcaccgccaggaccccaatcggtaaacatcgaagcttaaacaattttatttttaagtgtttaataaaagccacaaattctcggttaatttataaataaaaattaaaatggaattaaacacggcggtttaaaaacatgcactaacttggccagcggaagcacttggtgcgaatgggttgtactcctcgatgaccgattgactcgttgaattgtttccgactgatgcagccggcgaaaccacacgctgaacagccgggtcctgagggaaaaatgatttgtaaaaacagaaaaataaaataaccactaacagaaaggtatttaaatgatcgtaccttaaaagggtcagcaaatgggtttccgtccaatttcgacattttctatgtaatttatgtacctaaattctcatcagatattatggtaataatgtaatggtgggctcccttttcgaaaaaaaattttaaattatgagttttgggccgccttgatcagtgatcatgaccttgaaatctagaatcccgactcaaattcgattatacaagtattgacatgaattcgaaacccaacccggtttagcgaaatttttacggcgtaaaaaagtcattttacacgggtgccaaaaggacacaccaaagcgaaaaaagttaggtatgcacctagtcgcttatttgttagccatattatgtaacaacattatgccatttttttggatttaaattccaacaaattaagaaatctttttaatcttaacaaataaaaaagctaaattttaattttttcgtcttagactaggggacgattaaaaattagccgaatgctttctggtcgatgatcatgataacaattttaatccctaattttatggtaaaaattgcatacaaaatgcatcaaaaaggttaaatttctctacccttaagctatggaaaagaaaaattgtaaaaatgattgaaaaacataatttcatcccatgaaaaacacttgtagaaatttcaccccattctcggttttttgtcggccctttctctagagaagtgccaaaatgacaaaatctaaatttttaagcgaaaacaaatttgtttttctacgagtaagcaatgggcaaggaaaagatccatatcaatattgtggtgatcggtcacgtcgattccggcaaatcgactaccactggccatctcatctacaaatgtggtggaattgacaaacgtaccatcgagaaattcgagaaggaggctcaggaaatgggcaagggatcatttaagtacgcttgggtaagtcgtaatccaaatcatgttcatgttaaaatatattttttttaggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacaggttctgttttgcaatacctttgtaagccattgtcgttataaccatgataattttcattgtgcaaattaaaatttaacaaccaatgatttgcagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaaggttttgcttttgtattgtttcctgaaatagttctcctttccagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccattgcgtttgcctctccaggatgtgtataagaattggaggtnttgtttgtttgacacatggctatttcatttgttgcatgtcatggcagttcgtataacagttcgtgcaataggcaatgcgggaaacggctcataataagcttggcttaattttgggttgcttggacttggacttaagtttatttatggtgctaactgctattgaccccatttgttgtttaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaaggtttaacattataatcttatagcagttgtaacacctatgcacttttagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctggtagaacaactctatataatcagaaatcagtctttaatttttctagggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgttttaatctgtttgctttttggtattggttttttccagcaatgttttgcaatacgtttgtccattgggtgggtaattctgttgaagatcatctatgttgacccgttccaggcagcaattgtgcgcaccttttcgtagttccattcgtcttttaaagcccagaatcggctgttattctgtgctcgctcaaatgtcaactgaggttgaaaaggcgcagaaagcgaagccgggcggagacacaatcttcgggaagataatccgcaaggaaatgccttcgacaattctttatgaagatgacgaggttctttcaaatcgatctattccttcattttgttgttttttaggtgctcgcgtttaaagacataaaccccgaggcacccgtccattttttggtcattcctaagaagtgcatcactgctctgtccaacagcgaagagcaggtttgctgggcattttatatgaattggattgtttccgctcttcccaaactcaggaccaagcagttctgggcaaactgttgctgacagcgaataacgtggcaaaggcacagggtctctccaacggatatcgcattgtgatcaacaacggtcgccatggatgtcaaagtgtgtaccatttgcatttgcacgtgcttggcgggcgtcagttgggctggccaccgggttaaacacttggaaatgtcaatcttatcgattgattttttgaagggacttctggcacttttctacacactttgttggggaaatttggctattttaaatgattactgaaatgacattaatttattattgcatcatactatattccccagataaaaagtgcaaaaatgaataataaaatctaatgatttgtaatatgacttttttcctgacaatgatcgttttattccccgttttgcggctgttcagtattttctttccanagagcatgttccatagtggtacttttccttaagtgatgaaaattcatattcgttt

SEQ ID NO: 10048 - DNA, 544 bp, Heterodera glycines
caatcagaaccaggatcagctgtctatcctgaattatgaactggtaaagttcggggaaagtctttccaatttgatataatatttaaagatatttccatttaaatccacagattcggtatgacattatgaccgacaaagaggccattcgcaaatagagaacgtacgaacattaacccggaatcaattcggtaattggacgggcagttttttattttacgggaaatacagtaatagaaagtcccctccccccctcagaccaacctgagcatgcaattgccatggagagaactttcgcaagatgggcatgtgaaggaaagtcggcgaactacgattggatgtctgcacaaggcgcatttcgacaggtgaaaatagttttcgagcatcggctcgagctcagcaacagcggaggggtgaagacggatgacgccactctctcgtgggtaatcgctccttttctgacaaatttttgtaacaagacatttacacttggaataggccgtcttcctcacctactaatttagaaatttagaagattttcaagaaa

SEQ ID NO: 10049 - DNA, 1979 bp, Heterodera glycines
  misc_feature (834)..(834): n is a, c, g, or t
ccggggacctctagagtcactgaaaaacataagatttgccattctttcccatcagtttgtcttttccatccgccgaaattacctccactcctttcaaatttggcgtaacaaaaattcgatttgtcgcttcccaatggaaaacggagggcaaaattacggcggggaggggacgcttttgatcagagctaaattaaaatgagaaaaagcattcgggaaagaaagaaaaacgcaccaattgccaaatataacgaacaaattttggatgaaaattgtgaagagacacggcaaaaaccgacgcattggcaaattgggaaaagaaaaatggggaaaaggggaaaggaaacaaaatccaatggaagagcaaaaactaatgaacagtaaatggaggtaattatttgctttgctgttaagttgcagggctttattagaatttcgctttactaatcgttccttttggttcccccccggggctaacatcactttccgctgattctctggcatgtaaaaactttggcattttttaacccggtactcgtgctcatttggcaaaaattagaaatttatttttttaatgaatcgaggggtgctttatccgcccacaaaatttcattcagaaatcctacggctggggaccattctttgtcaatgcatttatccaatttactttcatcggatcagtcaataaaaaatgtaaaaagcatcagctgacgaaggaattacaaatggaagaaaataaacaaatcgaaggcggaaggaaggagaacaattagtgggggggggggattaagtttcttgacagatgaccaattaattaattagccgatgaatgaatgngtggggattataaacaaagtgaaattgcaattggtaaattaaaaaatgaaaattaaaaattaaaattgaaataaaaattgaaattgaaaaatggaaataaaataaaaattaaaaaatggaaattaaaaattaaaattgaaaaattgaaataaaaattgaaattgaaaaatgaaattgaaaaatggaaataaaaataaaaattgaaaaattaaaatgaaaaattgaatatttattcgctgtcgaccattgattaggaaaatgcaacagcagcagaagacaatttatgggaagaaattcatcttttgttgaattgagttgcgttttgttcgcccaattcattttcacaaataaatcaaccattttcactttttgtttacttttgcccaattttcgattgtggggacatttaaggaattagccttcacaatgaattgggaagggatgagaaaaaaggggggggggggagggattttggatgacgcaacggatgagagcggggggaaaagcattggagggggggggggaaaagcatttggggtgagtcattctgtgcttaatgagtgaattaatgaccattataaaaagaacagcaggaatagcgttggacggggaataattgggaaaggaatgaaataaatttaagaaaaaaggatgcaatggcggataaatggctggggacgacggaggggcggacggattgatgggggggggggaataaacgttgtaaatggcgtaaatggggggggggactcaatacgaccgttacctcccctctccgaataccccaatgaaagtccaatcgtgccgatcatatatgactaaccaacaatgaaacgaaaattcgcctaaccctgatcccaatatgcatgcaaaaaattgatcaaataactatgatcagtccaaagagaaccggctgggtcaattttactgattcgatcaggcaccgattgttctctctcgttattaaacaatgattctgatcaggataagttgccattaagatagagataatcatactatcttccatcgaataaatttatttcccattaattttttaaagtaattgcccccctaagcttttttaataccaaaaaattaagaaaaatctccaaaaaaaaaataggatttttatttaattaaaaaaa

SEQ ID NO: 10050 - DNA, 1602 bp, Heterodera glycines
ttcgtccgccgatcggtgtttcgtccgttcggcgatcacttcagtcagcttctcttctgccgaatgcttcttctgctccccctctctcacttcgttttcctcctcccattccgcaaaaagtgctttgaattcgtccggttccgtccccccattaattaaatgtgccgttgcgtccgatgcttttcccactgacttttcgaatgcaaattcctgcccgtaccaatagagaaaggccactttgagcacaaaagtggcaattggctgttcgttgtcggcccatagccaaaggtgctttccctggtccaccacaacgcaatcccttggcatttatttgcatttcttttgattttaatggtgaattggccaactgtacctcaaatccttttgggtgaaggtgaaattggcctgcggatgagcagtgttcatctcccaaaattcattgtcccggaaacgaaacattttcggtgcctttgtccattccctcggcttcgcaatgtcttcccccaaatgtgccacttctccggtccatttcagtccctccgcctcggctattttcttggccaatgctttcgaactttccaaaagtgcgtcggggcattgttcgcccctcaaacattcaatggacccatcgcaaattcgcacgtaaatgccctgagaacggaatttgacagggaagcgcatttcctgtgccaagtagcagttgccggagcttccgatcacgcaaaggacgtttgagccggtgcctaaacaaattgcgccgattttccgcgtgattggacggtctttggccgagcgatggctaaccccaaacgatcaatccgtccaaaatgtgcaaaagcatcggcgcttctttgcccgcttccactcgaatgtgctcgcacagttcggtgtccttctcgcgcagtgccaacgcacaacggctttgctccgcgggggtcgaacgcgggcccagccaatagaaaaagcatttccttcgccggccgcactctctccgcgccgcggcactcccgtccaatttgcgtattcctaaaccattgacggtcttttaccaccccaatttgtaagacctgtcctctcaattcggtactcccattcgatcacataacatttgtccgcttcgaattcgaccaatcccttcctccgctgccctttctctttcaattgctctccaacactttcgtaaattcgcaatgcttcagtgaacacattcttttcatccggtctcaaaatgttgtcctctaatcgcaattcgccgcttccgttcggacttttttcgctcattttcgctgccgtttctctgatcagcgctttttcactgctaatttttgctatgcttttggcctcacacggaacggacgaaacactctttggcctttgtcttcaaaattcaaattttaattttgtttcaattctctcaaattacgaaaggcttttccttctcctcgaattgtttggccaattactgaatttgtacttgaacagtgtgtcaacaatgccttcggaaattcttctcaaaatggtccattccatggttgaagaatgatcattttgacaaacgattcgtttggctttgacatttggcagacccttttaaattaatta

SEQ ID NO: 10051 - DNA, 1714 bp, Heterodera glycines
  misc_feature (1708)..(1708): n is a, c, g, or t
ttttgttgtgccattcgccatcacttcgaatattttgtcctcctcagaagtttccactcctccgcagcattcgtttagcagattttccttttctatttttgtatccgcttcatcccttttcaaaagcctccaaaaaaggcactccgtcttctgatcatcattgacaatttccacccgaatggcactcgtaggcaattctttactcgcaacaatttcgtacgccatttgagcgatctgtttcacgcattcacaattaacccaacttcggaattggcaaaacctttgaacggcaaataatcgctgcttcgttcccattgtaaataataagccgcttttgagtaattaataaatatgagcagtgatcgttgatggagcagcagcttggcaaaacgaggcgaacaaagggagggttagctgaagggaattcggttgatggcaaatgccgagagtcttgcccgatgcgcggattagcattggcagtgggaactgttctcgccgtcttcgctcttcttcggccgagtccctcagcttcacgccgcagtgttcctcaccaattatcggctcttggtacttttggggagtggaaggcacagacagcgacataatgtgccgatgaaataacaagcggactgactgtgctgctctcgaccacactcacatttctcgaagaattaattaatgtaaagggggtggggcgagcgtcgtttcgttgttgctaagggaggggaggggggggggagggttaacagaagcaagaaaatgacgagaggaagaaacaggccagaaaataatagatggaggaagaagatgaaaaggaagagtaaaaggaaaatcgaacggaagagcaaaaggaaaaagtagcggaagaggaagtggaaaaggaagaataaaaggaaaaagaaacggaagaggaaaaggaaacggaagaggaaggagaaaacgaaaatgagagaggaagaggaagacgatcagtcaccaaaattgcatgtgcatttgtacaaacaatattattattgtgcttttgattggatcgacttccatctgtcagtttggtttttttccctccctttccgtcttcccttcccccccgccccccccccctctctctcttttgtcatccccctccccctcccctcccttccccttctcttctcccttctcttccctcctccctcttttacgatgagtctcctctctctcaacagccattcattcagccatccgtaattcatcatccattttcggaagaatgaaagaggccctttctgtccaccgagaagggaggactcgttcccacttgagcggtcttaaatttcaaacaatgttttgtattgagccaggaaagagagagaagaaacggcggattgtgaaaagagagtgaagaaggaaaggaaatggggagagacggaagggaaggaacagcagagagacggaagggaaggaacagcagagagacggaagggaagggatgcgatttatggtcctggatgggaaggaatgggatgggaagaagggactgaattggatgaacggacgaagggattttatggtcgtggatgggatgagatgggatgggtgggacgggacggactcgagggatggaattgggtgaagtggcgtcgtcggattcaccccccaccctccaattgcataatcgtcgttcaattagcgaccggtttttggcccattatttggcttgaaaccgaanggatga

SEQ ID NO: 10052 - DNA, 1256 bp, Heterodera glycines
tcgctttttcctaaggcaatcgccgggaaaagcgaaacggatgccatcgatgccatttttcacgcgatgattcctgacgaatcggacgacaaactgttacaaatctccgtcaatgaattgctctcgggacagcaaaagacccttctggggatgtgctggagactaatccaaatttactgggcaaaatttgcaccttcgccgtccaacgaacgaaaactgacggaggcattgaaagaatggtaagcaaaggcatttaaatgaaaaaacaaattaaaatattgagacaaaaaccacattttatttaaatttccgcaaaggtgccttgaggcgactgcttcttgtccggacgtgctcatcaacgacttcacctcgtccttccgagacggaatggccattaacattctgatcaagtcctttgacgagtcactgatcgaccttcgcgaaatcagcgaactgaggggcgaagaccgaatcgaaaatgctctcagtttggcaagacggcattttcgggtgccgcgactgatccaaccaaaggagttttacagcgaacatttggacatgaaaagcgtcgcgtgttatttgatgatggtttgtcggatgaagcaaaattgggccgagtattcgtttcccgcgtctcagctttatctgggcatgtgtgagaagacgggcacgctgcagcaacggcagccgacgccgctcagcaggagacggtcgaccatttcagcacatgcaccggccgatcagtcgccccacgcgaccgttccgtccatcggacgaccttcgctagtgcaacagtcttcacattccatacagcaaagtgatcaaacaatacagacagcagttgatcagttctgttcagtgccgcagtccgtgccgacaatcgttcacccgccccagcaaagtccgcctgcgcaagtgccggtttcaccagcgattcaaataccgacaatttcagtgggcactatcgtaagtgtgttcaataatgtgattgatttgttctttttctttgccttggagctccttcaatccaaacccaatcaattccacttaattagcccaacactttgctgacccctccggcgatgtcccaatgccccaaggccgtcgttccaatcagtgtccccacaacagtcatttccccactggcccagcaaacacacagtcaaaatgaactgctcactcatcaacaacaacaacaagccattattttccatcagcagatgcaactacaacaacagcaacaacaacaatcccaa

SEQ ID NO: 10053 - DNA, 975 bp, Heterodera glycines
  misc_feature (25)..(25): n is a, c, g, or t
  misc_feature (850)..(850): n is a, c, g, or t
  misc_feature (888)..(888): n is a, c, g, or t
tgaaaaataatattttacataattntggttccaatgaaagtgtcttactgcaagaaaaatttcgatatttaaaatattcttggctattaaataataatttaataaaaaataaattaaaaaaccgcgagattaatgcttggccaagtgcttcccgaaaattttccatcttccacctttgccaatgcttgtttccgtcgccagtcgctgtgctgttgccgtttgccgatcaatcgatgcccaatggccaactgggacagtaatagaagtaacaatagcaacagcaaccgtgacaatgacagtaaaaccgggatgtgccccatggcggaagcatactgtagtgccggtgcctttcttctaccctttttgtcgttgttgttattgtagttccgcttcttcatcatcatcatcattagcagcattatttttctgcaggcacacagagatagtcgctttaattgaaaaaattgcaaattttttaaattttttatcgatcaacgagtgcctattttttattgatcaacgtgcgccgaccgatcgatcgatgatcggtcggcggggcgctcatttcgacgaaaaggcgcaaaaaaacctttttggtcgccgccgccgctgctgatattttgcttattcagcatcagcaaaaagcagcattcagagcaataaacaaaacaaaaaaaaaaaccagcaaagaaatggggggggggggaatgcttttccatcattatgcatacgattaagggatgctaatgatgataattgatgtgatgaatcattaggcctctatttgttggccaattatgtctcccacatttagcaagcagtttgcattttgtgggcggcctgttgctgngccagcagccttcattattacatattttctgctaatgnctgtcgttttgtcatccatccattcttatccccgcaggggttttctatttttcgtgtgactatttttgtctttatattttgctgtgc

SEQ ID NO: 10054 - DNA, 3013 bp, Heterodera glycines
atctttgtgaaaaataatattttacataatttggttccaatgaaagtgacttactgcaagaaaaatttcgatatttaaaatattcttggctattaaataataatttaataaaaaataaattaaaaaacagcgagattaatgcttggccaagtgcttcccgaaaattttccatcttccacctttgccaatgcttgtttccgtcgccagtcgctgtgctgttgtcgtttgccgatcaatcgatgcccaatggccaactgggacagtaatagaaataacaatagtaacagcaaccgtgacaatgacagcaaaaccgggatgtgccccatggcggaagcatactgtagtgccggtgcctttcttctaccctttttgtcgatgttgttattgtagttccgcttcttcatcatcatcattagcagcattatttttctgcaggcccacagagatagtcgctttaatggaaaaaattgcaaattttttaaattttttatcgatcaacgagtgcctattttttattgatcaacgtgcgccgaccgatcgatcgatgatcggtcggcggggcgctcatttcgacgaaaaggcgcaaaaaagcctttttggtcgccgccgccgctgctgatattttgcttattcagcatcagcaaaaaaagcagcattcagagcaataaacaaaacaaaacaaaaaaaccagcaaagaaatggggggggggggaatgcttttccatcattatgcatacgattaagggatgctaatgatgataattgatgtgatgaatcattaggcctctatttgttggccaattatgtctcccacatttagcaagcagtttgcattttgtgggcggcctgttgctgggccagcagccttcattattacatattttctgctaatggctgtcgttttgtcatccatccattcttatccccgcaggggttttctattttcgtgttgactatttttgtctttatattttgctgtgcaaatgatgggaaagcatgggagagaaagtttcacacctcattgggaccggatataaattcgagaaaaagctttattaccatttatggcactggcaaatctctaaaatgcccgggacgaaatcagagaatttcccaggccatggtacaaaagccagcgagtctttgacgtcaagtttctcctttcactcaaagccttgggaaaatctatttgaaattatccaattttttatatgtataccgaaaatatgctttgaaaagacgcaaaagcctgtcaagcttaaaatgggttaattaactttaataattcattttctttttttggcactgtacactgaaatcaacacaaaaaaaaataatcctcattaatatggctttgttgtgttaatcggtggcgtgggtatttattaatgatgctggtgtggcatttagcaataataatactaataatgacaataatgaggcggaggacggcacggaacacggacaaaaccagcagcagcagccaaacaacttcagcagtttacatatcctgtgccatgaattaaatttgtcggcttcatcatcatcattaaaaaaaatgtcgtacgtactttatgccgttagagttgtttaatttgcgtgttcatcaacaaaatagtgcctttctttctttcttgcttcaataagaggaagttaaaatttcccggtaattgccaatggcaattacttgttaagtacaagggaaattagatagtcaatgacaattagttgttataattctgggtaattagttggcattagtcattatataaatgggaaagttaaaaattctgggtaattaggtaattggcaatggaaatagtcgttaagtacattggaaactctcgacactctttgtctcattggtcttgaacagctgaatttttttgaaatcaatgtaaaggggttcgcctttttgttttgcttggaagcataattcgtgctattgataatgagcgagattttctcgttgtcggtcgttctcgccgcccagtcgagtgtttctcttgggcagtcttttaattacatttaaaaaaattgtaattagctaatttaaaaatgaagcaaattatttggtttttttattttgttcaatttgtagagaatttggcaaaatatatgtgagcctctcgacatcgatttttgaatcttttaaatcgacttttaaagggaaaaaaattagtggggaaaagaatgctcgcagataaatgtgcgagagattctctttaatcggttaaaatgtccttctaaaattttacaatgggagacggacggtgcacgctaaaaagagatttttaaagatattatgcattaattaatgctaatgagtgagtgctgctgtttcgatggtttgatgggtcttgaccattaaaactagcattaagaccccacccgatgcgggaaaatttagtccccgacaatttctccaaccatccacgaaaaatttttgtcgggaaatttccaccccgatccctcgcccagtgtcgggggcttaaccctaattcaaaacatttttcggacaatttttttttgactatgtctttaagaacgaagaataaatttcgataatttgtactaatagtcggtgaagagtgagtgagagagagagggaaaagggcgggattatggtcattagtctcgaccatctccgttaattgctaacaataagggtgtctgctccttgacgcaatgccttttaaaggaagttttaaagtttaaaatgttggtaattatcgtttgctgcttgctgctaatgggtaagtgcgaagaagaaacaaatcaatgggtgggcgtcggtgttttaaaaaagggggtttttcgcgacaaaaaatgcttattaaaatttaaacaattaaagcgagatatgatacgcgcgcgagactctctctctctctctcgtccctcattgaatttcgacccatccccccgggcatcgtttccatgagaggtcgtccattcggcgcgcggcgatgcttttcctcctccccacctccttcctaccaaccaaatgctc

SEQ ID NO: 10055 - DNA, 765 bp, Heterodera glycines
gggttcgaaataggtcgaaatagatgccggattcgtgatcagcgaccccgaaaactctaggaaacatgtttttatgttttttgaaaacaaaaataatttttttcaaaaaggggggggggtaccatcgacaatattaccaaatggcggggaccagcagacgtttggggcatgggggacgaaacctaacagttcgtattaacaaagagatgaattttcaaagattaagtaatcatttagatgagatacccttacaaaaacgcagcaaatgaaacatatttaatgttacaattacaaaataaaattttcaaacttttatagtattgtttgggcttttaaaattaatatttggcgaaatgtatattatatttgacacgaaattgcattgaagaattgggctaaatctaaaattacaggggcaaggaacgcatgttaaaaaggtagccgggtggattcctggctgaaatagaattaggggtatctgttaattattgcccccggatttttcaaaaaaaaaaaaaattcaaactcgagattagttggttttaggggttttaaggtcgggaaaaaccgattcttgcatctatttggcccgattcgaaccctgaacccggatttttgaacaaaaaattgaaaacccatttttagacgcataaaagtcgtttgcacgcgtgaaatgcagtagagctagatccccccaaagtgccgatttttcgttatttttttaaaaattcttggctaaaaattcgattatttctcacagatcat

SEQ ID NO: 10056 - DNA, 1243 bp, Heterodera glycines
cattttttgcgctgcgtatcggtcgtaaatttcttctacgacttgaacttctccgtaatgattccccgcgcccaatgtgccgagctgagtttggcctttcatttgaaaatgctaaactcaaaaagacctgcggaaggccccgtttctttgctctcaaagaaacttttgaagcatcggcttgaagcattctgcctgataaaaagggttctttaattcatcctgcatttttttgcgaaatgaccatattcttcacaatgctccttgtcttccgcccatgagtaaccctcgcgaagcgtccaatccattccctaatttgttaaattggtgaactgttcaacaggtcggaaattcacaaaccatctcaaggcattcttcgaagtctctcacattgattgggataattccttttgagccgatcccaacgggaatataatcgaacattgtctgcgcaagctgttccttgtgaggctgaacgtccttttcgaagagatttgttctgatcagtcgtacgccacagtttatatcgaagccaacaccgcctaagaaaaacaatgcatgaataaggtcgaagcaatttcaacaatttgcctggcgaaacaacggattgtgggtcagctgaatcaaaagcggcgatgtttccaattgcgaatccgtagccggaatgaacgtcaggtagtccgatcgaatttttaacaattgcaggtaatgaggcaacatttccaatttgtttcactgcaggcagaaaaccagcagccgaacttatcgtgctgacttccaactcatcaaacatcagtttctccagcgctgcattcacataaaaacgaccttccaccttaattaatgaactgtttctgaacaagcgagcaaacttacattcatatttggcacgaacccttttttgattttaaattcgacaggagaaatccgttcaatgaaattgagctcatctttgtaagttctgggcattgtgaatttttaaaatataataataattattattatgtaatagtattttaaagctctaaacacatccaagtttatgtgagggtttttcctctagctcttgtctttgaaaccaaacatatctagaaatttagcggtctacctcagttgggccggcacggttgggccccagcatatttttccactataactttctataacttttttctttgtcatccaaagcaagtaaacgtgggatcattcgaaagctagacatttttataagctgtttctacgctat

SEQ ID NO: 10057 - DNA, 4035 bp, Heterodera glycines
ataaattttaagttttgcaaagttttggcgttctcattactaaataaataataaacttatttgtacttggagcccaaaattgaatcgccgtgtggaggagggggtactgaatatatttatcaaaaaaattttattggcgaaattattagaaattatggaactcactctgtattgcttaaaaattcaaaaagtatgaaaacttaaaaaagcagctgaaacaaattgtttggaccttggttttaatttctccatttttttaaggaatgtcgaaatcagataattcagaaactgcaaatattgagagtttttcaggcacgggattggaagttggcgaaccaacctccaagggaattttaaaagttttttccagaatggaatccttggttcggggggaacctggtggaaaaggattgaagcaataccacacaggccggcaacagaatattttggaggcatccaaacattaatatcctttgtagttatctttttaaggcaaccgcttttcttggatggcctgtggcttttttactactgttgggcaggcgacaccatttggacaagagctcatctgcagatactccctttctaaattactctccgtttgtgaaatcaccgtacttgagttttcgacaagcttaacagttgggtggaactaatttccgcttctcgtcggcttttcgaccatgtaaggcgtgttcagtccaatctggcagtggctgctgtgatcttcaaaaaagttttttttgccatcatgcggtattcgaccattttttaagtttcttcccatttttcgacgcgtatttgtccatgacactcaacaaacttcaacaataattccgtctcaaaaggccaaatacaaagatccgttcgatgatctctcgtgttcttcgctctttgattttatatggacattatttgtagccttacgaagtttgtttttagaaaagaagtttatacttcagattaattgattaattaatcctttgttatttcattaatcatgccgcttttacagaacaattcagccaatctcaagaagacttgttgtgttcgtttcaccttcttttgtgtttggttgactatgtttttgatgctcttcagcgcgttgggcagcagagactgttgtgttcttcgtttggtcatttgttctgaaatggttttggtaaaattttgttttagtccaatctctctgttccgatggtcggtcttcacttgagtttctctgtgatgagtttgacggagttattttggaggctaagcatttgcaaattcattggctgtacccccggcttaacaaattgtcggcagaagcggagattgttggttatggagcagccaacggcggattgttatttaacatcgaagagaataggtcttttggcatctttttcaatatattttgttctttgaagaagagtgtttgaccagctttacaccgaagcattgatggtccgttcggaagtcgatgagcgaatgtttttggtgcttttcctacagaattttcagttgctttatgatcctcaatttgatggtgggtgtacttttttgatcaatgttatctatttcattttgcagagcaagctgtgtcatttttattaaagtttggcgattttgaaaaacgacctataaacgcccaattaatgatcaaaaggacctcacaaaattgtttcgagaagctaagcaatcgcaagacaaatagcagacctccattcatcggcaaatcatatgttataacaacagaagtaacttatttttcatattcaaagcttttggaagaagtacggtttacgtcatttctcgagtgtcgttttgagactttatgttaacaattttagaatatctgcttataattctttatcattgtacgatgaaaacggtttaaattaacaacaaataaattaaaaatttggcatgatatgtgagacattttttgagcgagaaaggaaagaatcgcgataaggttttatgatattgaacggaggctcgttgtcaaaccaaaaagtatagtctcgaaacgacttacaatttatcccgaaacgacctgtagcccaagaagtcatttatatttctaagcataaaattgttaattttagacaatttgtccaagtgcattgtcttcggatgagcaaaacgaagcacaaaagattcgcaatttgttgtcgtcatttaagggaaacgaagacgatcttcttggttatttgttcgaagactgtttggaaaatccaaaagaatttgttgcagacaaaggcaaaaatcatcacatttagcatttatcaactccattttattttattatctaaatttcagttgaaacttggtctcggaattttgcgtgcaaagctgccaaagaaatcgctttgaattccaaatttgacagcgaatttcaatcagaaattgccatgcgaatagccgaagtagggaaaaagagcattttaagttagtaataaaacaatttcagatagaattactcttctattacctgctgcaaaaagttgtgaccaatgacagagaaagaacagtgaatacggggatggaaaggcatttggatttgggggtatgcaaaataaataaaaattaattggtaagggaacgaggaatctaatttatttactataatgcttcgtttaatttgcttatttaattttaggtgatctttcagaacttggaatttttggcttccgtttttctctgttcgtccgaattgattttgtttgcttgcaatagtcaacgacatttcccatggacaatggaactttttcgggacgccgtttcgcctatttctttttacaaaatctttggattggtcgttggggcgaacaccggacttagcagagaagcagtgaaccatctgaacagagtggggggggggggagggggagaatgccgtgccatttaggaaagtctcacaatcagatcgaagagagcgttttggaagaatttgcatgggcaaagaattcgcagctttggtccgtcctcaaccttagtcattcggtcgatgcctacggcgaaccttcgcctgtgcccgcctcactcattttgggcccttcttccgcctcgtacattcagcgcagcattgacctttctcctcccatcatcattttctttaaaaaggtaactttgctcacaatcagtgttttatggcgatgggcaatcacacgccgttttaggtttaccatttggctgcgatccgtctttccgatctttgtgaacgtttacgtgttgcggacgaactgatccggcacaaagcttggactctcttcgaggtccgttttccagaagaagggtcatggcggttgtccgatatttcagacgaatgatatttgataaatcttatgactaatttttcaaatagaaattggcaattttagcacgttttccgaacaaaaacccatcttttgatgggccgtcacttggaccagcttctgatgtgtgtgctgtacataatcgcaaaaatttgcttgttggacaccacttttcaggagataatgtgatgatacgaacacaaaccatcgaactttgcattaatttcaacatttcctttttaggtttcattatcgccgtcaacctcaagcgactagtcgaatttacagaacggtactaatggaagacggaaactcatcggaggatgagccggaaaagaattacgacgacttaataaggtggacggcggtgaagcatctccgaattggaatgtttgaatttagcttttacaatcgagtctttgtgaattgcgtcaaagatattgtcaaagtgttacattctcccgggtctgacggcaaagaggttgaatatggcattatggcatggcttaaccttggcttttgctccagaatatcggtccgttgatcccatttccgaaaatctcgctgaatccgttgtcccccgtcaaaatgatcgccgaccgagtcaatgtcatgtcaatgtcgcaatatgcacagaatgtggcccctcctcagcaaatttcggcctctgtctcgcgcggccgttacactttaaagcagtcaccttcgaaggtgtgcaaaagcattcaatgtg

SEQ ID NO: 10058 - DNA, 4060 bp, Heterodera glycines
tcctagagcaatttgatggcattttgccaaaaccattcaaattatgaaattaagacaaattactaattattttttgactgaaattatttgttttatttaaggaatgccgagaaaaacttgccaactccgaattgagggaaacgaaattgttgtggaataacggggagctgaatgctgagaatgtgagaaaaaagaaaacgatgaaatttcaaaagtgaaatttcagagggcgaggggcgaaaacagaaaatttaaacttttttatttcagagggctctcaaagcagagttggaaaagcagaaacggatgacggaacacattgaattgaaggcgaaagtcttcaatatggagcaggaaaagcagcaattcgagaaaaaatacggtaattttgaaaattaattacaaatttccaataccgtatcccgagccttactgttaaataagcatttaaaaaagaatttctttaaaatttcatattttagtttccgtcgatgtgttcaattcattggtggaacgcatcaaacaattggaaaatcaacagcagaagaaagaggagggcagaaatggtaaaaaataaaaaaacggacgtaaaatttcaaaatttacgaattcttaattaacatttaactaaccgattaccaaatgcaattaaatttcagtttctgttggtcaattggagacatttttggcagggcaaaagcagccaaaacagcaacagaaggaaagtgttggtcaacagcagaagaaggaaaacgttcaacagaaaatggatggaaaatgttctgtagtgaatgtcgtgggtgggcacaaaaataatttaaaataaagtcattaaataagcgattaataaacaaacattaaaatttcatttgttttttaggaacttcaaagggtggcggcggtcattcgccgccgctggcggttatccctgtgaaaattgcaaaggttgaaatcgtatttttcataaatgcaaattgaatttccaacaggagttgccaaattggattcaactaaatgtttgggatgccaccatttgtcacaaagacatcgaaatcaccgggcaaagccaattgacggtcaattgtaagggcaacggatttggtaattaattgtgaaattgaaataaataattaaagtgatttttgataggatggcattctgtgtttgcgaaatttcccatctccaaatgttgtcgtcccttaattttctactttgaaatgaaagtcaccaaattggaaaggtaaaatgacattttaagtaattcaatttacaaattcgcataaaattattatttttgtgcatttattggtaatttttcaaaatttacatttttatagttttgtctcgattggattcgccaccaaggaaatgccactggacggagcaatcggacagcatttgaacagttacgggtaccgaagcgatggctcattaggctgcaatggtatcagtcggccgtataaaatgggatttggcaccatgccaatgccattcaacgcggcggttggacaacagagggaccgccgctacgttgggagtgccaattggccatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacaaaaaacaaaaaaagcaaataatttaaattcaatttgtcagatgactcctcttttttcactacaactcccatcaattctctgtttccatgcgtttctctgtggactggcgacaaaattgaggcgaactttgggccaagtttcaaattcaatttggccactctttgaagaaagccgaagaaacaacgaaagggcgattagcattcatttaattaattaattcaataatcttttttctttattttatttttaattttttatattattttatgatgtgtatttgttaatcaaataattttctgtttttttattcacttttattttctgtttttccttttttatgtaaagatttggttaaaaagagaccaccgaagaaaatcttgaagttgaagtaattagtaattttgaagaaattgctaaaactattaaattccccaaatttcctctttgttctttccactcattttggtgccattttattaatatttaaaatcgtttaatgggcctttttattaattttttcgcacttccagcagaggcaacaaataaaagctatttaataaagaagcatagatttttcacaaaatacaaagttataggaatatgtgatgaatgttaagcagataaattttaacaaaaaataattcattttcttacaaataaaaataaaaaagaagaaaaaagcttacaacaccttcgattcccaggacgtctccgttccaagtactaggaaggcccaacgttgcttaacttgccagatcggacgggatggcgtgctttcaacgtggtatggtcgtaagcgaaaggggtccatttgaaagcaattaaataaggaaaaaataaagagaaaaagtcgatgattttttaaataaaagatcaaaacatttgaatttaggcatcttttttaacaaatttccaaactggcaaacggcagagaaattgaaaattaattacaaattttgcgattcataacaaattcctttaaaactcataataaagcttttttctagacacattgattttttaattagaaaaactctataaaatcaaaattttgcttaagaaaaaatggttttgtggtgattttaagaaatcatccaccattcttagtggttaaagtcattatttttgaggtgccaatttcacattttattccgttaagaaatcttaaaaatatttcggcaaaattcaattaaagaaaaatgtatttgttcgattagtattttttatataattcagttttaaatgtttttccttttgtggataaatgcaaatgttgatttttcatttgggaaagcgaagatacttttaaatgaaattatggtaaaaatcataaaaaatattttaaaaattttaaattagcaaataaaaaatgacccgcggcagaataaaaatgaatttccaatttcttcatttttctattaattgactttttctattcattcattattaccacatttattgttgttatgaatgcaaaacgtaataatatcgcttaacgtaacccagaacaaggattgttaaagtatttggaattcatttaattaagtaaaaataaaaagaaaaattcaatatttttaaaaaaataaaagagcaaagaatagaaattttggtgttttttcagcaaatttcccaaactcgcaaatcgacagaaaatgaaaaaattacaaattttgccagtctcataaactctctttcaaaatcatataaaaaaatttcatagacgtaattaacgggaatttgaattttatgaattgaggaaaaatctaaaaagcagaaatttattaagaaaaattaatttgatgatgaatttttaagaaaatgaccctccattcttagtggttactgtcgttcttttgaggtgccattttccattttattgtgttctgctaagaagcctaaaaaatcatttcggcacaaaatgcccaaattggcaaaactggggattacacaagtcatcctaatagtttcaactaagctaaaaatgttttttcaagcttagctcgataaaaccagagggcattcttttaatctgaagatatgcggagattaacgcattttgtaagcaaatgtaaaattataaagttagcttgaacttttacagctgctctttggaattaaaaaagattctcttgacccttaggataaaagaaattttttttaagaaaaataattttaaaatcccgtaaaaaggatagaaaataatggctctattttatcactcacgcgcatctctctgcacataaatgttgcgaatgtcggagatgggtcgggagtcgagtacgagaatgtcagggccaaggagtaccaaattaatagaacataagaaaaacttatgaacgatgcacttct

SEQ ID NO: 10059 - DNA, 1377 bp, Heterodera glycines
  misc_feature (42)..(42): n is a, c, g, or t
  misc_feature (1323)..(1323): n is a, c, g, or t
  misc_feature (1369)..(1370): n is a, c, g, or t
cttggataaaattccttcctcatccattttttagcttatcantttgcccaacaacaaaaccaaaaaaaggattaatttatttatttgaaagatatttaattgattgatgataatgacataattttgcctaattactttttgtctacaaatgccgccaccctataaaaggcgaacatattcagcacaaaacagcaaatgttcattaatatatttggcactgctgaattttatttcccaatttacatttctttaaagttttgctatttgtaaattttatttaaaaatttttaaaatatttcttagattgcacaatacactttctttaatttgaaaaaatgtcatcatccatcggttcgccagatacatttttccgttcagaaactgatcagggtaatagaaaaattttaaaagaattacgaaaaataaaaaaataattatttaaaataaaatacaaaatctctaaattttatcacaatcagaagcagcagcaggagcagaagaagtgggcaaatacgaagtgttcagttggcacggaaatttgagtgatcaattgtcagccgaattgttcgtcactgatcagcagttgctgaaggtgggccattttgaatggacaaatgatcaaacagcgggaggggaggggaggccaaaaacagagaaatattatgggaaattagcacaaaatttacaattcgttttaaaggttttctaatgatataaaatcaaaaggagaaagggccgacctattcctagagcaatttgatggcattttgccaaaaccattcaattatgaaattaagacaaattactaattattttttggactgaattatttgttttatttaaggaatgccgagaaaaacttgccaactccgaattgagggaaacgaaattgttgtggaataacggggagctgaatgctgagaatgtgagaaaaaagaaaacgatgaaatttcaaaagtgaaatttcagagggcgaggggcgaaaacagagaaaatttaaactttttttatttcagagggctctcaaagcagagttggaaaagcagaaacggatgacggaacacattgaactgaaggccaaagtcttcaatatggagcaggaaaagcagcaattcgagaaaaaatacggtatggagaattttgaaaattaattacaaatttccaataccgtatcccgagccttactgttaaataagcatttcaaaaagaatttctttaaaatttcatattttagtttccgtcgatgtgttcaattcattggtggaacgcatcaaacagttggaaaatcaacagcagaagaaagaggagggcagaaatggtaanaaataaaaaaacggacgtaaaattcaaaatttacgaattcttattnnacattta

SEQ ID NO: 10060 - DNA, 3733 bp, Heterodera glycines
aaagggagacaaaaaattagagaaaaaaagtaatgtttttctctggcactctctatttattggtacacatctcgttttttcgggacggtgtgttaacagattttcaccaaaaaattacttttttgcgattttgagatgcgaccatttttacattcaaaaggctttttttgcggcatttttcaaaaaaactttttttaggcggggggagtccggcggtgccggcaggcgcccggaaaatttttttataatttttattgcgacttttttgttaaaaaatatgttcaaaatttaataatttttcctcttttcccccttcgctggcgacccccactccccgaaatagtcatccttaacagtgtaaaaatttctcggtttccgagactaagaacccgagaccgggaaccgagagaagcgaaaaacccgagaattttcccgagtcgggaaccgagaactgagactctcgcacagccttagggacaaaccaccacagtattaccaaatatttcacaaattgtcatcttattttttttctaaaattttttttaaagaaaacaatataggtaaacacagcggcccaattttgggctccaagtacaattatgctggatttttcgtcttagtggtctgtgagttagtcaccaaaagggggggtctcaggttcgagtcccatgcatgctgaactgtattttgaggtttttaaagcaaataaatataagtgaaatgataacacagtatttaatgaagctcaaaaattagaaaaaaattttatttcctgaaaaaacgaagaaaaaccttttatcgaactgtgtctattcaaaatcgaattgttcttcttctccattgttttcttcgtccgtctcccgtcgaccaccaatttcttcttgctaaatcaccatcaatcaatgacattgataagcgaaatttcgtcagtttcttcttccggttgatcgaactcatcatgctcttccctctgatcacttcgtctctgaattattatatataaatttttaaataaaacaacacagtttgatcaattgtccggagttcacaaatttcgccgtcctgcaccaaatgatcacttctgcaactgcaaattggagacggaaatgttgtcactgcagaaccacaatgcccgatcattgaccaaataaaactgacgtctccgcccataaaccttttgaattcataaaaatggaaaaaaacaaattttaaaatttaccacttgactcgtttgcccgccaatgtgcctattccgtcaatttgttcccaaagtgtgcttccatagcgctccaagttttcgcggctatccttggtagggaaaacggcacagacgaaattgtttgatggagaatttgaccgagcagcctggctgaatgagacggtaatcttcgtacaactctggccatggtcgccgctcagctttatgtagatttcgtcgccaaatctgatcagattgtccttggcagatgaaagacgcgcctccagagctgcctcaacatcagtgcacacaaatccaacacctgcactagtctcaattggtgcgtattgcaatgacccacagatgcggcgtttgatgtcaagcagctaacaatattcaattgaatttttaaataaatataaatgctaaaatttgtttttactttttcgagtggcgggaacacatcaaatttggcattgatcaggcgaatagtgttttttggtcgtctgtaagccttctgtgtaccgacaagcccgaggatcagaagatcatcctctggatcaactgactttttttgtcttggcagttgttgtttcttcttctgtggcgtgtaatgagcaaatttgtgccgaacttcccgactgatccgttcgagggacgcccggctggctgagcgtgatctgtcccgttttattacagccgcgatttcatcagccaatttgcgacgtgaggtgcgctgcaaatgatcgacattcatcttggtcgtcctgttggagttgctaaaattaaaaaagagaaaattatttgaaaaagataaaaaggggattttagtttcactcacttttgctggtggtcggtgtctccatcggtggtgccatcttttcctccaactgccgccgaagcgcagtgatcagtgcgtctctgttgcggacctgctgtcgaagaaagctgatcacttgttcctgctccttcagctgtttgtccaattgctcggtttgtgtcgcggcgtcctcataagccaaatccacgtccgttgctttgtccatcattgtcaaatccatgtgtgttgcattgtcggtagttgtaaagtccatgtttgttgctttttcgtcagttttttgatggacacgcacatggcgcctgatcggagttgctgacaatggccttgggcttgaacgcgggccttaatttaagtttttcttctaaaatagtgattttttgacttacgaaggtccggagttgacgttgacggccctttttcggcggcctgggtcgatgtcccctctccatctgctgttggcacggcttcggtctgcttttgccctgaaaatgcaatttttaaaataaaattaattttggtcaattttcgccactttttggtgttgaaccaacactgcgacccagatcccggcgccattccttccgttttcgtcttgcctctacaccagaattgctcatattctttaaattttcgctttttttgcgcgtcaagaccatttttagcttaaaaatgatagaaatttattgaaatttacactagggtcaaaaaaattttcctcgggtcagattttcttgaaattttgcccaggctagttttttgaccccatctatcgaattctattttgttttttgaaagtatattttctaactcgagatcggctcttgtgcttttgcaagggaaaatccccggaaaattttaagttttgcaaagttttggcgttctgattactaaataaataataaacctatttgcactgagagcccaaaattgggccgctgtgtttagtaattcaatatgattttcgataaatcgttttttaatttaaattagaatattattatttctggatatttctgaaaatgtattcaaaaatgtgcaacgttacttctttttcatcatagtttaaatcaaagttgccagataaaaattctcaaatcatttggtttccaaaaaagcctcattcgttggagtcaaaaagcatcatttaaaacaaaaaatatatataaaaaatcaataacaaaatgatcatttttctattaatgatcgtttcagcgttttttctgtcttttcaaaatatttcgttaactttcaaaaaagtcaatgactaaggatgaatttttaggttttagcctattttttcctgaactctcagtgacttgaaaagcacgaaaagcattttttcggttgttgttgttaagctacttttcgagtttttagagcctattttagttttttcccaaaaatattaacaaaaatgcaattaaatggagtcagatttctgagcagtattcggaacggtttccgagcttaaaaatgttaaaggaaggaagcattatctacagtacccacgaaatgaaattgcatggcatccgaattacaagcgtatcatttaataaagactgcgcagatgagcaatggtggtgtcatttataaaacagcgagacgatatttcatccaacataacacggagagaagaatcgattggtatatcatttgtgccgttttttacggggcgttgactaaagtacacccga

SEQ ID NO: 10061 - DNA, 1029 bp, Heterodera glycines
tttttgatttgatgagaaaagaacaacaaataagaaacgaggatttctctcttcccccccccccccccgccgatggcaaatgaaagtcgaattggccactgttttattaccctcaggcgaagagcgcccaaaagacgaaggtcactctgaaagaacggaagagttgtcagcggaagggccttttgtgttacggggtatcccaaaatgtgcaggtgttccatgtccgcgtcgatctgtgccaatacgtccatcatcgcgacaagcgccgattggacggattgcgactgatcggcatcggagcagtggcggatcaattctttgagcagcagttggtacttctgttgtgacggaggaatgacatttcggcatggaaaaggccaaaaagaccgtaatccgttggattggcttcagcaaataggcggacaatgggaggaggtggccggcacgccgctggcactccttgaaaagcgaagccattcaatacaatgaaaggcccctcgcccagcagaaaaaccgtgaaaaatctgagttgatcaatcgagttttccttcctcaacgcttcactgatcggtttgttgcggcaataggcgcggtaaagcgaaagcaaacgatgccgctgggcattgagcacaaaagaaatgccatggacggagttggaagagcgctgcagggcgggtaggagcagagaacggtggaaatccaactgagcagggaaggaacgaagtttaagcaacgaattcagcagatcagagacaaagtgatctcttaatcagcgaattgaactgatcagagacggactaatgagacagtgtcagcagaagacgtaaaatgagcatacaattggcattgtttaatagaaaaatcattgaccagctcgcggatgttcccgaacagaatgtccgactgtccgcacagtgcgggcggaatttgcgaattggcactcaaatccaacacttcgaaaggtcgaatgtaatgagtgacgatttcgtccaattcacaaacgtaactcttctcggtattcaactgaaa

SEQ ID NO: 10062 - DNA, 960 bp, Heterodera glycines
ccttttgttttgcaaaattttttttgtgatagtcataaaaatttattctctggggtttttggggtccccgatcacgaatccttcaattattttgatcaattccgatttcctaatctaaatttgaacaaaaaatcataattttaaaaattcaaaatttcgatttttattcgagttcgggttagggattagaaattagtcaaaatacatgtcagattcgtgattagcgaccttttaaaccccggataaaaaattatcatggttttttatcttaaaaaaattttgcaaaacaaaagggtccccccttttgtttcaaaaaggccaacttttacagtagcgccgttttatttgttgcttataaaattaggcttatttaatggtcatgcatatgacagcaaagtctattttaaaccaaatgattttcagcagaagcagccaaggaaacgcagcagtcccggctcattgtccacttcaagctcttcgtcaatcatcgcaatcagctcaacttctcctaccgctgttcctgattcagtttcaccacctttccgtcctctggaggtatgttatcttggccattttcaaaacagtacgtcaagtggtatgaccggcactaataaaattgtcaaattccaacgttttcacatttttatgttcaaaggttttttaaataacaaacgaaagtcaaatttgttggttgcattgtataaaccttgtcgcttttttgtccatttatatcgcatttcctttccacttttttgagttattttgcaaatttattgtcagagagggccaacacttcaaaaaaatcatttgtaagaaattccgaaattttttttttaagacaactgggcctactaacagcaaagccactaaattgcataatgctgaagaaatgcttgccaaggctgacaatgagcagaggggtgttcaacgctttgtgaacaggggtggccaagttggata

SEQ ID NO: 10063 - DNA, 1628 bp, Heterodera glycines
aaactagtcacgttctggtacaaaacagctacaaattcttacttttccgccccggcgctgaaaatgtataaaataacactggagaacaaaattttgacccgaagagcaaaaaaaaaaagtgtttggattcctccctccgattttttttctgactaccggcctgggttgacccccacctccccttttttcatgtatgataattttccaaaaatgcaattttgagtagcgctacgaaaattgtgttctttcacatataaagatttgtgagaacttaaatctttaaatttaattttttattttaatttagaatttttgatttctatataaataaatctttatttaaaagattgaagaaatcgttcaatgaattggaccgagaatcgctggccaagaatcttgcatttacagcaggtagcaaaacatactaacgaataatcaaatctattaccgattgatccttttctttcatagtccgtctcgacagtgatggtgttgacaaaatacagaactcatttttgcgttatttggtccaaatggaattggccaaaaaggagcgagaaacgaaaatgtgtgattcctttttttaatattttgattgaccaagctaaactatttccatttccaggcgtggaattccgatggcggaacggaaagaattccgacgcatgtttgacgagacaaagatgccaaaagcaaacccgcactttgaccaattgttgatatccttcaaatcgggggtatttaaaaaaatcaatcggttttctccaaatgcacccgggtggggtgctgctaggcttaacactggtgtgaggagttggagaaaaccgatttcattttttacaatatattaaactcaaaatttttccctcctagaaatatgaggactctgtcgtactggagcttgaacagtttgccaaatttgttcagctgcagccagtttttacgatgaatcagcagcagattggtcaacattttggacgaggtgcaattttaaagttgacgtggaatttacaaaaaaaaaaaaattcttttttgagcattggcactgacacaattcattcactctcatgtacactttttgagtggcaaaaacaaacccaataaaggcattaggaccatcagtgccggtcagtaataaaatatgtttgtattaatttataatttatttttaaaataatgattcatctattttttgcatatttttgaagaaaaactgctcacttcaatggctgctgatggttcgatgggttacacggaaaatgttttacctgtactccgtttgttcaccgcttttttaacggacattaataaatcggaggtatgtttctatccagaccgtaccccataaaaatttacattttttcgctctgggtaaaaagaaaaatgttttcagttttttttttaaatgttcagagtaggaattgtagtcggtcgattaaaaaggccattttttactattttaggcccaaattaaaaaaaaaccccaaatacatgtttagctgaaatcaacagccctatctgaacctgacgttcaacaagtgccagttcgttcattgcgctcgcgtcccattaaaagggtggtgtcgccagacaatggagcaaactgagcaaaatcagtggacgtgtca

SEQ ID NO: 10064 - DNA, 1544 bp, Heterodera glycines
  misc_feature (84)..(84): n is a, c, g, or t
caaaatttttcaatctatagttttttggtgttcgaacccaactcgatgacctcaacatatgttctttcaaccaactgagtttcnatgcgcagctgactattttggaacattttgtcgagcaaattcagtcgacggactcattcaacatttacatcaaaaaccattgcacggaggaacttgctgaagtacaacagaggaaggcaactcttgaaagagatgtaaggaaacgtattgggtggaggagttccgcaaattttttattaaaaatattggaaaatttttgatgcgcagctcattgactagaaaacaattttctgggggtggatctgaaggcttttccgtaataatgcatttttaaattaaatatgaaaattttgcacattttaaccaaatttgttaagaaaattggcccatttttctgaaaaattaaaaaaattttaatttaggaagtgggggtgattttttttccctatcatggctcggtattttgagccttttttcaaaattactattttttcagttagctgaagtgcgtactcaattcgctctgctagagaaggacataactgtacccaatgaaaaaccagttgatctctcccttatgtctcgcaaacaaagcgccgaatacaatgccaatttgaagaaattcaccacattgaaaaatgatattaacttgtttgagcagaaattgaatgaaacagagaagaaatgccgggtatactttaatcaatctaaacacccagcaaaaatgactgatttttggcgctttttgagttagcttttttagggaaattaatgagttttagggtcagacgccgcagggggaaaaaggggggggggtcgaaacaccatttgtgtattattctcaacataaaaattaagctttattgaatcgaaaattatttttagatcctcaaaatcaacaacaaatgtcgcgttgaaccgcttggtcaagaccgtttccaccgattttattggttctttgccggctcagccgatggttatgcagtgtttgttcaacaacagcaaagggtgggcgaccatctttttatttttttaattgggcaaatcatcaatttgttatttattaattgttttttaagtgttgtccgtcttatattgacctaaaagaaattggcactcaatgcacttcctcaaaaactgatgtcaaaaagcgcattaaaaaggaggacaaagttgacgaaaataacgacgaattattcatacaacgtctgactgaaaatgtggaaggaaggttggacaaattaattttttctaccgaaaagtttttttcccactttttagatctccttgtagcactgatgaaaggtgttgttcaacagaatgttggtggtgcattcagaacattgcacaattggatttgctgattgacacgctgacttcgcgcggtttgcgtgagcatcgactgaaaaggcagctgaacgctttccgcgatctgatcgaggaaggcatgggcaaggtggagcaggcaacagacaatagaagcagcaaagagaatgtgatggttgatatggatatcgata

SEQ ID NO: 10065 - DNA, 4614 bp, Heterodera glycines
  misc_feature (4576)..(4577): n is a, c, g, or t
aaaaagtcattttagaaaaataatattttctgaatagacaattcggtgactttttttggttttaaatttttaatcctaaaaaagaattcatttaagttgcttgttataattcattttttcttttatgatatcattcacacaaattcgaaatttggacaataaattaaaaatttcaactcatttggacaatcaaatttaaattaattccaaattaatttaataaggcccaaaatgaggagaaatcggtgcttgaccgttgcaacggaaaaatgggctatttggcggcaattccgatgctcatcaagcgattgcgcgacgctgcggcggatgggcataatagccatgatgaggggggcgaaacgcggcgaaggggtgggaaaataattgcaatatttttttattttaaagaaaaaaaaatttattttttttgtatgaaaatatatttaattttttattttatttttgtaagaaaataaataaataaaaatttccatttgcaacttaatatgctatttcttaaatgttttaaaattagaaattaaaatttttttatttgtccaaaaaataacggattttttctaaaattcaacggaaaaaaatgtgattaaaaaaattagtggggaaaaaattaagataatttaattgaatagctttaaatatttttttaattaaattttttttttgtaataaaataactgctcaagattccgtttcccacacctccgtgctgttgggtcgtcatgcgaaaacggtcacttgtggattgcatcgggctgaacgctcaacactcaccgcacaacacacaaatttcaccgaagccgagtgggggaaaccattaattaattaataatctaacaaatccatggaattgtgatcatcctgcttcggaaaaggcgattttgcgggaaccggaaaaattatctggaatttccgtaacgaacgccattgttttatagaaaatacccaaatcaaatattcttggtattattcgaggagccctaatgtttcgcttattactacaaaagttgaaggaaaaaatcacctaattatggccaaaaatgaggaaaaaaaacgaattttcaaaaatattttcgtcatcatttttcacaaaacgaatgaaacttttttaaatttacaaggtaatttcccattagcaaagctttttttttgtcatcctgctttgaaaatttttgaacaaaatttgtaccaaaacccttatataatttcactttttcccccctttttttacagtttttacaatgcgctccaggatgcgtatttgttgacggaccagcaaatgtgggataatggctatccccggtgggcagaaacttccgctgctgctgacaaagcgatggaggaggaggaggggcaagggttggacaccgacgaccccattgctggtgatttttgttttataatttattttattttaattatatattttttaataaaagtgtatttaaatacattaaaatttaatttgtttacaaatttatcttttcgacgtttcgttaaacaatcaaatatttaaatttctacaggaaaacggcgcgtcgaaattcgtcagtctgagttagatgcgggcaaaagtcgtatcccatttgtggacgatgcaggcaaatcctatgaatttatacacatatgcagactgaattcatacctggaaaaaacaatttttttcgatttaaaaaatatatttataaaaaaaattaaaatttcggtgaaatgttccataaattaatatattttttttgtgtatttaatttttccatatttcagtgttgtccagggtgtgtgatcgttgtggcaaagagtatcggctgaccaaggagggcgattatgcggccggtgcttccgctgatcagtgcattttccattggggccgggcgtggaagaaacggggtgggtgtactgtattaggatatggtattctggggcaaacacaataggaactcattatcagagttatgttggtgcagatttagaaaaagaataatggctccccctccgccgtttcctttcctccccttcgaaaattcaaaaaaatatcttgaaaatttttattaaatttctagaaaaaaaatttgaatttttttttagcaatctttgggtaaattttttaatagttattaatcatgaaattttaaaaattgttcgaaaaatttttcatttttttctcttgagttttcttgtaaaaaaaaattcaagattagactgataaatttaagtttgaaaatttaaaaaaaaattcgcgcggggaaacgttgtgtacccgtgaaagaccttcttaaaaaacgcgcttctcgcaccgcctattttttcgaattaattttttctttttccattatttgaatttgttttttttttgtaaaaaaatagtttccggcactgtcgagtcgcgctacaattgctgcgatcagccgctgactgtgcagggctgtgacgtcgcgccgcatcacatcacgcagacgcaacgcttgtccaccctccgctgctacgcggagacaccgcgtccgttcggcgtgggcgacccgcgctcaaaaaaggcaagaagcgcgcgcctcgcgcgcacaccaagtgccgcgaaatcaccagacacatgaatggcatgggaaaatgggtgcagctccctccgcatcgtttccccccgagaaaattaaaaaaaccctttccaaatttaaaaatttccaaaaaaatctgaaaatttttggcgatttttcaaaaaatttattaggcattactagtttttgaaaaattttgcaaaaaatcgctagaaattttcattgtttcttgtgatttttttatgaaaaattttcccaaagttttttttcatgaaattttttaggaatttttcgaggggaaaactgatccgggtaggacgtaatgcacccctcggaacacccccccccccacctcctcgccgtaagagacccaagaaaccctctcctgcctgtcaaaataattttttcattgaattttttgtacaggtgtatgcccttgactgcgaaatggtgtacacggtgtggggaccggaagttgctcggtgcgtttgttcatttgttacatttgtcttttataatcaatatgtacatattccatgtttatttaaataaattttctattttgatgggtgcacttcattcctccgtcgtttaaaaaattttttgaaaaaattgatcggttttttttttgaatttctttgaaaaatttgatcgatttaaaaaaatttttcttatgtcttataataagaaattttggggagtggagggaaacgacctgctccggttttcttccccccctccaaatttttctgtttgatgattaaaaaaaatttttttttgggggggggggacaatctgcttcggttttcttaccccccttacaatttttttctgcttttaagcctttccgtcgtggacataactggcgatctgatcctggacctgatcatcccggccgagcaccgaatcgtcgactgtaacacaaagttcagcggtctgaagccggaacaagtgatggccggcgaatgtgatctgcacgaagtgggtgatcaatcgatcgatcgctcgcacaatgattttgcgcataaagcaatcagctcgtttctctattaacctgaacaagccaaaaaaaaaatcgaaagttcctcccctgatcagttgaattacacaaaaaaatcatatgattttttgtaagaaaattccaagaaaaacaaaattgaaacagagatatttggatacatttttagaacaaatttaataattctgcataaaataaagaatcgctggaccaattttttgacacttttcttagaaaaaagatactctaacaataagattttttactaaaatttttaagttttggaattttttttttaaatttttgagtgagaaaggaaacgctaaagagggcgagggggggggacgagctgctccaattttttgttaacagaagagattgttttttatggtacggcctaattcttttttaaaccccccccactttaatcgttaaaaaaatatttttattaaataaattcatccaattgtctcatttaattcgcccccccccccccccatttcttaggcccatcaacgcttctttgagctggtcaacactgagaccattctgctcggccattcgttggaaagcgatttgcgtgcaatgcatcttgtccatcgccgggtggtggacacttctgtacgaaataaatgctcacaaaaaggatgtagtagccatagccccctgctgttaggagactacaaattccaaataacaaaacaaatttattataaaaataagaaaattgagcccgggaggtggggttactgggcggtccagtcccggtactttcaatattgcgcgatctaaaaaaaatctgggtctcattaaacaaaaaattaaataaaagattttttggggggtggggggaaattgttcaaaatttttactagctttccaaaattttccaacggtgttactttaaaaaaaacaaaagatgcggttgtgaacagttgaattaaaatatttagaaaagtaagtaaatttagtttataaaaatttctccaacggnnggggggggggtgaaaagtaaaataatgtcaaagaccg

SEQ ID NO: 10066 - DNA, 2308 bp, Heterodera glycines
tgagtgcattagagccggagtccctttttccatttgctcttttcttcagtcaattcaacacggacggttcacttatgcgcaggcgcgcaaatgcctttccgacccgttaattgaggaagtgactgagcaagtgcacgtcactttggtaacggattaaatgacaaattcaaccaaatgaaacgaaagtttgtcccaaaaaaagggatggcaatacgccggccgcgtggaaagggcggtcagtcggctgatgaacgatgcggtcggccactacaggccaaagtgccctttcagacctgtcgtccatttataaaaggcggaatatttgtggctttttaggattgacgccgtcccaattgccatcggagccattaaatttcgaaatccaattttcattctcgaggatcacaactgtgtgcacgtggacttcgatgttcggatgattgtgctaaagtacgacgagggagtgggagaaaaacgccatgacatttttgtattttaagggtcaatcccggggacgacgaagcattgaacaccgaccaatgggaaatcaccggcacagcgcggaaggtttacgagaacaaactgatcagtggcacggcgtacggatgtctcggtttggtaagcaagcaaatgcggtgtgaactcattagtagagcccgacgcgggatccagccagcaatcccgcatttttttggaaattatgggtttgatcccgctaaattttcatgttttcttgagcaaaaaaaaaaaattattttgaaaaaaataatataccgtctactggtcactaattattgcatttttaggtgtgttcaccagtaatccctggcgtgaagccgggcgacacattcaaggcacgatttgtcggcttccaattccaaaagaatctttgccaaatccgtgcggcgcccctcaacattaagcgtttttgacaccaaatttcattttttcaattttattttctttatttttttattaaattttataattgaaattatgtgaatgttgatgaaagtgtcataggatgaattataagtaacggtcgctcgaataaatggctttacaattagattgattagctataacaatctccgcggacataatttcagaaataggaaaagaaataaaacaaattatctgagaagttaatggtttagaaatttgccattttctattgtaagaagagaatctcgggtcgaaaaacaaacagtgaaaattaaggaattattagcaaatttaggtgagtttgtttgacttgttctgttgaccatcccaaagcacagtttgtgtcatctgttcggtgttctacaaagtttattgttgtgccgtcgtggaagaagaagggattggtacgatcacctcaaaaaggggaagagtccaatgtttcccctccccttccttttggtacctccacgtaagtgatggggaaaaagccggtccggccgtccactgtgccctcaaaccaatgctcgtcaatttgcgaatcgagctgaatgatttggccctctaaaaagtgcttaatgacaaaggggcaacaaaaagaaaactctctctctctattacaatttacgtctctaatgaatgactctcagtttcttcttgtaccccccccgtcccctttgtccgttgttttcccttttttccgtttcgtacccttaaagtcgagttcgcccgggtttagtgcttggaattcgtagagtgccttgcatttgcccttttgtgaggcggtcgatgtgtcattttgatcggcagatgaagccgcagtgacggcgtgggctggggatgaaccggcgccatggttgttggcagtagcgggtgccattgggccggagatggataaattggccaaactgtgccttcccaaatcgttggcactgaacacatggatttgtcacagtttcatttcccttttaaacaggttcccaaagtgactcattgcaaattaaaatttgttagtttaaaagtcccaaatgtgttgatttccgttttttgaaaccgacagatcgaaaattttccctttaaaaaccaacgggctaagtgagtttaagtcactgcgcgaactgcgctggcggtcaatcaccggcctcggcacgtgctccacccgctgacgcgtgttcgactcgtccacccttaaaagacctttcaattttagaaaaatgggaatttgaccaattctacagtacacaataagcaaattttgtagtcggaaaggatttgtatctccaatgccctctacaagccaaaaccctggggccgtccctagggacgaaggaaatcaacggaagggcctttttttgagttttattct

SEQ ID NO: 10067 - DNA, 2592 bp, Heterodera glycines
cctctaaaatgccagataataccccctttgttccttcaataccttttgtttgtttgcgcttttttgcgtcataatccaatcgccaacttttcaatttgtttctatgtgcctaaaaccaataccatcacaacaattctttttttgacatactccctgaaattgaattgaccaccaaagactcaactcgaaatcaaaatttattattaatttaaatcggaaagatattgttaaattttttgttctgctcgggtagtggagctatgggtctgggccggtccatggttgacacgaaaacatgattggacgcagtctttttgtccaaaaataatggcttttttaaatgttgagctaaaaaattaatccccgggtaaatttaaagcgaaaacttttcgtaaaaatgttaaaataagtgaagagaataacaaattatcctcaaaaaagaaaagagataattaaattgcaaaaactcacattgaaatctttgagttcattgttttgaaaatcgctgatcgggtcgagaaagttgtgctttacgttgtcctccaattggtattttacgtcggccatttgacggaaggcatcggccgcgtcacaaagggcctgagaaagagcaaaaaattgtacaatacatcgattatttttcaaaaaacctttccaaagtccgattgaatgccaagcgaacggccgtacttttgcattgtgtccgccaacattccctccgtttggggatacgattgatttttggtggaaccgcgcactttggacattgcgcccaatgcggcgattttggcacgaaccgcttaaaatttgggagaatttatatcaaaatttgcacagggaaaaaacaattttttggaaaacgccggactgaccagggttaggctgtaaatattcgttggtacccgcgatgacctgcgtgatcagttcgtttgtcatgtccaccttctgtaaaaggaaattagaattaatgtcggtgaaatattaaattagcaaaaaatcctaaatttagaaaaatgaattagttttatctcacttctgttaaaatttttaagtgcattttcaactgtctaaatgagatttgcactttttacaagcttaattctatgatagtgatacatatttcgcttaaatacccccactaactctttccatctccgtaaattcttcgtcaagtttcgtcgcctcagcagtgccaattgattcgttcaggtactggttggccttgttgaactgttttttgagcgctgacagagacattttgccgaaagaaatgaaaacaaaactaaaaatgttgaaaaaccatgtttacttaaaataaacatgaaagtgtggtaggttattttacggacaaaatatttcaaaataaaaaagggcaggaagtggtggtctttctctttttggaaatttgagtttgatggatggtggtgccatcatttgaagcgccaaagttccggcgaagggccaaccgacgtaagtccaaaaggacgggaaaaggtacgaaaagaggcaaatgcatcgtggggggagccgttggaggtgaagccaaaggcaaagccaatgaaacgaaaagaaaggaaaaacggaaggagagaaaggggaggaaaggaaagtattgaccgaccgcaaaaaactgcaaaaagaacggaaacgagaaacgggaaaatgggaggaggggcaaaaaaagggagagcaaaggggaaaaacggggggggggggggaggacgcggtgagaaaagcggcacgcaagtccaataattcgcgtgttgtgatgtgttgtctcttccgtctcgctttgctgtgttcatttgtgacgaaaggacgagggaaatgagctcaccccaaccccaactcatcaacgaaaagcggcagaaaaggcgaagagcaaaaaaagagaaaaaataaacaaaaattaatggaaaagcgcaaaattaatgaccaataaaagaataattgttatgtaatttaggaaacaatcaattaattaaaggcacttccaataatattcattatgtaattcagtcatttgttctcaaagccattgcttttgaagcggcacacaaaacaaaacggacagacaaatattacataaaatgctgaatttttaagtaggcgccgccggagaatgttaaaatgagagtacatttgccattggactccatccccgtggatttaaaatgcggcaggacgacacgggggcatctgcagcaattgtggtgtgccgctcaattttatttcactcattggcaattctgccggtgaatggtgcagtgaatccgagaaatatgaagaaaatgttttactgtgctctggtttaatgagaaaacatactcaaaaaagcaaagattgtgtccagccaaatgggggaattgtgccaaaggggtaattctacttcagcagtttcctcaagtgcatggtgtgcatcccatctgtcattgtgcggttttaaatggcatttttaataaccgacaaatttaaccaaatttttaaattatttcgtcccctgccgaagtttcagcagatgagccgcagcagtgaattaagagtatttggagagcacttcactcttttgtaattttggagattcttctcgcc

SEQ ID NO: 10068 - DNA, 1104 bp, Heterodera glycines
tattcatcagcgactgctgactgtaagtcgtacaatgctgtagctcgtacagtaccacttatatatttatctatcatttccattaccgtttcgccctctcatacattatgctcatttcattgccttgtgcttccattagtcttttggcgtttgctttaaactttagaccttcgccgcgacatccgaaagtgcacttattgtgcacagtggcacgaactgagctcagagtgcagcagaagcaggaagaagccgaggaattgtacggactctttgctgtactgtttggtcagaaatgagcacccgtggggacgcgatttgttgacgaacaggtggggataagggatcagcagcagcaccgatcggtcactcattttgaatctcgacggatttagcgaataaaatgaaaaggaatcacagcccccctccctccccttccctaccgacgacggaaatgtccattttggcaatttcaggtccactcattgcatttctcacgctgaccttcgctcatccaatcattcatttctgctgcctgcgttggcatttcttcccacaaatggcctccggcgctgcgccgttggcaatgcccgacagcgcaattgccaatgcgcggactgtcccaacggcgatttaccaccattttatgaggaaaaggaggagagaaaaatcagggaaaatgtgaatgaaagcatcgaaagagaagggaacggaagaagtggaaaagcatcccggagcaaaatagacgaggataaaaagcagaaaaaagccaaaacggagatggcatacggtgggcatacgataagcacaaaaaagcaatagctttggaatagtgaaaaccctcaaaatacccattttcagtgaccgccgctacccatgtttcaccttcgtctgtgccctcttcttttgccaattcattgtccccaatttcggtcacttttcgttcgctttacgcgcggccaatgaatttgcagcgaaaattctcgagagaaaatccaattggcactgatcggcccgcgctgcttttggcccattcggcggatcattcccttcccaaatttcacttggcactcgcgacagttttaacgcctttggcacttttcactt

SEQ ID NO: 10069 - DNA, 5531 bp, Heterodera glycines
  misc_feature (8)..(8): n is a, c, g, or t
tgaaatanccttttacttgggttaagaattaaaaaatttagcctattaaaatatttagaaatttttttattatattgtatattttttgaaaattttccgatttccgacgtttttggggtcggaaatccgatttccgacacttccgaaaattttttgggcctcggaatgccatccctgataaagaccgccggaccccctgttcctagttttttgaaaaattgcaccgcaaaaaagtggttttgaaaagaaaaaaatagtcaaatttatgaaccgttaataatttgatttccgatcaactttttaccgtcggatccaatcggaaaattttagtgacacatcagcaccttttaatgcatcccgccagcccctaaaaatttatttttcagcattttttgatttttggaaattttttgaatttaattgaatttttcgaattttccaaaatcccgcaatcccgcacgggatcccgcaaattttaaatgcgggatttgcgggatttgcgggattaatcccgcgggatcccgtcccgcaaaaaaatttgagttccagtcccgcagcgggatccgcaaatttgaaatttccggtctctatacataacatatgtatgtctcaaaaaagaagagattctttacttggcatggacggtaaaaaagaaaaaaaagcggcaataaatcttttttatggataattatgggaaaaaattggcgttctgtcacatttactttttatctttatttctctcacttttacgtactatctcttcattcttaataatgtaaagaacaacatttacttcgctctatagaacttttttttcgccttacagaatttcttcatattttgcatatcgatagagaaaaaaattctgaatcgattaataaggaaatttaatgcaaaaataaggccaactttagagttattttaaccgaaataataaaattatttttttcaggaattaatgagtaaaaaaaaattaaaacaaaagtctgacgtgaagaaacccgtgcacaaaagatgggacaagcgggaggagcaacaaaagaagttggagagggcgagacaagccaaattggcaaagaaaagtgagtttctaatcaatttttaaagcctaaaatatttcaactaatttcagcagtccaacagcaacaaattgaccatggggaaggagaagctgagatggagcaacaagaaatggaccaagcggagcaagtggaagagacttacgaccatgcaagtgagttttaatgattttaatttcaaaaaatatcaaatattcaattttttagtgcattttgacttccagctggagaatgatgtccaaatgtcgccgaatttggccattgacgatcaacaaccgccgacctgggacgcaacagcagaagcgggagtccaatgcgcgatacaaacaatggaagtctcaacccaaaccgactggaacatccatgctctgctttctgctgatcaaatcgctgatttccgcgccactgctgatcaattccgtgttcacatgttggagcactttcgtcggcactgttcgacttcaaaatttcatcatttggtccaccatgcccctgaatttgctgaaaaccatggattttggggccttctcagtgagcagcctgtggagaaatttcacgcgttgttcaatgacgatctcgcgcgcaaagcaaacatcaaagatctccacgatattttgatgttctgtgctagagaatctgccattcgaaacgccatttttgattcaaatgaactctgatcagtcttttgtagttttttttataagtttattatactttttgttgttatttttcatacatttttcaattttttatatttaataaataatttgccctcacattacaataaatgtttagttttgctgtaaaaaactatgttttctaatgagtttttacgattttaaaacatttgatcagatcaaagatataatttgattttcaatttgagtgtgttggcgttttgttttacgccaattattttttggcaatttttttcgttttttaccgtccatgttgggggcaagcacaacattgttttaaaattgggaaaaatatattttaaagggttttcgtcaaaaatttcattgttttgttgcccgcttcctctcacttgctctacaacagattagaattgacaaaaattgagtgtgatgaaaaatgctggtcccacaaaagaggcagaaagggggggggggtgggttgagtgatttgtgctgttttcggagggcgttgtgattattttccaacactccgagcaaaagtcgatgtttttgtttgtcaatcaaaatcacatccaaaggcaatcaacaaagcaacgtccattcatatttacctattttgcaatatttgtttacattaccttatgcatattttgttattaaaaaaaagtttttacgtgcattaaacagtattgagttaaatttatataagtaaaaaaaaaaaaaaggtaaaattgttcgaattcgggatttggaattggtctaaatttaggtactttcccattatgtgaccgcaagtcaaaacttttctgcaacaaaagggatacataatccatcaatcgagagtgtgtaattgtggcagtgatatgcgtggtgcgagataagaacagctcaggacaaaagaatcccggtttgacgttgcaacaaatttgcgcgcccctttgttgattttttaaaaattttgccttgcggtcacataatgggaaagtaccgaaatttatgttgtattcataatcagcgcacccgcaaaatttgaaatttccattctctactatccatatttttgttcgaaaaaaaatttgcgcaatttttcagtttttaatattagtaatttgctgtgctctctctctctctttctgttgccaaccataaattcacacacatcatcatatcacaatgagcagccgggacagcgagtttgagctgttgaacgcatttttatgttttgaggatggcacacgaatgcatggcaaattgttcggtgccgcgcgggcggtggtgggcgaattggtgtttcagaccggcatggttggctatatagaggtgagactaattggttaattgaaacggtgaaaactctttgattttaatttttgcatacgaacgataaaattgtctagtttaatgtagagttaggactaatttgtttttttttcatggcatggcatttttatgaaaatttacgccgccataattttccatttttcagtcgttgaccgacccgagttatgctcgtcaactgttggtgctcacttacccactcattggcaactacggagtgccggacgaaaccaaaaaggacccaaaatggccccaacttccgtcaaaatgctttgaatctacacaaatttggccggcggcgttggtggtcaatcgcatttgtccggagggcgaacattcgcattgggaagcggtcgaatttttatggcataatttgcatggaaaatttgtcaattttcctaggggtcgattaaaccaacggatatatttttaggtccaatcgttgtccaattggttgagcaagtcgggcgtgccgggtttgtccggcgtggacacgcgtctgctgacaaaacggataagggagaatggcacactgaaagccaaggttttgtgttttttgagtggcaaaattagtggaatggaaaagcagaaaacgaaacgaatttgtaaataaatttgttaaattgattttcaaaggcctcaaacataaaatttctgcattaacagtaaaataagttttgaacgctatgaaaaaatagaaaaaatccggaatttcaaaaaaaaacaaaaaaaaattttttttcaaccttttaaaattaagaatatggtgggacttgtgtaatcaaaaattatttttatatatttttaatcaatatttgcaatttcccgtagccacatttttgtctctccacaaaatgctttgttttgatttttgcccatttttcagttggtgctcgagtcggatgatccggaacgctttcaatttgtcaacataaatgaggagaatttggtggccaaagtttcacggaaggtacatcccaaatccctcctcccacttaccccctcctatcaaatgattcaatttttcaaaattcagtctccccaatggtttggcgacaaggagcaatgtcagagccgaattttgacgattgactgtggcctcaaaaacaaccaaatacggtcagtggtgttacactacatcaacggctcaaaagatcttttttttaaaatttgttggggttggtagattttttccggaaaatgttacacaacacaaaaatcatcattggaattttgttaattcgtgataaaaaaatagggagcaggacaaaatgtcaccgtcggaacatcatcgagataacatcgttacaaaaaaattttttttgttttttaatagaggaaaaataccttggatttttttttttgcggcaaggttttcgagtgtatccaaataattgacatgaatttgaattgtttcatgcccttgtttttcaatttcttcataaatcatttccaatcactcaattttttcaggtgttttctgcagcgagactgtgccgttcacgtcgtcccatgggattttccccttgaccaacacattgagggtaaaaacaaattttcatttttaaaaaaatcaagatttaccctattttttttttgttagattatgacggcatttttttgtccaatgggcccggtgacccgcaaatgtgcgctccgttgattgaacgtttgcgccgaattttgcgggaccgaccgaaaacggcaatttttggcatttgtttgggccaccaattgttggcaattgccgcgggtgcttccacgtacaaattgcggttcgttaatggaatttttcgatttttccccaaattttcgggtttttttaggttcggaaatcgtggtcacaaccagccgtgtgtgcacaccgattcgggccgttgcttcatcacctcacaaaaccatggctttgcggtggatgccaaatcgttggagggcacaaattggacgccgttgttcaccaatgccaacgacgcaaccaatgaaggcattgtgcacaaggagcatccccagttcaggtggcacagttttttaatttataaattttgcattttttttgccattttttcgtggtgtaaaaatcgagttttgtgccatcaattgtttaaattcgaacaattgtttaaattttggattttttacggtacaaaaaattggattttgtgccattaattgaatgaatttttgattttatataccagtcttggtgtttcagtgtttcatggtacaaaaacaagcatcgtgtcaataattcatttaacaatttggttttgagtgtccaattccatcccgagcactgtgctggacccatggacatggaatgccttttcgacatctttttgcacgctgttcaatcactcaaacaaggccaggcactcaagtaaatggtcatttgttgttttccaagcccgtaaccaaggaggataggaaaaacgaaaaattttccaaagaatttcgt

SEQ ID NO: 10070 - DNA, 2798 bp, Heterodera glycines
  misc_feature (2714)..(2714): n is a, c, g, or t
aaaaaacgtttacaagggaacatcgcgaactgtgagtgtccaaatcgctttttaaccacttctatcatgtagagcatagtcggtttagtattgtaaattttcggcttttttggctccggcgccaaaaatgatcagaaaaaatcgatcaaatgaaaaacccagcaaaattttgttatttgattcattttttgcctcttacactttagtgcccattttgtcatgggttcggatcctctagacagatgacgattttttttgaattttttcaaacttttattctactaagcatatttttattcatttattttaatttgttttataatgctatttgatagagaattgtttgctgatcatttataaaaaagtttatggctctatcattagtttttaattttatgaatttttatcttttgtaatttttatcgatttttcgaaactttgctcacttttttctgatcatttctggacgccagaaccaaaatagccaaaatttacaatactaaatcggtgatgcgacatttgcggcgctgacacttgcggcgcccagccaaagcgacacttgcggcgctgacatttgcggcgtgacacttgcggcgcccagccaaagcgacacttgcggcgcagaattaaatgatcccaaaaattatttaaacaattttttgattaaaaaagatttgtttaaccattctttcagtccctttcttcaaagcctttcatccttaggcgatttgcaatgtatgaatgtgattaattatatcatcttgctttttgttttccttatggtcaaaatcgatgactaatcgtcggatcgcttcatcatttctcaaatatttttttaaacgtggcctttcagcaattccacgcgttgggtcaatttcgtaaggtctcagacggttttgttggtgttcttcctcattgttttttgaaaaaagtaatcaattcagaaaataaaaaatgaaaatatataaaaagacccattcacccttcgactccattattcgtacgctgctgtagaaaatttgatggaaaattaaaaatcaactgataaaattttatcaaataccacataaatttaattttattgaattaggcattgttaaaaaataaactattaaaataacaattctgttaattttaataaattgttgaaataattttggggtcgttgaattttgcgccgccgcaaatgtccttttgactgggcgctgcaagtgtcggcgccgcaagtgtccttttgactgggcgccgcaagtgtcgcgccgcaagtgtcggcgccgcaaatgtcctcgccgcaagtgtctgcgccgcaagtgtcgctttgactgggcgccgcaaatgtctgcgccgcaagtgtcagcgccgcaaatgtcggccaatcttttttgaaaacccttttttgatgaaaagtcgtgtaaaacgcctttttctgcacggggtgtttgttacgagtttgacatcaattccgaaaccgacatcaagccgcatatatggaaaaaaaccaaattttggttcgaaaattgcgcgggattcgaaacccgacgccgggttcaaacacacaatttgccgccctgataatgtcaatgaattagaagaccattctcctccccccccccccccactcacttccgttggcagtgcgttcagcagttcgtcgccgcccctcacgccgctcagtgcgattttgcggatttgttcgtgcgcttcctgccgactgtgcccgcgtttggtgagcagcatcagcgcacgttccaagaacgcgtccgactttcgcacactttcgagcaccgcactctcgtggacgcgcatcccttccaacacgcgctgaacaaatggggggagggggataaatctcattttcattttactgcatctgccaacgccgcagggtcccaaaatgctttagtttttctaaatctgatccaaaaataaaaaaattgaattaaaatttcaaagttttccgaggagacgggtgccattgaaaacagcgaccaaaaatgaatgtacaatttaaattgttacattttataaataaatttgttcttgcctgcagcgtcgacagaattgcgtccgcggccaaaaatgcgtccggaagaataatgcgacggttggccgagtcgtccaacgtccgctcgaagccttgctcggcgaaagtgatcagcggattctattgcggagaagaaaatgaatgttgtattaacaaagtaaattatatgataaagcgagcaaaaagtgccgaagcaaaaccatggcacaaaagcacaatttgaagaagtaaagaatggcattaagaaaaagggagcagaggggggagggggcggagcaggactaaccccagtaacagctattgtaagttttcaaaaactttaaaacaaacttttgaaaaatttttttatttttcgacgcttcggcggcgactgttaaattataaaggaagccaaggggacaagcacagaaataatgtgtcgaacttgtttattgagttaagcgcgctgagaaaaatgtacgcaaaattcggggaaaaaaaatttaacaaaggagaggtcggcaagtgaccgtgggatttccaaatgaaatttttttttaaatttcgggggagggtaacgacgcgggagggggggaaagaagtgcctccgaattggtcaaccccctggtttgttaccatcatgctgcacatcaaatagcgcgcgatcccacaaattcgctcgcaaagcatncggatttcgtttgtacggcatcgcggaactgcccaccctgcaaagaggagagtttcaaaaattggttttaatttttgttgattt

SEQ ID NO: 10071 - DNA, 2779 bp, Heterodera glycines
aataatatgaagaaaaacacaagggattcagttatgaaaagcggaaaaagacattggctgcattcagcaagcaatatttgtaaaaaaatgagaattttaaactttcaaaaaatgttcgaatccgggttcggggttcgaaattgagcctgataaaggccagattcgtactaagcgcctcgaattacacctgaaaataattttctcaaaacttaatttaaaaaattttttcgggaccaataatctttaccattgccgaattgcaaaattttgggtatttttcagtttgtttggcaaatttcaattttaattcgattctttttgataaaacaatcatttttattacctttttaaatgcgtgcaaaaggccgtccgcccaaagtgtggcccttttgccgacggttgtcaacgacgccgcttggaaatgggtgcgcccatcgatcggaaaatcggcgtatttttgcgcaaaatcagcaacacggcccaaacagatggccaaactgtaagggaaggttcaacacttttttcactcatttttcattaaaattggtgtttgttaattttttcaaaaatggcaagttttaaataaaaaaattgaaaattataaaaggtgtctagcgagagaaaatttgcgagttttaacgaaattgcgaagcattttataaattttcctataaaatttgtcgccccaaatgcgcaccgttcaagcaaatggtcgatcgcctcccgttggagtatcagacaagtgttgtcctgcacgaaacacgaagtggcacccaaatggatgatccctttggccaacgggcacacctcaaaagcatcagtttttagatttggtaacatttactcaggaattggggaagggattcccggttatattccaatttatgggtccaatcagtgacctttctcagtttcttaggccatgacttttttcttatttggtaaatgcttacatttttggtaccaatcgaaagcttaaagttttaaggaatttataaatacaagaaaagaataaatactttcattaagaaaaaacaacgagaaaacccgaaattcatttattttcgcgtatattcaataaaactgatgattgtcactgattggacgagtaaaaaatggaatagagccgggaattcatcactcactgccattgcccctttaaatggtcccatttgcaatcattcgggcaattttgaatgtatcattttcgaattcattgacaatttgtgccgaaattcggcacaacatccgtacttttttaagtcaaatgatttttttttgtatttcgaacgcttaaaatttgcaaatttgaacccgaaataaagctgtcaaactaacgactcttctgttaaatggctcatttttttgccctcgcccattttttgttgccaaacttcgccgtaggcgtggatatgtgccacgacttcatgcttcatcgtccgttcatttgctcggattttgtcccagttgatgttgtgcttttgggctttcagctcggccaccatttcggcactgatttgcgcctcaaggcccaattcgcgttcggattcggccagccaaatccaaagctggcgccacagaagggcctaaaaacttaattcaaaacttttcctaaattcttggaatcattcaaatgccataaagtatttaattgatacagcattgggacttcattaatatgtcgttcaattctccgatttgattactttattttgtggagaaaaaagacgcagaagtgggctgcgacggcaccaacgctcgacaaaaacactgccgtactgatcagtggagtccataatgaaattttgtgagaagatctattaaatgaatgcatcattaacacaccgagtcaattttgggctcccaatcaaaaactaaatgcatgtgtggcgaagtggtttttgtaataaaggaacaaagggtggaggttcgagtccgttgcgtaacacaaatatttatttatttttgttcaaaaaacaaaaaaatgacttttttgaaaatttttttttcaaggtttttgccatttaaattggacgatcttggtatcatacgaaagctcttgatgaggagagtatatgagtttttatgggtccgttgtccgtatcttttttgggccaatacggacttatacggagtaagggttttacgggtttttagtccgtaagtccgtatgggtgctgttgtttccccgggtttaaggctttaagccatttcaaattaccgttttaagagagaggtatttattgaaggaaaagcattgacaaatattatgtgttaaaaaccgggaataattttgggtcaacaacaacctcagcagagcaatttgggtgggtcagtgcaatttgttattttgacggtaatagaaataaatggatggcaaatgcaacagaggtgaatgatgggatagaaacggcacgataacatcggaaatgagagggcaggattggcttgggataggatgaacagactgacatatttatgacgggataaggggtcctggaagcatattttccttaatttcggcccaataagcctctaaaactgcagtgcgacattgtgaacaccaacttttaggattgaactgtttaaaatttagaaaactaattatttttttctaaactgggtgatccaacctgtaaaaacccaacccatctttacccgtttttgaatttcacgggtttttttggattacggtcacgatttactggaccaattcatggtcacgattacacggtttatatatttagtcagttgagataaatgatgatcgggactgtgt

SEQ ID NO: 10072 - DNA, 2073 bp, Heterodera glycines
  misc_feature (37)..(37): n is a, c, g, or t
  misc_feature (165)..(165): n is a, c, g, or t
tttataatttatatttcatcgagcgtctgcaaaactntaatattctttccttagcagttttatttttaattgtttttcatgaattatattttattttcattaacaaatttgaagcattattcttgaaacaaattttaatattcaagtattcagattaatatcgtntaataaaataatctatgtcttattaatttaattttttaaaattatttttcatttatggatatgaatgtttatggaaaaaacaaaaatattattaattatttgttataatattctttattttttcatttaaaaatctgcaaaaaatctatttattcaaatttctacgtgcgtttcttgttaaagattttatcgaatttaatttattgataatatttattatttttttagttttttaaaatcaactcttattaacttaatcggtttgattaagtgggtttaatatagtttattacttttgaaggctttaaccattttctcttatcaaaatttgcatatcccacttatggtgaattcatttatttcttattgttatgcttatatgaattttttgattaatttttgttggataaaactagggttcggaccccgcccccgtcacccccgcccccgccgggggcgggacaggttttttggcctcaccaccgtccccgcccccgtgactctgacccccgccatcccccgcccccgcgaccttcacccccgcgggggcgcgggggtgaaaatacacccctaagaatgacatattcatggacaaaaggcaaaaaatttatacaattttgatttttttaaccattttgacaaattttttatgaattaaagttaattttggcgctgcctatcggcatcgcagggcccaaaaattcgtaaatcttataaaaaaattctctaaaaattgcaaaaacctatcattttttggacaaaatctattaacagatccatcagttttcaaaaatttttcccggcggcgcctatcggcaccgccattttattgcttttcaaaaaagttatgaccaaaaatcgtaaaaaaaaaattcgtacatgactttttttcaatcttcatcaaattttttgaaattttgcctgtatacagagaatctttagggctatcgagttatccaaggatctgctgctcttcgacttccaattccccttctttcacgtttcggtggtcctggtccaattggacttcgtttgagccatccatcgtcgtcaatttgagagtctcctcaatgtcaccactgatgtccgtaaggtccgcactaaatatgttaaggttgctaaggtaaaattagacggggttgtttaaccccaaggttatatcggcggatgagctgaaacactcttgtccatgtttgattgtcacttccgcgaaacttttgaattttttcatctccttcaaaagtcgggtactattgtctttctccttcccgttttcttcgtataaagtgtcaatacggcgtttgagagctccttccttctctttctggatagccaaaacagtcgtaatttttgacttagcactgttgacgtgttccatggcgatatttaaatcgtcggtaatctcattaattagcttgtcgtcgttcatcttggtcaccaccgttggaaagagtaggcagaggtctacacagccccttcctttttatggagtccacaagactacccgaccccccccctatttgtgttgttatctgcaccaaaccccaagaataaagcatggacaagtcaggcttgaagccaggccaaggtcgaactctataagttagagctttcattgctacaaaaattatgttttgaatcaccgttttttgtacattttgtcattgatccctgactgctctgctgattgtgagaaaaaccaacaacgcctttgtccattcgttttgtatgaataagctaattgattttctccatttttgcgtttcattgccctcccccaatccaagtccaacccttttcaacatacataaccacaacttcccgttaatcaattataatttaatgaaattactgttagcccatggatttgtcccctacaaaattcattggcctcctaattaattaatt

SEQ ID NO: 10073 - DNA, 1192 bp, Heterodera glycines
acacaccagggatggcattccgaggccccaaaaattttcggaaatcggaattccgggggtccaaaatttttcggaaatcggatttccgaggcccaaaaatttttcggaaatcggaattccgaccccaaaaacgtcggaaatcggaaatttttcaaaaaatataaaatattaaaaaaatttaaatattataataggctaaattttaattcttaaccaagtaaaagctagttcaaaatttttttgatctatttaaataaatatttgccttaaaaaattattcaatgattttcatcaaaaattttaccttttttttgcgacgcgttttttcaaaatttttgaaaacacggcgggcgaggtccggcggtgccgataggcgccgccgggggaaattttttataatttttaatcaaattgttaccaaatcttgtccaaaaatgactaaatttagcgattttgaggcaaaaatttctcaagaaaaatatgatttttagggtgcggcggtgccgataggcgccgccgggaaatttttgaaaatttcaatgcaatttattaaccaaaattgtaaaaaattgttaattttttgaaaaaaaatcataaaaaatccggaaatttccgactttttatcaaaaatttcggaaatcggaagtcggaattccgacgtccaaaattttttcggaaatcggaattccgaccccaaaaatgtcgtaaatcggaaatcggaattccgtgccatccctgacacacactatatgtgtaaattttaacaaatttttttaaaacatgccttttttatccattagtttgatttttaaaaaccatttcatattttagtgcacagtaattaatagggcttccatttttaggcaaatgcctaaaatttctgcgcacttgatacgcatagataagcacgaaaaaagcattttccgcttggtttggggtttctacgctgacttttataatgcctatttttgtgcctatttaatgcctattttgcgatttttttatgcctttttaggtgcctatttcgcgattttttgtgcctaaaaatggaagccctagtaattaatgtacaaaaaaagcattttttttttctcggagaatatttcagcaacagaataaatttaaaattaaattttcttttcagtttatcgtacgtatactgtacccaaatcaaagtagttttttaaaattt

SEQ ID NO: 10074 - DNA, 1246 bp, Heterodera glycines
tcgggaccaggtcgttttggcgccgatgttttggcgccgacgatttggcgccgacgttttggcgccgacgttttggcgccagggtcgttttggcgccgacgtttgccaaagcgaaaaagagtaaatgaagaattaaatccggctctttgatagacttcgtcagaaaaattataacgatttcatcatttctacctcccccctacatggcgtcaaaacgtcggcgccaaaacgttttggttgttttaatctattttagaaacaaaaagagaattttgaaattttttattttcgattttttgttcgaatttcggctccgggttccgaattggtcgaaatggatgcctggttcgtgagcagcgaccctgaataccattggaagcatgttttcatgacttttgaaaacaaaaaaaatttcttcaaaaaaggggggcaaccaaccatcggcagtattaccttcgcgaaaaatacgttttttttgttattttacaaaatttttaaatttgggtgttttctttttttattatagcttggcgccaaaacgtcggcgccaaaacgtcggcgccaaaacgaccctggcgccaaaacgtcggcgccaaaacgtcggcgccaaaacgtcggcgccaaaacgattcgacccctaatttgctgctattcaaaaaatttgttcaattttccttctcgtttttaggcagggttaccttttgtccttatttgtaagatttgtccttattttgagggtccaaatcttacaaattttaaatgttcttatttgtaagatttgtccttatttaagctctttgtcgttattttagtcttatttatttggattcagagagaaattacgatttgaaatgactatttttgaaagaaatatgttttttgaagcgaattaatattcgaaatcttactttttgcttcatttacttactgatatgcgtgatccagtgggttgtgtgatcttggttatgttcttcattttatcgttggatcagttcccctccaaaattttatttcttctaatttttcaaaattattcctttatcgatgggaattcaatcataattcaaacatttaaaatcaaaaatattgtcattttttgactaaatctattaacaaagtgcactaaaatttcaaaattttccccggcggcgcctatcggcaccgccggacttcccccgcctaaaaaaaaagtattttgaaaaatgccgcaaaaaaagccttttgaatgtaaaaaccgcaaaaattg

SEQ ID NO: 10075 - DNA, 5099 bp, Heterodera glycines
aattaatgggagagtcgaattaagtggaggattgtttaatttaatggaaggggcaattaatatttaatgggtgactatttagtccatgcgtttggataagttgcaaaaccatttgtggcttttcagatacattgatgaaagtgttgtgccctttctgcactttttccggccccttttcgcctcttgcggcacaaatttggccattgagtcgcggagttttcgcgttttggagttcgttggacaccaactcctgccgatgatcagtgcccgaatttgcgggatgaaaattttgtccggccatctgcgctatttgcggcaattctcggcctccattctcgacgattgttcctccctccgatcgctgttttgcgttggcaatttcttccccaaattcccggccgatggcagtgccggcgcgtcgtcgagccgcgcattggcccattggctgtgctcgcctcgttcagacggtgtgccgaagctgctccgctgtgacttcaattggaagtgtcaatggacttccaaaattgagggactgaagacggtgtggtggtgactcactcactcattgggaagcaggacataccgtcgcctcgaaatttttttttttttaattttagtaaaacaagaaaaattatcaaaaattagttatccagcctaattcgaaaaaaattctttaaaaattcgaaaaaaaattacctattaagaaaattcaagaggaaaaaatttatttttttcaaattttttgtattctggaaattcagaaaaatttactttttattaacacttaaattttcaaaaaagctacaattagttgcattttcttgaaattttgaaaatttttatttttggtgacgttatgtcccggcgacgttttggagtcttccccactcattgatttatgccaaatttggaattggcccttcaattttgccctccaggcatttgctaatgcctcttcgcccgtctgctttgtgattgtcattgtgtggcatatttggattggtcccgacattgaacgcatttccgtgcccttttccctgcgcaatgcgttgaccgaggagcgattggcactgaaattgctcggcaaccaacgctttctgatcgtccgctgtccaatcgcgcgaaacgaacaaaaatgggcccaatgggagagggaggcgaccgagtgggaatttgatgagcaatggaatcgcattatcatctcggccagtgagagcgggtcagcaaagaaatttgttgtgttaccagttacagtattacaagggatacgatacttattaatgtatgcctcccgggagttcggaccaacaaaaccctggggaaaaccccgtacaggcagggggcctttgtctgtccgggttttattttaaagtttcgaatggatgccaccgaatttacaacttaagtttctctactgaacaagccgacacgagtgatcaccagcttcagcaggaggattaatattgtgcgatgggagaaaatccgttgattaatttgtttcagaaagttttgccaacttttgtgcgtgcgttcgatatttttaaattttccatatttttgtcattttcgttgcgtcgcaaatgttccataaaattttgtttggtttatttgcctaactaatgtttgttttgatgatttctcatttaatttcctatggtgattttctgggccgtttccgaaatctccaaaaagttggaatcccgagacttcccgcccataggggggattttaatccgaaccccccaaaacccaccttaattggaacccattaaaacaattccaatgcaataattataaatattttcacaattttcatagaaatccgtactttacaaatatgttaagcagcaaaattttgctcgaattcatatcactcaaatgaaaagggaggaaaaaaatcaaaaaggggaaaaacaattgtttggcatcagaatgccagcggcgtaacgatgcttaacaagacaatgattatggtggtcattatcactgtcactggtagggacatgccaatgctgccgttacagtagtccgtgtcgtcacagtaacacaccgtattctgaacaccgaacactcgcatctgtggggatgagtgagaaaagaaaatttcgactttttaagcaaaacgcatgattttgattatatggtctggttgccgactaaaaactgacaaaaagtgccaaattttggcaagaaattgtaaaaatttgggcataatttcaatttggacaaaatttattaaaattaaaaactctaaatatattatattacattttagaaggaaagactcaaaattaagctaacattttttattttgaaattcggtatttagctttttttcaacataaatttaccaatttttagaaatgtagaatttttttattcccgagaaaattcctcttaaaatagattttttttttttttagaaaatgcccaaatatagaaataagaactggaaaatatggatgaacagtcctaattagaaaaaactgaaactaaagctaacttttttgtgcgtccaaatacaaatgccaattttatctgtttcgttaaaatttcaaattgtgccctcacctgcacacatccgggcgcaatgccaatggcatggcttggcatttgtgccgcacctctgcccccgccgccttcgcccatcgccactgctgaacgggcgtacacttagcaaaacgggggaaggggggggggggtaattaaaatttaaaaatatctgaaattttttacgaggcccatgactctgcgaagcttttgacggattggcggaggtataaaatgcggcatttgaggcggaaattgtccgattttcgcaccctttgctcacatatttgccagccactaaaaaatgtcgatgatcgcacagaaaattatgaagtcgcaaaatgatcagttcggagcctaattccccgaaagtctttagagtccggacatgattgatcaatatatcctgttaagattttccctggcttctgaaatacggcaaggacaggatcccgactaaatcgggatttgagtcccggatatttaccgatattttttagaaaagtcaagtctttttgtatatgtttatttttcataaatcagtgattttgagtcatttttcagaaaatgtgtccgaaattaataacaaagcttaaaatggtcggcccccttcatgttagcaaaggttgatatccttgtgtgtttatttatgttcttttatatattttaaaatgtaatttagaaattcgaataaatatcggttcgttttaccgaaattcctaaagctctgatcattttttaaaatttataatatttttttcaaattttttacccatcgatttcacgcaaaaatcgccgtaacagaagccggattggcattgcattggcatttggcactaaattattatttgatcagttataaattcaaataatatttacctgatagcaaattcgttgggctcgaaaaccgccgggatctgctcttcgaattgctaaataagatttatttaaaaaaaaagatttaagaaaaagttattttgcgctgaacctttattttttgaatttatatctttttctagattttttctaaaattaaatttcagatgtaaaattattttatttttattattaaaataaaattatataaaaattataaaatatataagtgaaaatttttttatttatggtttttatgtttatatttatttgagtaaattttataaaatattaaatatttacgagaataaaaaatctatttttaaatatttcaaaaatattttaaattgtaaatatatttatattactaaaatatttttgaattatgcaattgtttttaatcctaaaattgcttttcatttgattggcatttgtcacctcgtgccgtttgctctgccgctgctgctgctgctgcctctgtcactgccgaaatcaccaaaaatggcacgatcattcgtgccattgttgtcccaatcgttgttgttgtccccattggcataatgtttcgcctgcgcctccggcgccatccgttggccattgcctttaggcggccaattttgggcgcaaggcaatcatttttcgagaagagtgaaagcatatggaaaataggtaattaagcacatatctaattaagaaaaattgcttattaattatcattttttcaaattctattgggccgaataactcttttttcttttactcaaagttcaaccgttgccgacggacgtggccatggacacatcgccgcccatttgccccaaaaaaaaacttaaaaagttaatgagtaccccaaaattacataaattattcaccacaaatgctcattaaagagtcaaatgttgcaaaaaacaacccaaattatttttttaaattactcaataattaattagtcaatttgaaatataccccaaggattaagataatcattatccttaatgaacggagtatattcgtgctctaaaataaaacttttaaaggttagaatctgattctaaatcattttcactttcaaagtttttgtttgactagaaaatgtgcccacctatttttcaattttgaatgcatatttaattttaaatgcatttccgtgatttttgtgccaaaaattgcgccaccaatctttgccatcatcattaattagctcatccaccaatagcagcagcagcactcactttttgggccttccttctgctgccgctgaggtgggcagacaatgatttttgccacccctccaagcgccggccggagagattaatcatgcttcagcaaaagcaaaaagacggagggaggcgggataaagccaaaacattggacataaagccaggacaagtggcacaatgtgggcacaccaacaacgccagcaagcaacaacaacaacaagccgataaaagcaacaggagaaatccgtacggcacggcacacgacggagagtgtcccccgaagggggggggcggcacaaattcaaaaatgaatgccatgcatttattttgttccgcaaaggtgggctgctggcattggggcggagcgctggcccaaagccccggggcaaaagcaaaaaataaaagggaaaatgacgctttttggctttggttgtaaaaataaatgaatgaaga

SEQ ID NO: 10076 - DNA, 1171 bp, Heterodera glycines
aaataaaaaccaacttcttcgtttgagacattgaatgtagtaatgtttgggcaatttttgtaaatgaaagtgagaagcgctgcagcggaagggaatgccaaacgataagtgccgcttgaatccatgcaggtcaattctttgtgaagattaatgtgctataaaaatttagagtataattaatactgaaattgtataggagtttttagttgggaaatagaatctatgatcactaaatgagctccaagttaaagacaatctttggtgaatgtttcgttaatgcatttttaatgaaaattttcgaaattaatcaaacaaagcacaaataaatgtcattcatgcctcctatttttagattacctttttaatgaaaaatatcaattattttatattcaaccccccaatttcatataaaagcaaaaaaatcgaacacttaccgttacgttctttaacatgctcatcatagtgctaattatgcaaatgaatttgttaacatcgtcgaactgaaacataaacagaatgttgattggctggcctctttatggatatattttttaaaaactttcaaaatcagcggcctcgaaaaagtatcatcttgagtaaaagaaaatcaccaagattgtttgttcaaatagattttgagtttaataaaaatatatgcgttttaataatttacaaatatattttcatgcaatttatagaattttttttgtctaaaggtacccaagttggcagataataaaaatttctcgttctctcgaaattgctttatccaacgtaccttgttatttttgtgtgaagccgtgcttggtggtgaattgtttagccttaacacaaaaaatatgtaataaataattgtatgatatgtctaatcaactgtgaagaaaaactcaaaacctaatcatttctaaatcggaattttccacccaaggctagacggattacggttctgtaattacggtgattaacacccaagtaattgcggatcatggattacagtaatttaatccatggctgggacttttttcgaagcgatttaccaaaatgcaaaatttttttacttttatattaaatgagaaaaattttaaaaattaagaaaaatcgtttaaaatatccatttaatgcaaatttttcatatctaacaaaagtttggaattttatttaaggcctaaaa

SEQ ID NO: 10077 - DNA, 1644 bp, Heterodera glycines
aattccttgttgtttcaattccataccattcttcgttttagcaatttcatttttctataagataaaaagcattttgtttattaaaaaggctcagagtgtggactcttcggcaccaaaattcaaaatgcaccaaaatagggtgaaaaagagaaaaagtgacataaaaaggcataaacattttataaaggcaaaaagattgattgttaaagtgtaagttttttaaaattttattaaaaactaaagaggccactttttatttcacttgttttttggtgcaattttttttttgctatcacaaaaacttgttacagtggttttttcggtgtatgatgtcgaacctgacagaatctttaaaccgtactcgaaacactcgaaaatcacaaattttcgagttttgggtttcgttcggttattaagtcaaaaattatcttatatttttcttttaaatgtgtattggaatgaatttaaaaaatatgagaaataataccctcaatttggaaatattttttcaatttttgcacagatttcgcgaagatgttatttttttaaaatttattaaatgacggaaaatcggtgtttttaggccccggtaattaaggatttgcgtttaaaatcagttaggcccagccttagttgcatcctcagtttggtattacgattgtttgtagaactgctccgtctctcgtttcatcaaaaattgttgataaaaacgaacatcatccgtaaaaccgtgaaaggagtaattttgatgagcggcacgagcaatggcttaataaaaaaaaagcaatgagaaagggcgcaaattatagagaaatcacgaataaacttaattaaaaacacaaaaaagggttccgatgaaaaaatatattaaaaaagaaaaaaaccattctaaagaaaaagaaaaaaattatattacgacacatttttgtagaaaattgtctctttttaattttataaaacttattcaattaggtgtaaaatggtagataaattttatggaactcattttgaggaatgtaataatgaaatgagaattttctatataccatggtatttctgaattgttcctgtttctagaagcgtggcccatcggtttgcgtatctttcctgaaaattttcttttaaattaaaactaaaaattattaaaactggcgcaggtaataaatttacagcaaaaatcaaataaaaaattacttcagttacaaatggctttgatcgaccaccagtaacaaatgcactgcggttaggcaaatcaacgttgattgcatttagtaacatggtgttcattcccattcttaaacaatattttatgacgaggactgagatatttaggaatttatcacactgattttgagaaattgttttttctaactcagtcaaaatttagaatgaataaaatttgcagtaaaatttttatacataagacaaatttcataatcttttacgtaattagacgaaagcaagaaatgttttcctttaaaattcaactcaatgatgttaaggcattactcaaaaaccaccaaaaatgaaaaataatttgtttctatgctcaaaagtagagttgagcgggaccgggacctaaacacggacaactgagtaccgaagttccgagaccgggactagtcacggtttttttccggtttt

SEQ ID NO: 10078 - DNA, 2539 bp, Heterodera glycines
  misc_feature (2280)..(2280): n is a, c, g, or t
  misc_feature (2415)..(2415): n is a, c, g, or t
  misc_feature (2435)..(2435): n is a, c, g, or t
aatttatatcatgaatttttcagagcattcttgaatggtttaaagaatataccaggcagcgcgaatttgcgcctaggtccaattccttcattttcagtctaacactgatgctttggcgcttgttcaattcacgcaaaccgcgtagctgaaaatattaattaaataaattccaaatttctctttattttcaccctttcataaattttcttaataaaaactgcaaaaaaaatgaaaaaaccaacaaaagaatcggcgttaaaaattttcaaaaaatacaccttcccctaataattaacataaaattaaaagacaacgtaaattggaaaaaatttcataaaaaatctcacagaaaagtttattaaattttttttttttttgcaaataggtgaagtttcattagtcgtgatttttaatgacgatctcgaaatagttaactaagatagtgaggaaaatgcctgaataatgacaaaatccaaaatagtaatgaaaagtgacataaatttcagccaaaaattgagcaaaaaattgtattttcaaaaatatttttttattattaaaaatcagctgaaatcgcaaaaatagattcttggtgaaaacctattaactcaaataagggtgtaaaatgaccaattcaaaaagcaacaaaattaagccaaatcagtattagataaaaaattttaaaatcaaaaattatttcaaaaaaattatttttatgatctattgcaatttaaatttctctatcaattaaaatgtgtttatcctttaaaaatttaccagataaattgaatttgcgcggttcgaatgaagggcattggtcggcattttggcacgatcgatttggcatttgttcaactcgtgcaactgaaaaattggaaaggatacaattcatttgattgaatttgttcatttaaaattaattaataaaatattatgctaacagagtttttttaatttcgtttgaagattcaaatatatttcaattaatgcccaatgtccgtcatttatagtaagcctttattggacgccgttttcactttcttcataaatatcatattcaaaatcagcaccctgaataagcttatatttctagggtaatttgaggcgctgatcacgaatatgacatttatttttcaaaattccgaacccgaattcgaacaaaaattctaattcataaattacaaagaaaacatatttctaggggttttagaggtcgctgaaaacgattatgacatgccttttgaccaaattcgaaactcgaaccctgacttgaacaaaaaaccgaggtttaatttactaaaaaatttaaaaggtaaaatatccatcataggtcccagactcaaaattgcataaaaatacttttataggttttcttaggtgctgaaaacgcctaaaccataaaaaaactgcgcggcaaagcgtttaaaccggttttgaaccggtttaagacttgaaaatttgagtgaaaagggaggcacctaagcttttaaaacggtcaaaatcacacaaatttggtatcatccgaaatctcttgatgagctaagttaaaaaacaaggtatagattcgaaccaacgccatctgagcactgggccaactaagtcccagtgaaaatggacatttcagtaccgaaaaatacttcttccgtagcccgtagtctcgccccacctactggccgccgtagtcgagtgtgcggcggttttttagcgcaataagcaaattcaatcttttatatttgacgttcttttaccaatttctgactatggtttaaaaatagttttaacgattttgaggacccataacatgcgtcggttttgcatattttgaattttgtcgagaattaatttcctttttttttgttagagtccgggtttagaatttggtcaaatggatgtcatagcagttttcagcgacctcgaaaacccccaaaatatgttttcattgtaatttatgaatttcgaatttttgttcgaattcaggttcgggattcggaattttgaaaaataaatgtcatattcgtgatcagcgccccaaattacccttgaaatgactttttatttgaaaatttcaggtggagaggggtcacaaaaccaaaaagtaccgaattcgcaaccgcaaatacttttataaattagaaaatccagcttatatactgtagaagcatttttcattccatcattgagaagcacaattttaaatcgaaaagaattttttgtatatttttttacaattaaatttcaaaaaagcaaaaaaatttggaccaattttgaaaagaaatagtgcancaaggatgggaggggtagacgaaaagagaactttttaggaagggacgcaccccatctgatattccaccttttctgttccataaggggccaaaggcgactggtcgtcgttgacaaagaagttgtccaattaaggtnacttggaatttccgcattanaatgtggtacaaaatttttggactgcccgccccctcgcggtgggacttaaagccatggtggacgtgaaattacaaatctcaggagtattttgtttcgaattttt

SEQ ID NO: 10079 - DNA, 1334 bp, Heterodera glycines
tgaaaaaaagcaaattttgaaaataaaattcaatccatttatcgatagaatggtgttttcggtcccacatttgcgccctcccaatttcccataattcgtgcagttttgtgggcgttttttttgttgcatcccagatcgaattaataactaattaatcaattttttgagtgccttttttaataattattaatccatgaggatattagcctttttttgcggttttcgcgcaacgcccttttttgcgggtttcgcgcaacgacgcggcaccgtttaaaccacttctaaccaaaatatcttttcaattttggataatcggatagataaaacattaaaaaattaaatggatttaaatttcgaaaatgggtcaaaaacttcatgaactctgtaaaattaccaacggttttcttgaaattaattaaatttccattgaaaaaacctggaaatagctaaataggataagcaatgaaatttttgaagaaaaaatacaaaatcaatttttaaacaaacaaattttatctttttctatttaatcaaaataattcttggggagattttcattttttaaaagccagtgtgttttcaagagtttcagttattcccgagtctaaggggaaaaaggcatgatgatcatagtccaagagttttcaatttttagtgaattttcaaaaaacagaaagcaaatcactcaatttattcaatgggcgttgatcaaatttttccaaattgatcatttaatttggttccctattttattcgattgaaacaaacaaaaacaaattgaacctttgtccaaatgatgggaagcgagcacaacaccgtgccattgagcgccccccggtgccaatgttccccagtgttcggttgggtgcagcagtgccaacaacgctcactcccatggcaccatagcgcacctgaaaaataaagtgtttacatttttaaataatcagtagtgcctgccattcatgcctaaattgtgccaccgaattaaaaaaatgccttttttgtattgtaataaaataaatataacacctcgaaatggccaagagttttgctcccgccgccctcagctgcgcgtcaaatgtgtcattgcagtgtacctgcaaaaaaagacccctccctcccgccctcttcccgggcaatccgaggcttaccaattgcgatcgatcagtaatgaaatttggggggggggggctaaatgcaactcaacaaatgttttttgttttttgggatttgatggcactgtcattgggggtattgatggcactgtcaaagtgagctggccaaggaatgaaaagagtgaagaatggtggggggggggggagtttacgcatgat

SEQ ID NO: 10080 - DNA, 1358 bp, Heterodera glycines
  misc_feature (15)..(16): n is a, c, g, or t
  misc_feature (28)..(28): n is a, c, g, or t
tgcaggtcgcacacnntcctatggtccntttgagaaccaaaagaaaactgatcactcactgatcagaccatttttaatgcttgcagtattgttatacatttgaataatttactctacagcacaatagctgtattgctgctgtattcaattacagttttaagttgatcaaataaagatcaaaattataaaggatttatttatgtactgtacataaatcttttttagtgattaaataaaaacaaaaatcaaatttaaattaatttttaattaaaaaactttttggattaacttaatagctaaattaagaattaaatgaacaaaatttaaaaaatgccaaaagcattaaaaaaggacgccgagttggcaaattgcatgacgtgggtgaatattgatcgcctttgatgggtatgcgacacaacagttgtgtgtgtggtaaacaaagggagggaggctaagacatcaaagatcatttgatggccgaccgtgcaaacagacgccgccagcaagggaaaaaattttaaaatttttttggcacgtttggcaattaaaattttaaaaaattaattaaataattaatgataattattattattcaatatgtactgtattaagagaaaaataatgaaaaattatttttttattcctctgtgggggttgaaccagggcaaaacgcaaaaatgaacgcaggcttagccaataggctacaagcacattgaccgaaatgactttcaagcgttatatgtatgaaacattttttcacaattaaaaactttattcctttttccgaatttccatcaataattttgagttcgttcttcattccgaatctggacctaccggggtcgaattttgggttattttatgcgcacaatttttcaaaaataaaattaaatttcaggattttaacattttcactaaaaatgaatcatactcaaattcgaaaagcattctttttaggcttatttatgtatgtatgtacaaatcagagtccaactgatttttttgttttgccaaaaacaaattccaatgataaattcaatatttttgattgctaaaataatacgtaaaatggtggtccaaatgaacgggatcgaaacatgggcttcgagagtgggtttccgggaataaaactttttaccggaatgtgactccccattcttttcctaaaaaacccggaaccggcacggtgggactcgggttgggttttccattcggagcgctattagccaaattcgttaatttcttacagtatcaaccaatttttactgtatgtattttaagcgattaaaaagtgatgttaaattcttttttgacatacagtatatgcatgtctcatgaaattactgtttaagcttttg

SEQ ID NO: 10081 - DNA, 1830 bp, Heterodera glycines
  misc_feature (137)..(137): n is a, c, g, or t
  misc_feature (149)..(149): n is a, c, g, or t
gcactgattgatcatgatcacataattatgaggatgggggtacgtcgctgatttgtccgtgtcttgtgatcacttttgtttagcgaattttgaaaatttatacaaaaattttacagagaaagttgttcccccccccnttcgttcccccncccccccgtcgtttccgcccggaaaatctctagtaatttatcataaaattttgaaaaaagattagaaaaattttatgctcatccaatctatgaacatttttttttgttactgaaattccgatttgtcaattttgcgaccaactgcgcatttgcctattactaacgtgccgctgctgaaggcattgattggcgcagtgaacgagtgatcactgatcgctgatcagcattagtgccagacgaacgtctgtttgtctgtccgtccgatcactttgaaatcctatgtgactttttttctgtctgcttctcctctccttttacaattttgtcattctctcacttgtccatgttctctcattctcttacgcactcttcctaattattttttttttgccactctcactgttattctctctttctaacacacattttctcattctctcttttttttacagttttcttcatttttcttttgcctcattctctctctccctctctcgccctttaattttctctttccctttctttctttccctgttccacatccctcgtttttttaatgagaaatttaatacagttaattccatataccagaaagttgtaaaatgtaaatcccaatgggatctcgggtccaagaaagtccgtttaccatttcaaatcccggttccggtccatggttttctaaattactggcctttcaatttagtcccatcccaatccaacaatgctttttgttgcttcccgctgctattttgtttgaccatgatgcgaaatgtgtgtagagtccgtaagggatcgggataccgccgggattttcactcggtccctatcttgatttcggcttttcgaaaaaggccgggaccggaataccgacaaaatcgtgttttaaatcccggggtcaagatcaaatgatcccgacaataaaataacactcgagatcggaattccgacaaaatctgaatttgaatcccgatatatcgaattcaaaccctggcaaaagcgggatgatttgaatcttgataatcctttcccggctgaagcaaatccctaattaaatgttgcatatacatatatggcgcaaacaaaaaacaatgtaacaaaaaagctgaaagcccaaggcgaaatttgaatattggctttgttatacaccataatgagattgagcggtggagaaggaagcagagcagcaggcgaatgccaaaaaaatggattatttagtggcagaaaaaacagagggggcgagcggacactgaaattgggacaacacgaaaacagcgaaaaacaacaaatttgaataatacatgtaacagcagggtttaatgtgccgatgcgttgaaaaaattcggcaatcggaaattgttccgagcccaataaaaaccgaaaaatcggcaatcataaattgatatattccgacatagctccgatgtgtatatatgtattatgttatcgtgcaacaacaaattcacagcaaaactaaaaaggctggacgcggcaaaaccgggattagagtccggtaatccaataatcccggcgcctgctgccagtcccgaatgccgactttttaaaaatccgggtaaaaaagacaaacaatgtggatttatccaatggtttttatttgcgttaaatggccaaagaattttttgaattatttttgtgaaaatttgtcgcgtaaatagagtagaga

SEQ ID NO: 10082 - DNA, 1113 bp, Heterodera glycines
cctgaaaatcattgggttgctcgagaatgaatactaattcaatcagaaaaaaatatctgtattattttatatatatattttttgtataaatttccacaattctgtttttaataccgagaatcgggttatttcattttgaagcctaaatttgtggcaggaatgcttccttggcacaaaatgctttttcccatttccatcaaaatttttttcctgcagattacaccacttaatacaataaatttgctgtttttttaaattcgcgttaaattgctaaataatttttattttttatgtgaaagtttgtcgcgtaaatagtgtatagtagagatcggcccggtcggtttttttcggtttttttcgattttcggtttcggtttttgaccgaaaaaaaccgaccgagaaatttttgagtttttcggttttttttggtttcggtttttttcggtttcggtttttaaccgaaaccgttcgaccaaccctcttgtccggttctctagtgtatagttgaccaacaagaaagacgtaactggagccaaaaaaaaaaatcacgaaattccattcctgccctttggaatccgaaattttggcctgaaaatctctgatcactttttggccgcatgctttcctttctgctgctccgctgatcactttttctcctctgctgatcactttcacctttgcagtaacagcaacagcagcataaaaaaaactaacaaaactttttttgcacacacaaattaaaattatttttatttttgtttttatttttgaaaaaacacctatacaaattttatggttttttacggtactcttactgcttatatcacgccctttgatcgcaaatttatttgtactatcattgatcacttatttggccaccatccaccgggtatgatggatagcaaatcggggaggggatggattcggggacggaatccaaccctaattctgatcagtgatctcccatcgcgcccatcattgatcacactgatcacacattttttgtccaacgcaccttcatggcgcatatttgatccaattttactttcattcaattggccaatgctttcctctttctttatccgccctagagggcggatgttttggtcggtc

SEQ ID NO: 10083 - DNA, 2846 bp, Heterodera glycines
aatagggctggtcgggaccgggaattttgacaaaaaccaggaccaggacttaccgggaccagaaaagtcgggaccgggacctcgatttttgtccgggaccgcgagaaaagccgggaccgggaccaaccgggaattttcccaagagaaaattttttgaaaaaatttttgaaaatttgagtgcactttgttacaaaatttcctaaattcaaaaatgtgcccagaagatttttaaattttcttttgggggaggaattcgaagaattgttattttttagcctgtttgaaaattaaataaaaagatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccagccgggaaattgatgcccaaggccgcgccaaagtgctgaatattgtagctactaatatgctcaagttacagtaaatgagcaatagtccagagcagttggccacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcactttcggtttccattgcattatgcgatgtgtcaactccaattattggaggaaaccaagtgcatgtcggctgacgcaaagaccctaacagactaaaacgcgcctaggtagcgaagctcccaaagcgcaaagcgcttttcccaagcgccaccctcgcatgcacacacccgctagttttttaatagatagctaatttgacaaatattgcgtcgatatcgaaaataaaatttggagattcagaaacgtaataactggatgggattttgttatttgagaaattttggaaatttttttgaaaaattttggcaaaaattttaaatttcaaagtggccatcataatttaaggctggtattgtaggttgaactttgtaattagtaattatttcgaacatatttaaaaagtttagaggggcaggatactagtttccttgtatttatttcatggaattttctcattaaaattttgccttcttacaaagagaacaataatcttttttaagttgtagatttgttttcatttgtagaaaaaggattattttatgtttagaaatttttttaatatagttcgggtatttaattttgcgaaaatttttgcggatttggcgtgtgggaaggtaaatttcgcataaatgtagaaggtagtttgtgaatctttgaaactataaactagaataaacctgtaagtttgttttaaaaatatgtctactgctaagatttcaagaccagaagtgtcagaagaatagatttttttgcaatttattgaggtggagattagtattgctacaccgccccctctttttttttagaaatttgagacctgttttgagagaaaacattaaatatgccattaaaagaaagtagtgagtttgtgggacttgaatcagacagccaagtttcagagaggagtattaattttggcctaatttgaagagttgaaaggaaatgattaagatcatcgattttgcttacaataatctacagttgaaatacacatatttagaataggaaaatttttatgagtacatgagagctgattttgtagggaaatgtgtgaaaatttatgcaaataaagtcagaggcatcacaccatcagtttacaccagcattcgttctttgcagcaggttcggagggggaggaagaattgcatgtcgttgttgccgtttgtgttctgatttatttgctgggagaagggtcgacggtttgccatccgctgttgacgttcggcgtccaattgctcactggtcaggctgggacggatcagaagtcgtgcgaattcagtgttcggcgttcgaatttcgctgcgtttctctttccatttacccagagcgatcctctgaaattttgaagcaggcagcacaattttgagcagacggccccgacctcacggggctgggtcagaaaatcgccccattcggtaaaggcacaagggcgaccctctatccccagcgaatggagtaaacctttgactttcgcctcgtcctcttcaacacgttcgcctggtgtagtctttgcactttcagggagtccgatgactaccaaaatctgcgacgttcaatttcttaagctgaggctttttagctgcttcatataattatatcttgtcaaaagatgcatttatgtttcgtttttaatcatgacaattgatatgttgcattttccacgaagattagcaggatgatctaatttatatgttcataaattattagacattattatttttaccattttataaatatctactatctttttactaattttacaaggctttaaattaggcttcttccatcaaccgttaataacaaaacccgaacatataaatattttttaatctgttataattttaaaattatctcagcttttattaaatatt

SEQ ID NO: 10084 - DNA, 157 bp, Heterodera glycines
gagagagaggagagagagagagagagaggagagagagagagaggagagagagaggagagagaggagagagagagaggagagagagagaggagagagagagaggagaaagaggagagagagagagaggagagagaggagagagaggagagagaggaga

SEQ ID NO: 10085 - DNA, 4874 bp, Heterodera glycines
  misc_feature (4825)..(4825): n is a, c, g, or t
ggggaggagcaaccagtaagcacaacattgcacaacggctgaggtgccggggcatcgtcaatcgggacaggcccaatttggagtgccggaggcgcaaattgctgctgatgctgctgctggtgttgcaaatacggttggaaagcgaactgtagcggaggaagtaccaaaggcattgtgaatggtgggaagacgggcagtggtggcatgcgcatttgcaaagtgctgatcgcctgttggacggcagctgaaagcatcggcggcggttgttggtgctgtgttgccggggcgcaatgtgtcaattgttgctgctggtgctgctcctcctcgacatgttgctgctgctcctcctcctcctcgacatgttgctgctgctgctcctcctcttcctcctcctcgtcagagttcccctcggtgcgcactaccacctccacaatgggcgatggaacccgggggaaaacctggtcctaaatcaaaaatttggctgttgccatgtcatgactcatcattaccaagggtaccctttctgcattgcgcaccccgaacacctcaaagttctcagggtgggcaccaccgacccgggctatttcgctaaattcctgatgtttatttgctgattttcgccccaatttcctcacatttggcgggccctctcgatgtcgatggcaccaccaacagctgcatgggtatacacagcgtccatcagacgagcgagggtatacccaatctataaaatgcatttcaattcttaaatccccgttctcgctaattttacatggctgagaacttcctcatctttgaggtactggtggtcagatgattggtacctaattaggtaccaatacctcacagcatcgcagatgagacatggcgccttgtcgtacagggccaaagacgtcacttcatactcagtggtgccatcgtcctcttctgctcgatcgtcagcgtcctgatccgggtgtcgatgttgacactaataaataaatttgtccattaaaaatgaggtagttgcgaatggcttctaactcattttgcactcaaaattatgaaaagatctatctcgggatgagtcaaattatcatttttgcctataatccataatttcacaattaatttagacttattagataaaaattaccccgaccgtccctaatcgcaatttcaacaaattttataacacattcattaaattcaaattttgccgccgccaaaagatgtcaatggggcgctaaaagtcacttattcttttgtgtccaatattccctgcactaatctttgttgatcgccccgagccaaacaaagaaagataacatctgtatgaccatttctacaatgaaaagacgacaaattgacaaaagaaacaaaaatttggagaactaaagtggatgggaaagggggggggggggggttaagcgatcgggccatactccgctggtcatttctccgaatattcgcgccatgcagtggattaaattcaactgcacgctttgcccaagtggacttcagtgtttctatccgcgcaagtacgcaaagcctgtgctttgtgctcatcccagcgtccgtaacatcacggactttttgagcaccgggcagcttggcgaagctgcaacgacaacaacaacaacaacaacatttccgacaactgcggaggtgtcggcggcggcgacagaatgcgcacctccgcccgtgcatttgaccgcgtggatcgcggtgtgcacagcgctggtggcgcttttggtgattgcggaggtctgttataattttggtcatttatccgctaaacccctattcctcaattaagcttgtgcgtgccggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcgccgactccgctcattttgccggctatgttggccggcgtttctctgcgccagacgggcgtcaatttgactgtggaccgggtgggcaattttaattaaattaaaatctttatatattttaatttctcactcattaaaattacaatttaaatttaaaggcagcggggcagcgccgcgcggatggtgcaattgaggagggcgatgagcccgtgtacgatgaggtgccgcttgacagcgacatcgtggtcgagatgcgcgatggagaaaatggggaggaggaggaggaggaagatgacagcgatttttagtgattcggcaagcgatcaaccaccatttattcaatcgatcgattttgcactaatttaaccatttaaaaaataaagttttaaaaatgttagaaaataggatcgctcactcaaaaaaattggtcataaaaagtttaaaaataggtataaatccaacaaataaaattctaaatgaggatttagaagcatttgaaaaatgtgggtgggcgctcgcgctatataaataagtgcgcgtgtccccatcggcccatttcaatttattcctgtcaaacatttgaccgtcagtttttttgtcagcatcatgtcggataaaaaagcattgttcaagcgtgttatcgcagaggtggacctcactataagcacgggcggcataaccttgagcggcccccgcctgtctgttccccgtttcattccgtttgaggaaaacgggcgttgccgagcatgtaaaggaactgaggctgaggtggacacaatggtcaccaaggagggaatcaccttatggtgcacacgcatagaaaaagctcagtttgtcccttttgacgttgtctacgagcttcccggtcattgtttctttcgcgtgaaaaataaggcaagggtgttcagcgttccgtacagcgaactgccgtcctcagacaggtgcacccagcctctaccaccaccaccaccaccaccaatgacaacagcaaaacatcaacggacaccggacgacgaggaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgtcaacttttgatcaacaacaacaacaacaacagctatcgtcaaaagaggaggagaaggaggaatgcataaacaacagcagtgcttcagcacaactgaatctgctcccgatggtgatgtaatgggcgatttcgtcaatagcattcaagcggcgacaagcaatatgcaatagcaaaaaaagcgcaaaactcgctctgccctatatataaaagttgttgattgctgcacgatttgtcataatttttgaaaatgttaaattctcaatcgttcagtaataaagatatttgtttcaaattgccttgcggtataattatttccgggccatcctcgtcgggcaaaacggaattcctactaaaatttattgctgagtgcaatgaactgatcgcacccagtcccatctcaattctgtactgttttggtgaaatgaattcggcggttccgctactgcaaaagcgggagttgaggtgtattcgggcgtgccctcggaggagctgattaggcgccttcccaaaccgatgctgctcattctcgacgatctgatgctgtcaatagaggagcgctatctgtctgatttgttcaccaaaaaatcccatcaccatcagtttgcggtagtgttcatcactcagaatctgtttgagcggaagatcaaggtggctcgcctttcggcgcagtatttggtgctaatgcgcgcgcccaactcgctgctgtccattcgaaatattggagttcagctttttccgcgtcaactcgattttttccttgacgcctaccgcaaggcgaccgctcgcccctatggctatttgctaatcgatatgcacgcatcatctgatccggcgcttcgcctccgcaccaacatatttaaagaggagcaggaggaggacgagggaacagttgtgttcatccccaaaaatggagcggtataaacgtcaacaacaacaacaagctaaagttagtcaactaataaaagataatgccaactggctttgcgcactgtcgaaggcaaaatgtgtgaaacgatgcgggagattgatcagaaaggcgaacactgatcagctgctgtcactggtggaagtgtgcttgaacattgttgcttcccgattccgcctgacaactcggcagaagaaacgactaatgccctacgtggacacggtgcgccgcgtgagcagagcgaggagcgagaggggcgctaagcgagcgcttgtcgtccagaaaggagaggggtttggcggactatttgcagcccttttaacccccgtcttaattgaattggccaaatcggttgtgacccgaaacacataaataccctcgtaaaattgtctcacacacgcattcattcattaataaaaatggcaaacaaattcattctcgtaccacaagaaatttatcggggtctcacctccgtctcgcagacgggagacctcaatttggacgcggttcgccacgacctggaccgggctaggggtgaacggacaaatccttcggcgaaaaatgtcaattataaccagcagctccagcgttatttacagatgagaaaggaacatgcagacagaccaacaaaagttgagctggccaagggaataagtgtactgatgaatagaggtggcgaagaaggcgaggttgttgataccccagggcgtcctcccgctcctccaccaccacctccaccgcctngaagacctcctcgtcgtccaccgcccagtcctccgggtggtcccggggg

SEQ ID NO: 10086 - DNA, 1648 bp, Heterodera glycines
gagagaacaacacaaaaaccaaagtcagaattcaaaccgccgtcgacatcaaagaaacccgatcaccacactccggcaaaaagagtgtcagagtttgttgatctcgatccacgaccctccacatcaaggcaggccgggtataacccgcctcccccgacgcccaaaataaaacatgagccgacaacaaagagacccatgccataccgtatcccaaaaagggaaccaaaagtcgaggaagcgccacaacagcaacaacctcttcctgctgccgctgttgtcgtcgaagaaatgcccgttgttcctccgcctaggaggggggccaaacgtcgctaccccgtatatgaagatgatgaggtgcagataagaaaacgagtgagacaaccgagaagggtaagggtacagtactcacccgagccaggcccatcgacatctgcacaaagtgatgaacaacaacaacgacaacaacaacgcgaactgtttgccattccatcaaatcagctgaccatgactcagcgggttgaacggctatacatcaaatgtaaccattacgctgatcgtatgggcgttcgtggaaatacaattaacaccgcaaacggcaagccgttggtgcataccaatttgcgaatggccatccgctatataatagacagaagagcgggccgccccaccattagaccaccaggagcggccatattggaagaaaggcttcagcaggacccaattctgtattcatggacggctccaccaaagagaccgtcacagagcaaaaccacgcggaccgcaccaaaaatcaaaaaggaatttcgtccgaaaaaatggagctgatcaacgcaacgcttgacaagctgtataacagtccatcgtcgcccgcggcgttcgcgggcgttaccgcgctgtggaaagaggcgcgaaaaagtatcaaacatttacgcaaaaaggacgttcaacattatttggaggggcaccgcacatacactctgatgcgcccccgtagggtgcgctttccaagggccagcactgtagcggcaggattcatgaccgatgtccaggtggatttggccgattttcaagcgctatcgcgacacaaccggggtcaccgctatctgcttgtcgcggtggatgtgctctcaaaacgcctgtttgttgttccactcaaaaataagagagccgaggagatgttggaggcattcaagctgctcatcgatcaaatgcccatggccccccaccgcattttctccgataagggaaccgagtttaagaacagattgctgaaggacttttttgagcagcgagaaattgagaagcatgaacccgtgcattcatcggtcaaggcgtcggtcgccgagcgggccatccgcaatgtgaaacagcggctgtaccggtattttgcggaaacggagacgctgaactgggtggatgcagcacagaaaattgtggacgggattaaccgctccccgtcacgtgcccacggaatgcgtccgattgatgtgggtttttccaatgctcagagggtgtggaagcgattatatgatgatggacaccgtgcgccccaaaaacgacgaccgccacgcttccgcaaagacgattttgtgcgcatgagcagagagaagggacagtttgagaagggctatttgccaaattatggcga

SEQ ID NO: 10087 - DNA, 284 bp, Heterodera glycines
ggtcccggtgtcatctatgttactagatcggggatcgatccccgggcggccgctcgagcaggacctgcagaagctagcttgatggggatcagattgtcgtttcctcgccctactcatcggcacagagaggagcacgaaggggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgt

SEQ ID NO: 10088 - DNA, 1991 bp, Heterodera glycines
ctgcctttgctgttgttgttcatctcctgttcgtcctctttctgctcggcaccctttgccggccgttttcccatgcgcaggaagtgcccgagtttatgctgtccagaaaggatgtatgtgctgcttcttcaaaattaaaaaaatatatatctatctatatatatatatatatatatatatatttcgtttcatctttttgaaacatataaatcaaacccgactctcgattttcttgggaccaattaacaaattaccaccagttaacccccccccatgcaaatgtccaaatttatgatgcgtttttttgcccgtcattctcatcataaattgttggcagattgtcgacaaaaatgtggaagagtcggaaacggtgctgtcgcccaatgattttgcgaacattcccgagaaggaagtggatttgcgcaggctcggcattcgtgtcaattcgggtcggttttgtggtcaattttggcacatttggggcggggacaatcattggaaaataaataattgtagtttatatttccaattcctacttagggcgggggatatatcaagacaccaaaagagccaagattttctcgagtcgtgtgactcaaaaccgagagtatcgaactgcactatcgctgatttgctcctccgttttttttgttagggatgctaactttggttccataatttgaattaaaaattgggaatattacatataatattaggcaaattaaaaacttaaaaaattatacgatttatcggtcaatattttcgtatttttattgagaatttgattatcaaaaaatatagatcgaatcatttcccttctttaatataaactttggttggtcaattaacaacagctaattttactaacaaataatggtcatattttcttttttaattaatttttcttggtaaaaaaataaataattttttcgatttataaataaaacgccattttcttcgcgtttcgttcagacccgaccatgggcaacaaagttgagggagacattgtcggatggtcgccgacaaaggaaacgcccaaaggacagcaaatgatgccgaaacggcacaaaggtgccgcacgggtcggcactgatgctgctggtgccgccggcacagtgctatttgacgagaacggattggcacggaacgcactccgacagccctacaggcaaattgaagggggggggggggggcgcttctcaatgtcttccgttggcattgggaacagcggaattgtgtcctcgtcaactttaacccccacagcgatgcccgtccgtctgagaaggtccaccagctgatcgccttgatcagtcatttgccgataagtctaacaattaggcagggaattagaataatttgaaattaatctccaataattggttctgccaatccgaaaactttgacagattaaaaggagggcgacacttcatcctgaacaatgactgcgctaatgtgcttgtgaatattgggagtggtgaacaacaattgtcgaaagcgacggcgattctctgcggaattttccatgccaaaaagggtcaatcgcgagtcgagagcaactgaaaaggcaagtaatcaaaggtgtgtgtggtgtattactcattaccgtccgaatttgccataattagctaattacccccccccccctcctctccgcccccattcattcgacctgccgggtcgcccgctgccaaaatgcctttgcccggctgaagcactctcgccacgatatcgcgcagttcgcactcatttttctcactcaattcgaaagtcattcccatcgatctgctcctcctcttcatctttgttcttttgtccattttttttactcccttgaattttcttttcaagtcctttgaaatttgaattttgatttaatgaataaatccaaatcacttaatatttgcattattttttgcaccaatcgacaaaataataataataatataatatataaataaccaatgagtggttatttttttttatggaaaaaa

SEQ ID NO: 10089 - DNA, 3648 bp, Heterodera glycines
  misc_feature (15)..(15): n is a, c, g, or t
  misc_feature (46)..(46): n is a, c, g, or t
  misc_feature (107)..(107): n is a, c, g, or t
aggcaaatgaaaggngggggggcggtggggtcattaatccaataantattatagaaatggcttaatcaaattagaggggcatttaactaattaagggaatggtattntgatcggaaaaacgaccaaaaaaagatttatcggtgaaaattaatttccaccctcaggcgatggccccgcaacgaaattccatacgcggtcaggtcagtcatctgaggcagtgtcattagtgaggatgcttctctgatcagcattcaacccactcaccaataaaatatctgtgatctatcatcagtgattagaactattttctttttaaactcaattaattttctctggttttgaatcatccgtcagttttgatcattgctaattggtctttgaatgcttctgatcactagtgatcattggatcttcgatcattgctgatcagcagcacttatctgagcatttcttccgtctgacccgttcaccaatccttattagtgatttcatccctcttttttcgaacatttcggtcactctccgtcaatttctgatcactgttactgatcatttaattccaaccaaaagtttccctcatcacacagtgcacaatacggctcctactcacgttcggtcagtgttttttgtcactttttctccgagctaattgccttttaaaaatggtggcactttcccttattaggtaattgccaaagcgatcagtgaatatcacagcaaaacgtgtgtcaggtttgtctgtgcgttcttcactaatcaaccaattaattaattaatggtcatatgatcaaaaatttcatcattttgatcatttcccagatttgtgccgcgcgatgcgcgcaaacacagtaaaaattaaaatacgattttaaacttttaaaatgattttcccatatttgagcggattatgtgtggatacaccctgatggtaagtgtaaaatcataaccaaacccatttgaaaaacccgattgtccatgcctctgatcaatcagaatcattgtcatcgccatttcataaacataatttgatcactccgctccccttttgctgatcagatggctgctactcattggtgggccgtactggcgggtcggttttgaccgcacattttccattcgatttgcttttgtgtataaaatttgatcggtgcccacagacgacagccgttgagcttggacagcggatgcatccaagtgggcaccgttgtgcacgagctgatgcacgcagttgggtgggtaaaagggggagaagggcattcattgatcagtgccaagagagagagagagcgaaattgatggcatacgagtgatttgccgagaaaatttgtatacagattagagacagggggacgggccgagatctctgttcaggctgatcagtattgactgcgttattgcattgatcaattaattagatcgaaggccgagcataaatataggctctgtctaatgtcaatatcgaggtcggaaaagcaaggcatgtcgagactgatcagtcgtgatgaaagtgatcaggctggaagattgaatgctgacttgtacctttcgatatacataaatgtgatcttcatccattttatagtcaggctgtttccgaaagcgaaaaatgccctaaatttttgatttgaatctcaaaatgccgtctttttggcgaaatttgtccccttttcttctttacagcttcttccatgaacagtccaggtacgaccgggacagtttcatccaaattctgtggtccaatgtgcttcggggagcggacggtgagaaaagcgatttcaggggcagaaaataatagggagtggtcgagacaatgttcagatcaattcgaaaagtacagcttcaataccatcgaccaggttaatccatggcattgggaattaatggatttttttcttgcagcttggcgaaccgtacgattacggaagtaaggcggggggggggggggggaagggtgcaagggtgagagcggggaaagggtggagaacgggtgccaatgaaaaggcggcgagaattgtcccgaaaaattattctcgaccccaagtcgagattatccgggttaattgtcggaaatttaatcacgaccaaatgaatcgatgatcggtcacacggggtactccagcgaaacctcgacggagtttttggcattgtgccttcgagctttataatgcttaccagtctcggaaacccttcattctcgagggacaactctcgggaaccgagacgggaatgggtcttacaaaattctgttcaatcccacgctaccatacccacacaaataccccctaaaaaggcataatgcactacggagcgtacgccttctcctcaaatgggaagcggacaattgtgccgcgcagaaacggcgccaatcgaatgggccaacgggtgacgttcaggtggatatgatcagtagggcataaaattacatggaaattataataatcagaaaatggaaaaaaaattttaaatttgttatctgtcgctagattttatcaattaaacgaaaattttcagaaataagttaggttttatagaatccttgatcgaaatacattgaaattttaaaaattgggtcggaggaattcgaaaatttgcacacaaaaaagtaacaattattttgtaaatcattaccaaaagtgaaattgacctacggaagatcaacaaattgtaccaatgtgacaagcggacgccaaacacaaacagagtcagtttaaggggacttaatcagaaaatgactgctttttaatgaaagggacggcaatttacaaagagtcgggatcagagggtacaaccaagagtgaatcgactaagaaacccaaaccttcattgattttacgggggaaaacccaaaaatccaagtgaaattctgatagagttaagaacctctgatcatgtccgagccttatttgatttcggaattcgaatacaaaaaaacacctaattaaagcaattagctttaattaataattaatttcttgcatatttaagtgcaaattttattcattttcctgggaattcaataaataaataaataataaaaataattatttccaggccaatgccaacagcagaaattggggtcaacaacaacagcaggtggttattttcacaaatgccatgccatttaatgatgcttattaataatgcctttgtttttttttctcgctgctttcaattttggttgatcgctgccgcttgtatttgtgcttttcaatttcagtttaaggctaaaacgatagcaccggcattctcggggatgatggtccccggcccaacatctcaaaagtcccaaataaatccacagaaatccacgaaatgtgtccaacgagttggggaccaaccttatgggcaatgatcatcaccaagaacaagattctgaatttcagcaggggtcatgtagttttcacgcttcaaaagggtgttgtctctctgtcactggggatttgtgatggatgatcgatagtctcgattcccaggggtcaatgctcccccttggtaaaatcattctttctcggcacacccacccctctattaatgtctatcagtggccaccgctgatcacaacgctgaaccaatcgcggcgattcccatggacagccgcgggcggcgccaacggcggatggcggcgcgggcgacggaaaacggaccgat

SEQ ID NO: 10090 - DNA, 2270 bp, Heterodera glycines
  misc_feature (2203)..(2203): n is a, c, g, or t
cctaccctaataaaaatgaacatttaatttaagcttgtgcaactggggatgaacaactctgcgtgcagagtgtgaccaataatccgacagtttgttctgaaaaaacaatgttacgggcgtgtccaaaaagttgcggactttgtaacagtttggcaatgggttcggcgtatggctaagatgacgagaatttggacgaaaataattgaaaattcgcatttacatgtaatcaaaaacgatgcctaattttatttaaattttccaagttgtatattttaacaattaggcgggtccggatacccaaccgggcccgaaaacccgggttttcaatacccgggacccgcccagacttttttataattcattattttaaaaggaatttttataaattttaaaatgaactatatttaagttaaagaaaaatattcttaagcaattggaaaaagcttaaaaatattatatcataaaatttaattatgaaatttgtatcttcttaagttttttgataaatattttcatttgctaccaaaaatatttttagtttaataattgtaaaattttaaattcttttttatttttgaaaaagtatgaatagcttttcaggacggcccgatacccggactcatttttaaaacttggacccggcttttctggacctgtcaatactctggctcgtctaaccctacttttaaatatgttgaaaaattaattatttgtgattagtaaggttgattatatggtcaaataattccaaaattacgaattacaactttagttactcttgatcaaggttaacaaaattttccatttgatggttttttgagtaatgaacgacccagcaccgataaaatttgcaaaaaacaaaatattttagggaaaaatctgcctttattatggacaatttaacgaaaatacaactaaataaatagaaaaggaaaacagaattgaaataaaataaatacctcaaactttcttaaaatatgaccaaaaaaccaaaaaaaaaaaaaaaacgaaaacacgaataaataaaatcgaaagcgaaatgccacgtaaaatatgaaaacgaaaaaaatgaaaaacgaactataaatttggatgaaagcaagcacaaaaaaataaaaagctaaaccaaaaaaattttacatcaacttgatcagatcaccccttcattatggtctcaaaacacgaaaattccatgaaatctgtaaagtttttcgacaaaaattcctaggggaaacttttttgtgccaaaatgatggaacaaatgtttgtgtgtcactgattttatgaaaagtttgtggagaatgcatactaaaatataaaaattttcttttatcaataaatcttcttcttttggaatctgaattgctttgcataatctcaaaaaattcttccggtggaacatcctaaaataaatttgtttcatatttatttaaatcaattttaatcaaataccaaaagtagggttgcgtttggttggtttgagaaattaaacttttttcatgaggatttttaaaactttttcagaatttgtttaaaatttacacaaaacaagaaataaaagtttcagaatctttatattcaacttggaaattctaaaacaaacaaaacaatcttaaagtttaatcaaacaacaattattcaaaatttatttattttcacatttttaatcaaattgtgaaaatcgatttaatttataatatttaattattgtttgttaacatattttgtccattaatgatcaattttctgaatttttggataaattttcaaaattttatggaattttgggtccggcagtgccgacaggctcctccgggaaatttcggatatcttgtcacaatctgttaaacgattttgaacctaaaaattggctttttggctatatttaaaaaaaaaaaaacattttaattgattttttattgtgttttcgggtggtggaaattttcataattaatttttaaaaaatttaaaaataaaaaataataaaacaatttcattaagtgtggggatcgaaccaagggcgaaatcaaagaaagaacggatatttaaccactcaactgataagttttcccttatctctaatttaaaaagaaaaatcaaattttattttttctctaaaattttttcttttctcccatttttcaaaaaatatattttttctcacccctccccccattcgtaccatttcaaaaagatctcattnccaaaatacaaaaataacagacccccgtttttgaacatatctctgttaggtaccataaatctgctat

SEQ ID NO: 10091 - DNA, 4012 bp, Heterodera glycines
  misc_feature (43)..(43): n is a, c, g, or t
tcaatttaagtgcattaagatgaaatatagaaaaataaggatnttatggagtttattttggaatttctattacgaaagttaaaagatattctagaaatctggaaaacttgaacactctatccctcttgtaggttgggggggcggcttctaccagagggactttgtattgttgaatcccttcggacttacggtactcatcagattcaacgaaggataaatgctgaatttttttctcatttttaaaattggaacttatttgtcaagcgccttgaaaatttgaaacaaaaatccaaaaatgtaaaggaaaattaaatgaatttcattgtcgtgtttaaatttggcatcttttcaaaatattgtaaatgttagcaaaaattcacttaacgttgctccataaattaacttataaaatttttttttattccaaatagaaagattgacttttgctaagtaaatatggacataaaataccattaattattaaatcaattaagcataaatttattttcatcaatttgttcagctttccaattgaacccttttattcaggcaaatggtcggattgatgttgagaaatattaccattaaaatcaactatatgtttagtaattgacccaattaataataaatgaatttagaaaatcgatgggcttttcccggctgattctgatcactctgatcagttgctgtcttttgccattggcatccgttgttctggcacaatgtccttaccaggggtggacagtgagcggatcctgccaaataatgggatattgtgtagaccccagggataagtgctattacaggagttcgtgttgtaagttttttttgctattgcattattggttttaaaaatatatttttaaaaaatttcgtttcccatctcagctataagttaacaaaaatattataggtcgaatttcgaatcaacagtacgcgcagacaacaaagcaaaacccgaaaacggggctaatggaaacaaattactgccctttgggggcctacagagatggaggtcattagctaattagtagggatgggtgtaatttatagaaatgtatttttaaaaagaaaatttaaatattttaatttttcataaacataaatctcatcctaagtgattagcatacgaaatggcattttaattatattcacaaaaataaaaattgtattttttatttggatgtcggaatacatacatacatatatttataatttacaaaccataaatttatttaaattattgccattgaattgaaagcaaaatttgaggctgctcaacgatgtgttggacgccgagccaagtgtgcgtcaatcggcaagactgttgtaagtgttgccaattattgcttaattttttatgatagtataattggggggggggggggtgataatgatgaaaaaatgtgacttaatagaaacagcgggtgcacgacttcccccgcctcccgcaaaaaataatataaatttttagttttaaacttttttaaatattttttttagcataagaaattatgcttatgtttgaaaatattgcttagttttttattattagaaaaaaaatttgtttacgagaaaaaaacctctaagaaagacagaaagggaaaaaattaataaatttttcggcgggggggggagacaagctgctgctccccatcgcaccatcctgcaggcgaaattgttaatttaatggatgttaatttgcttttatgatgtttaggtgtccaatcaaacattccggtgaacagcaacccctacggcccgactaataccggaccaaatacgaattatcccggatttaacgcttacaacccgggtataagcggtgaagacacctgcagacagggccaaggacaatgtccgttgacaatgtgccaagacggatgtgagttttatttcttgaaaattcaaataaataatagtaagcaaatggacatttatttttaaaaaacgaaaagaagggaataaatactggcaaaattaattatccaataaaatgaacaataaaagtgctgacattgagcatttatggaattataaataggtaattgagagagaatatcagtgggcacttgaacaaaggtaattagtgttaattgctcaaactttcttgcgagcctctcatccatcattaattccatttaaaatcatctgagaaaaaaagaaacaatgtccgattctcactcctcattgatcagtacaattatctcctcctccagtgataaatcagtacgcttcaacttccctactgatcagttcacttatccccatccctccattgatcaatcttttccttccccatttttgttcctcactgatcagtccacttcttctcttacttccccacctgcttttatgccgatggtgttctgtgagggcgttccgtcccgactttgtcctccatcgcggcttaaattctttttactgcgcgacagcgacctgcgcacgcgttccacgatgcgcgaactgatccctttgaacggattgcgccccccgcgcggaagcgacgacgacggaaacggggaaggactgccgccgcctccgcgggtccgttcgtttgaaccgggcattttttcactgggcacgtgttcgccctttcgaaatgcctttggagttttcaaattctaaatttgttttttaatttcctctctaagttgctaattgccctcaacattcttttaatagcgcccattgacttatcgctaatgtcttaatttccgtctttaatgacccagtggaccaatcgatcgtttttttccaaatcattttcaccttttccgacattgagctgacttccatcgaactcgacttgcccaacagtccgaatagtccgccctttgtcggttttattctgaaattatttgcccttccaacaatttttgtttcgctttttctcgccttttccgttttggctcttcactgctgttccccttttgttggagtttttcaaatgattcaaaagcgcgggccatttgacgaactgtcggatgtttgccttgggcaagctcttctcgacggatacggtagagaatgtttgtgcctggaaaaagttacaagtaattccaatgaaatgcctgctcactgtttaccggcacttcccgtcctgcggtatttctgctgcacgtcgtccacactgccaaagtccccgtcgtccattacggcaattgcgcgctgtcccagccccgccagcggtgaggacgtgtgaatgtccacggcacggcattgaagcattggtactttgagaatttgaatatcaagggcaacataatttgattgttcctcaccagttgacccgcccctgaacattgccgattggcccttaagaggcgaaatggaccgcgtcatcatcgagccgcagtccaaaagtcggctgtcccacgttgtgttgtcagtgaaattgttttccgtcagcgaactcattgatggactcttaagggggaattgcttaaattggtcgctttcggcattgtttcacttcgtatcccctctgtggtcgtgtcacgtgctgtgcctggtgttgcgtcggcatttttataacggcactgacattgaccgcgtcattgttgtcgtcctgtttatgttcagctaccgtctccgtcggtgccactaccgtaattttttgttgccgtgtcgccagttcctgctccaatttgaccagctgtccgctcagccgctgcacctccgccgtgtaatgcctttgatactcgcggtactgtttctgcagctcttccgccgctcgcaaagcgttgtccgcgatttgcttataatccacgccttggccaagcgaagcggcgccattctgcacaaatttttttcagttgtaatttgccataatcaacccttaattaattgaccattttatgcgcccttccgcccatttgttctctctctctttgccactcaattttctccgtttggtgcgccaccatttccttaagaattttaattggttcgaagttaaattagactaattgctccacctgctctcgtatctttctcagctcctccatct

SEQ ID NO: 10092 - DNA, 2562 bp, Heterodera glycines
gacaaaatggcgtacattggcattgacacgaccctgtcaactgacatttttggcactcctccgactttgttctgctccgtgttgcttgcctcctcccctccatgacccgagtttttgcccttctcctccaccggtggagacggggatgacaaaatggtgtgcattggcattaccggaatgtggctgttggccgagtcagtttttggcacccctccggcgttttcctgctccgccttcttcgcttctacttgatgttcctgtcttgcactctttttcctcattgattttctgtacctcctcctccatcttagccttctcttgtggcttctccgccgttcctttctctggtccctccgttccgccattctacataagggtgatcaccacctgctctctgcctttctcgtcctttgttcgtctgacttccaaccgtccttcccctccggcgccgtccttcacttcaaccttaccattctcgttcaccctcacttccggcactgtgtcctcctccgtcatcttttccttcaatttttttgcttcctctcctcctgcccattcaatcagtttgtccttcctcagcttcacttctttcgcttcttcgtccatttcgaccatcacttccaaagcttccgagaaaagtcccaagtcgaattgtggcggtgcctccggcttttccttttggatggtctccaattcccaatgcatttttgccagtgctctttggggctctgtcagttgtgattcgagtgaagccaatgaattttgtgagttcttccattgttccggcgatgaaatagccgaataaacagccttcatatccgattggactgactcatcttaaggggcaacaaatgggaatatccaagtaagcaggaaaagggatttacctgggatattttgaacattgagaagcagggggagaagaagcagaagggcagagagggccatgaaaaaatgaaaaattgggagattaattaaatgggcggcaaaagaaatataaataatattttggaggggagtgagtgagagggaaaaagcgggataaattaataataaaagctaatcaatggatggatgggcgagtaaaagagtgaatgaatgccttgtgcttccctatttggcgaggctttgtatggattggctgctcatcacgaaacatcgatggtgttggcaaggggagggggtggaaaagcgcatgaatggagtgagaaccatgccaatgccaggcccaatgatcccatgatttgataatgatttgtcttcaaatggaaattgccaaaccaagtgaccatcaaattaagggtattgaatcacttatacaaatgagtgccactcaaattattaaatattgaaaatagaaacaactagcatttttattggaagaaatattctgaaaaagtaaaaacggaattatgaaaatggatgataaggagaaatcttgcagatttttttaaagacgtgtagtgttgtaattttattgggcggctcattaggccgtttggctctattgaatgaatacgttaatgaagtatatatttctaaagcattattatcaaggaattttacgaacatttgagtttttggattcaaaaaagttatttccttgcatttttcaatataacttcgtgtttttgtccggatattcgaaaaagttaagaaaatacctattatgttttcttaatatcgataaaaaatttctcatttcatttcttaatatagaagaaaaaaaccaatacttaaagatttaaatcttttattttttgtgatatggattattgagtaactaaaaacggaaaaaataaatctttttttattttgtaacgacaattccattaaagagtttatctatcaatataattacattttaattaattaatgaattttaataatttttcatgatctcttctggtcggttcctatcggcgccgccgaccaacaaaatttccctaagatttcaaaagttgacttaaaattgtcatttttcggtgaaaatttaaaactaattttctggatttacaaaatttcactctatctagttcttaagtgtcaaaaattctcgtttatggagctaaaatgcgggaatgagaaaccaaaaaggcgagaaagcgaaaagagcaacaagtctaattctttaatttgttttgttttgtcgctaattattcttctcttactctatttttctggaaattcctctttgttgaattttttaattaataaactttaataatttcgttttttcttatcagttagttttttttcacgtttttctctcaatcaaataatttttgttgtatttttgtatgaatagtataaatatgaatcaggcaattcaaaaataagggcttttactcacgaaaaataactgttaaaaacaattattaaaactataattatctaggtcaatcttcatacttcatcatgatacttttccagaatttctcattgtaattcttagattttacgatcatccttttgcttattttcacttgtattcccaacaaaaatgccaccattgtgttgagtgccgcttctatttacatttcctcctgtgtttatgcggaa

SEQ ID NO: 10093 - DNA, 2023 bp, Heterodera glycines
cattggcattccagtgttgtgcatgcgctggtgtttctgcaaattggtccagggcatccgaacacgctctggattgttcatgaatcatgttgcacattttgtgggtgtgtttgtgcccccgatggtgggtttgtcatttgctgttggtaatatgccctccacggctgttgatttacattattccatggattcggccatttcccggattgcatattagtttggtgttggtgagtccaccatgaagcattctgaggttgctgttgcatacttgcaaatgcttcatggtcatgtcttggctgtgcatttgtcgtattgcttgtcgaagtgtcagcgttgctggccagtttgtcacaagcagggcaattgctgtttctttttcgccttaagcactggttagtgtagcaattgagccctattattaaacaaattatattaccattttttcatgcagttacgatgaaattcatgctgaaatatttgcatattaaattaaaattaaaatgggtatgccaattcaaacatggcctaaactttgcgagcctatcaggttaatattttttataaattttgacttgatataatttcttgggtttttgtatcccaagcggctcacttacaagatatgctctatctagtagaataaaaaattacttcacatgacaatgaaacaattctttgattttcttttttcatttcattatcgcaaatggggcagtcattttccaccaaagcacctgttaaaaaatattaacttaatttgcgttagtgtttcaataaatttacttcgagcagttcccaacagaagaaaaagaattgccaagaaaatgaagtgtttaggaaaatgcatcagatattaataaaagaaatggaagatatttttaaataaaatattaaattataaacaaaaaaaaaagaaatatttttaaaagaaaatcacgaaatattagttcaaaatttatgaatattacgaatatgattaaatctttctgattagtaagaccctgaaacgaagacaatattaatatttttgaggtcatatttaaccttacatttagcaaatatgaagaaattttatacactcaatttggaaaattatgtccaaaatatgaggaagggacgagggaaattgaggattggatttgggggaataaggaataagccaaaatccgggccctggataaatgacctccctaaattggtaatcccatgggcgcctactagatctaatacgcgtgcggggatgggtgagaaggagcaaaataataatataaatatttgccaattacattaataataattccgccgcgttctgctctcgctcgccgattaactgcccgctcaactgactccttatcgagagaatgctcccgattaaatagttggacttatggaacggaataaagatggggaaaagcggggataaatggtgtgagaaagagattaaacggatgtgataaattgcgctttacactattaaaataattttaataatttaaaaatcagttggaattcccctcggtgccgatcagaatatgacccggtgttgtgtgaatcgaatcggacaattgctggctattttaatgtgaaggtgaaggaatgaatgaaaaatatttattttattaaaaataatttaaaaatttacaattttaatttaaaataattaaaatttatattttttaatttttatttttatttccaatatttaatttggtcattaaatattttatcaatttattttttcattattaattttcattttaaactccttatggacctctggattcaggcctcagttttcctgtccaagtccagttttttaggcaacctagtttttttggcctagactttcttagttttttctggcccaaaattcaagtcgctaattatttaaaaaaattattagccctttttaataacatattttttaaagtaagtttcttttaaaatattttaaaatggtttatcttaaatttatttcttttccatttgaaattaaaaatttttgttttcaattaaaaatatc

SEQ ID NO: 10094 - DNA, 3045 bp, Heterodera glycines
  misc_feature (2880)..(2880): n is a, c, g, or t
  misc_feature (2887)..(2887): n is a, c, g, or t
  misc_feature (2908)..(2908): n is a, c, g, or t
  misc_feature (2914)..(2914): n is a, c, g, or t
  misc_feature (2929)..(2929): n is a, c, g, or t
  misc_feature (2951)..(2951): n is a, c, g, or t
  misc_feature (2979)..(2980): n is a, c, g, or t
attcgagacttggacatttcgtgggctggacattttgtgggtcagcggccacactatgggtcaagcccagtgttagacaaaattgctcataacgccaaatagcgtaattggcgtaaatttttgcgcgctaattcaaacacactgatcactgccatttctgattgtttattttgatcagccatagctttgttcctctccaactaaattgacctaaattggtatctaaaataagaatttgaaaaggagaatctttttctagttaaaataactctacagttggccttatttttgtattaaatttccttattaatcgattcagaatttttttctctatcgtgtgcaaaatttggtggggttttaacaagcagaaaaaaagttaaacagcatgaagtaaatgttgttttttctattaaaaaaaatgaagagatagtacgccaaagtgagagaaattataaagaaaaagagaaactacgagatagtactaggcttttctctgcacagtggagttgacccatagtgtcctgcttattaatttaaaaccatttcatttaaaattagttaaaaatttcttttcttttgaaaaataaattttaaggctgtattttcgaaatctttttcgattgatcttatcaatgagtatattttcctctttggattaaaaaaataaaccataaaaatcgcttcccgagaaatgagcatttgaaaaattgtgtataagaatgacctcttatcaatattgtaccgtttggcgctgtttggtattatacataaaatgtgatctgatctattccttatctttctgctgattatcaattagtcatcgcgttggttttgatgagtgctgtgacttattcagtgtgtgtaaaaggccaaaattttatttgtttgataaaattaaattaataatcattttgttagataaatgctacatatgtataaatacatatgtatacaccaaaatttagaaattttatgcgattgattgcccaagcatttaatacggattggaaagggaaatgaaaatcttttatttccaaataaacaaacgctcattccatccgtccgaactgcagcataatcgcgtgaatgggcgataatagggacggaatgcatttcatttaatcaaaaaatgcaaacattttttatatatcaaaaagtgaggaattttgttggagccttaaaaaatggcgaaggatggaatgaatgaacggcgcttttgttggcgaaataaatctcacctcttccgccacataaaccagtcgtcgtcagtctgtggtgggtaatttaaaataatcattaaacatttcgaaacgcccgtttatcaccgctcattggtgagaattgttggggcattcgccaaattgtttcatgaaactcctcgaattgattgaaaagcaaatataaataaaactgaaaagtagcaatttacaaaaagcagattgaatgcataaactggaatagagcattttgcgtttatttaacaatttacacgatttttgcagctacgtttttaaagtttattttccgcatgtggattttcccggaatctgatccagatcccgactttttaccaccaattgcaacatctcaaattttccaatgtcacctgtgcgtgtaaggcctcccgaccatacgaattattcgaaaattcttgagaatttttatgttaattttaataatttcgacccaaattccagaatttgaatcctgggaatccaatcccggcctgattcccaacctcaaattttcaaattctaggctttttcctggatatataatttttttatcagaaaaagcgaagttattaaattctttaattttacacaatgattaataaatacatatgagaatgaatggacaatgtgtgtgattcgtattatgtacaatcaaaacgagtttcatatgaaaaagatcacagtttcaaggttagatcgatgcacggcgtcctcctccatcgtttggaatatcgcggtaatcactttcaagcgccacgttcgactccttcacgcattgtttcaccctctcattgtaccgctggggattgacgcgaaacatcagctgaaattagaggggaattagtttaaaaatattcatttcatgcgaatgctcttcttacgagtgcctcgagatttgcagggctcaaaaagttcggctccgaaagcattgattggactgagatgacgatggactccaccgtgtgcacaggctgccaacgttctgccgctctctcaacgccaaacggtccgtcgcccggcgggtggagaatactgatgcacacatagccatccctgtaaactgtagggagaggaaaagcatgatgaaggaacggttgatgcaaacggtttaccattagggtgaagaatgttagtgagaaatcgcatcttcggcggttgttgcgggtaactcgtcggaaagtcgagttgtgccaaaaaagtgccaccttcgctaaaatgtgaaaggggaaactgtttgtaaaataggtatgcgttgtctcattttgagcaaactcactagggcgattcgggcggaccaaaaatgatcacttgccatttgaagatctgaaaaaactggggatttgattggaaggcaaaaaacttgaaaagaaagtgccgacattgtcgtcgtcgtcaacgaggccacggacagcgaatccatcggttgggttcgtctgaagttcgaccaattgacgggccaacgaagcggacataagtgggaagaacggcaaaacaacgcaggaatagtaaatgtggcaattttgagcaaaatcatcccctttatatacatatacaccagcacgaaaataggtaagctcctgtaacaaaaaaagatttgtatgtgtgtctaagtggcttttaagagaggaatggaggtttaactccnctccacnacataacaattatttatttantttttnccaattaaaaaaacnattttataaaatatttttaatnttttttccaaaaaggttaaacaaacttnntatcatttcaaacttcgtgattgttagaaacttttcaacaataaattcttggcatttcgctgaag

SEQ ID NO: 10095 - DNA, 1434 bp, Heterodera glycines
  misc_feature (37)..(37): n is a, c, g, or t
  misc_feature (46)..(47): n is a, c, g, or t
  misc_feature (93)..(93): n is a, c, g, or t
  misc_feature (199)..(199): n is a, c, g, or t
tttcccggaatctgatccagatcccgactttttccancaatgcacnnatctcaaattttccaatgtcacttatgcgtgtaagtaaggcctccngaccatacgaattattcgaaaattcttgagaatttttatgttattttaatatttcgacccaaattccagaatttgaatcctgggaatcctatcccggcctgattcncaacctcaaattttcaaattctaggctttttcctggatatataatttttttatcagaaaaagcgaagttattaaattctttaattttacacaatgattaataaatacatatgagaacgaatggacaatgtgtgtgattcgtattatgtacaatcaaaacgagtttcatatgaaaaagatcacagtttcaaggttagatcgatgcacggcgtcctcctccatcgtttggaatatcgcggtaatcactttcaagcgccacgttcgactccttcacgcattgtttcaccctctcattgtaccgctggggattgacgcgaaacatcagctgaaattagaggggaattagttaaaaaatattcattccatgcgaatgctcttcttacgagtgcctcgagatttgcagggctcaaaaagttcggctccgaaagcattgattggactgagatgacgatggactccaccgtgtgaacaggctgccaacgttctgccgctctctcaacgccaaacggtccgtcgcccggcgggtggagaatactgatgcacacatagccatccctgtaaactgtagggagaggaaaagcatgatgaaggaacggttgatgcaaacggtttaccattagggtgaagaatgttagtgagaaatcgcatcttcggcggttgttgcgggtaactcgtcggaaagtcgagttgtgccaaaaaagtgccaccttcgctaaaatgtgaaaggggaaactgtttgtaaaataggtatatgttgtctcattttgagcaaactcactagggcgattcgggcggaccaaaaatgatcacttgccatttgaagatctgaaaaaaactggggatttgattggaaggcaaaaaacttgaaaagaaagtgccgacattgtcgtcaacgaggccacggacagcgaatccatcggttgggttcgtctgaagttcgaccaattgacgggccaacgaagcggacataagtgggaagaacggcaaaacaacgcaggaatagtaaatatgacaattttgagcaaaatcatcccctttatatacatatacaccagcacgaaaataggtaagctcctgtaacaaaaaaagatttgtatgtgtgtctaagtggcttttaagagaggaatggaggtgcaactccgctccacgacataacaattatttatttattttttgccaattaaaaaaacgattttataaaatatttttaatgtttttttccaagcaagttaaaca

SEQ ID NO: 10096 - DNA, 3976 bp, Heterodera glycines
aagcgatgaaaaaatgggtaaaacgcgggaggaaaacagtaggagcacacgaaacattacattcattcttctggcacaaatttagaacatttgtgtattggttgtttttattgagcattggacacaccgtcccaaaaaatgagagatcaaccaataatgagagagtgcagagaaaaaaatagaatttcttcaaatttaacatattctgcattttctataatgaattcatttttgtctatggttgaatacaaaagttttaagaaaaacaaaatttcgaacgttcatatcttttttttctgattcttcaaattgcttagcattagttttgggaaagcttctcctaatcaagaagagctttagaataatgccagtatcgtccaatttgcattaaataattgccatcgaaatgttcaaaccgggtacaacttttaccacccactttatttttttaattaattaaatttttttttttttgcgattttcaaattttctccaaatatcatttggatccttcaccgttcgctcattcgtgtttattggcctggatatgtatgatgattaacctgctgctggattagtctagtaaaccaaagtaagaaattaattcatttaattagtcgtcattaaattttaattgtttttcggcactcggttgggccgattcgaagtgccgtgaaaatggcattgaatgcacggcagagaattgtcgttctatgcttggtccggcacttttcaacatacgttttccggtttgtcaaacgtggaatttgcgaaggatattgataaaaaaagagattaaaaccaagtttaaactcattcaacaacgagtgtcaactttttaaaataattaatttaaataaataaaataaaaatttaatatgctttttcttatattttcagtgcattcaaaatgaaatataattttttaaaaattttattccattttttatccatggagaatattggcacaaattaaaaggaaatggggaagcactgatcagaattgtttgggctttaacctttttcgatgctccaaaagaaggtgcgaattaactgttaattaatgctaattacaacgatgattaatttccatttagacgaaaattggagttgcaaatgtcctgcaacttttcgaattgtctctcaaaagaacgatgggtcggatttgaagaatgaatttaatgactacttttttgacaacaaaaagaaaatcttgggttcttatttcatttcatttccagtgagtcacaattaaaatttcccttaattgacccaattatggctaattaaggaactgtggacccgagcaaaggcttttacgacaaaagcgaggacaaagtgacattggccatcgatgtgacagtgaaagaagcaaaaaaggagcacaaataccaacataattttgtaaagtaaatgtttcggtttgaaatttacttgacgacatatttttattccgaaagtcattagagtaaatgttctcacattttgatggcttattttatttgagattcaataaatttatccctggctcatttactcaagcccggccctgattcgatgacaccgacatttccaaccccaacgtaaacctaaaacgctgctcgctttgaccaatgttggcaaattatattagcaaaattaaagatttgtttttcctacttttataaatcttatagtttctcgaaaattacaataatcatcccgtgaccaatcatcgggcctaaatgaaatacttttaattttttttaaacatattgattttactgttttgaccagaggattaaatctcaattgaattggtggattatctttatccacaatttttatttgaacaaaaatgctaagccaaaacttgaggaaaattaacggttcaaacttggcaaaaaggctacacggataattctgtcacttgcacatttttctcagctatttttttatttgctaaaataaaaataatatttaaaaaaacggaagataagcaaatccaattcaaattctttacaccccctcctccagactctctgagaaggggtgggcggaagtttgggcactaaattaaggattttcattctataaaatgccttacatatgtatgtattatttgtatcattacaaggctcagtatgttcaaaatttaaaatttataaatttaaatagtattagacgggtctcttgtcatttcaggcccaactaagccggtatcagggtctaagtccaaacagaaaccagtacatgtttaattctacgtttaaacaaccgtaagaattgactaaattacaagattgccaggtttccatataaaatttttttaattttcgagaacatagaaatttttgagcacaaatgttgttaaatttactaaattttaatgatttatataacattttatatatttatattgttttatttttttgaaatccctccctctggtgcccaaacttcccggtgcccaaatttttggtgcccaaacttcatgtcgccctgagaaggggtcccccatctcggtaggggtcaactccgtcccgccaactccgtcccagacaagtttaagaatccatacttttttctcagttgaccaaacataacaacatataaatcattcgaaagctcttggtgtttaggaagatatttctaagctacttctaatctattaagcggcttacaattttcgctcgaaacccgcaaaaaaggcaaaattttctaagttttttacctcaacttttttttacagttcgacattctctgtaattattagtaggctaatagagcctgtgaagagctttcgaatgatatcaaaaattgttggattcggtcaacaatttaaaaagttacgctgctcaaaacttggctgggacggagttggcccgttccgccccaatcttgggtgtcaagccccccccccgcccccttattttttttttgtatgccctgcgtttccggtaagtccctatcctaattttcaaaaaaaattaacattttccattaaatcactagggatgctaatcttatgtaacaaaatttgcgaattatgtaaataaaatatgtataaaaaatgctaaaatatgtatgaaatatgtacaaaaacccccaaatatgtactaaaatatgtaaataaaatttttttaatggttattttttggaaaaaaattcttcgtaaaaagtgaaataggcacaaaatgccataaaaatgaccaaaataggcttagaatcacatttgaacattttacagattaatttttgatatatcattttttgaaaaaaatcgatttttttggatacattttcaaaaaaaaattttaaattttttacaaaaaatttctataaattctcaaaaatcctcaaaatatgtaaaaaaatgaaaaatatgtacgaaaaattgcgaaatatgtacgaaaaagtccaaaatatgtataaaaatatgtacatatgtaatatgtagaaaaatccgaaaatatgtaaataaaagtcccaacttttgttcgcaaacacaaaaaagaaagtgattttcctactaattaggttatggagaatctaggaaaaaatatgtatttacataaaattagcatccctataaatcaccaattatgataataaaatttattaaatgcattcccactgactcagcaccatccatcccatttttctccactcggttttagaattggcggaatcactttattaaccaaaaataaaataaaagtgaacaaaataaaacgaaaaagcattctttttaaatatttgtattttcaaaaacttcaaaaacttccaaaatgcaccagtctctgccattgtttctgccgcttttcatcttcttcgtctacgcgaccgattgtctcaacggtatgaaattttgatttaaaaatttgtgaaaaaccttggacaagaaaaaaattcggaatatcgctttttgtcgttgtatagggacagttaccgtaattgctaaaatgtttttagcaaattattagttaattaaaat

SEQ ID NO: 10097 - DNA, 1240 bp, Heterodera glycines
tttcacttgggaaagatgaaacgattgataaaaaatgttatcttaccaattaggtaggtatgttagattgagcggaaaggaaatctgatccaaaaaagtttcgatggtttaagaaaaataaacaaagtgctcactcactcagtaagttgtgataaaatgatcaaaaggtgcaaatgataggaaaatatcagataaacaaaacgtaattaaatggaaataattttaatcgtgtcaaaaaaattggcttcaattttaaaaatttaattcaaagaaacttactataaaaaagcttgcatcgttgagcaggtcggcaaaaagtcgccatcgtttgcaatctgagaaggtttttgaaattgactaatacattaggcgaaactcgagagtcttgagtgagtacaattaataatggcattttacaccgtcattccatttttggtaaaatgaattgtttatttgccaaatatttttaataaaaaatattttataaataattagatgatgcaaaaaaattaaattatatttaattatataaatatttattatagaaattctttttattaaatagaatgaaaaataataatttaaataaaaatatattgaataaaatataattaattaattatgtttttaattcctttcaattttatttaagaaagcaacattgaatattttaaaagaattattgttttctttatgatttttaataaaaagtaataaaattgatcaaaatgtcctttatttaaaattttaaattaattattttttttgcatttccaaatttttggctcgccccacccgagtcgagccgagtgcctttggcccaagcgaatgcaatgcgtgccaacatgccgactccgtccttcaaaatccatgtcagtgccgccgccaaaactgtctcaaatttaaatttttcaaaaaaaaatgtttccattttcaaaattgcctcctaccgcttgttcgtttccaacgccgacacctttgagcactgccaatgtggccaaagtgccgttcagagaagaggcaaatgccttcaaaaatgaacaaattttaaaattaaaaaaaattaaaatttctttttaaaacattttttgttgaaaattttggtgtaatttaaattaaagaaacaaataataagggcaaaggtcttgaagagaatattaacccaaaaaaacctaaaaatttcggcaaaattccaaattttccatacaaattttgggtcagtgggggggggggggggggg

SEQ ID NO: 10098 - DNA, 1477 bp, Heterodera glycines
  misc_feature (1330)..(1330): n is a, c, g, or t
  misc_feature (1333)..(1333): n is a, c, g, or t
  misc_feature (1340)..(1340): n is a, c, g, or t
ctcactgaatggacacgtttccgtagagaattctttcggagagccaaacgcttaaatttaaagcctcggtaaatttaaaactcaaattccttagctaggccaaaaaattcttgaaaatttcaagccaaaaaacgacgcttacgtcgccgtcccctcggggtcgagcaaaactgtattcatggaccggttcgccattgtatgtttccacaatgttctgttgttgttgttctatggcttcgacttgtgatgctaatgattttggcattttcaccgcggactatgaaaaaattgaaaaattattttaaaatattaaaattaactcaaaaatttatcttggaggctaatagtttacatgtcttcagttcattttatttaaattcgatgagaaattaaaaagcattgaattttgtgccaagattacccttcccattttagaatttccacttttgtattttatgaatgggacgattttatttttaaaaattagaaataaatcctagggctccgggactattaaaaagcgattatttttcatttttattttaatttttccttatattggtagaggaaaactgtgaacattttcgttaaaagaattctttattgtgagatccgtccctttggggttaaaatttttgctaaattttccaactgtttaaatattgcaaaaataaataaataaaaaaataaataaataatgaatattttcaatttttattttgcaccaaatcctaatgaaaaggatcaattaaatatttgccactttcatcatcatcatcatcatccattagaaggaaacaatttttgctccccgttttcccctactaagagagtgtggtttaaaaaaaggaagaaaaaattaatttaaaaaaaaattcaatatttttgtcgaataatttaaaaaatataataggagactaatagagaaaggatagaataattcgaaaattgacttttatcaatattttacaaattaatatttatcccaaaaaattccggttttttctcatttaatcgggtttaatcatggccaaagttttgttgtttatgcgaaaatttaaaatttaagaaacacattttctagggctaaaaaatgcactgatcacgaagttgagaaactcaaattctgtaaaatcattaattttttcgatgatttttcatcagatagttgatttttttccaaaaattttagtttttctaaaaatttattgctggtaaaacccatagtatagaactcacaaatagtttgagaatgagctgtttatgaatgaaaaattaaatttttagttattttaatgattttttttaaagttcttatagtcataatgcnggngtctggngttcgaatccgcttggctgcgaactacttttctaccttttaaactgaactcatcaacttgtatgtatttccaataaataagttcgcagttcagcatattggcagcaaaattccagttgatttaaattgcgaaaaaaa

SEQ ID NO: 10099 - DNA, 2898 bp, Heterodera glycines
ttaattaaggccttttagctgcttgttgtcatttatgtaaaatttcaatttattaagtgaggaggagctgcgacattttaataaataaaattttagccatataataattaaggcaactgacaaatgaggctgggattttaattataaacttttcaaaaaaattatgtgtttaaaaaaattttttttaaagattacgtgtcaaaattattattttttatgtgcgaaattggcggtaattgttgcaaagtcgggaaggatttcttttgctttgcaaattttaattttcccgacacggctgaatgtacaaaaattgctttaaaagaaattacaatatttctgcttttcttcaatgttgcaatttttcaacccccaaaagctgacgtaggcatacgaaagatatttttctttcatttttagtgtttgccaatattaaagctttaattttcttaactaataagcttttcgataattaagagagctcggctctggttcagattatgtgtccaaacaattacaatcctcagtttcttaggccataactttttttctttttggcttacattcttggtgccaatcaaagcttaaactcactagaattatgaatacagcaaagttacaaataaacacgaatttcaggctttttcgagtagctatatttacgaattatttttcgtctctttttttattaacccataatttgtcattaattgaacgcataaactaacaacagattgctagtgtatatacataaaataaatatggacaacaattcgcctggtccctcaaataatgtcaacccggaaaacaaaattgggaaaaccaatgttggtggaccattgtcagacatcgacttgttcaaagtttgttcaatttgaatttgtttattggcatattaattacccctactacctaagttttgattttccaggagatttgtggcattgacgaaccaactgcttccgcgttgttgagggagtcgggcggggacctcgaggccgcgattcaccaatttttcttcgtatttttttttgttgcctatttttgaaaattgacgaaccaattttctttagacccgcgagaatcccgaagttctccagaaccaggacaacgaagtgcaggagcttaggaggcgtgcaattggtgacagggcacggaataatcagcagaagtgcgtttgtttgtttcttgttttggcacttttgctgttgggggaacaccgaaaaatgccaaaaggttgggggacccttatggactgatttttaaaaaaagttttggactcatttggtcactgcagaacagagaaattactaaaacttgttctcggctgtatgtttttggggccaaaatcaggacagttccaggatgttgcgttggagggtgacgccctaggcaacgacccttttttgcggcgcgctttctacaaaatttttggaaatggggaaaatttaaaaaattttctcgtgtttgttaacggattttcaccttaaaatgaccaattttgggacttacaattagagctattttttgtgggttttccgaaaatatcgaattttttttttttaaatttgggttgtggaggtcttggaggggctatcactaaagaaaattggacgttttgaacccagcagaaaatactatttatccctaaccgtttgctatgtttagccaatctcttccggtggtttcggcacctccgaatgccccgctcatttcgtggtctcaatgggttcgtggcattttcctcatcccgtttcgctacctttacacaacggcaatggacgtgttcttcttcgtttgtacgtttgcaacttcacttttaatttaataccaccgatatttagttgatttcttctttggagggcggccgccaagacgtccaatcaccggaaataatcgtcaaaagtgagcaccaagcttaatttcttataattaaactgggtatttttgagacacaaaaattattatctgtcagtgttcattcgttaagttaaaaaacggcagtgttttaaaaatgaaagctaattttttttttgtagattttaaaagacgcaaaagtaaatttgggttctattgcactttatgagtccaaattcggagtttaaacaagttaaaatattcataaaacaaatttcgtatcgaaaaaatgatgaattaagcaactgttacataacatactgaatttgttgttgtcctttcagcaatgccaatccactggcacgagggcagcaggacgttttggcggatagaatgtgaaaaatgattgttttttccatatttttcgcaatttaattcaaaaattgcttccttttttcagcataatgcgtgaacaacaacaggcgtatgagcaggcgctggccattgacaagcaaaaagcggagcaactcaaaatggaaaagcaacgggcgcaggcggaggcggacaaagtgaacaacaggaaggcatttttggcacgaaaacggggcgaagtggcggcaaacattggcaaaacggcggcggaaacgaatggcaccggcggcggcactgtggcggaggagaagggcgaggatttggtgcgcattcggctcgtgtttccgagttctgcccgcatggaacagaactttcgccactccgacagtctcgaggtatgtttttttgtgtgtagttcgacgacagaagcagtccaacagctggttattctcattggagagcgcagttcgtttacccattcctccaaaaaaaaaattttttaattttcaagcttagaaattaacaaaaaaaaactagaaaattgcatcaagaaaaaagattatttctatctttcaagcgttttatgatgaattgaaaagtttttcacaaaaattgttacaaaaaatcgataaaaacttttttgaaaaatttttttttcttaaaattttataa

SEQ ID NO: 10100 - DNA, 3083 bp, Heterodera glycines
gaaaggcgtcgtctttgagttgcgcccgcgtctccccttgtttctctccttgtttattctccaagtgcatttttcgctggtaaaattgtaattttaataaaaaagcgcaaataaatttaatttttgtttcggcagctttgtccgatgagtattttatggagaaaagcggtatatgcgccgaattttgttgggtccgtagtctgtgcagcttttttagggttttgccaaatccgcgtttattattttccactcattaaaattgaaaaacatttcgccagaaattaaaaaacacgaattagaatttcgggacctaaaattttggcaaaaccgggaccggtacttgctggtaaaaaaagcgggaccgggaaccgggaccaaaatcagaaaatttcaaaaactttaatcattcgagatttagaaatcaaatgaaaaaaacaaacataactttaaaaaaaattttttactattttttcttaaaattttctaaaagtctaggaaatatttggttttttttggtggcaccttatttgttaaggtttttttttgatacttaaaactttcgaataaacaaattaaacctaaaactttttatcaagaaaaaaaatgaaattttgattcttaggggtgtattttctgaaattttttcaagtcatttcttaggggtatattttcccgattttatttgttatttatgcttaatatatcggaactagtgcgcagaaaaaaggcatatgcctcaaaagtcggtctctctctatttattggcgattagactaattttttatctacatatttattggtttttattggtttttattatttaaattgcaatccctcctaattattttcaaaatttagacatgagaaccctgccttattttatcattttcattacttcacgtgaaaaattgttggcaaaaatggcggaagtaaatagaaacaaggatattgttggctttttattaattctgatatataaattaaagaatttttagctcagtctttatattattttattattactaaaaaagaaaattaaaaatgtttaaatttcttattttcaatttgttattgcttggaacacgaatttttcaagaaacaaaatgtcaaaaaggttatttttaaaaaataaatgtttatacatacttaacggggatggcattacgaggcgaccccaaaaattttaggaaatcggaatttctattcccaaaaatgtcggaaatctgaaattttgaattaaaaaaataatagaaattttctaaatattttaattactaggttttaaactaaaccaaaaattaaaaagtaattttctcaccagaatattttttatgtcaatcaatttacattgtttaaaatattattgggaaagtgactatttacattgacgccatttttaaaggcccgcgttttttttaaattttgggaacgaacataagcgtagtccggtgggtgctggggaaatttttttaaaagtttatgcgatttaaacagaattatacaaaaactgctaattttgagattttgggctaattttttaggaaaaaacaaggagtttttggggtccggcgggccgacaggcgctgaaaaactaattatttcgtaattaaaaaaaatcattccgaattggtaaaaaattaataaaaaataaatttccgattttttattaaaaattccggaaaccgaaatctgacctccaatttttttcgggaattccatgcagtccctaatacttatcatttttaagtgtatccaaaatttaagttttcaaaatttcaaagataataaaggcacccagacttattattaaaatatttgatttagctaaattatattgaatgcttattaaaatatacaaaatttaagccacttaattttcaatttttaaactgctttttcgtcttaataaatttaaactccgcttcttctaatttagatttgattatgacggaaaagaaactgttgagcacagctccgagcgtattcttccaatctgatgaatttttgtttgaaaaatggttccaaaattatatttttggcattttatgcgccgaagaatccgaacgaaaaattacaccggaaaattatttttacaatttttatgaaaaagctcaaaaattgcggaaagatttctgttggacaatgaaaaatggacaaagcgtggaaaaagcaacagaaaaatttggaaagaatgcaagaaaattaataaaagagttggaaaatgaccaaaaaataaaacaaagtattcaaaaagcgatgaaaaataaaaatatcaaaaaattaaatgaagccgaaataatttcggtgataaaagaatttgaagcaaattcagcggaagaaaacaaaaaccaaattaactcattagtcgtccaatgggtttatttggcgttgaacggactgtggaaagcaatctaactcttctctcttcatgatgcgcgcagataggaaagtatcccccggaaaaagtgggataaagcacatgggataaccctcaaaaagaaagcggcaaaagctcagtcgtttcgagcaataccatggtatggaaaggccgtgggttcgagtcccaccaggcgagtcaccttttatcttctacaactctccctctctcactccttttctcttgtgcaaaaaaaagagttggtactttttggttttgttcctacacctcaaaattttaaatgcaacaagacgacaaatgtcccgggcgcaatgtcatgtaacctttgatcgctatgctaatttagggtcactgtgagtttgtgcgctcacgtttgggtgctcacgtttgggcgccaacatgtttttccacgaaagctttctataacttttttcaatgtcatccaaatccaacatttttgatatcattcgaaagcttaacatgtttagaagctttttctaagctactgcttcacgattagacaattaccaaaaaagttatacactgaaaattgcaaaaagtcgaaatttttgaagttttttcttaataaaattttttctaggctcgaaaatcctttcgatttggaaaggctaatagagcatgttaagagctttcgaatgataccaagaatgttggatttggatgc

SEQ ID NO: 10101 - DNA, 2381 bp, Heterodera glycines
gagcatgttaagagctttcgaatgataccaagattgttggatttggatgccaaagaaaaaagctttcgtggaaaaacatgctggcgcccaaaacgaggcgccccaaacgtgagcgcccaaacgtgagcgctcaaacgcgcgcgcccaaacgggtgggtcccgctaatttatgctatgagaatggtacaaaaatgtccctccagcgcgccatttgttgacatttcttaacattttgaagtgtatgaacaaaaccgaaaagtgccaaagatatttatagccaaataattttgcatttagcagttgaacaaagcccaaatgggacgacggcgggtggaaaagtgaagcgcgaggagccgcgcctttggctgagcaaaaactgtgttttgcttttgctcggctcccttttttccgtcgcttccggcctttatctgatgcatctttttttccgcagttcctccgctttgatttggatcagtatcagcttcaattcccttctgtttgttgtccaagtgatcacattcacgcggaaatgtacaaatttcgaaaatttattccaattttccgatgaaatggaagtgctgcgttttgtcaataattaagtcaattaggcaccaaatattctcatcattcattcgtcaattttttcataatttgccaaattgtagcagacatttagtctactattgttgtttatgcagtagaaaataaagcatttcacataatcaaagaaaatgttttattttttaattatttttctgcctattttcgcagaaagtccaaaaaaattcattttcatcgaacaattcacgaattagagcgatttattagcagtagaaaatattttttgagtttaatactgtcacatattttgcttatagccggaacccgtcagttggtcccatcgtggtgcgacttttggggatttgcaacttggggacccgacgagtgaaaccatgaattattttatatgttgtaagaatatcaaacttttttcgtcgtttttcaagagttggtaatttaaaaagttcaagcctttgtccatatggattatatggcaaattacattttcttaaagctatacgagtaaagtacttttgcatttttcaattttattaatgtgaatttttaactgagggttccatgcctcaggggcatattcaagaagaggacggatatacgagataaaaatgtttttccatattgaaattctttttgacttaataatccgaaataaaaatcgcattctaccgtaagcatttctagttacggtatttatatgttcagtaaatttaagtttattgtcgataagaatacccaggtctcgaatggtgtccacttcacaaattgtgttgttatttattttatattgttctctagggttattttttcccaagtacaaaacaaaggttttgttaatagagatgtcgatacaccattcattagaccaattggacaattgcctcagagcttcgtgcattatcactctgtcagttttagttctatgtattgaatacaatttgacatcatctgcataaagtttgataaaaattcctttcggaattttcttaggtaaatcattaatataaataagaaacaaaataggtcctagaacagagccctgggggacgccagagcacattttgtattcagaagaaaacgaattttcaacacgaactaaaaaggagcgattggccaaaaaatcagaaatccaattaaggattttacctctaatgccaattttatgaaccttatataaaagtaagctatggggaataacatcaaaagctttacgaaaatcaatataaacacagtcaatattttttccattgtaaataccgtcaaaccaattttcaagagttaaaataagttgggtaacagtagaacgacctttaacaaacccaaattggtgtactgagattaggtcatgttttaaaaggaaactagtaattgccctgacaacaaatttttcaaaaattttacacagtgaacatgtgagggcaattggtctatagttggtgagacaacttttatccccttttttaaagagaggaattattattgattttttccaaaaggtcggtaattttccggtatcaaatgagattctgaaaagttcggtaacataaggtgcaaaagaaaggaaacaatttttttattaacctgaaatttataccatccggtgaagtattatttttatttggtaaagatttaaggacccggccaacatcaacaacattaaattcaatatcattaattacaggagagtgactagataaatcaaaaggtaaagacttagaattatgtaaataatgttcagaaaaaatttttgcaaaaatttcagctttttgatcaggagaaaaaataactgaattatcataatt

SEQ ID NO: 10102 - DNA, 4162 bp, Heterodera glycines
aaaaaattaggttaaaacctaaaaattataagccctagtaataaggatttagcaattcatatttatagtatgttaatttaaaagagatttagtaaaactaacaagcaatataatttattttaataaaaattatttgtttttatgtttactgtcgaaaagtccactattttttgtgtttctgtcgaaaagtcctttactgtcgaaatgtcctttgctgtcgaaaagtccttctgtcgaaaagtcctctgtcgaaaagtccgggagccttttgaaatgcccaattccttcacaaattctttctgtttgcgttggttagccgacttttgcgccgcagacatttgcgccgcgaaacttgcgccgctcagcaaaaaagacttttgcgccgcggacatttgcgccgtgccatttgcgccgcgacacttgcgccgcctaacaaaaacgacatttgcaccgcgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaattttaagcgaaaaaaataggtaaataaataagggcataaaaattgcgaaataatgcgaaaaatggtaaaataggagcgaaaatttgaaaatcagtgcgttttttcaatgaaatgaaattaaaatctatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtctatggcttatagttttagtaaaacttattgataatagtggaatttttatgaatataatatttttgacagcgcggcgcaaaagtccatttttgctgggcggcgcaaatttcgcggcgcaaatggagcggcgcaaatatccgcggcgcaactgtctgcggcgcaaatggcgcggcgcaagtgtcgactttgctgagcggcgcaagtgtccacttttgctgtgcggcccaaatggcgcggcgcaaatgtctcatcacgcataaaaactaggtacgtaaaactactgtggacgcgtaaaaattaatgtgacgagcaaaatattttgacacgtgaaacccgtgggtcgcgtaaagacaacaggatatgtaaaaatcgcgggtcgcgtaaaaattatgtgacgtgtatgtacacgtgaaaacggtggtcgcgtaaaaactatgggacacggtgtttatattacgtttaaatattttattgacacgtaaaaacggtgggacgcgtaaaattacgggacacggaaaaagcgtaggacgcttaaaattttgtgggacgtgatggataaaaaaaattgtgacgcctaaaaactttatggagtcgtaacactgtgggacgtaaaatctatgggacacgtaaaaatttttcgagacgtgtaacctatagacgcgtaaatatttaggtgacgtgtaaaacaatggaacgtaaaatttatgtgaaatgtaaaatttcagtagcgtaaaacataaggaactcataaaaatttatgggacgtgtaaattttttgaacacgtaaaatagtgggacttaatttttttataaaaataatatgaaatttataaacacgtaatcattatacttgtaaaaattttataggacatgcagattggggcgtgtaaaatttttgggcgcgtaaaaaatggaacgcgtaaaaatttatgagacgtgtaacaacttataggatatgtaaaattttatgtaagcgtaaaaaaattggacgcaacgtaaaagttctagggaacgcttattcagcatagatcatattttaaaatcttctataaatctattttttaatcatttttctcaagcatccgctcgtcgaaaaataagtgaggactacaaggaaattcaactaccgtctccggtgtttctggatgatcaggaccaaacgttgtgggacaaacgggcggccaagaagcgattgttgttccaccattcgtcgttggatgtgccggccatgggaagcattgacacggcacacgacgatttggcacaccgctacgaagacatggattccgaggcagaattggccattcaggaggagccgcctcgttacatcaacgacgaggaagcggaagactttgaggagatgatcaagttggtggcacgaaaaatgccgaaaatggaatttttgcaagttcgaaagtgattgaaattcgaactcaaggccacaacttcaggtttaaggcgaatcgaattccgaccaaaaattcggaaagaggaattggaaaatttcgaggattaaaaaaaattcaaaattccaaataaaatgtcgcaaaaatcggaatttcggtgcccaaatattttttccgcatattgaaaattgcaatttttctgatccaactgttccgatattttatttagaacaaattgaaagacagtgaaaaaaacaattaagggctgctcgaccgccaattgatgcgttcagcaacccaattcttcttcgtgacgcagacccattgacaacgcgcaaaaagttgacaaaacgcggcagcggtaaaggcagtgccgcgtctggtggtggcggtggatcaacactgttgcgccaacacagcaaaagccgcttgaaaaagttgagcgaacagtcggactcacgaacaccgtcaggtggtgccacatttgatagtgacgatgactgattgatgagatgataaagccaaaattcacacaaaggaccagaatgggcaggcggcacacacaagcaataaagggcacaataattaattaattgcctaattaccagattaatgaatattttaattaattaacgcaagcattcgtttttaattttgtttttacgataaataaaatactcagaataactttttaaaacctctactaaatttattactggttacggattatggaaattatggcattttgagcccacttaattacggattttggttattgaaaatcctagttacgctcatttctaatacataaatatttttgaattacataatattgtgtcagaaacccgtttccacttgaatctaaaattacgacaaccaataaaaaaaattgattttcccattttaatatattcttcagtaaattcttttgaaatgagttaatcaaattaaaaattttgaaattttatttaaattaaatttgcctttgtcacgtgccgctggttttctgtgaacgcgggatataataatgaatgaattcacaaatttttgcataaattttgacaaattttcatgtgcctccttttttaagtaacctgcactaatgatgattatgatgatggggcagataattcaagcattggtaagaagtttttttattaaaaaaatttttaagatttcaaataatttaaaaaacttttactagggatcgaaatttgaaaatgcctggatttgggtttcatgtttgtcatggacctttttctagataatccagcaaaatccaggtcaaggatttgtaaaatgaagaagagttaattaaattattaaatagctagaaatccttgcagaaatccttgcaattttattacagattttgtcagtatagtggatttaaaatttaagtttttagctgacgccaccgaaatgctggccgaactgtccgccatggtggccaaatcgacggcccattccggcgccaccagtccagcaaacattctccagtttattgaggagcaaaaacagaaagcgtcaagccaagcagttgctggagaacaaccatgaagcacaaaaaatgatttttttaaattccccaggcttaacatttttttttttataaataaggcgatgaaaagtttaatgctcgcaatattagggtaattttaattaattaattttaaaatttaattaaatatgatagcacataagatgttcatcttcgatggcaaagacaaagtgcttggaaattttgattgttcttgaaaattaaaaagcga

SEQ ID NO: 10103 - DNA, 2044 bp, Heterodera glycines
  misc_feature (21)..(21): n is a, c, g, or t
tgtttaatttttgactttttnaatattacctctatcttaaataaaatgaaaaatttaaattttgaaaaatttaaaattgaataaattttttattatattttttacactacaaaataactgtaccatataattaaatgtgagcccacaaaagcggcatttgtaataagtaaagccattctcatccttgcacgaatttgtccgcactttctgttcttctgttgccgccggcttttcctccttttgatcaggcttaaaatgtgaaaataattaaaaatttattagatttcaattttttcaaattttcgttacagtataccactaaccacagtatcgtcccattttagactccgttgtgcagcaatgtttgagctggttacaacagtgccatcatcatcttcttcatcagcagcagcagcagcagcacaacctttcactgttatgccttcattttgttgttgtccatcagaaatggcagttttctaaaaatgtaaatttcaaataattttaattaaaataaatatattttaaaataatataaaattaattattatttttactgatatttcatatttttcaattaaatacttaattaatttttaaaaataatattatataattattttgtcactgacatcttcataatatttaaattaatatgtaatatttatttattatattgttttttcactgacatcttcacttttatcaccaccaatttgtcccttttcctcattttcagcttttgcctgatcctcattttccaactttgctgcttttacattttcaatgttgctaatcacatcctccttggcctcaattaatgtgattggttcagttttcttttctctggacgcctaaaatattttaaaaaacttatttgggtttttaatagtaaattcttaccgttgtgtttaattcatcatccatttattaactgagtagaaataaaactgttcgtatttggccaacagaaatatttattaaaacggattaataaatagcaataataaatacataaaaatgaggaaataaaatattcgcaaaaattacatttaaattctggtcagttcctggtttggacattttaaaaactttagtctccgttcttgcttatccctgcacagcaacggctgagctgactaataatgctaaatggccatcccaaatcgttttcttgccgacgggggagggcgggggcggcgatcgatcacttctccgatcgattaagagcaggaaaatagtggattttggatgatttattcaaccggataagccggcgaatgttaactttacactgacccagccaactcagctttatccactcttaaaattgaacatatgtcacacattgaatactcaaatgcgagataaactataacaacaaatttatttataaaaaatgaaaatagcattttagtcggaaaagaaatttacggaaaattatttctttgaagcacttaaccaaccctactccttttactaattaagtggctcttttccaatgattttaaaaattgttttgtttattttttctgagttttctgagcacttgaaaatttttatgagataaaaagttgttgagagttcctacagcggattctttttttttggttgaagatgttgagcaaagctctcaatagctgctgatgattgacttgcacgagataatgagggcttacagaaagaaaaaacaatcgttaatgacccgaaaacctaaaattacaggactaaaagccgagaggaaaacacccatcataagagaaacaaaaagaccgaagaaggcccaatgttttttttttttgaaaattagtaggcttatagagtaattaggggaaaataaatttttttttaaatttgacactttatagtctaggcacataacatttttgtaaatgcactttttctgctatgcctataggtaatcggagaccttttggctcatgccaaaatgttcaaaagtacgggcccgggccgtttggccgccgctagaaatttcttgttgccacacgacaaacgacgaattatttgctccccatctgtcccc

SEQ ID NO: 10104 - DNA, 1064 bp, Heterodera glycines
tacaagcaaatcgaacgcaacaattttacaaaattctctgctaggagaagggaaatcccaactgccaaaagtgaaaactatagtaagacccaaaatacagtttactgtttcgaatcataccatttcacatactaccaaattaccgaaagtaccaaaaacaaatttcaaatcaactgtaaaaccaacccaaaaaataaaactcaagggggaaatttcaacgcctaaaccaatttcagtaacggaaatgccaaaaataacacttactccaaatgttacagtaacacctactgtaaacattacggtacaattttcggagaaggcaattttttcaaacaaaaattctgaaaatgaggttaagataattacgccaaaaaatataaatgaaaaatttgaaaatgggactaccgaaaacattttgacaacgaaaatgaaaaatgacaagggattggaaatttcggaaaaattggagcaaaaccaagaaattgtgcataagtttttgggaatagaatctgaatcgttagaggatgagagtgatgaatatgatggaacaaatgaatatgaaaaggatgaagcgagctatgaatatgaaaacagagggattttgtctgatattttggaaatggacagaaaaaagagaacaacagtgactacaccggacgcgcgatgggttaaaaaagtggagaaaagcaaattaagaaaaagtggaggacaggagaataaaaatacaaacacaagagtgaattatgctctttataagttgaatgaggaccgaaaacggcaatatgatcaaatttttacccaggcttgcgaaaattcaaaatttcagctccaattggccaaagccattttacaaattagtccaaatgagggagtaagacggatatttaatcgggatgatttggtggccaaatggaagggagaaaaacttgaggtcggattttgcgctccgattattcctgaaaaaataatttgggacaaaaaaatcggaaaagaatgctttgaatgggtaccaatattgccgaaataacactttttttataaaacctggaactcgagagctaagc

SEQ ID NO: 10105 - DNA, 4909 bp, Heterodera glycines
tgtaacacagaaagggattattcaggaattgacaaaaaagtttgacaaaattaaaccaaagtacaggaatattcaaaatcctttggtacttaaggcaggtgcattatttgagtccgacagtattagagtggaagaagccatgatggagtaccgtaaaagaattaacaatttacccgcctcaacttttcgagtggtcaaaaggcccaacatttcggaagtcataaagctaattaaggcagaagcaaaggaaacacttgggatagtaatgggaaacaccggaaatttgctggatttaatgagaaacattcccgaaaaggcgaaggaagcagttaattatttaaaaggaatgtcatttttattggtgattttgcctattttggtactgattgcaatcattggttttattgtgaccaaatattggcccattatttatgccggatttcgggctgggtcggtggcaacacgagtcattcgccgaattattgggatgaaaagacacagaacaagggtagcggcagtgccaacggcaccggaattagcagatttaaattccgtagacgaagaggcttatgttttggactatttaccacctagaaggattgcagcaattacaaatgacccgagaaggcttccatcgattcgcgtgcattttaatgggctattaaccgctgctttggttgactcttgcgcaagtgtttcttattgtcgggagtccattgcccgtaaggcagggctcacaattaatgatttaaatggggaaaatgcaaatttaactgcagcaaatgactcacggattcaaattttgggtaaagcaaacacaaaaatacggattgaggaccaaaatggaaaatgtggtgaatgggaaataacggtacttgtctctcctgataaacattgtcctggcccagttcttttgggtctaccgattttaacagatttaaaaggagtgatcgcattcagtgaacggaaagtacgattgggcgaaatctgggcaaatataatttccgttgtcgaagcagaaaagccaaaaaatgtgaaaataacattggaaaatgatgaaatttttgaaccaaggactgaaaatgtaattacagcaaaagtaaatgaatctttttctccggatcaaaattttttggtaaagggaacaataaatcgatacccgagtataattgtcgggagaactttggttgcacccggggacaaaaattttgttacattgcaaataatgaatgcgggaaaaatgccggtgaaaatttacggcgggtcgcatctcgctgatttggaattggtacggataaaggctttacctggggacgaaattcatccgaaagattatataccatccgaaacgagatggcatgaaaaactcccaaatttgccaaatatggccataaatcgattaccatcagagagattaaatttggaaggcacaagattaagtggggaaacacaagaaaagctcaaggaaattgttgacaaatatagggaggcttttgtggcagacgatggaaaaattggactttaccggggaccgatcgcacataaaatcgatttaatgccagggtcattgccttttcactttcgtccttatcggtatccgcctgaaacccagaaggaaattgaaaggcaaataaaaataatgttggatcagaacataataagggaaagtgagtctgaattcgcatctccgatcgtgatggtcccaaaagcggacaaaaaatcctggcgttttgctattgattatcgagcattaaataaaatgactaaaaaacgggtttttcatttaccaaatatacaagaacttttggatttaatgggggcaaaaaagtattacacatgcatggatatgcaacaaggctttatgcaaattccaatggcacccgaagatatcgaaaaaacggcatttatttcacatttggggatttacgaatttattatgatgccgtttgggctaacagccgcaccggacaccttccaaagagtcatgaattcattaagaagacggctaacggcagctatgcttatttatctggatgacattataattgggagtgagacggaggaaatacatttattggacattgaaaatttccttaagttattaagagaagttggattcaaattaaaaattgaaaaatgtcactggggaatggctgaaatacgatatttgggctttttactaagcgaaaaaggcgtgagaatggacccaaaacaagtctcagctgcaaattttaacacaagacaaatttgaagggaaaataaaagaaaattggggaaaagaacaaaatgaatctttggagaccttaaaaagtatgttaacatccgcgcctgttttacaatcaccccgatttggcaaaaccttcaccattgaatgcgatgcctctcgaaaggcaatcggagcagttttgcttcagaaaaatgggcctgtggcattcatttctcgtgctctgaatagacacgaggccaattacccgtctatcgaaagagaggcacttgcacttgtttattcggtcaaagaattctcaccctacattattgggtcagggataacaaaaattattacggattgtagtgcgctgacaggcatgatgaatgcaaaagaattaaaagggagactagaaaagtaccaggtcaccctccagggtttcgatcttgagataatataccgcccaggcaaaaaaaataaggcagcagattttctttcaagatacaatattccgggaattttggaggaaaatgatgaaaatggggaccaaattgaaaaaccaaaaaagggaattaatgccttgaaggcactgaaaacaaatccgaatcagaccgctgaaaacgaaaaatcggaattaagaatttcaatgttcgaaataatgaaagagcagagaaaagtgcgggaaattgcaaaaatattttatattttaagaacgggtaaatgctctgacgacgattcaaaatggcgaaaaataattcaaaattattgcttggtaaatgaactaatttattataaaaatggaaaagaaaacgacggaagcccaaaattacttattccttactcactaagaaaacaaatttttgatttaattcacaatgagggacattttgggtttgaaaaaacatttcatgaaataaaggaaagattccattggaatggaatgaaggaagacgtgaaaattttggttgagacttgtgaaaaatgccaaaaacggaaaattttgccagggcaaataaaatcagcaccaggggtcccaattcctccaactgaagctccatttcaacgcgtacattgcgatttaatgggcccgcttaaaaaaacagaaaaaggaaatttatacattttattggccattgacagtttttcaaaatggatgatggcaaaagcgatcccagaccaaaaagcaaacactgtctcagaatcatttattgaaatggtggtccaccaacaatcgacccccgaaatagtcgtaacggatcaaggacgacaattcacgtcagaaatatttaatgatttggcaaaaatttatgggtttgagcaccaaatgtccacaccgtatcaccaacaatcaaatgggcttgccgagggatcaatgcgcataatggctaatataatttcacaattaattaatgaaatggggaataattgggacgaagttttgagtcatgcattatttatttacaacacatccattcattctacaacaaaattttcaccattttacatattacatttgcgccacccgcgcatgccaacagatcgcttacttaaattaccatccaaagatgaattagtttctgaaatttctgtttttacgaggaaccatgtcgaaaaagcctcaaaggcttgggaatcagtaaaagaatcaattataaagtcacaaataatacagaaaaatgagaatgataaaagccgaaaagctgaggaaagggaatttgaaataggagaaatggtacttttaaaaaaggaagtgttaaagcacaaatttgatcaaagatgggtaggtccattacgctgcgttgggattgaaacggataagaaaaatctgattttacaatcattggatgggaaaaacaaatttaagaaagtacaccaggaaaaggtcaaaaaattcaatggtccagcaattctcccactaagagaatcggatgaaccgttaaattgggaaaaatatgtggatgaccccaacgttgaacaggaggaagccgaaatgagtgaagattcgggaaaagaagacaaaaaagggaaagaaatcaaaaagttttcaaaatttggctttgaaagcagtgatgaagaagatcagagcctcaaaattttttttgtaagaaataatgaaaactgggacttaaatgaaaatgagcaaatttgggaacaaaatggggaagccgaagaggaaaatgaaattccgtgcacaacaacagaaatatttttggatggggaaataactttggcatatacaagttggcctgaagccaatttaatctcattaacatcattagttccgacaaatttaataaaagatgactgggaaatacacacaaatgaatttggaaaaagatacattacggcatggctttttgggataagttttgaattatttttgagcgatgagcctgacagggttgtcctaggaattcaggcacaattttcaataaatgacgaatggcactcaaaaactgaaggggaaagggaaacatattgggaacaattgggtgagattgacggacaaatcctcgaaattcagagaattcccgacataaccattacttattccgagaacccattaataattgattatgaatttgatcaaaatgatgatcagaataattcaccgacaattaatgttatttcggaaggggatttattcatgagcatattggacataaatacagaaacagagaaacaaaaagaaaaatgtgcgga

SEQ ID NO: 10106 - DNA, 5253 bp, Heterodera glycines
  misc_feature (30)..(30): n is a, c, g, or t
gtattttctatctgttcaacggcattcacntcgcttcattcatcccatttgaacgtgtccttctcaggcagttggctaaataatgtaaacatttaattattggattaatttagtagaattggtaaccgatcttaaccattttattgaaattttattttgataattaataaaacaatcattaatatttttttaattaaaaaatatttttgttcaaaattgttacagatcgggccacgcaacaacactcatcgccaagccgaatgcaacctaagaaacatgacccatcattgtcacatccgtcaccattaggagtacacgcaccttaatcatttgtcgtcattagaagtttcaatttttatgaaaatgcctattattttggcattttgatttcttcgcgaatcctagaacattatgccaaaaaaattcgccatttttgtacatattttggcgttttcgttactatttcatttacgaaaattgaaactaaaaatcattttgtttcaaaaacgcaaaaatttttattcttttgaattgcatttcgttaaaatttttaacgaaattgaatttcgtttcctatttcttaaaattccccccccccctattcatgtatgcctaaaaatttcattcttgaatcatcctggactattttatttcaatatttttcacctccacattggccatttgccatcatgaacatgttcatggtgatgatggtggccaacaaaatcacggcaaaaatcagtgagaaatttttcattttatttagggttttttggaattaaaaaagcaattaaaatagtaaattagttttagagaaattaggaatgtaaaaagaaagaatttttaccgcttttatatgggaaaattttgcacttttgcttggccggcaacttttggacacagctgttcaaacaaattgttgttcttttcgctggcaatttttaggatgggcattttcaatttttggttttagcaaaaatttggggtttttttaatttgacatattgaaattttcattgggcaaaagactgattaaacaaaaaatggcacataatcgtctggcaccattcaacgtggagagcaaaagtcagaatcaagcaccgcaacaaattgaaacgaaattgaatatcataatcagacattaaaaaaatttattgcgaaatgagtatgcttataaattatatggattaacatattttttctgcgaatatgccatgaagaaagtggctcaaaaataacatttctacgttaaaattttttgatttggtgaaggtttttagtccatataaacccagattttgggggttttcgggaataaatccatatttagacatttttgcatttttagttatattttggccattttttggaaattttcacaagaaaaatgcaaaaaaaaagcgaaaaatacacccctaaaaaagaattttttcgaaatttcgaaatatgaatttgatttgcaattgttaagcttgaatttaataaaaattggcatttttaaatgttaaatccattttttggcagtttttagcgtattttagcaaatattgaatataaatatatttttcggaattttttagggtttaaaagatttattttggcagtttttagtcaatattttggtccatatttggccatttttgagctttttagtccatatttcagtcatttttagtccatattttatgcccaaatttggcgttttttagtccatataatttataaccctagaaatgagtgtcccttttttattaagaagaaataacatatatttttttaattttcttatttttcaaaaaattcattataacttttctaaattctccaccagcatctacccaaaaaatataattgttataagtgaatatggttaccgtagttcctttcccaaagttgttctatgatctgttacggccgcattaccattcccaaaattggaataatatcctttattccgaaggtgtgcacacaattacataatgagtaaatgagggaaaggagcggcccccgattcgtacgggacagatggggagggaaggatcggacgggcacttggcccaatccccccgatcagaatgaatagaacaaaagagaggggaacagattaatgagaagggggggcggggcgagtggggcgagaaaagtcaagagcataggcaataaaatacaatgtaatgacaatcataagtaaagtagagcgctaatcggcaattgtaataaaccggtaccggtaccaactttttccaccggtaccggtaccggtaaaaaccgataattttcaaatgttaataatttttggacgaaatttttcaaatctaaattattcaattccgttttcgtccggcggtgccgataagcgccgccgggaaaaaaatttgcgcttttagccaattttttttttaaaatagcactgtcccaataaaatatgacgaaataaaaaaaaattgtttttaaaatgctaaaatttggcgaaatgttccattttttaaattttccatttccctaaatttacatcaaaaaatttgtgctcagactactcctattcttaccagtgcaagttctaccggcggtcccggttctagacaaaccggtaactgtatatttatttttgaaaaacaggaatcagtaccggtacaaaaaaccggtaattaccggccgtaccggtatcggtaccagtaccgctctaccctagttataaggaacattgttcattaattgtctggcaactttttcatggtgtcattgtcatggcaattggtgccaagtgttgtcactagggatgcaatttttaggctctaaaaactgccaaaataggtaggctttaggctctaaaaaaaaccccaaaaatagggactaaaaatggaaaataggctataaaaatcctcaactttagggtgtaaaatgacaaaattttattcaaaaaggtaaaaaaataagtcaaatcagtattgagttacattatttttttaattcaaaaaatagtccaaaagaatttttttaatgatttttgagaaaatttttcatttcctaggggtttttattttcagaaattttttggtcgatccttagagttgtatttttaaatttcccaaaaaatcgcttcttagggggtgtatttttcgttttattgcatttttgttaacaaattttgggcaaaacgccaaaataggcaaaaaaataggctaattcaaaattttttaggctttttaggtgctaaaaataaaagcctagaaaataggcactaataactcgaaaagtagcttaacaacagcccaaaaaaacatgtttttcgtgcgtttcaggccacggggagcacaggaaaaaataggcttttgcttaaaaattgcatccctagttgtcactacaacaaattgtaaatattttgcttggcatcatgtgtttttttgttgtcttttcaatgaataaaatattataatattattaaatttaaaattcgaaagcattaaaacaaaaagttattaaaaatttacaattaaatgaaaaaacatttaaaaaaattttttttttattaccattggtatgagaagaattatttatttttttaatattaaaaaaataattttttttttgtaactaattttttaatttaatttaattttgattaaaaataataaattccttttgcatttacttttttttgttttccttgaaattttagtttaaaagaaagaccgcacaactcgtctcattaaattctctgctgatggaaagaggtcaaccaacatacgcaagaaagtgcaatcaaatcatttcgcgcactattaattagttaaattgggtattttccacttttaatgtcttatattatttgaacaaaattaagaaatgtttaaacaaatttctaatcaaattaattattcactcgtatttaaaatatgttaattaataaattattaatttattaaactctaattagcatcatgcacagtaatttgtcggtatagaattaaatgagtccataaaataatcaaaaaatttcttggtgccagcctcaatgctatttcatttaaaatttgatagattttgaaattttaatatattaaaaaaaataatttaaaaaatttataattttagcgtggaaaattttaaaatgccagcaacaacatttttcataacaataataacacttgtaatatttagtcatctccattttttggcaaatacgtcatcagttacaaatggcacttctctgctaaatgaaactattggtaaaaaattttggttttattttttctcaaaattaccgtatttttctttacacagtaccaaaattacgaattttgatccttacaacgagaattccaatcaccgagacacattatgtgctacaccgtaaaatggctgaactgcttgcagacgatgcagaacatgtggagaaagtggtatattcaaagaaaaagacttttataatatgatttttaaataaaatgtaaatttataaattaaaaatttttatagtaaaaggcaaatttatcatttgaaaatattattatgaaattgattttcctaataaatttcatttagaaaccaaaatttttcataatttttttaaaaaaatattttcaaaatgttaaattgaaaatttttattttttatcttttataaatctcattaaaaatcaaaatttaatttttcatcggcttcaattgacggcatcaatggatcacaaaaaatctgatattaaatgatatcaactaaacctattctgatataaaaattcagaattttaatcattcagcttttgcttgtcgcaaagcctgattgtgccgagacaagtgaagtgccgtcaaaatttcatggacgattattggtgtggaatcggatgacttttggcacaaatgccgcacaaaatgtggaagaatgccaagaaatggtcaataaaattatgctggacatgcaaacgcgacccaacttatgggagaaaaatggcacacaatttttgccaagtgccgataaaccgtatatgggcaaccttggtaaataaatgggattaatgattttttaattaaaaatgaaataaaggtatgacaaaattaattaaccaccgagtaaatttgtcaacatttctgagctaaatttttatgaaagatcataaatgaaaatcgctgagtaaaatcatctaattagagttaagctaattatttttataaaataataaagaaaaatgtaattgttttttatggtcattttaaatatcagaataaagatgtcagttttttggcggttatttta

SEQ ID NO: 10107 - DNA, 4764 bp, Heterodera glycines
aacaatttcaaggaggtgtggccataatctcgcctttaactgatttttgtttccaaattgtttagcattttcttcgtgccaatgccatttcttccgtcagttaccaaattcattttaatgtgcaagtgccgtcaatacaaatggtgccatttgaattggtgaacgaatggacaaaggaaaagctgacattggccaaagcaatggaaaatgaattggacaacatttggataatgaaacgatgcaaaattattggggagaccgcgacggttcattggaacgacggaaagtgggacaacagttgtaacaatgtgtccatttggctttataatagcgccaataattgcattgggtgagcaattaaaaaaaagtgtttagataattcaaattgcgcttaattaaggccattgtctcctccactggcagaagaagcggcacaaaacatcacaaaggggccgtcttctgacaatgaatgagtggtgggcccagcaaaaacagtggtcaacagaagaagaaatgatttatttaagaatgaccgaccgatcataattcaaatcagtgatcaaatgaaattttatgaagaaaaacctctcaatttcggtaaataaatcggacgtataaaaatggcaaaaaattggactctattgcggttcacaagcccataagcttttttttgcaactttaatgcaccatagctttttcttattaaaaattcttggtatcactcgatagccctaagagaaaaaacggtaatagtaaagctggtgctggggttttcgaggtcgctgatcacgaatccattatccgtttcgctcaatttcgaaccccggactcgaattcgaaccaaaagtcgaaaattcaaatttttcgaattgcactcttttgctcaaattttgtttaagaacacggaaatgaactaaaagtcatcactgcttcagtaaaatggtaatttgaaccatttttagactaacagactatacatttttgattcagtctttttcgattaactgatcaaaaatagaaaaatttttgtatttcgaatttttaatataaatttcagaaattctttaacaaaagcaacaatttttttattgacgcgtgacatttttgggacaccttcaaaatttcaaagtttcgttaaataaattctgttgaaaaataatttctccgtctccattttttcgagttttgaacctgttcaaaaaccgtttttttggcatttccgcaactcgagacatatttttccacggtaggggggggggtcagttgcgtctggccatttgcgtcttagtacttaaggggccagttgcgtctcaaacattttttatagagtaaaatggattaattaagttttctgtatgctatattttcattttcacagatacattgacaagaaatattcaaaaatttatagaaaaaataaaaagttttaacaaaattaacaaagtttcatttacccatttggtaattgctcgaaattcccctgagcatttcaataatcaaatttcggttattttggttttggccatattggtgatcatcgtcgatttgcggctgcgttttttcctcattgtaggctccagaatcctcaaaattcgtctgtccactacacggtaacgctttgctttcagcggcggagcatttccggcgaggaaatgttcgaagtccacgtcgattattttctgatgctcgcgcaaattgtttatgaatttccagatcggtggggtgtccttgtccgatcgaaagttgcagcgtgcaatggtatgcttcggcgaagttatttgtgcggtcggtgccgttcattgtgcgctcatgcacacttcattcttcgggacgaaacaatggaggactgaagcgttagcggcactggcggcagcaattcgatttcatggcggactcgcttcactagcttaaccaaaaatgtgaacgtaaaaaaatgattagattttcacttttttgtggcattctttgttggaatgttcgccattactggcgtggcaatttgctgaagtgtgtgcgtcctggttgccgctggtggttccatcgtctcagttcgccgacaattctcaccgatctcaaccaattggtttcaatcgattcatttggtctgtcgcccgctgcgtttggtgatggttttgatgggccaatttctgctggccaagcattgtccaaatggttgcactctccgagaaaagatggccaacccaagcgattgcgttgcgaagattacaacgcacaagggaacaccaattgggtcaacaatttcaagaaggtgtggccccacattttcgacaaatcagtgcttttgtttccaaattgtttagcattttctccgtgccaatgccatttcttccgtccgctaccaaattcattttgctgttcatccgtcaatgccaatgatgccatttgaatgtgtggtgaacgaatcgacaaaggaaaagctaccactaattgcattgggtgagcaataaaaaggggatttgtttttatacacggcgagtaaattttgcgctccaagtacaattaagttggttttttcgtcttagtggtctgtgagttagtcaaaaaatggggggtcacaggttcaaatcctcctcatgttgtgtgttaattatgtttgcattgggtgagcaattaaaaaaagggatttgatttttatccaaatttgagatttgcgcttaatttaggccattgtctccgccaccggcagaagaaacgggacaaagcatcacaaaagggccgtcttctgctgacaatgaatgacggacaaaagaacaaaacaatggtgattagtggaagaaatgaattaattaagaatgaccgaccgatcataatttatcagtgatcaaatgaaattttatgaagaaaaacctcgcaatttcggtaaataaatcggacgtataaaaatggcaaaaaatgtataaaaacgcacaaaattttgagatttgcacaaaataatgaacaacaaaaaaaacaacttgtttttgtgcgtttcattgcactgggagctcaggaaaaaaatagggcaaaaccctaaaaatataagccctattttcaatacgattgtttgaaatttgccgaaatttcctgagaaattcaatgatttttttaaaaagtcgtgaatgggatttgcggaacaggctatatgctccggctataaattttacagagtttaacaacccacgcataacacaaaaattttggcgctagttacaagaaggacctttttgaaaattttttcacttttttgaaaatttttttttacacaatttgtttttttaccagatggtacgcatttcacgttatttaataattgaaaaaaatttcaaaaaggtattattttagactttagattttgaatttttatcaaaaaccaaaggggggacccttttgttttgcaaaatttttttttgataaaaaatcgtgaatatactttttattcgccataattgtactgttaatgtttaatgttcatattatgagtaaataaaacaaaaattttttcaaaaagggaaaaaaatttcaaaaacgtccttcttgtaactagcgccaaaatttttgctatctatcgatgtatgaatttttccttgaaaagttgtgacaattatttttcgggattttgacgggggatttacgacatccattagcaatattagcaccggcaacattaaagtgtcgatttgctgctgttcctttctcttttctcctcctccttccgtcgaatttttccttttcctctctttctcttccgtctctcctccttcccaaatgctattttcctcctcttcctttgtttctccattcccattaaaatttgtacgaaataaaaaataatttttcaaaaaacgttcgaattcgggttaggggttcgaaactgcgcaaaaagatcaaattcgtactcagtcagcgtctcaaattacccttaaaatgctttatttttggggtttccctcttttttgtgggaccaaatgatcttggcgattgccaaagccatttaaggtataactcgtcgaacaatcaataaactcagcaatttgcacactaatcattttataaaaatttttgcagaaattatcggtctacgtcagttcggccccgcacggttcggccccagccatgtttcggactataactttttttttctttgtcaaccaaatctaacaatttttatatcattcgaaagcccttcagatcagggctggagcgcgatcgcgatgcgcgatccacggcgtttttttttgcgcgatccgcggtcgcggcaatttgaatgcgcggtgcgcggccgcggttttttctgtgcgcgctccagccctggtgtaaacgtagttttatatattatttgttttaatcttttaatttagccccaaaaatggaaaacaatcaaattataacgaaacaaaacaacaaaaactcgaacatgaaggatgcctctatgtcttccatatgttcaatgctgaccgtgacgtaaaattttggcgctgtgaacatcagcgtgatgaattcaagtgcaggggacgccttcacacagcgctcaatgatgtcgttctgaagacaattggcgaccacaattgcaaccacagtgtggcaaatgtcatcacacaaaaaatcgtcactggcataaagcggcgtgccgctgagacgatggaaccaccagcggcaaccagggcgcacacacttcagcaaattgccacgccagtaatggcgaacattccaacaaagaatgcaaaagaaaagtgaaaatctaatcattttttttacgttcacatt

SEQ ID NO: 10108 - DNA, 1163 bp, Heterodera glycines
ttttcagcattttaccattgaccaatcgttcggtgcttccgtttccggcgctgcctttcaaatgcctttcgacgagtgaaagtgaaaatgaaatggcaaacgatgagccaacggaagcggcaaaattggcggaggaatttgccaccaaaaatttgacgacgaaagaacggatggatgccattctgaagatgatcagcggaagaagcggagaagaaggagcagaggaggaagaagaaggagaggaggatgaagaaggagaggaggatgaagacgaaaagatgacgggagaagagttggaggagagggaggaagatgaagaagaagtagagttagaagagagggaggaagaagatttagaggtgatggaagaattggaggaggtggaagagttggaggaagaagaaaagttaaaagagagggaagaagaaaaagaagaggaggaggaagaagaagaaggagagctggaagagaaggaggaagaagagaagaggatggaagaaaagaggcgggaagagtggcaaagaagcaattcattggtttaaaaaggcagttacaagccattacggcgctaataaccttatcgttcccatttttaaaaatatgcattatttatttatttaatttcgttgtaaaattgataaaattaattttgaatattgaaatgctgtttaaaggaggtcatgtgaaaagggtacagattattcagaagttttatgcgccgcaaaaaaattgttaaaaatctgatttgttcatcctaaatggcactcacaaaaaattggaaagggtaaaaaaaaattttttttcccgaatattgtcccaaatttgctgtaacaaaactataagttcaaaaattgaagacaggtaactttttttatagagcacgaaaaatgtgaaaaaaattcagctcaatgtgactttttgtgctgatcaaaaaagtcaattgtaccacaatgatcagatcactccttcagggtggtctgaaaccctaaaatggcttgaaaccgtgaaaattttgtaaaaaaaatcctagtgggttggataaaatttttcgtataagatgaatataacagacagaaagagcgcaaattttgctacaaaatggcctttgaattatggctctatgatgtgtctccaccgaggaaggtaagcctaaaaatcgacta

SEQ ID NO: 10109 - DNA, 2344 bp, Heterodera glycines
  misc_feature (431)..(431): n is a, c, g, or t
tgtttgtttagaggttttcagtgggagcttgggcatcgctttaaaaatttttatttttgtaaatttcaaattttccagcgcttttttttcatttacaaggagaaaccagagctcggacggcatttcgagaaagcctaggcaagtgttttcttgaacaactccggaaaattaggcgcctcaaaaaaaaagataaaatccagcaggtcaagcttggaaaaatatatttatggaatttttctatccctaataattgcaaaaaacttcatggtaacaaactttaattggttggatataaaaaatggcactctcacaccaaatcagccgaggtcggcaccagaaggccccgcgtttggtggttggaaaaaatgcccaaaaaattggggcactttcccccccgcggggcggggctctccatttccatccacccaatnccatcccaaatccttctattgctggctggcagcaatttcctgtccattgaaactggccaaggccaagacaccgacgccatttatgagagaagaaaagcatagaatttcaacggggctatagtggagaaacatgagaggagaagcattcattcattgtgtgccggccatttggccaattgaacgagcggcgaaatgccgtggccaccaaataatgtttttttttctccgaaggacggcacggtggcgggcgccgggtgggaacagacttggccatttttttaccccattgattttgctgcttggaagaagtgggccctcctattttttgccgagttttgctatagggacggcggcataaagtgcatttgaaaagcgaaaagagaccggaaattgccggaggggaggggggttaagaagagaaagagaaaaaatgacaggcagagagcgaaagagagagaatataagagagaatgagaatcagagagagagagaggagcgagggagggagggaaggagaaaaaaagagagaatcagcaaaatgatggttaaaagaaaagtggagagagatgaaaagcaaaaagaggggaagaggacgaaacgggccagttgcgtctgagccaagtttagaccaccataacttttttctttgttgaccaaatccaacaatgttggtatcattcgaaagctcttaacaagctctatcggcttcctaaaaatcacaaagacatactgacatataaaaaagttataaattaaaatatgcaaaaattctgactttttggtagtgttcatgttgcaacttttttataagttgttcaatcgcttagcaatatcttatcaaaagcttctaaacatgtagagctttcgaatgatgccaaatttataaaatttgacaaacaaagaaaaaagttatcgtgctttatgcttggctcagacgcaactgacccctaccgttcgacaatgaccatttacgatatatcatatcgccaaaattaaaaatatcaaattaaaaataataaatgataaattaataaatttaaagagaaaatataattgctctatttttaaatttaatgaatgcattatctatcgcctattgtgtatgattatgaatagtgaagaaagaagacaaaaagagacggatctataatagaaatccatttatttcaattattgtagtgtcctcttttcaccacttagacaaaatgttttggtcctcagaggatattagtggcatagttcaagcagttcagccaattcataggctaaaaatcgggagcttattgaatttgtcgaggttgagtcaaaaagaggcgcttaattgttcttgagggacgaaaagattcgaacgcttttgaaaaagactcggcgatagtcgaagatgtcgaatattgccgatgtctcataaatgcaaaatcgaaaactaaagccattctcataattctattatgaaaaaaaaacgaaaaaaaatccattttatatcgctcccaaatccgcaccgtccatatcatttagcagaaattagaattttatttaaaaaaatatatttaattttgttgtcgaaacggcattgtcgaaatgtccgggagccttaggtttatttttgaggaattttagtaaaaaaaaatttacaaaaagttataaccaaaaaattccgaaaaatttagacgcacaattttgtccctacggtttctcactgcgtttgcgaatcgcgccccgtccatgtgcaagggaatgccatgcgaatgcgcaatgttcgcaatgcgacggatctgtgccaatgagtagagcgtgccgctctccgtgctttgggtgatggacacagccatagggcggcccgcgtgcactgacacgggatttggcggatagcgttggattgcctcctctaatgcctaattaaaaaataacaattt

SEQ ID NO: 10110 - DNA, 4303 bp, Heterodera glycines
tttgaggattatggcccggaattgcaggaactgttggaacatgagccgtgttttggggtggcggcggtggtatgcctggtggcacattgttggccatcgtttggtgataatggcccatcgtcgacagaccgtcggcggtgggccgtaaatgcacaacaaaattggacggctcgacaaaggtggcattcacagctgaatgtgaaccggcagcagcaggcaccgccgatggaaaggcggccaactgaatctttattgaaaaaatttataaaaatgaaattttttaaaaaaatatttaatgatcgcgactctcaaacaattatttttaaggtgtttattcaattttgagcaaatgcattaatacgttaatagctttgtttaacgaaatattgggtgcctaaaatattttagtttcataatttccttagaatttttttgaactctgacaaaaataacctttcaatcagaggttaaagttcggtatttccgagaaaggcctggagctggaccatattggatggatctagattttctgggcaaatccaggtccagcaagccggtttttaatgcagaccaattccgatcccaaagtttagtttttcactctgagacaactgattaaaattaaaattcttgtaacccaattaggcgccgctgctactcgtccctgtgcattatcatcaacaaaagcaacagccttttccgctgactgttttaatggtggcatttgtgatggcctactgttggctgctggaggtaacactgaaaaatattgttgttgcagttgttgctgctgctgttgatgatgaaggtgagggtgacggcgctgattttgctgctgctggtcagcataagcagcagcaaatgggtgaaagtgcatgtccaacccgcgctgaccagagtcaatttgtcaatttgttggtcaatttcgttttttttttgtatcagccaaatgcttgctaacaagaagatacggcaatcaaatttttttaaatgatcgttaattaaaatttgatattccgagcgacatatacataaggtataccattgaacgaaccgcaatgttaccagcttctcttgcctcaaagtttgaaaactatacatatcaaaatgtttgttcaatagttgcttttttgaaattcaaaacaaaaagccaaacttaaaaaaattgtacatatcaatttatttcaaatctaaaactagagctggtcgggaccgtgaccggggcgggaaatcccgggtttttcaggtcccggttccggtcccggtttttgaaaaaaaagaaatcccggtcccggttttgctagtcccggtcccggcgggactaaattaagcactggtaagaatgggggtctgggtaagaaaagagaagaaaattggtgaagaaggagaaatttttggagaaaaaaaatcaattttattttatttaacgtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttttcccccctgaagaaatttttaaaaattttcctcgaattagtcctccaaaacgaaaatataaaatttatgggtacatttttgaatataggcaattttcgtaacaaagttcactcaaatttccaaatttttttcaaaaaattttctcttgggaaaattcccggtcccggcttttctctcggtcccggtcgaaaaacttggtcccggtcccggcttttcgggtcccggtatgtcccggtcccggttttgcaataaaaaaagtaaaaatgctatcctaagaaatgacccgaaaaaaaaaatcagaaaacaccccctaagaatgaaaaatgttctcaaattgatcatcaatatttaattatcctctacttctgccgtacattattttataaaattttgtgaaaattaaacttggaccaaaataccaacaaatttgttcaaaacaatgtatttaagaaaattcgaaattttattgttattatttttcattttttcattgtcggacaaaaaaataagcaaaaatattagttctggaccgggttcgaacctccgctctttttctcttttaaatgaatttttcttaacaaatatttgtaaaaaaataatatgaaaacacacgcaaattcacctttatttaccaaatggatcaaaaaaggcaaaatatgatttatcaaagatgaagctgcattatggttgcgccacatctatttcaaaagaagtctcggcattttttgtattctcggcactttaaaaaaaaattaattattctacgtatgcatccattctttataacaacaaattctttatttaatttatttgtttgtctttatgtttaaatatctttaaaaaagaaattttcatatatggccacttccagtaggaattgagagaatgcaaaatcactttgaggggaggtggggggcagcaacacaacgacgacgggacgtcgcaatttgcgcatcgcataataatagacaacggcggatggacactgctgatcaccaccgattgggcagactgatcggagccattgtgttgcacagagattgtgacggccgcagaattggagtggctcaaaattgtccacattttgacgcaaaatttcgcatactctgtcccatccgacgcgccatttattgtttgatcaaattaataacattgttcatctaccggtgttcacacagcagcaggacttgttgtcgtcatgttttgtttttgtgttggaattggccattacaaattggccaaatatttcgcgtaccatttacagattttttcactctttaaattatgcaatttcagcagctctagattcattttaattaggccgtcaataatttagtttataaaaaatctgattttgtaatcagtgtgatcaccctcaaatttttatcccaaatcatatatattaattaatccatgtggatgtccatgcggccgaaaccgatggagattatgcattaaattaatatttttttagacaggcattataatttgtttcggcataaaaatggcccaaaaattccattcaatgattgtctctatcacccttttggtcaccgtaatggcccaccatgcacacagtttaaccactccactgacagcacatgtccaccccgtgccacagtacaccggcttcccggagactgtggctgtcccagtgccaccacttccgtgcaagccgttgagtgctgcacagcgagctgcactcgctcccgcccatccatcggcggccgacgcgtcaccccaacaagaaatgctgcaattccaccgcatggttgccaagcgtggttgcggctgttgttgttgtaaaccatgttgttgttgctgttgtaagccgtgctgttgctgttgctgtatgttgtggatgtttttgtaaacagggacaaggctcgtgttgcaaaacaagttggatgaggcaaattaaaacttgggttaaaccttgactccgagttcctcgtcccgatccccgggctttttgggcctgctccccgactccgagcaaaaaaaaaggtgtaaattttttgttgaaatataattttgaccatttcctgatcgggattaccgacaattttgcactcgccgaccccgctctgccctcgcccgtattctccgagaatttcttccccgagggatcgagggaggggggcttaactctaattaaagcctttgttatttgctgggcctttttttcacatattcaattccttttatctatgcttggctatggacccaaatccgtagattaaacaaaattcactgcccatctcgaccccggccttttccaaaattcccggttccgtacaactctctaaaactaaatatatatataactccaggcaagccctgctgttgttgcaattgctgtaactgttgttgctgttgccataaatgcatgtgcatctgtgtccgcccatcatgctgctgcaagtgctgcccaagctgctgtggatgtaaaaatgtttaaatttgggcaaacatttttttaaaattaattattcaaattatggagacaataatggacatatattacagtattccttttgttagtttgagttgtacggcgattaatttatttttttcccacgaatttgatttaaaattaaaaacaattggcaattgtgaagattattggtcccacaaaaaaaaagaataaaaatccaaaaaaagcatattttaggggttatttgatgcgctgagcacgaattt

SEQ ID NO: 10111 - DNA, 1515 bp, Heterodera glycines
  misc_feature (1318)..(1318): n is a, c, g, or t
ttttattcttttttttgtgggaccaataatcttcacaattgcccaattggcaataggtatattgttttagtttctttttaaccaatttaaacaaattaatattattttcaaggccctggctatgggtgtggatgccggcgccgccgtagacgagcattgactgctccatttggttatccgatgccaatgttcttacaacagttacgtacgccaatctatgagccgagattatgccgcgaactttgtcaggtaacaaatttctaattaatccagttcttatttaattaataaattggttttttttaaggtcagagttttgagtgagcgaagccattcaattggtgaagtgcacacaaatgtgaatttaataagcgcagacgaccggcaaaggatggccgcttcggcggcaggaaatgaaaagctgtgaaaaagcaatgacgacatagcaatataaaagattagataaataatatattctattgtgtatgaatagggtgtatgcattgtttattatttaattatggggagataaagtattttctgctacctatttttgtttttcaattaaaaaaaaacaattgaatatatttttggtaggacagtttttcttcgaataattatgttaccaaaaaatgaaagaaaatcaataaaaattaatatttaaaataatttttaaattaaggtttgtttttataaaataaataacaaaaataaataaattcatatcatttgaaaataaataaaatatccataacaattagaaaataaaaggtctcgaaatgcctcttctcttctcattattattgttgatgtgtagcatttagcgagggaactgaatgaaaaatggaggagaacatttccaccaattgttgaaataatgaaggggaaattgcagacggcaacacaaaatttatattaaaatggggcgcgccaccagcattgcccgaggcgccaacgatggcaccaccgcctccggcgatagctgtgctcatcccgctggagcacacctccatcagaaaacccttcaggcacttgaagaccagttcggcacggctcaaacaccagctgatcgtcattgactagcgggaaaaaacattgtgtggaagaaatggattaagtcggatgagagacttcttaaatggatttataagactttttggtattagaaaaatatcttttttagatttaaaaaaaatcctctccgtttttctaccccgagggtcggggagaaatataatataaaaaactatgcaaaaacacctcagtcatgtgctcaaccaaaagtaatggaaatgtgatatgattgatgccagaatgnggtgccaaacggatgacatttcgcaatgcattgatgcacggatggcgtgaagagatgtcctgctcaaccaattgacgatcgccgacaacgtggaagacgaccttcatacaaaaaacaatgtcattttcattagggactttccacttttgaatttttctttataaaattaatttttatctaactcgaaccgagccaaa

SEQ ID NO: 10112 - DNA, 1324 bp, Heterodera glycines
  misc_feature (1317)..(1317): n is a, c, g, or t
ctaaaaataaatcacaacacatgaatctaaaacagcacacatcattcacctgaacagctgataaattggaatggttggtcacgtacacgtcgccaggcctcaacgagtttacgtcaccacagtaatcatcgttgtcctcccccttcactgtatactgatgatcaccatccaaatctgtggttgaatgaatagtaggcaataaccaatttttcgtctgttatagtcaaaaaaatttctgtgccgatttggaaagtgccatactttttaaaccagtttgaaaacctggcacgaaagtgccacaaaaaaatgctcgttccgcaaaaatctgagtgattgtagactgggaccctacaaaattccggttcggcatcacatgactttattataaatgcgtgcggtggtgcactgattgtttggagccgaactgcttgttctagtgtaatacactgcaccttgagaaaactcagaattgtcgtccacaatgtcgttattacaagtcgaaatcatcaggcgtggcaatgatgctataattatatatatatatatatatatatatatatatatatatatatatagtagtagtattaaaagcgactctattgcagtttacggggtggtccattaattagagaacattctcacaatcatcagtctcataggccatcaatttttccgtaattgattggtcaaagcttacacattctttgcataaattgaagaagacttaaagtcccggaaaaatgtggtgtaaccaaatggggacgggacaaaatattgccgccgaaatatcgccgagacaaaatatcgccgcagaaatttaaaaatttttttttcaaacagaaatatttcataaaaaattcttaggaaatttcttagtaagaaaatctcaagaaaaatttttttgaaaaacttttgcgattttttcgaaattttatgaaaactgctaagtttttttgaaaaaattttccaaaaaaaaattttcttttaaaatttctgtggcgatattttgtctcggcgatattttggggtgtactgtaccctaaccaaattcaccttcttctactgctgatgcttgtaaaccggcgagtggcggcggttcattattcgccttttcactactgtcacagtcgttttgctgctgttgccgccttcgtcgttgtcgtacagcggccgccgccgcacgacgcttgcggttcgctttcattacctgtttttttttgaaggattagttagtttatagcgggtatcaaaagctctagatattttggaataagcttataagttaatagtactagtaagtgaaaatttaatttatanaactatc

SEQ ID NO: 10113 - DNA, 1457 bp, Heterodera glycines
aattatttcattaacaaaaaatacggatcataaaatacttctaaatagaaattttggataggccattggaaagagcacaaaattctctaccgaatcgccttttgtatggagggtctacgtcttattcccactgagatagagaggtgatcaaaattggacaactcaaacattcaattttttgatcattttcctttgaaatacggtagaaaattagtgatttttataatcatcaaaattctaccaaatataatttgttaggtacaagtcttagccacaccatcaaaaggtaattcggtagagaatgtactcctttcaatggcctactctaaatttccagaaaaattttcccaaccccctaggaatttttttcggaaaattttcacgattttcagtgtattatgggtgtcccgatcaccatgaatgagtgatttgatcaagttgatctgaaagacttttatgattagcatcaaaagataagtaagcatgaattatctcagatttttaaatgaactaactataaggtgatttttcatcattgaggcaagactttttttgcactcatttttcggcatctttgactttgatgccaataactcattcatttcgcgtttaataaaaaaacatattaggatctgatagagcaggaaataagctatagaataaagtaaattaaagaggatttgttttataaagctagaaaatttaatattcccgattttgttaaaaatttgaaatatttatttttgaaatttttggcgttatgctattttcaaaattaatcttcaaaatttacttagcaaaatgcaacaaaaaaaatcaaactttcctttcgtcaattcacattgccgctaattgtgttgttacgtaattaattgttctatagattattttttctaccaaaaaacttccaaataaattccatccgatgaataaacgaaacgaattgcgcgcaaaactgcacgcgtgtcacattcagcagcaacaacagcaccaacagcagcagcaaacccgcagcggcggaccgtccgccgtcaaccaaattccgaaagccaaacggccggcggcggtggtacgtacaaaaaatgattcgtttttgagccattttgcggcattttccccgcaaaatgccgcctatttttgctgctttttaaaaaagcataaaattcaaatgattgtggtaatttctgtcgcgaaaatgtttgtttaaacgcctaaaattgccctaaaaatataaaaatagttggaaaataaaccctaaaatgccgaaatacataagatttattttgaaagtatggtttttttaacaatccaaggcagagtgtatcgaaaatgtcaaatttagcatttatttttcatccgttgcatttttgtcgaaatttaggccgcaatttccgcgacagtgccgaaaaaaggccaaggtggagcacccgttccaccacaaacagcatcatcaccaa

SEQ ID NO: 10114 - DNA, 1499 bp, Heterodera glycines
ggtcagagaggcggccgaacgtgcggcgtcggcggtggacgacgcggcgggcgaagtcgtcgtggaagagagcggcggcggaggggggccgttgggtaagccacggcggagggggagagggagggcacagaaatggaaaaatgggacaagaaaaatggcatggggtgaaatgaggaaatgagtgataaatctaaaaatgatggggaccaccaaatcaaatgaatgcctccgatttttgggatcttaaccattggttgtaaatgcacattttgaggaatgtgagattgaaattgccaaaatttggaaattcaagttgagaaattaaatggaagttaggttgaaatggcataatttgagagatttaaattgaaaatgcggctctatttcagtttagggcgcccaatcaatgaacatcatcagtttcttgggtcatcatttttattttttcttatttcccgagactttaaaccagcattgaccaagtaagaaaaaagtcatggcctaaaaaacattggacgtctaaaacataggtgaacaaggggtgcgccagggcgaggcccatacgacggacgattggcgggggggggggagtgccaggaccaatttttcgtacgaaggcccccaattttctccagcgacgacctttttttcacattttttgcggcgcgcttttttcaaaaaatatggggaaccggagggggcagcggtgcccggcggtggataggcgccgccgggaacatttttggattttttaaatgaatttcgctaaggaaattgttcaaatttttaatttttcccattcgttacgacccccccccccccctcctttacagtcgccccctttacgacgaactaggggggtgtgccggcacatcccttgttcacttatggtctaaaatgcaatagggccaaaagtgctaattttgtttgagattgtaatttaaaatttgcaaaattttgtaaaggtttgaatcaggaaatgcaaagtttcttgggtttatagatcagttcttgcgcaatcggacggtgtcgtcggtgtcaacttcggacatttgctcttccccaacacaacggagcggcggcagaacagcggaagatgaccaccaacaacagcaagcagtaacagcaccaagcggcggggccgacgcgtggctgtgctgcgcggacggacgccaaattgacgtaggcgcaaattgcctgaaaattagccgttcttagggctttactcgatgccagtgaaattttcaaaaaaaggccgcaattacaccgaaaaggcatttccataatttgttattttttgcaccaaaatctgaaattgttttttacgccccccggcacaccccaaaacgcctactatttttttcgaggcaacgtaataaaaaatttttaatttttcttggattttttttgcgtctgcgttatgtcccggcaacaccccccccccccttgcgacataacatcatgtccttatttatatataatcgcccctacccccttat

SEQ ID NO: 10115 - DNA, 2300 bp, Heterodera glycines
tcagttgcttttgttgctgatcaaacagcgaaaacagttttacggtgacacggatcagctgcaacagttccctttgtcggcattcactcggcctcccccaacaaaaattgttgagccgacgacgacaacgacggatggcaccaccgatggcgatgccattgagcagcaacaaaatggcggagatggtggtgccaaaaatgagggcgacaaaagcggtgccaaaaagggcgacgacgaagacgcaattgttttgctgacggaggagcgtggccagcccaagttgactgcaggtccggcaaacacggcaccatttatttgttagactggggcaaatgccgaaaaatggaacaaattccatgattctcccctatatttgagcaatttcgaaccgtaatcctgaaaaaaaatttctcaccaatttagctgacgaaaatcggcatcgactggcgcacaaaagtgcggacgaactgcttgaacttctgttgtccgacgacaaaatggtgactgataaatttaaaatcaggaaaatctctaatgcaactccctatgcatttttcaatttgagggggtaacttacccccctcccctccttcattttccctgaaaattttttcaaaaattttccctttaatggtcactgctgccacaaaaaatgcttaactcttgtcatttaatgcaaaaaaaaaatttttcaaggacgaacagcaacaacatttggtggtcgctgaactgctcgacaaacggcccgacctggtcgatgttcacgcgaccaactttgacgcccaaatgcacgcgctgttcgcctgccgattgtctgtggcacgcgcgttggtcgcccaccaattggcccattgcgcggccgcggcggtgatcaaacggagcggtgagttgtgggaaaatggaataaatggactccaaaaatgcttaaatccggcaaaattttgtttgtccaatgccaatctaatgcccgacttcctaaaatattttaaaatggcattttccatggaatttatccaggcacaacccaaaatttcgctgtgacataacgccaccaaattttttttatttaattatcaaacttagcaattttcaagatcaaaaatcttggaaaagttaaaaaaaattcaagaaaaaaattcgtagaaagatttataaggaggatattttaagaaaaaattgaaaacttttttagggtatttgaaattttataataaatatttttccgttccgtagaaaattgtcaaatgttttctttaaattttctaatgttttcttttaaaaatttgcccattattttcagtactaatttatttcccctctttttcagtcacttttctgctcaactctttcaatccgaggtgatcgtcgtccgtctcatatattttcctcgccttttttggctttttcaatttttctcccctttttcctcagtttttgcccctctttggtggtcacttttgtggccaaagtgtgcggcgcgccagcggaggacaccaaagttggcttagtgctcaacggggagcaatgctttgtgttggccctttacgttttggaggcacttaattaattaattatctaattggttgcctaatcattttgcatcgtttaatgaacgcgtttgttttaaggacattgaccaacaattcacgcctgacatggtcagttcggatggtgtcatttctacaaaaaaatgaataataatttgctacgatattttcattgcacttttcggttttatgaccactgaaatttttaaataaaaattcatttttggggtaatttgtgacgttgatcatatgacctttattttgcaaaatttctaacctgaattcgaacaaaaattcgaaagcacccaaaaattaccctaaaatgactttatttgaaaatttcagggggtcaccaaacagaaaaaagatgaaataactcaaaaactattggaaaagaaaagtcagatttttttgagtttttaaattaaattttgccaaaatctttcttatgccctcctccgatcgggattgctgaatttagcccaaaaactcaaaattttgccgtttggtctcattttttaaaaaaactgctaacataatgccaataaatttcctctatcccccctcatttttgactttacgaaagaaatggggttcatggcttgggactccctccaactggtcgttccgtcttgggccaaattcctcactggccaaaatgccattccgccccccggggtttgggttttacaattaatgcccaagggggggcccaaaaaaaaaagggccaaaatgaaaaatttttttcctttt

SEQ ID NO: 10116 - DNA, 2935 bp, Heterodera glycines
  misc_feature (2923)..(2923): n is a, c, g, or t
agtaaaaatgaatttatggcatttattattttttatatttttctttccttttgaaaacgaatccggcaaaatccgaccaaattttgatgaaatatttggcaacgaatgggacaaaaaggaaagagaaaatggtatctaatcaattattcaaatgcaaaatgaccagaatattatcaaaaatgatcaaaatacaaaagaagaacaaaataatcaacagaaaaaagaaacaattcataaatttgaaacaattaaagaaaagttaagagaaaaaggaaattatcaatggaaaaacagagtcaaaattgagagaaaatttggaaaattattaggcgtaaatcgcaaaaaaaatttacaaatggaaaaaggaattaaatttaaacaaaaagaaaacctatagaatgaaaaagagtttttatgatgaaaaaagagcgaattcaatgaacgtttagatgaatttaaaagattatatggccaaggcaaacagaaagaatttgtgatggaattgggcatttctaaagagacatttataaaatggaaaaaagaattaacgccaaattataataagagtatgagtttttttattttaatttattgtttttttattaaataattttagctcaaaattccattgaagaaaaattacaaaagatgaagcaatattttgaaattaaagaagcaaatccaaaaatcagtgacgaaataattgctgggaaattggatattcaactcttagaaaatgggaaaagtttcttaatatataatttgttaatgtacgactactggtttattgtaatctaattgctttgatgaaatgcttttctaataaattctcaacttttcctgggcttttatttgtgagcaaaccaatggcacatttaaaatgatacaaatgaatacttttaaatggttaatccaactcagaactcattgctttcaaaaatgcccctaaatttctttggtttattgacattaattaccgttgcatggagtttattttcggctttggttttgactgaaaaaaaccgaccgagaaatttttgaaatcgcttaagaaatatgtattttttgccctattttgaaaattatgtcaaatagccaatttcgagttgccaaaagtccttttttggcggcaaaataggtcaaccattcgtgaccggaaaatgagtcagatgaaaatgcgttagtgatacaaattttttaaaataaagttcgatggttcattagtattgtaataatatgtaaatttctatacgaacaacgttctgaatcacgaaccccggacccaaattgaacaaaaaggcgaaaagtcaaaattttcggaattagggtttttattaaaaatcgttttaaatacacggaagcaaacagaaaacaatcaatccttcaataagagatcattaatccgtttttgaaacaaaaaggctaaattcgaaaatttggactttcgactttttgttcgaattcaggccaggggttcggaattggccgaaatggataccggattcgtggtcagtgctctcgaaaacgcgcaaagaacttgtttttataacaaaaaaatttcaactgacgcattttctactgaagctttttccactgacgcattttccgggcgcccaaccattccatggaccaacaccgtcctgtgtaaatttaaaattttaccaggcattaaaattaacaaactttcgcgactttataaaagcatttatcttatatgacaatgaattttaatgacatattagggcgctaaatttctaaaataggcaaaactcctgctggaattctttctttttgcattggagttttatccattttcaatttttctaaaaatgcatttttggtaggccaaaaaggaaacatgaaaacccccttcaaaaaatcacatgcaagcaaattgctttttccattttctcaaagttcgacttccaatccccaattttttagcaattaattcattattaatttttgcgtttccttctttaattttaaatattgcttcatctttttcaatttgtcctcgttggagtaaattctttttgcttaaattataattaaaatgcaaaaaacaaaagattctcgcttacttttattatattttggtgttaattcttttttccatctccaaaatgtgtctttagaaatgcccacaaattctttctgtttcccttttccataaaacttttaaattcattaaatcgttcaatgaattcgatctttttctccacataaaaactcttttccatctttttattttgatttaaatttaattcttttttccatttgtatattttttgtcgatttacgcctaatgattttgcaattttcaactcaatttttgctctgtctttgttttggtatttttcatttttcttcaacttttctttaattgcttcaaatttttggatcattttacttttttgttgatcatttggttcttttcgcgtattttgatcacttttgataacatttgattggaatattcgctcatttgaccatttgggtctgtccccatttcttcacccatttgttaatcaaaataaataaattccatattttcaatttcatcgttctgttcaatttttaatcgcttgttcttctctgtggtttttatcccattcattgccaaatacttcgtcaaaatttggtcggattttgccggatttaatttttaaagcaaacaaaaatatagaaaatattacaaggcacaaagtcattttcattatttgtttctctttaaagattttaatttgaatttatgccatcaaatattgctaaaaaaatttatgattttgaagtaggcataataataaaaatcgaaaatgtcctgacttttgtgatttgtcctcaaaaaaaaagtgattacttctcatatttcttcaaaaattgtttcattatagtaaggaaaaattatgcgtcaaaatgntaaaaattaaaa

SEQ ID NO: 10117 - DNA, 2343 bp, Heterodera glycines
  misc_feature (2266)..(2266): n is a, c, g, or t
aaaaaaaaacaaggtggctggatatctcaagggataaaaagcgcaaaatttgcaaaatttttgactaaatcaattcataacttttctcagacgcaaccaaattgcacaatcttggtatcatacgatagcccttgaaaaatggctgcaaaattggtcattttttggtagccgatttttatgcttaacttcctcagcggagacgcaatcgtagagacaccaaccgaaggccattttgtaaaaaattgtgtgccctttctgaaatcagtcacattcgttttcgacgaaaaaaaaattcccacccctattaaaaatcttttacaaaattttcccgttatcaagccattttttggctttagatcaccctgaaggagtgacctgatcatcgtgatgcaattgacttttttgaacagcaaaaaagttagtaaaaataaaagagaagaacaaataagaaaaattgaacaaaatgatgaaaaggagaattcacaatcagcagaagttgatcaaatgtgtgaagaaatgaggacagacccaattgatcaaatgagcgaatattccaatcaaaatttcttcgcttaaacgtccctttcgtcattagaaaatcaccattatttaggacaaatcagaaaagacagaacattttcgatttttcttaatttgtttacatccatccaaacaatgacaaatttaagcaaaattttatggaaaaaattcacattaaaatagtttctcgacatttaatcacctaaataataaaaatgaatttatggcatttaatttttgtatttttcttaatttataaaattaaatccggcaaaatccaaccaaattttgatgaaatatttggcaacggacgggacaaaaatgaaagagaagaaataatgataaaaattgaacaaaatgagcaacaaagtgtaaattcggaatttattcattctgtttttcaaaatggcaaagaaaatggcctaacaaattaacagaaaagaaaaatgattcaaaagtttgatgcaattaaagaaaagttgaagcaaaaaggaaaatttcaaaagaaaatcagttcaaacattgagagaaaaattccgattgtcaagcggtctggtaggcttcaaaaattattaccaaaataactaaatggctaatttaatttcaaaaatcaaaaccatggaaatgaaccagggcactaaggggtagagcccggagcaggaccggatcatgcgcaggattttgcaggatcccagtccgcaatcctgcattgtttggaaaatgcaggatttgcaggattgcaggatttgcattattaatccagccggatccggtccggcaaaaaattttgaattccaatcctgcaacaggatccgcatttgatttttgtgcgggatccggcaggatccgcatgcattctttgaaaattttaaaagacggaatgccaaaatttttgaataaatttataataaaatcaatcaaaataaattcaattttcatctcaaatttcacctagaatttgcaaaaaaatttaccggcggcgcctatcgacaccactggatcgacattaatcctgtagaattgagtcaaaaggtgtgacatttggtcattttttggtcaaaatcagttaattaattgataaaattttcaaaaaaaaaaattcagacggcgcctatctgcatagacggacccctttgttcctagtttttgaaaaaattgcgccgaaaaaaagcatttttgaaaagcaaaatagtcaaatttattgaccattaacagatttggtttccgatctctttttaccgtctgacccattcgaaacatcttagtcgcccttttaatgcatcccgccagcccctaaaatttcttgtcaggtatttttttttttggaaatttcattgaaattttttcaaaatttctaagaatccgcaatcctgtgcgggatcctgcaaatttaaaatgcaggatttgcaggattaatccggccggatccggtcctgcaaaattttttgaattccaatcctgcaacaggatccgcaaatttgaaatttccgggctctaggtcaagccaagtgttagacaaaattgctcataacgccaaatagcgtaattggcgtaaaactcgcttcattcccaactaaactgaacaaatttggtatctaaaaaaagattttgtaatggagaatctttttttaagcgaatgttaagcaatttgacatctcagaaaaaaagttgtgggagtttcaaattttcattacgttataactagggagtccaaaaatatggatantaaatcgcgaaatatggccataaaatatggaccaaaaatcgaaaaatatggacataaaatggccaaaatctcaaaat

SEQ ID NO: 10118 - DNA, 5655 bp, Heterodera glycines
cagagtatgtgcgccgcacaccatgaatggctgacaaagcaaaagggacaaaagctaggcaagaagatgaatgtcctgcgaattggtggcctcatggtgaacatcctgaatggatcaacacgactgatggaagtcacgatttgggtgaatgacattccgatcaaatttgtgcttgactcgggtgccgatttgactgtgctggacgaagtcgcacacaaggctattggaaagcctcggctgacccactgcaatgagcaagccgtgtaccatgacggtacaagctgtaagcttttgggtaaaggcacagcacgtttttcatttggaggaaaaacagttaatgggaaatattatgtgacgaagaaaggatcactcagtagaggaagaactggaccgattgttggagcagaaggtgatcaaacctgttgatcacacccattgggccgccccaattgtggtggtgaagaaggccaatgggtcaacgcgtatttgtgccgatttttctaccggtttgaacaatgcgttgctgcttcatcagcatccacttccattgcccgatgatatttttgcgaagctgaacggtggaaggattttctctcaaatcgacttaaaggatgcttatttgcaagtcgaattggatgagaaatccaaggaagtgtgcacgattgccacccaccgaggaaattaccagtttcagcgactgccgtttggagttaagtccgcgccaggcatatttcagtcaattatggactcaatgctggcagactgtccatttgctacggcatatttggatgatgtgatcgtcgtaagccgatcatccgaagatcatcagaagcaccttgaagaggtcttcaaacgttttgaaaagtttgggttccgtgtcaagccagagaagtgcttcttctgtcaggaccagatcaaatatcttggatttattattgatcaggacggaagacgaccggaccaaacaaagattcaggcgatttctgagatgcctgttccgacaaacgtgtccgaggttcgatcatttttgggaatgatcaaccattaccaacaattcgtgaagaacatgaggttcatccgacagccgttggacgaattgttgaaacaggacaaactgtgccaatggtcggaagattgtcaaaatgcctttgagaaggtaatcaaaattttgaaatctgatcaattgctgacacactacgatccggcacaagagatcattgtatcggctgatgcttctgagcatggaataggagccgtgatctctcatcgtttttcggatggaagtctaaaagccatagcacatgcatcatcgtccctgtcagcagcagaaaagaattattctcaaattgagaaggaaggcttagcgattgtctttgccgttcaaaaattccacaagtatcttttcgggagacacttcgttctgcagacggaccacaagccgttgttgtccatttttggcaacaaaaagggaattaaggcttgcacatcgaatcgattgcagagatgggcaatcactttgctcggctatgacttcgaaatcgaataccaaaatactgctgattttggtcaagcggatgttttgtcgcgcctaatcgcgaagacaccagtgccggacaacgaagtgatcattgcaaacattcgtgaaagcaatgaaacgggagtgttgaattttgttgcgaaaactctcccactggatcacaatgatttgactaacgccgcgaaaagtgatcaggtgatcaaaaatgtgaagaaatttgtctgctcacattggccaacaaagaacaaaatggccgcagacattgttccgttccatcgacgacgagacgctttgaccatcgaggatgaatgtctgctttatgcggacagagttgtgattccggcctcgcttcaaaaagatgtcttacaacttctgcaccgaggccatcccggaatgaagcgaatgaaaagtctcgccaggcagtacgtttactggcctgggatggacgaacaaattgaaaattttgtcaaaatgtgcaacgaatgcacaatggaggcaaaaatgccggtgaagactgagcttcagtcgtggccgaaagctgacggaccgtggaaacgcgtacatttggattacgccggaccgtttatgggaaaaatgtttctcataattgttgacgcgtactcgaagtggcccgaggtcttcgaaatcgttcatcgaattccgcagctacaatcgacaaattgcggtcactctgtgccagttatggccttcccgaaattttggtcacggacaacggcacacaattcgcttcaaaagaatttaaggaatttgtgaccgaaaatggcatcaaccatctgttctccgctccgtacaatcccatgtcgaacggacaagctgagcgttttgtcgatacgttcaagaggacatgccggaagatcaagggagaaggagcctcggaaatgttgaccacatttttggcaacataccggaccacgccttgtgaggctttgccggagtgcaaaagtccggccgaattgttcctgggaaggaaaccgcgcacgactttggacttgttgaggccaaagccaaaggcaccgataattcgagacgaggccatggagaagcaatttaataggcgccatggagccaaaccgagatcttttgccgtgggtgataaggttctcgctcggcatcgtctttctcagccttggcgtccaggaaaaatcacaaaatgtaaaggtgtgatttatgacgtcgaatttgttgatggaaagtgtggacggttccatgccaatcagttgcttgtgagaagcactgacgaaaatggcacaaacgcattgaacgtgttcaatgatgcgttcgatttgccattggcaccaccgcttgttcagcatggtggccaagcgcaactgcctgtagtggcacccgctgctgtcatcgcaccagccttggacgaagaacccgtcgtggatgaagctgatcgagcgcccgaagtgcctgctcaacgacgatcacagcgaaatcggcgaccgcctgatcgctacactccatcatgaacggacggatcagacggacggatcattggaagaaccgaggaaaagattttttttaggggggaagatgttgggaccggtactctattgtccgcccatattattttcattcctttatttctctccccttattctctcctctatctctcttccctgttgtcccccataaataccctgcgtcctctgacctccccgtcattcagttgtcaaccatttattttgcttatattgtctcaatcaatattcgccctttgtcctccgtccccttctctttatttatttatttgtgtctcccaacttgaataaaataattgtttattcacttcgccggtttgggattggacggcacaacattggcgacgccctgccgacatcgaactcaatcatctcgactttttgttttggttttgaacaaaacaattttgattgttcaacctttcagttgttgttcatcaattgttaatcgtcgtgagcagtgagcatcaaaaaaaaaatggccgaagcagcaattcgccaactgtccgacgtgttccagcagttcttgactgctcagcaagcaaacgcggcagcaccagcacaaccgactcaatgccaaatttggcaaatttcgactgttttggtcttggtgaccatggcgaaagcgacatcgagggttggctggaacgcttcgcccttgcgcttgactgctcaacaccgaaccttcaggacgaattgaaggttaagctcttgctgacaaagctgagtgagacggcctacgccgagtacagcaaacattgtttgccgaaaaagccaacagagtttgactttggcaaaacttccgaaatgctgaaaagcttattcgcgaagcacaaatcagtttggatcaaccgatatgagtgcttaaaggctgaaaagcaagacgaggaggactttcgcggcttcatcaaccgtcacaaaaggctgttaagcgattttgagtttaagaaactcaacgaagagcagttcaactgcttgatgctcctcgtggcgctcaaatcgccgaaggatgctgaattgcgaaagcgcatactgtcaaagttggctgccgacggtgacagagcaacatatgaaagtgttgttaacgacttacaaatgtttctgtcgaccatatcggaggcaaaagtaatggagagaccatcgaactccaatattttggctgtaaagcgcaggcagcaaccgaagaaggacaattttggagaaaagggctataagcagcaatcatgttggtgttgtggcagagagcacaccccattacactgtccgcatttgaagacagtttgtcgaaaatgctcaaaagttggacatgtgcagagtatgtgcgccgcacaccatgaatggctggcaaagcaaaagggaccaaagctaggcaagaagatgaatgccctgcgaattggtggcctcatggtgaacatcctgaatggatcaacacgactgatggaagtcacgatttgggtgaatgacattccgatcaaatttgtgcttgactcgggtgccgatttgactgtgctggacgaagtcgcacatatggctattggaaagccacggctgacccactgcaatgagcaagccgtgtaccatgacgatacaagctgtacgcctttgggaaaaggcacagcacgtttttcgttaggaggaaaaaccgtgacagggcaatattatgtgaccaagaaaggctcacttaatcttttgggaattgacatgttggatgcctttggcctattggacgctttcagaagagaagttgataaggccatgaaagtcaatgtggtgaagaaggaagcgaaggattcgccgaaccctcaatcaaagaccactttgaccgagctccaatcaaaacacatttggttgtagtggaagagctggaccgattgttggaaaagaaggagatcaagcctgttggtcacacccattgggccgccccaattgtggtggtgaagaaggacaatgggtcagcgcgtatttgtgccgatttttcaaccggtttgaacaatgcgttgcagcttcatcagcatccactcccattgcccccgacgatattttgcgaagctgaacggtggaaggattttctcacaaatagacttctccgcacttcacactttgtcgctgaccgaaacaattacttattttttataataatccaaaacatttttttaatcaaaaagattaaatgaaattttatgagtcacaaatcatatttgaattcaaaacaaaacaaatgaaaacagaaaagtgatactgataatgttttgtgaatattactagaataggacgtagagtttatggatagtgagtgcaaaggatttgtatgaaattgatgattaaaaattatggaaaaagacatagaaaggaatatcagtggaaatgattaagcatagtaaatgatcataaaagaagcaaagatttagaaaaacaaatgtttttttatgaaaaaggtgacgaattgaaaatgtcaaatttaatgtccgaaaatgtttaaataggaaatgatctgcaaaaagcccgtattttgacatcaaaaatgtatgaaaaggcgacgaattgaaaacgccaaatttgccatcatattgatgcttaaggtaatatttctcatcaagatctgctgcattt

SEQ ID NO: 10119 - DNA, 1851 bp, Heterodera glycines
attggatggcttttggctgtcttcgtctgctgacttgcgattggatttgcattcgactcccccttctctcttccgctcctcccttctgtttttcctcttcctcttcttcctcctcttcttcttcctcttctctctttttacggccaaataattccgtcccaatttggtcaatgtctccgctcgtctttttcatcgctttgttttttgttccattttcggcacccattgaaaattgccgcgccggcaatggcggttttcgatggtttgcgtttccattggcactgtttgtgccatttacttcgaccaatgttcgccgaggagtcttcaaagaagtggggcaatgtgaaacgaagggacaatttgcagcaattcaccgtcatcattctgctgatgttgctgttactgctccctcccccgttgacctaaaagcaacccattcaattatcccccattagttaattatccccttttatttaattacccctcgttatataatttcgtcccttgcccattttcgctccttaccatcagcagccttccccgatggtgctgctgatgcgacgacccctcggcttgtccgttttttgaatcggcagttgctgttggtgccgttgtgaatgtcggcaccgtttcagcttgtgccactgcgttttttgcgttcggctccttttttggcacctccaaattcgcttttgccgcgtcacttcccccggcttcatcctccgctggtgccgccgttccctccgcttgcattttcgtcgctttttcctctgtcggctttgttccctttgctccttctgccttcgtctttttctctgttggcacttttttcggctgttcctttggcaattccgtttcctttttctcttctgtctcttccttttccgtgctatttgtttccgtctttttctctgcctctctctcgttcgccttttcttttacatctgtctgtgttttgccttttttctcttccattgctcctttctctgcacttttaattgcggccgctgtcagactcggactgatcgatgccggcgaaacggactctccccccgcgccaccgatgagagggacagtaagcggcgacgtagcacccgagggggtcgctctcccggaagtccacgcagaccccgtgccggtgctttctgccctgaggcggctccaagcctgctaattcagtctggtgaagcctagagaccgaacggacgaaagtctcgccatatttgccaaaaagtcgagatttgtctcgaccaaaagccattcctgcccgcccgagctttccgttccattcccttcccttcccttcccatcccattcacctctcaaaaataaacgaaaacgaatacattttcggtgctttccaacactgtgaccgttaagttttcgtcacgaaagccctgcttaagccaataagcggccgctgagccggtcagtcccccgccgatgatcaaatattcgcaatgcattggcagcagttcataatcgttcacgttgactttcatgtgtgccagcggatgtcggcgacggaatgcgtcatattttgcctgcaaattgttaaatttgcgaatgtttttttttttttgcttattgttgcctcgcgatatcgccgcgcggaacgtctgaagtcgtagctgagaatgtgctttccacggtcccaaaattcttgaccaggctcaaagtatcgctcattttcataaggttgccactgtttgcattgggtaaaactgagaaaccgtgatgaggttgaggcaaaatttataatatgtgtttgaaggatccgttgatttataatatttctttgaaaaaacactacaagaaaaaaatattaaacacaatcatggacgggaaaaa

SEQ ID NO: 10120 - DNA, 948 bp, Heterodera glycines
  misc_feature (18)..(18): n is a, c, g, or t
cggcattccccgcaacantttgcgctcgcaatgcgcgcacccttccaactcggccttttcttcacaaactcggcaccgttccaagttgaatctgtggaaatgccaatgtggtgggttggctgctgcttctgctgctcctttgtcctacctctgaacatacgcttgcatttctgctgcgttcacatcgctcgcttccaaatgaatttccaaaaatgccaaaagtgtcaaattcgtcggcaaactttgcacattccctccgtctgacaatgctaaagaaacacaaaacaaacgatgcccaagaatttgttaatgaattatgtttactaccggtttcgccacggcattcggggcaacgaattcggggccgagcaatggcggacgattcgacgtaactttccaagcaagaaagactaaaggaaaggggagggaagagaaggaaacggtgagagacagagagagagagagaaaagaagggaaaagccaccaaaaagtgtgttggcagaagagaagctttggctgtttgtacctgaaaaggagctgaactttaacaaggaagaaaagaagaagctaatgaaagagagtggaagagaaagaaacaaaatttgaacaaaaagtaagcccaaaatcggagtgggcccagagaatcgagaaagccaaacttttctcgactcggagtcgacacttccgagaatatcactaaaagcattgttttttcaaaagacctacacacttattaacccccccccccatttgacctgtccaaacaaattgggcaagtgagcagtcgttcgatgcgttccaatggattgcctccggcgccgtttttctccgtttcctttggcctttcttccctttgcttctcttccatttgcgcttctttttccctctccgacattgtcgacattattgggaggagaaaataagcgaaagggaggaagaaaaggacaa

SEQ ID NO: 10121 - DNA, 3417 bp, Heterodera glycines
  misc_feature (2177)..(2177): n is a, c, g, or t
  misc_feature (2230)..(2230): n is a, c, g, or t
ggggtggtcgcatcaagctgattaatgatgggagaggaaacagcagaagggaggtgccaactgctcccgccccgacgggtccctccctcctcttcccctcccctttcgctcctttcgcttcatccagtcaaaagaatgaatagagataaaggaagagaagaatggataagcagaggaagaagactttccccgtcaccagagcattgtgaggaaacgaatccattgaatccattcccccccccccccgccctaagcacagatcaaaagaatgggccgttggagctgaaagacgagggatgtgatgagatgggtggggaggggaggagacggaagggctcaacttcagtcagctttttattagtccttacgacgtcagctttcagggggggagaaggaatttgaagttggaaagagaactaagcgaacgaaagagagatcatttgtaagatggagagggagggatgacgagggaatgggcaaatgtgttgtttgttggggggggagtacgcaattcgatgtttctgtcagcattttctcgagcaaattggccattttaagtgggaggagagagtcatttgagtcatttggggggggggggggtgcgactgatcaatcaactgatcaaaagacaatcaccaccacgcgtttaactgatcagtcaatgaccaaaagatgtttttttttgtgttccatttgtttgactttgtttaaaaaccatccaaaaatgagtggtgcttcgatgattgtttatttatgaaatatcacaaaatccatcagtgatcactcacacattccaaaaatcaaaatttctggttgcaaaaaatgctggccaaagtgattcggctaaattcgttttgcgtttgcattgctccgatgcgtccgccggtgatcagctgctgatggacggaactgagctgtgcagtcattcgatgcaggatcatatcctggtcaatccgtttgcactaaataataaaaattcaaaaataaagcgaaatgaaaagcgaactttgtaacggcgattttggaaccaaatctgaacagagtgagcaattaatgaacaaaatgccaatgtttttctcgccttaatttgcgtcggtgtcagccccaaatcgcgtgccaattgctctctctccgaactgttcacatatttttggcgttcaaagtattgttccaaattggccacctcaaaatgcgaaatttctccacttgaaatgccattccatcccttttttggtgccaatttccaattttccccgccttcgcccaatttcttgttcactcacttgttccggcgtgaaaagcactcgcggttttcgccggttgtgctgagttcgcagtcgaatgggcggagaaagctgccgacaaatggtttggcattgctgttgatccgatgaagactgttcttttcccttttctccttttcccccttctctctctttctctccttctctctctttttccctttcgtctccttttccttttcttccttctctctccttttctctttcgcctctttctctctcttttgtgctattttcgattcctttgctctcctccttttcctctttttcttctttgtcctcctcttccttttcctctttttcttctttgtcctcctcttccttttcctctttttcttctttgtcctcctcttccttttcctctttttcttctttgtcctcctcttccttttcctctttttcttctttgtcctcctcttccttttcctctttttcttttttgtcctcctcttccttttcctctttttcttctttgtcctcctcttccttttcctctttttcttctttgtcctcctcttccttttcctctttttcttctttgtcctcctcttccttttcctctttttcttctttgtcctcctcttccttttcctctttttcttttttgcctcctcctcctttttctcttctctctccctccttttctgctgctgcttttgtttctgttctgtcttgcgcttgtctttgacttgcctttgtcgttttctcctcctttctcggcatttcttttgctttcgttgcgcattggcacattttaaagagaagttctagcgaaaaagtatgcgaaattgtgccattgaaattcatttcgtcgcaaacgttgggaatttttgtgtgcgataggccgggggggggggaaagattcgttgctcaatntgggagtgaatgacccccgccacttctgctccccccgcccctcccctctgccncttggcactccttggcatcgttgccgtgtttgccttccctttgctcccccccttggcactatcgtatccctccttatttccctttcccttttccctctgtccgttcatccgatccctcttcttttctcttcttctcccctctcagaatgctcttctccccctttcccatcattcatttagcccctttcttctcattaagtgattgccaaatgaaatggtctttccccaaatgtgccggatatcttctcaatttctcagtgccaaatgcttttcatctttctctgtccaccaattcttttcaaactttgatgaaaagcttaaattcttttacgatgaaagagataatgggggattaaaaaataaaagtaaattggaaacatttgtgcctttttgggttacatttgccgttttcatcattttctttttttattcatttgactattaatccgttcaattggcttgaagacggcgcggaaaaagccgtgccaaagggaagggacgctgctgcagagaacgcttccacccatgaagaggaaacagaaattaacaaatataaacggaaaatgtttccaacttcggcatttcgcccatttcctccgccgcgctttgctccgtttccatttgctccaatttcttcgtcgcactgtttggctccggagggatcagcgaacgtttcgccgacatttcgtcccacgcgtaaaaacgtttcgcctgaggggaaaaatggcataattaaagaaggcaatgatcccaaatgaagaaaaaagaaacggattagaccaaatggacgacggcggaagtccttttgtgttttggaaggggcgacgaaaagcaaaatgaagcggcgaaaacggagaagccgagaaggaaaagcggcgagaaccgatcaaagggacgacccttccgtgccattttatgaccgattgaaaacaaatgaaatgccacggcaccaaatgtggcgaactttcgggtcggatggaccaacacatacaattggctttttcctgcatacggaggcggaaggacggaggaagcgacgggcggaaaatcgcgcggaaaaggccaactgagcgaatgaaacagaaaagaggcaaaagtgcattaagaaaattgggcaaaaaatggacgaaaagccaacggacggacgatgaattttgaaaagcatttaaatcatttcattcgctgct

SEQ ID NO: 10122 - DNA, 1789 bp, Heterodera glycines
gaaaaatttttaaagcataaaaattttttcagccctcataatttttttttaattttccgttttcaagcaattttgggaatattgctttaccatgaaggaattgtttgatcatctcagtatcagacttcctcttagaaattaatgatatcttttatttcaaaatattttgcttaaaattgaaaaaaatttattttcgtcccttttaacagctactcaaaaattgtttttaaaataattgaagattttttgggggccggtggtcgttgatatgctccgccgccagaaaatttttttcttcaactttttgcatttttcttaagaaattttccgatattacgtaaatgcatactaaaaagtcaaaatagttttttatatgacaaaccctccaaagtatgcgtttttattattttaactcgctctcctcactctactgataaaacaccaaaaaatttcatttcgagatggaactttaatctcgtcccactaaattttggttttccaatggtgccccacatttacttcccggacatttgcggccccagacaaaatggtaaatttgcggcccgagttttgggccccaacatttgcgacccggacatttgcggcacatttcttatagtccattttcggacttttgtgtcctaatttttgttgtattttgcggtccaagccaaatcggatacatttgcggtccggcatttgaggccccagccaaaatagggcatttatagccaattcgacagtggacaatccgacattcaactaatatttaaaaataattttaggcatatgaacggaatatttactaataccattttttattgtattaaaggcgtgcatcgatcgttaaatagctaattctgtttcctttactgatttttaaaattaaaagaagacagaattaaaatttgttgttcaagattaaacaatgaaccgctggaaacgttgaaagggaatggcaaggaaaaaaagtttatgtgcaacaggtcaagaatggtaaaaatcattttgaaattttagttggtgtcggattagccatttttgtaggattgtcctcattgtcggattatccgggagccgttggtactcctccttcccttatttaattatgttcgttgggccctgtgctttccatatataagaatttctttaaatagcttttgttcacgattaagcacatctaaaaaattaaaatatgtttctttttatctgaaatttagaacgtgctaattaagccaaatttttcattccagggtttgagaagtttttttaaattttggtttgttccaaaaattgtccgcaaatgtccgtccggaaaagtccgcccgcaaatttccgtctgcaaatgtctggaagccctttttccaccttagttatcaagataaatgatatttttaaaatatttttttgaaaaaatgtaaattttaatccgggttagaaaaatcttgggagataaaagggtctgggtgccgttaggttctgattagagaccggacgggatttttatgacttttatttctttcataaaaaattaccaaaattattattttaattcctaaaacatttgataaattttatttggtagttttatggcgcaacaatttctaagattttgtccaaaaatcagaataaaaattgttctctacttatttttccttcggtgcctatcggaaccgcctgacccaagaacccattattttcttttaaaatagttcaaaacaaaatatggacagtatttggataaattaggagaacaaattacatttcaaattttcaaaaattttcctgg

SEQ ID NO: 10123 - DNA, 3204 bp, Heterodera glycines
agcacatctaaaaaattaaaatatgtttctttttatctgaaatttagaacgtgctaattaagccaaatttttcattccagggtttgagaagtttttttaaattttggtttttttcccaaaattgtccgcaaatgtccgccggaaaagtctgcccgcaaatttccgtctgcaaatgtctggaagccctttttccaccttagttatcaagataaatgatatttttaaaatattttttgaataaatgtaaattttaatccgggttagaaaaatcttgggagataaaagggtctgggtgccgttaggttctgattagagaccggacgggatttttatgacttttatttctttcataaaaaattaccaaaattattattttaatttttaaaacaattgataaattttatttggtagttttatggcgcaacaatttctaagattttgtccaaaaatcagaataaaaattgttctctacttatttttccttcggtgcctatcggaaccgcctgacccaagaacccattattttcttttaaattagttcaaaacaaaatatggacagtatttggataaatttcgctaacaaattacatttcaaattttcaaaaattttcctggcggcgcctgccggcaccgccaggctccccccttgttccccaaaagtttttttaaaaatgcactgcaaaagaatttttaaaaaatctgattttttgattccgatgcacttcacgacttgctaattttcctcaaaacaagattaaaatatttttgtccacaataattatcaaaaatcattggaaatcaaaagttagtgttgataataaaaccgtaaatattaattcataagttgaaaatatgttaaaaatttaaaaaatcattaaaataacacattttaaaatgttttatgccatcagaacccattcataataatttataatctttcgttgaaaaattacagctgtaatagttaggagtgcgtctgtcaataaaactttatgaatattcttaatgcttgcttttatttactgtttttatgaaaatatagaatttttacaaaacttgattatgaagtgaatatttattatttgcttaaaatctttatttgattttataataatataatgcaaacctacaaaggtatgggtccatccctatcaagatggaaatggtcgcctcggaaggttagtaatgaattggatcctcgatcgcggcgggctgccaaacatgaccttccacgaacgaagaagggacgaatataatttgtacacagaaaaactcagaaacgacgaacggataagcagcattgacacgcacattccggtgcgcattaatgcatttgagatgaagggccgttgcagtgtttacgtgcatgaactgtccttctttgccaaatatggagaagccgaaataaatttggcggatgggccaaacaatgagtcagttttttttaataatgggttcgattgaaattgaaaataagtctttggggctttcaagggcgctgatcacgaatctgaactcgggtttgcccatttccgaaacctgaaccagaattcgaacaaaaaatttaaaaaaatttccaaatacgcaattttatggggaaaaactttgaattcatttaactactatttaattgatgcataaaatctcgttaaatctttaccttttatttatccaaaatatctatgtagcaattggcttgtggtttatgttttttttggttgattatttcccctcaactttttaatttttaaattatcccatgacaatcaacaaccttttataaaagtcattatttatcagaatataacgattttatgataaaatctgatacacgggaaagttcggcttatttgttgtaattttttaaaattttaaatattgaaatataatggcgcaaatgaactgcttgcacaaactttcagtaaatttttccaaaaccaaaaattaatatttttgatgaaattttatttaaaaaatctggccaaaaagacgttttttgtaataaggtcaaaaaagcaaataatttgttttgaaaaacaaaaattgtttttaatttataagattttaatcgatttttaaatgtaaagggaaaattcttcaatttagtcacggagttttcggtctctaatatcgggaaattttcggtctcgagcatcactaattcatcccggcatattctttgtccgaactttgcacttattttgattttcggtcccgttctaataaaagccatgaaaaacgaaaaactatgctagaaacacaataatttcagtgtggccaaagagacgcgtcgcgagttgcattggtctctctggcagattcttttggccaaatacaaaaaattttttggcggcgacaatacaaaagagtatttctgctatgattgtgagaacaagctcttctcaacaaaatcgatcataagaccaggatctttcaaagaatttatcatcgacttgaaggtacggtacagggaccgtcccagggggaggggggggggggtacagtatccctccccaggcccctactcacatggaatttataaaatcagaatttttgttgaaaatttcgattttgcatgttggtacacccttcaagcctaccgcacacaaatttttcaaaaaatttcgctaaacttttcccacaaaatagcatattttgtgagaaaaaatctgccaaaatgcacattcttccgtctcctatcggcaccgccggacccaaagaatccttaattttaatatataaaatgtatttaaataaataatatgaaataaatatcatctcagcaaacactgatattgaacagtcgctgctatgattatttgcacaaacaaaattttgttgctttgcgcgcctctctaaaggcaattggctacgaaagaatcggcgaagtgactatcacagaaccgggctgcggtgagcaatcgcacacgcggaagtttttcgaattattgtcgtcacaaaagttatttgaacggtaggttttgttttaaatatctaaattaaaattattttcaaatattaaaacagtgaaaatccttgaaataaatacgccttttaaatttatatcattaaggaatgattttatttgtttcgacaacaaattttataatgcagaaagtgttattagaaggatcgatgatcctcacattttcgtggagggaatgcaaaaagacgtcagaattgttggtgaaaaatacaaccaga

SEQ ID NO: 10124 - DNA, 5451 bp, Heterodera glycines
aggatttttgtgcctatttaaatgcctatttttacaattttttttctgcctttttaggtgcctattttgcggattttttgtgcctaaaaaacgaatccctagtgatcagtgcaaggaacttggctctattccagtaagcgcgtccaatgagtgagcaccctcaattttttagatcataacttttttcttacttcgtcaatccatacattcttagtattgtatcaatcgaaagtaagctttcgattgataccaagaatatatgggttgaccaagtaaaaaaagtaaaaaagtaagggtggtcactcattggacacgtaaacattggttggacgcgtaaacttgaatagagccaaaatttttcttcaatataacaccccgttttagtggaaccaacccctcctctcaattccaacattaatttccgaatcaggatcccgtaaaacaagactttaatcccgaaagccggcccgggtacagtcctcgaatttatgcaatgaattttcaaaaatccggtctctacaaatcagtgatcaacaaaggaatctgccggcttatccttgcaaatggcaccccttctgatcaatcacccgctcctttcgccgatcactccgtttcgcaatcgttgagatttgccgttccctcgcgcttcagccgtttcatttcttttcgctgctttttgatcactttctttagaatttttttcagatttttataacttttatccaattctgatcgattttctttcaaaaaattaaatttgtttttccattttgtgacacgcaaattcgttaaaaaatctccaaaattcaacgaattaaaaatgcgtaatttttttgaagttttaacttctttaaattctccaatttggcataatccgtcaatgtaatttaaaattccttgtgcggttaatcgcttttttctttccaaatttagcaaattctgaaaattcgaaaattttataattaaatgtatttagataatttattcaaaattgtttgtttgacaatgcttttccaaaaattctgctcctttttactgctttgttcgcccgtttccttctaatttcccaaaactcaaaaattgaaatttttaatcctgattaattttttaattggtccatcattttcccatcgtttcctactgtaaccagaagtgccgtcttcggatacttcatccaaatgtgcagcaccgtttcaattgcactttggtgctgctcaatccattctgtgccggcggaatacacaatttgagtctctttgaaaatgcccggctgagtgcccaaacgattccgcgtaaatccgaggtacaaattgccaatggcaaaaagccttgatttccgttcatcctaattcaaaaaaaaagtgtaaattgaaaaaaccaaaatttgttttgcttttcctaatttgatgttcctttttctcacttcaattaacggcgtctctctttgttgagcacgaaattggtcaaatgcaatttcaatgagcataattcccattgaccaaatgtcaaattttgtgcttatctgttgaaaaaaattaccaaaatttaaattctggtataaaactttatcactctgagtttgacttagttttaaatttttgtttttattttttaattgccatttcattttttgggttttgtacccaattttccggcacttttttaatgttgccccgctctataaacacactgcttggctctgttcgccgtaatattcgggccctgtgtattccgggcttagtgcgtgctcttcgccgatcacaacacattcatttttgttggacgtggagaccaacttggcaccctcgaaatcgatcagtttcaccaccaaatgcccatctttctccacgtacaaataatttctcgggtttacgtccatatgaattgcgactgaagcgcaaaaaaagaaaagaaaaaattgaaactaatacatttgaattaaaatttatgttaaaatgcttactgttgtggaattcgaccagcggtcgtgccaaccctcggatggcattgaccatttgctcgtcactgtcgtattgaacagccaatcggtcgtacaaccgatcgtggaatgaatccacgcccatttccattattatgatgcgctctccatacggagttgtgatcccgcttaattaatcattagctgggttaattattgcgtgctaattaattgttttttctcacgcgtcaatcattgtgatcaaatgttttctctccatctctggcaagctttgttgaattctctccattgttttgatcgaatttctaaagagggattcgtcacccgcctctcttccactgtaaaatttgacaccaacgcaatgaattacaccgtcagcggaggtgaaatagccaatgagtaccttttgaataatacgcgttatgctaattaattgtaaactaattaattaattgctttaattaattgattatttattgttttcactttcgtttgctcatcatttctctcaactttaatgttcaaaggttctttgtcattaaagtatgacttgtaagaaatctcaacttgaagcgattctattgaatattttccgcattttgttgcattatttgtgcaaattttttgaataaaaataaataagaaaaacaataataattcttctattagcattttaactaaaattttaaaatccttgttaattaattttggttaaaagttttttttggttattatttaaataaagattaattcttttaaaattgcagggaatggaaaaatgcataagcatcagaaagaaaatttatacaatcaattaattcttgttaaaattgatattgcaaatgaattatgacagcaatagcaaatggagaataaaaatgaaggcaaactatgctttaatttttaatattgtgcaattaattaaaaaaacgctttttcgtttcccaattaatttctgatctttggggtttttgcatatatatatttcggcattatcacaagaaaattcgaaaaataatatcatttaaaaatcaaaatctttcaagaaataacactcttaaagacctaaaaattttgaaagaattcgataatcaaaaaactttttcattttcaaaatgaatatttaaaaaaaaaaaatttctttgaaaattatttttaaaacggcggtacgaaaatggcggtacgaaaacgaccctggccgtataatttaatggtttaaaattttcaaaaatttgaacacaacttttgaaagttttttgggtggccgatcatttcgtcactgagaaataattaaaaaaaaatattagttaaatattgaaaattcttttgttttatgtattttttatatacttggattggctttctcgcaacttgtagacttaagtttccgttttatttccataaaatgaccaattcaactccgacaaaaaaccagggatcatgatgcattcatcaataaatttgttaaaaggaatgcttaaagttttcagcgatggtaacatccgttgctgattatgaaaacgcgccagaaaatagcattagagggaaagtcgtaatgcaattccctctatgttgatcaagacaataatttgtgtcaaattttttgcttaatttatgcagaaagcagcagcagaaaatccccatcgatatctcagagcaatatcatttaggataacactcaattcgtgatcttcgacctcaaaacccttataaactcatttttcgactttttaaaatctaaaaaataatttcgaaaaagaggcttccaccggtggtatgtacgcttacccataaataatttttgagaattttaaaacaattaatactttcataagatagttttattgaaattagccaatatttttttaaaattatgtctcagtgacgaactgaacggtgacgaaacgatcagtgacgaaatgataggtaaccgttttttgtccattttttgctaatatatttcagcattctgccatttattcgtacagattttgaaattttttgtccatatacaataattcgggatccggtaccaataatcagtttatttttcaaaatttcaattttaacatttgttcttttatcacaaatcttttttctataagtaacgtatttttcaaaactttttctttgctgatattaatacattattgcatattttcttttacaaacaatgcttctattataagcaaaatgatatgaattaaccttactaaattgatgctgtcattccatatgtcacattttgaacggaatatttattgaaacgaaaacttttattaaatttttgcgagagaaaaggtagagaccggcgcgggacgggatccgggattttgcgggatcccagtccgcaatcccgcattttttggaaaatgcgggatttgcgggattaatcccgcgggatcccgtcccgcaaagaattttgagttccaatcccgcagcgggatccgcaaatttgattttttgtgcgggattatgcgggattttattatttttttgaaaatttttctaagacagaatgccaaatatttttaaataaattaaataataaatttaattaaagaactcatttttcatcgcaaatttcattcaaaatttgtgaaattttcccggcggcgcctatcgtcaccgccggaccctaaaaatccctatttttcttgcaaaatttgctcaaaatcgcaaaattttatttttttcggacaaaatctgttaacaaaattttcccggcggcgcctatcggcaccgctgtaccctcctccaagttcccaaaaagtttttgaaaaaatcgcgctgtaaaaaacgtgtaaatagtcactccttttcccaaaaatgttctaaaataatgaaaaatgacaaaaaaaaagattttgataaaataattgaataattttttcaagcgaatatactaaaaacatttgtgaaataccttttacttggttaagaattaaaaaatttagcctattagaatatttagaaatttttttattatattgtatattttttgaaaaatttccgatttccgacgtttttggggttggaaatccgatttccgacacttccgaaaatttttggggcctcggaatgccatccctgatagggaccgccggaccccctgttcctagttttttgaaaaattgcaccgcaaaaaagtggttttgaaaagaaaaaaatagtcaaatttatgaaccgttaatacctaatttgatttccgatcaactttttaccgtcggatccaatcgaaaaatcttagtcgacccatcagccccttttaatgcatcccgccagcccctaaaaattaatttttcagcattttttgatttttggaaattttttgaatttaattgaaattttttcgaattttccaaaatcccgcaatcccgcacgggatcccgcaaattttaaatgcgggattagcgggatcccgtcccgcaaaaaattatgagttcagtcccgcagcgggatccgcaaaatttgaatttccggtctctagt

SEQ ID NO: 10125 - DNA, 1618 bp, Heterodera glycines
aattttctgaagaattttaagaaataagaacaaaataagtacaatagcccgaaatcagaacatttcttacaaataagaacatttttattttgtaagatttggaccctccaaatcagaacattattcgctctagtccagtttatgcatccactcgactttattattatcagccaagtgaaatccgacttttttcggcgttcgttggcaaaaagaaagtgtaattaaaaatcggtaaagaaatagaaagttgttactattttgtgaaacctcgtaatacacacctaaaatcaactttcttgccattgcttacaactttaacaaattaactatactaatttgatgtgtgactatgtatgtcacactttgaatggacaatttttcgaagcgaatgcctttgcaaaaacaaagagagatgaaaaggggaaaagagaattattattgtaacaacaaaagtcaataacatttacgaaatcaacacccgtaaattcgatttctcttttcttattattgaattattattccaatattccgaatgttaaaaataaagaagtcaaatcaaacgtttcattccgttccttgaacaaaaaatcaacttttacatgaccaatcataattttcgcgatcaatcaaaggcttttgtcgatttagtatcattttaacaaaaaatcagacttaaatgttaaaatctctgaagtaattcatttattgattagttcgttgggtttgctgccgatttttttattatcggtttgttttttcaattattgtaatgatttccaattgatcgaaaatattataaaagtaattttaatgatttttttaatagttttaaatttttttaaaatttttactcccattttaaaaaacctttttcatttgttaggatttatttgcagttctgcaattttagtctccaatcaattttatgacacccaaccacaatttgcgcgattaattaaaaacgtttaccgtattatctctaattatcaagagagagagaaaaaagtgagaaagaagaaagcagtgagagagaagtaagaaaggagagagggagagagagagagagagaaattaaaagatgagggaaaatgaacgatagagagcgtgataaaaagaaggggaggaaagagagagagcgagaaaggaaaagagagagagaagaaagaacaagagagtgaaagaaaaatagagagagagaagacagaaaatttgagagaaaaagaaagagatagagagagaaaaataaagagagggataggagtgaaagtagttagagagtgtgaaaagagagagattaagagaagaagagggagagaaagtaaatgagagagcgagactgaaagagagaaagagagaagagattgagagagcaaaggagagtgaaagaaaaatagagggagagagacagagaaatttgagcgagaaataaagagagagagatagagttaaagagggggagagggagagaagggaaatgagagagcgggattgaaagagagagaaaaaaataaagtgaaaaacagagagagagagtaaggaggagacagagaaatttaagcgtgtgagagagatcggggcgtgtgggagagagaaagagaaagtgatgaggaggtaaaag

SEQ ID NO: 10126 - DNA, 3085 bp, Heterodera glycines
tccaaagagtcatgctttttatagtatcgagaaaattcatttaatcaagaaatattttttgtgtgcgtcgaaaatgtggaccgaaaaacaggagttttggttggaaaatcggcaacatggagttggaaagggggaactaatgggcgggaaagtgcttaaaacaattaggcatttggcttttcaaaaaaaacgctgagaaattttttgaaaaactttttattggtttctaaattttttaatttttccgggggggactgatccggggtcgggcatgtgctgctcccgtttgtcgcgatggacacttttttatttaacggattttctttaagttcaatttttttttctatttttcttggattttcttttattttgattccaatctctgaatatttaaattccttttttggtataagtgacagaagttttggtagaatattttttttaataacagggtttcacgggttgagcgcacctcgttttgatttgcgacgtttcggtacagtttttttcagggggatatattttttttgaattctcattcctaatttcttaaaacgaatcttaaaaattaacaacgcccccttgtctggcaaatatttgaaaatttttattttctataaatataaaaaaaaaattatttttacctgaatttgaaatggcattgaaaactgtatcgaaaacggagcaaatcagaagcggggtgaagtcatggggctttcctataggctagcatcatcaaccgtcggcaaaagcaactgcctccgctgagcatggccagtgtcaatagcaataatgtcaatgttctgctacagaagaagcacaagcagtaccagcaccaacacatggacagccctttcaacatcagcggcagcagcagcagcggacgtgccagtttcggcggcggcaaaagcaaatggtggcgcaatgtgatgtgcggcgccgggcgcggtggtgccaagcaaaggcatgtgtgttgagtgccgaaaaatggccatttaaaaatgatgaaagccaaaatgccaagattcccagcgctagcccttcaaaaaaaattgtttttttttgaaaattggcagtttttaatacttttgcatatccacttcccaaatcagaacctgatgaaaagtcgaaatttgaaaatttggttttcggctttgggttcgaatttagttgaggttcaaaattagccaaaatcaatgttttatcgtaattattaccccgtaaacaccttaattaaaaaattttcacatcgactcttcgaaatttcaaaatgttcgtttttcagtgaaaattggcccagaaaacggcgacgcggcggcgtcgacactttggacaatggtcaccaaaacggaggtggcgaagaggtgacggatgggctttatgagaaaaatattgctattctcaaactcatatttaaaacttgtccctccccttttttccccggggtaaaagttaaaaattttccaagaaaaatcatagatattttttaaaagaaattcaaggggaaaaaattgaaaaattctaacatttattgaaattttataaaagattcgaaggatttttgaaaattttatgattttttttttgctttgaattttgttataaaaaatttgaagatttttcttgaaaaatttctaagtttaaaattaaaaaaaaatttcggcgaaattttgtcctgttctcttttcccccattatattctcctcaacatcgccaggtgatcacgcttgactccgactcgtcttcctcctccacctctgacaacaatgcgcgcagcgctgccggtgccattgccaacctgcgcatttcggcggcgactgccaccgccgccggtggtgtgcgccgctcttcgtcctcatgctcctccgtcgatggcgccaaatccgccggcgtcgaattcgcaccgccgccgacggcaccggcacgcattggctgctatcaacgccggcgcagcagtggcagcagccgcacgggcagcagtagttcgtcttccgcagcgccgttcccgtccagcaccaccaccaccaactcgtcggcatcattctcttccaacacgtcattgtccaacatttgctttggcaccgcctctcacggcagcagcaacaacaaccatgccgtcgtcgcgttgtgtgcccgtgacggtgatgatgatgatgacggtctgaaggatgtcgcgttgccgcccatttgtaacgatgaggacgaagatgatgatgacggtgaactgcttgaaagcgttggcggtgaagatgatgatgacctcgacaacgttattgaggtggtttatcgatcggttgcacaccaataaatttgttattgattgatatgctcgttgaccgactgatcaacggctcttggcggactttttgttttgaagcaatgaactttatgtaaaaaatggcaggaattctccatatggaaaagcaatttgaccggattttttgctgcgatttggattcttgtttctttttgccttattattgggcttttatcgccgtccaaaaattttaatcattctaccaaaaaagcaaatttcgcatttttaaaaattttacaaaaaattaagaatttttaaatgtagtttttaaacctttttctgtttgctacaaaatctaatctgcaattaatcgccttaaaggcgaattgggtgccaaaaaatctgggtctgatcactccaaacatttttccctcctctgatcacctcttttcaacatcagattgaccaaagtgcgccgccgactgttcatcgccaccagccacaacaacaaaatgatgcttcgcaaatgatggaagaggatgaggagttggattgggactgggagtttgaactggtcgaacatgaaggcttcaagctacagccgactgccgcttccgatttgtgttctgctgcgttgacagtgccttcgtcatgttcggtgccggcagcgagcagtccatgtgatcaatcggcgagttccatggcggcgagcagtccacaaaaccaaccggcgacttccatggcaatgaacagtcttagcccatcggcgacttctattgtggcggcgagcagttcgagtcatttggcgacttccatggtcgctagcag

SEQ ID NO: 10127 - DNA, 2071 bp, Heterodera glycines
gcaatgtgagcgccatgaattctcaatttttaatttaaaattaattaatttaaatttaaaataacaattttttattttatgctattttttactaaagaatttatttggaattatttgaaaatgaattttatttttgctaaattcaatcggctctccgtgtccaattgcgccctttttgtcgcgcaaatggtccttgagggccgtaaatcaatgccaacactctctccgcttgtgtgccatttcgaaaaaggcacggaatgcgcctggcggggaatgcgtctgaatgtttctggcaaagtgttacaggacaaactcaaattattatttttttaaaattctttttaatttttcagtaccaaatttcatgttttcaaatttgctttagccgtgttcgtctaaattgcaaaattttaaccttttttaaggcactttaattattaataatttttacattattttaaattaaattaaacaaaattattttttattaattcccttcccccccccccgttttgcagctgtgccacggcttttccctggacgccatccataaactgttgcagcgttcgattggtcccgtgccgtgcgcagtgtccgtgtcgtcgacccacgcgcgcttccactgcgactgtggcgcggagcgggcggcgcgctttctctacgcggagttggacgccgcgcggcgtacgctgctgctgggtcctgcgcccgagttccacgccagccgcgagtgatggtgggcggggggcagtagcgtttcggcgcccaccatgggaatttttagtgtttcggcgcctagatttttgcgccaggaattttgggatgtcaaaaaaatattaaaatttgctaagtatattttaattactaactgcttttttaaaaaacgacattttaaaacaaatagtaatttagacatttttgagtttttacagttttttattaaaaaaaaatattttgattaaaatatatttgattttatatttaaatcaattaccgtatcacaggtggaggggggaaagagaaacggacaatcgccgacgagagagcacatgcaaaatggagtggctggcgcagacgagaaagggagggggagacagagagagagagagagtacgcggaagttgttttttgtattttgcgtcaaatttttccaaaaaatttctgtatgacaaaaacaaacgctggtccactttgtggtcaagtggttaacagcgagttgtttccgctttgccacacgaggttcggatccccgtgcggggattttgccaatttccgattttaattttaattcccctttttgttgtacaaagaattgacgcaattttttcatgggtttacttctgctgcatccactaattagcgtaattacagttttgttgtgttatatgatgtccaaaaaaaccacgtgccttttttttgtttgccatttttgtttttattgtctcacttttctcaccaaatcttttccaaattcgttctcaaatattcattcacacacatttttaattcactcatttccatatggtaattattattatttttattgtttaatttaactcatttttccatttttttttgtttctcaggacttttgaaaaacgaacaatttcagatcacatttttgtcattttaactaacatacatgcctattattatgatctgatttgaatctatatatcgatagaagcaaaaggaaaaaacaccaaatatgccattctaactcataattttgaataatttttctcttttgttggttaattattcctaaagttggacaattatggtataataaatgataattcctaaaattaaaaatggtcattgctttgattattaacatgaaatatccggaaaatttaattgagtattggttatccaattttcacattaatatttaattgtccaactttgaattttttgcaatttaatccactgaactttttggcaattttaatttttttcatcaaaataagcataatgaaatacctaacaccaaacatattttttgattgttttttaataatgcattcctctaaatttgatcaatcacaattttttaaaattaaaaaaa

SEQ ID NO: 10128 - DNA, 738 bp, Heterodera glycines
ttgtatcgatgcgagcgtggattttgtctatgtttgtcatggcattgtgttgaacttttgttattgtcgcaccgtaaattgattttttttaaattttaattttcgactttttgttcgaattcgagtccgggattcggaattcgtcgcaatggatgtcagattcgtgatcagcgaccccgaaaaccccctagaaatgtgttaaaaaaatttttttttatggtctgtaaaccacataagtaccgaaattctctcacttccatattttatgcttaaatgcgatttggacccatttcgttccgaggccaattccatgtctcgaattcttagttcatgaaccgtgagcatgtctcttaaccgattttctggtcggtctaaattttggtcaaatctcggctatgccaattttgacattccaaaatttggcgatggcgatcaggcctaccttcttcaaataattatttggccacagatttgtacaatggcgcaaaaaaaagttttaacgggatttttcccggtcccggtcaaaatacttaggtactcagttgtacgtgtttttcagtacccggtcccatacaactctagttgaaatacaaaatttttaataaaaataaaaagtcatttatttaacgacaaataagacgataaattttgtaagttaataatttgtgtacaacgattggaagtggaataactaacagcaaaatagtgctgttcgagactgaaaacacgagacttttt

SEQ ID NO: 10129 - DNA, 2135 bp, Heterodera glycines
ctatttcgaattgtttatttaatttgtttttgttatcctccgattttacaccactaaaattgaaagttttagcacctattttgaggtttttataacctaaaaacgaactatttggcagtttttagcaactaaaaaatcgtatccctagtcacacattatatgtatatattgtatgtcaccaaattaaatgccggaatttttcaatttttatatggactcaattgcggtgtgcacgacataaattagcaatgaaaattgcactttcagatgcacccaattaaatattcttgatatccttaatccgcggtctctaataatatttaataaattaaaattataaaattgcttaatttaaaaaaaagaaatcccataagtagaattttgtaaatttctttttttcatttaattcattcacgacaaaatcaatttgatatccacatcagcttattttactccatattccatttccatttctctcataagataacaaataatatttttttttatattatggattcattttgccctattcactttttattttattttaaatttaattattatttcatatttgtaataattcgatggcatttatgaattttaaaagatgaattagtagataatattcatacataaattattgattttttgccgatcaagtcaatcgacttgggcggccaatccaaaaggtttaggctttgtccaaaccaattttgggcggatgttgtgacctgctggggcaaaacctttgggctattttttggtgcggttaaaaaagtacagaaaacaggatgatacccttcactatttatctttatttatttatttatttttataatttcattaaaattctcttcaaattccatactatttcttccataatatttttgttgaaaaatagttataaaatttaaacgatttgattcaaaatttcagcgatcaaaatttcagcgattacattttttcggcgttttttggcctagggctcttttgttaacaaaatgaagtttttctttagtttgctaattcatttgatcgcttattttgggcggaggtggggggcgagaggaaaatgttgctattgcaatgtctccaagcagctgatcaccgattggaacggagaaggggcgccattgtaggtacaaaaaatgctcatttatttgatcgccgattttgggaggggggcgagtggcaatgttgctaaagcaatggtcccaagcagctgatcaccgatcggaacagagaagggcggaattgctaaaaaatcttccttaatttgtttccaaattcatttaatagatttttcggcgattttttggccgggggctctttgctagcaaataaaggttttttgtattttgctcatttatttgatcgctaattttgggaggggcggggggagcgaaaggcaatgctgctaaagcaatcgccccaagcagctgatcaccgatcggaacggagaaggtcaccatttgcacgtacaaaaaatggctaataaaatagagtggaatgcgatcattttgtcattttcaccccgggattgagccaattttcgccaattttattactatgtgacttccttatttaattcaatttaatttaattatttttaaattattttaattcattttaaattataattattttaatttaattcaactattttttactgtgaataatattttattatttcagttccaaaatgccttgggtctggcatagcgcagggcaaggtcgccgtcgccaacaacaacaacaacagcattatggatcggtgaaaattcttttttttgcatttaaaaattttctgtttaaatttaaataacaccaaaaatattgtcacgcttttctgtttttttcaatcttaagaatttaatcaatccttttctttttttagcctgtaaaatttttaattaagatttgaattactacggtcttcaaaaaaggctcaaaatgccatttttgtgttttatttttttttcagtaactttctaaaattattttgtaaattaacctacaaaaaatggaacaaatttgagactgtttgctaaatggtttttaaatagtgttaaatttttcagatacaacagaattttaaaaagtgaattgggcttaaaaagaatagtaaactgttt

SEQ ID NO: 10130 - DNA, 1117 bp, Heterodera glycines
  misc_feature (1041)..(1041): n is a, c, g, or t
tgcaccttagaactctatgaaaccattcgtcgcattcaatatgcagataatgacacggagttttgatcgcgtccaaagaacccacctcaaaatgttcctggaaaatggaacacattttggggtggggggtaaattgactaaatggaatttatctgttgcgatttttaatttaatttaaccaaaataagtgtaccacaaatatcagtctgaacagattaagaaattgacaccaaattcattgttagaaaaaattaagcttcaatctcaatttgttattaaaaagagcgtacaattcatattgttagtaaatgttgggcgcccgccctcaaattgttagcaaataattatcggctcaaatttttagaaattattggctcctgacccaaatgttagcatataattggcgccttgatcaattgttagcaaattattggcgtttgactcaaattgttcgtaaattattgcccctgaccccaaatgttagcagataattgttagaaattattggcgcccgactcaaaaaattaaatggcgccaaaaaaccaataatggcgccaaattcaaaactaaaaaaataaaatggcgccaaaaaaatcaataatggcgccaaattcaaaccaaaaaataaatggcgccaaaaaaccaataatggcgccaaattcaaaactaaaaaataaaatggcgccaaaaaaccaataatggcgccaaattcaaaactaaaaaataaaatggcgccaaaaaatcaataatggcgccaaaaaatcaataatggcgccaaattcaaaactaaaaaaataaatggcgccaaaaaaatcaataatggcgccaaattcaaaactaaaaaaataaatggcgccaaaaaatcaataatggcgccaaattcaaaactaaaaaaataaaatggcgccaaaaaaatcattaatggcgctaaattcaaactaaaaaataaatggcgccaaaaaaataatgggtgaatttaaatacaaaataaatgtgccatatttattttgaaaaatagaaaaatgacattcaaaactcatntttattgaggtcgctaatgcagcccgatggtcaaatggttaaagcgcttggttatatatacacaaagttcaaaacc

SEQ ID NO: 10131 - DNA, 2546 bp, Heterodera glycines
tgggcgcccgccctttattgttagcaaataattatcggctcaaatttttagaaattattggctcctgacctaaatgttagcatataattggcgccttgatcaattgttagcaaattattggcgtttgactcaaattgttagtaaattattgcccctgaccccaaatgttagcagataattgttagaaattattggcgcccgactcaaaaaaataaatgacgccaaaaaaccaataatggcgccaaattcaaaactaaaaaaataaatgacgccaaaaaaccaataatggcgccaaattcaaactaaaaaataaatgacgccaaaaaaacaataatggcgccaaattcaaaactaaaaaaaaataaaatggcgccaaaaaaccaataatggcgccaaattcaaaactaaaaaaataaatgacgccaaaaaaccaataatggcgccaaattcaaaactaaaaaaataaatgacgccaaaaaaccaataatggcgccaaattcaaactaaaaaataaatgacgccaaaaaaacaataatggcgccaaattcaaaactaaaaaaaaataaaatggcgccaaaaaatcaataatggcgccaaattcaaaccaaaaaataaatggcgtcaaaaaaaaaaacaataatggcgccaaaaaaacaataatggcgccaaaaaataaatggcgccaaaaaaataatgggtgaatttaaatacaaaataaatgtgccatatttattttgaaaaaatagaaaaatgacattcaaaactcatttttattgaggtcgctaatgcagcccgatggtcaaatggttaaagcgcttggttattatatacacaaagttcaaaacccgggctgttaaagaattttcctccgcttgcgtagcgatgaaatgcctccgcttgcgtagagatgaaatgcctccgcttgcgtagagagataaaatacctccgcttgcgtagagagataaaatacctccgcttgcgtagagagatgaaatacctccgcttgcgtagagagatgaaatacctccgcttgcgtagagagatgaaatacctccgcttgcgtagagatgaaagctctcacgcttccaaattcctgcaaaacgccccaacgctgatgaggaagaattggagaacccgaaaagtttgaaagatgttctccgttatgcaggagctggaacattttacatcactgcaaccattgccgacttgcattaccaagtctatgatgttcgaatatttttttttgctagtaaattttttttccattagtcgtgcccgctccgagtgcgtggtatcccctgccgtcgcaaactcccaacaaatctcacatgtgattcgtgcgggcaaacagtggagaagccagtcaaaaacatttatctgaaaattgttttgcaagaccgagacgacagcacctgcactcaacgtgcaacaattttctcggcggttattcaatttttacttttttttaatatttgcacacccaggtcgcagaagcgtttctcggacttaagtcaattgatgtccaagaaatggatgaacaaaaattgtatgggcattttgaagccaaactggggaaaacaatcaacgcaaaagtgaccattaaggtaaatggttttgttggacactgctttttgtagaacaacaaatataggaagacagccaaaactttttcggcctcgactgggtggtcactcgaatttataagtcaagcgaaaagaaaattggcgatgctgaaaagaaagcggttgaaaatgaggggacttcttcaaaaattgctagattggattagacattttccatacatttggacctgttaaaaaaatataaatttatcacattttgcgtgaataatgcacaattatggacatgaaacttttttattggaatgtaatttcgaaattaaatgctctttgaaagatgattcgtcataaattacaaaatgagcaggacgtttcggagattttatttttcttgaaggccttcaccaataataaggctcagatattagttgtttgtcgcaacatgcaaaaagttacctttttaacattgtgtccgaaggaaggcgaaaatcgcgaaaatctctttcaattaatcaaacaaaatctattggaaagcatcggaccttattcatttgtacggtacgtataatattatttttatattagccaaatgaacatttttttaaaggtttgaagagcagccgctttcatcagatgaagaagtgctgaatctgttttgatataagttattaacgaagtctgggcagtggaatattttgaagttcatttactatttcatttgcttcactttgtgtaaaatgtccacgccgtttcaaaaagtttaccatggaaatcacacagagcagaaagacaggaaaaattataagataaagaccaaaaaataaaatgattttttcagaatttgtaatttgtaaagactattcttcatcactatacccattcaaaatttggataatcggttttgttgttattgttggtgtgttattacttttctgcatttttttttgtattagcaaaatttctttt

SEQ ID NO: 10132 - DNA, 6148 bp, Heterodera glycines
  misc_feature (1806)..(1806): n is a, c, g, or t
  misc_feature (6053)..(6053): n is a, c, g, or t
tttttgtcacaatacccaacttgcctggtgaggacttcaaaagctcgtctccgacgcgtacttgcgcaaccgcctgtgctgcggcaacttcttcttcggcacgccaacgccgcccgcgccatgctgctgcagcacaaagcgttccgcaaccgaactgatgatgggcggtgttgcagcgttgccaattacgcagcaatggccggtcaccgcggtgctgtccgccgcctcgcaacagcaacactcggagcaggaagatggcggtgctgcggcttctgcgctagcgctgccgccgaaaccgctggcacccaattttccggcagcagcagcagcacgcttttgcgcctggaacgacgatggcatgggcatcatgcgcacgcagcgcgacggtggtggcagctgttgctgaccggatgactgctggccacggctgtcactatgttgttgttgctgttgccgttgctggtccatactgaaatttgagtttttaaatggcaaataatcatgccaaatctggtgggacttttggcactaatttgtaagattttggaaaaatggcggcatcctctttaagaaatgaattttttttaaatttatataagaaaatttcttatatttttcatttttttttacccaattaatctttttttaatttaggtaggagctaatttgtaaatggaagatagtaatattaaaattaattattattttaatttcatttgcagaaaaataaattataacttgccttaaatttaatcataaattaaacatggtatgacatttagaatgtcctaaattttttatgaccataaaaatttgactcattgaattccttcagaacttttttcagaaactgccaaatttcagttcctttatttattataattagggattacatttttaggctctaaaaaccgcaaaaataggtaggctttaggctctaaaaaacccaaaaaataggcactaaaaatgcaaaataggctctaaaaaaaacccatttttaggggggtgtaaaatcataaaaatttttcaaaaaaggtaaaaaaattaagccaaatcagtattgagataaatatttttaaaatcacaaattcttgtcaataaataaataaattctggagaagaatttttgaaaaattttcgagtctattcttaggggtgtattttttgaaaaaatttttggtcgattcttagggggtgtattttttgttcttattacaattttgttaataattttgggtaaaatgcaaaaataggttctttcaaaatttgttaggctttttaggcgctaaaaataaaagtctagaaaataggcactaaaaactcgaaaaatagcttaacaacagcccaaaaaacatgtttttcatgcgtttcaggccacggagagctcaggaaaaaataggcttttgcctaaaaatataatccctaattataattagatcgaccaaagagttctattatttaattaaaataacaattaaatttgagctaaagtacgatttattattctgcaaataaaattaaatttaaatatttctatcatttaaaacttttttttaggttcgccccattgatacttttttcggttccacctagcaccgttaccacatactcatttaaaggaaatttcgtacaattttttttttttttgaaaattcctatccattcagcatgacctacctatattaaattacactgtaatcttaaatttttcatgctctcaattcctgaaataaaataaaataaaatgcctacattttccgggatttgtatgcgcaacggtcgactcaagtcggaaacggagggggncggcggtggggggcggcgctgtcaatgcccgcgttggcatgatggcactccgtcgttgacgacgcttcaccgatgaccgcaagctgttcagcggacgacgccctcctgcgcaatttcgtgccgacgacattttggtgtggtttattggcaccgccgttggcattggcttccgagtccatttgtactggttgttcaccagagaatttgttgttttacacaatttacagttgagaaaagcgcgcaaaagcaaaaagtacaatcgtatcgtaacccctatttttgtttacggtattatgtaatacagtaaattcatttgttatttgaacggactgtgctgggagaaaaaatctttggattaatgcaaaagaaaatattgaaaatgtattttttgaacgctttcatataaaacgcaatgccaatctgtgcggtcatgaaaaagtgggggcggcatttatgcaactttggcacaccatttttggcacgaagtgaccgaaaaagcttattttgcgcctttttggcattgtgcagtgccaatctttgcaaaaaaaaaatcgcggcataattttatgaatatttttggcaactttttggggcggatgccaaaaatgaaatgtccggcaatttgtggagtaaaagcgaaggtcaacagaggaggaagtctcccaatttccccaagggtattcaaaggaaattcaaaacagcgctaaaaatagaacgccaaaacagtcagatttggtgtggaacagtaaataatttgccaaaatagctgttaaaatgccaaaagaaagttaaaataaataaaatttatttacgtaaaattgttacaaaaaaaacaaaaattattttaaatgaaatttcaaaatgaaaaaattataaattatttttgaaacagttttttcgcaataaatttaattgtttttattttaatacttaaatcaaaaataataaaaattatactaaaaactataacaaatttattaattgagttttaaagcattactttaaatacgaaaaataaataattaggaataaaaaaataaaaaaattttacactaaaaaaatgtatttaatttattgaaattttatgaaaaatatctgcattggcattttcccgtggcataaataaactgaaaaatgagcccaaaagcaatttttgttttgtgtgtgccctcaggggaggaaaaaagtgtgcaaaatctgtgccgaaaaatgagggcaaacaaaatgccaaaagtccaaaaattgataaattgggggcggaagagaaaagcaataaaataaaatatatggcggagggtagagatgcagagtgaaaattcattcaatcgcctaaggcagaaaaaatcccatgggaattttcattttttatttcattgaaaattgttttcagcttaacagtttgccaaggaattcccaacaataaaaaaaattaaaacgccaaaaaaaaattaaaaaaaaaaaaaaattgggcaaaatcacattaaaagattttttgtgagagataaatctaatttaattaaaataactaacattattttgaaattttaaggataactccgtgcccgtcaattttttcaaggaatttttctaattttactaggtcatatagacctgaaaaatattaaaaaacttgttttagatgctacctttattaagctttaattttgagggcctattcttagacaaaaacctaaattctcacatataatttaaaaattttttgttttttgtaaaaaaatttttcaaaaattttctttgttttgtttagccaaatacatagaatacaaaatttaacaacaaacgagaaatttgtttaaaatttaatgaaaaatgaatttagaattttttttcccaaaaattccaaggatctttcatttatgtaaatagttccgaatgcttaacacacaaaatttaattatgctaaagtgcatggggaatggcagcataggtaatggatttttcctgctagccacggaatgacgtgcccaagtcaatttggcttttgggaatttggaagaaaaattttttgaaatttaaattttccaaaaagaaggcctctgaaagaaaacaacaattaaacaatgcttttaataaataaataaaaatttacaataaaataaattcaatttaaattaactaattttcgttttgatctaatttttaatgcaaccattttcaaatgattcccaaattttcatatttttaaacaaatcaaaagccattaaaatagaaaattatttttaaaatggatgaaattagttaaattaatatacaaggaactaataaaattttaaatttttcattttaaatttttgaaaatcgggaattttcttttttcttttttttctctaccctcttaaccgccccccaatcagcaccgtcattatacgctttggttgctctcggatttgtgtgtgccaatgccattcgttggcattgcgccgtcccctcccaccctcttttgccgtgtggccaaggcgcaaattgggttaatgagctttacgctgccctccgctcaagcaaaaagctgtgagtgtgtgttgtgtgtgccctccggggaaaaatgcggtaaaaagtaagcgccggtattttggcacggggagacaattttttgcgatggtggaaaaatgccgttgagcaaaatggggatgaacggtggagggggacaatttcaaaattttaaacacttttatttaaatggtggaatttttaaattttaaaaaaggttagacagtcttttgtttataaaaacctgaattttgagataagcaagcgaaaaatttcaaattttgttaatttccacatttgtcttaatttgaattttgacaaaattatcgaacggtattgaatatggttaccgtagttcctttcccaaagttgttctatgatctgttacgtccgcattaccattcccaaaattggaataatatcctttattccgaaggtgtgcacacaattacataatgagtaaatgagggaaaggagcggcccccgattcgtacgggacagatggggagggaaggatcggacgggcacttggcccaatccccccgatcagaatgaatagaacaaaagagaggggaacagattgatgagaagggggggcggggcgagtggggcgagaaaagtcaagagcataggcaataaaatacaatgtaatgacaatcaatgggcgtcggttatcatccgcgacactgcgccggtgccagcaaaaggcggcggttgaccccattgaaaattgccgtttgtgggggtgggagccgaagtgggggaggtgtgctgggggtcaccaaatcgatgtccatatcgattctcgccctccacgagccgctccaccaacctttccaacttttcgagcagttcgatgattgggttcagtgtgggattccctgaaccttctaacaacttttcaagccggtcaagacgggcgagaatgtcctctccctcactcaaatttggggaattttgccgacgttttttgggcattggggattgaattatttggagaatgaattatttggagaatgaattatttggagaatgaattatttggagaatgaattatttggagaatgaattatttggagaatgaattaaattaaattctgaagagaaaagtcattactcttcgctgccgtacaacaaattcaagcaaatttattttattattatattaatttttaattgagtcaattttatttttgcattaagttgagattttttaaattggcagaaaaataataataattctttagtttataatatcaatttagctttaaatatgaatttttttttacattatataatattcaaacatttttgagattatgtaataaatagtttaaaattttcgtaatttatttaactttttatagattgtttgtgaaaagttttttttaagattttgttatccgaatttattgtttacattttcaataaaattccgtgttgattaattcattaaattaaattaattattgggatatttggaaagacattcaaattaaaaactcttaaaccaaaatcaaataatttaaaattgagtaagctaatgtatttttagtggcataattttaattattctattgttaataatttaaattaaatgatgaactaactgaattatgctaatagatataaatttaatatattttgaaaattcgtttttcaagagttgtcctattacgtgtacggtttcttgattttgtccattgcgcgatgagaataactgactctatcggctttanataattattttagaaatcttttattgataccaaatataataataaaaattgaatattacttaagaatttaaaaagcacaacgatattcgctacta

SEQ ID NO: 10133 - DNA, 2318 bp, Heterodera glycines
  misc_feature (12)..(12): n is a, c, g, or t
tgtgtattttancaatagaaagcaataaaaatggagggtctttgacttgaaaattcatttattatgataacaacttgtaatatttcgtatgtgtattttctcaactggtgaaaaacaaaacaaacgatgaacagttaaatttcactatgtttagctgagtcgtatcaacattccaatcgacaaatgtttttagcctaatgatacattccaaattttgggtgaatttattcatcgcatttgaccctgaagaacaaaaactattattgcgtatttaagattgtggagcgaaattcctgacattctttgctgacttttgggccatcgttttggcagtgtccctcttcaattgattttggcaattgttgaagcccatgccgatgccttaatgggctcaccagttcatccagaaagacaaccatgggaaaacataccaacgcctgtcccaagccaaacctaaaacacatcatttgcgtaattaagatatgttcgttcattcaataacctaccggccaagacctcttccccttgaaaagcgcaagcgctgtgacaacaccaatagaaccacctgccaaaattttaagcgcagtatccgctaaacactggtccagggtacgaccgagttcattttcactcatctttatagccaacagaataaagcaaaaaaaaaaaagaaagaagctaattataagaaaaagccaaataaaatttaaaaatataaaagtatataggttttttacttggaaaggaagaaaagaaagaaaagcatgacttacctgctctttcgaaataaataaataaaatgtctatcaatttttgcaacaaatcgcaaattgagggtacagaaatgaatatagttaaggaataataatattttgttgttacttattacacaggaattttggtttctcaaaaaaggtcacttcaattaatctgtactctcataaatataaaaaataaaagcacaaatatccaagtgaaataaaaataatgcaatattccgagacagtagggcttgtctcattttcaagaaaaaatgtttaagttaaaattttcgcaattttttgagctttggtgtaaaatgcaaattttggaattttcgaccttagttcaaattcagtcaggatgagtttaaaaatatatttacgaaaattggggaccctactgatgccctattttttaccaattgcttacattagactcaatcattgcactactgtaaaacaataataacaaatagattcgtaggcggaacgacccaataaatgtcagcaaatggcagaaagggagtgaatgcctcagaaattgaatttaaagttgaatcctccatcattttctccaaacggattgaagccttctccaaatggattgaatccgccgccctgtccaccagaccagcgccactgatggaattgttggcctccaccaccaccttgcgggtcaagcgggtcttccccagcatcgtaccttaaaaatttgtattttgtacatacaaacaatggttgtacctcctttgaagaaggggtgggagagaacgatttacctcctcctcttctccgggtcggtaagcacatccttcgcatttgcaatgtcaatgaatttgtcctgagcccgctgtttctccgcgtcgtcttggaaaaggtccgggtgccattgctgtgcaagctttctgtaggctttcattatttgacgtttgtccgcatttcttaacatttttccacgtgaacagtgtaaaaagtgttgcaattaatgactgaccttcgaacaccgaggatcttgtagtaatccttctttttcgacagttttagcaatttttgtgcccgattcagttgctccttggctcgtcttgaaccctcgtgagcgttcacagccttttggaagtcttcaaccgccttttcgtactgctcattctgcaagaatgcctcgccacgatctagcaaaacatccaaatcgttttcatcgccatatttcagcacctccgtgcactcttgaatcgcctcagcaacatgaccaagctttaatataataattgaagcaagaattataaaatgcagatgaacaaacctttacgttacacttgcaagtgtgtttgtagacgtccatttgaatttgatcaacctcacgttcaaagcggagaacgctctttgcctaaataaacattcatgttttcatttccaaatatatgtgaaggattagcctaaattattcaatttctcattttagctaacaaggaaacctcgcgaactgtaagtcagaaagtgggtataaatttggtaccactggatagcagtgggtatcgacttatatactgaatttttaat

SEQ ID NO: 10134 - DNA, 2906 bp, Heterodera glycines
  misc_feature (48)..(48): n is a, c, g, or t
tgattttttgcagccgttcatgaggttcagcatgtcagggctcatgtncaagcttaagaaagtttagttaatgaaaactaaataaacagaaaaaaaggaaattcacagcaatttcaaaatccgcttgagcctcttttagatttcctttcttgaacaataaatttgctctctgaattcgacccttaataagaaaaaaagattaattattccttttttcaattaccgctacaaaatcaggcttgagttcaacaactttgtccaagtcgggcaaagccgcgttcactttcccacttgccaaaaaaacggtcgccctgcgataataaatttgataatcggttggatccaaagcaactgcttgatgataatgctagaaaaggaagtttaaaataacatatcgtctaaaaaacacctgaagtgcttcttggaattgtcccttagacagccaatgttttccttgttcaagatgtttctcaatttctttgcgttgcgaagatgctaaaataattctttttttggtttgttataattaattatgaaaataccaaaatgaataagagtgaacgaaataaaagacaaataggaaatctgaagtattggaagaggtagaccaagaacgccaagaggaggatttagccactcgtaattgaaatttaccatatctaaaaagaaatcattaactaaaaatgaaatttacatttaaaaaatgacattaaattgatataaataaaggataaaggaaaagcctacatcaattgcttgataggatacgtaatcgtaagcataatcgatgctaattgaagatttacgctgctgaacataacgccactatttaaaaaacaaatttaaatttttaattttcaagaaatgacttttgagacttgcgatgtgtgtatgtattgtattgtatgtacataggatgtaaccttacctttttttgttttccttcttaaaaatgaaagtcaatgatgtttatgctgcgcagttgacattttctttctatttatattttagatcgcattagcaagtttatatgaataagaaatgataatcgaggacgaaacaagactaaaaacctggatatcccaagtggtggaagacatgtatttttgtttttattttatatattattaaaaaaacaagcaataattttcagaagtgatgcagagcctgatgcgttagcgaaatatgtcattgcattgatcaagaaaccactttctgatgcagacttggagaagttgtgcacagacaaactctctgtatttcttcaatcgcgtaaactcgaaaattcatattttcaaccagaaaaagaccctaataaaatatcttatttttagataccgagtcatttgtgtcacgattgtttgaaacactcaaaagcggtcaatatttaccgaaaacagatgcactgacttcatccgaaccaccaaaattgattcttcaacagaccaaatctaaaattgatcaaaaatctgctgctgagcatgacgaggtttaaagaatggtttcatccatttcgttatattgattttacttagttggtacttactgatggtgaaagtgaccatgatcaggaacgtgaagaaattttacaaccgaagcatacgagaacaccaaaaggtacaaatctggcgttagtaaggtcattgctttacgctcttttagaaatgccacaacagcagcaactccatgccaaaagcgggtgtccgttctgtcttccccccgctccgcttctgcaaaagagcaacaacattcgtcgtcacctcggcgcagcgctgccgctgcagaacataggccaaaagtgcgtgcagcttcgcctccgtctatagttgctaccattgctgcgcaatcgtcagtagcaactgctaaaccacctcgtaagcgcatttcgcccccaccacggtcgacaagcatggagcgtcgtgcggcaaaccgacgtgcgtctcctctggctccattgcggcgccgcgttgtgcttacgggtggcaacggaggtggttcgatgcgcatctcatcttcaactcgccttatggtcgaccgagaacgggaacgacaccaccggggagggaccagcgcaggagggagcggtcgaggaacaattgtcgggagaagtcggtctaagagtagatctccgcacaggtataggtcaagtaccgtctaaaaacaaaaaaaaaattttacaaaggaaggaaaaacgtaatatggtgggagttgaactcgagccgcgcatttcttcgcgcagacaccgctgccgtgactttcatggtaacaaattgtatagcactgtagtgtaacaacagattttagaaaaagggttttgtatgcgtggtgataactgcccatttgaccatggaccggaccctgttgtagtggagaatagtgctttgaaagacatcgttcgcgacaccactatttttgatacttccaccacttacggggtgaatccacctccgcctggtttggaaagcacggttacaccaagtgctatttgtgtcaacaaactttctggtggtgtcactgaaggtgggcactttaaaaatgacgggccgtaagacgtgaattcatttattttgttgttcaggctacaacccagaagctccatccatggataattcggcagcaattcctcaaatagatttttcggttccacctccgccccttccgcagcatttcctacaacaacagcgccaaatcctttatccacctgcaccaacagcttccggcattattccaacatttggtgctgctactgctacgacggctcctacaaatgcctccggtggtggcgttcttccgcttcgttcagcagttgtaagaaacaaacccagccgttttgcttcacctaacagactaatagatttttcatttcatggcttttcattcatgggaataattcctttaggactcat

SEQ ID NO: 10135 - DNA, 3296 bp, Heterodera glycines
  misc_feature (3210)..(3210): n is a, c, g, or t
ccaaccaaatcgaagacagcaagcacccattcaaaatccgtgttttttcgaaaatgttgaaatgggaaatcccctttttgctcagaaccaaatcgtagaacaagtcgttgagaattcacattccggcattagaaatgaaatacagcatccaattggactcgaaattgagcggtacggacgcccgatcgctaattcctctccaatcaccagaatgggaagttcgcataacgagccacacaattcttttgaaaacgcggagtttgaagagataaggcaatttcgggccaggcaactttacgaaaatccacgcggatttcgtgaacaaaattttgtcggagaacaacgagaaaggatgaatgaatttgagcaaaaccatgctccggtcccaaattttgaaagaagaaatgtatttgttggtgatccgcacggaaatcagctaatttttgggaattttgaaaggaacatggaacggaattttggacattttgaaaattttcccggactcgcacgaggtggaaaccaaaatttgaatgttgggggaccaagaatggaacaaattcgagacccacacagagaaagaaatcagtacgaggaacggcatttcatgccaattcccgaaccaaatatgaggcaaattgatggacaaaaccaaaatttggcttttcgacaagtgcagggccaaaattttcaagaaaacatggcgagagtgatgccatacaccgaaggaattcctgatattattcttgaacttcacaaagtcacactttcaaatcagtacgcaaatgtccttagagaaattcctactctttttggcactgaagggagggacaaaatcaacgattttttcaccactcttgaattgtgtacaggagattggatacccgagaaaaagttggaaattttgagagcgaaattaaaggggaaggcatccaaagcattgaatttgtccctacgaaaatttggtcaccaagtgccattcgaagtcattaaaaggggtgacaacccagaacgtcaccggacagaacgtcaccacccaaaacgtcaccacccaaaacgtcaccaacccaaaacggcaccactcaaaaacggcaccacttaaaaacgtcaccactcaaaaaggtcaccgacccaaaacgtcaccaaaattaaaaatcacttaaaaattaatttttggtctctgatcagctatgcttcagtcacagatttaaggatagccaatgtatggtttttgatctacaaatttgagagaaaattaagaaaagagattatagaaaagtttataaagctagcaattcacttaaattctcattacaaaattattattttgctttattaatatggcttcatttattactacccaaaaaggagcaaaaaaactgctttacgatggttatgcttatttaaaacataaggatggtgctggtggcaaaatttattggcgctgtgatcaggccaaaagttcggccaaatgcagtggttttgccattgcaataaacgacgaaattactgtaactaaacaacataaccacgctccatctccgacacgtattgaagttcaaaccattaaacacagcataagagtgaccgcagctgcacaaccagcaactccacctcgttcaattgtaaatggagcaattcagggctctagcgatgctgccaaaatacagctcccagaattacgacacatgcaaaaaactgccagtcgaattcgaaaagccaatggcaacttcaaagaaacaccgaaatctttaaaagatgttgaaatccctccggagctccgtcgaacccgcactgcttcacaagaaggctttgtctttggcgatacaggccctgaagacgaacagcgtatcatctcacttgcttcaagaacggacataatcaggctgtcgagttgttcggtttggatggcagatggtacttttaaatcagctccttcactttggtaccaaatttgggtcatccatggcttatacaaaggaagagttctcccttttgtatattttttattgccatctaaggtattggttgaaattttgcatatatttaaaaattttcaaataattagtcagaagaaatctactgcagagcgattaattttcttacggattgtatccagaatgttgtgcccaattccccaaagccgaaaatgatctgcgttgactttgagatggctgaaattaaggcttttcgtcgtttttttgatgctgcaacaattcatggctgctattttcattttatgcagtcaatttggagaaatattcagagttcaggccttgcagttccttacaaagaacacgaagaattcagagtgtcgctcaaatgtcattctgctttagccttttgttcaccagcggacgttcgagagcgatttatcggcttggcaggcatccataaaacataaagaaagaaaatttttaaaaaattataggaaatattgttgacaaatttggacataataatggtgttcccgaatttttggattattttgaacggacgtggattggtagaggattcgccacccgcccgcattgtatagtagggccgaatatcaagagcaaaaccaacgtttactcaatgtgatcacggaatatgatcaaactgagccatttgaatttttgaaaaagtgttcatgtttcgttcatttcgttgaataattttttttaaaagagtggtgacgttttgggtaatttggtgaccttttatctggtgacctttttgagtggtgcctttttgggttggtgacgttctgggtggtgacgttttgggtggtgacattctgtccggtgacgttctgggttgtcaccccttttaatgacttcgaatggcacttggtgaccaaattttcgtagggacaaattcaatgctttggatgccttcccctttaatttcgctctcaaaatttccaactttttctcgggtctccaatctcctgtacacaattcaagagtggtgaaaaaatcgttgattttgtccctcccttcagtgccaaaaagagtaggaatttctctaaggacatttgcgtactgatttgaaagtgtgactttgtgaagttcaagaataatatcaggaattccttcggtgtatggcatcactctcgccatggttttgaacttcatacgtgtcggagatggagcgtggttatgttgtttagttacagtaatttcgtcgtttatttgcatggcaaaaccactgcatttggccgaacttttnggctgatcacagcgcccataaaaatttgccaccagcaccatccttatgttttaaataagcataacccatcgtaaagcagttttttt

SEQ ID NO: 10136 - DNA, 1378 bp, Heterodera glycines
ataaatgggttgttgctgtagctgttgttgttgttctggttatgttgcagcgacgacggtggcgagtactgtgccgtcgtcacagtcgctgccgacgaaggaacagtcgcgccgcgagcagtcgccgcaacgaccgccatggcattcgccagcgtcgctgctgctgtgttcccagtcgccgccgtcgccgccgcgttctgttgcaactgctgttgttgttgttgttgctggcgtaacagtatgttctgcagcaacagttgctgcaattgctcacgacttgtgctgcttccaccgccagaagttgcggtgccaatgccattcgcggcgctcaccgcttgcaacaggtgttgcgccgccgcggcactactcactggtgtgggcggggaggtgttgttcaacgcgttcaggtacgtgccaatgttggtggtgccgtcggcattactgttgccgctgctgctaccgtatgaagtggcaacggttgccaatgccaacaacgagttcaagcctatagaaaaatgcaccaaaattatgcaatgaatcatcgtgaacccggcatttgagtctcatccaatattaccaaagagatccccacaatcccagttgtaccgtatccccacccctcgcctcgattgcgtctcattactgtactgacgtattacaccgtaataccgtatattccctccccccccccaattgtcagtcccattatcaattgtaccgtatcccaccgcgcatcgacggatcaatccatcgtatctcaatcacagcactaccgtacgtatcatactgtccctccctccttctgtgatattttttctcaccggatgaggaaagtgccgcggactgttgcaactgtcgtagctgtgccaactgttgaacaagctgcaactgctgcagttgctgctggcgcttggcctgttgctgctgttgttgttgctgctgctgttgctgcaaaagtgccattgtcgcggcggccgccgctgcggcactcgtcgtagtgacgccaccaatttgcggcggctgtgccgacaggcgcaacggccacgtgcaggagccgtctcatgctgagtgccagctgcacactaacagtgtgctgactgctctcgtgtcacgcgtgacacgcccccgcgggaaagcgcaactttatgccaacaatacggctccatttccgctcaccgtgcgtcagctgccgagacaaattcgcttccaagccttggaaatattgtgagagtggtggctgcttcggttcccctcaccggatccgctcgctctgtggtcggaggaatcccgatcagtctcgagaatttatgaaaaagccatcggtacggatctcgaggtcggtatcccgatgccgtacggtctctatcccaaccatata

SEQ ID NO: 10137 - DNA, 1207 bp, Heterodera glycines
  misc_feature (25)..(25): n is a, c, g, or t
tctctttctctctctaatgcattgntctttctctctctctctctctctctttgtctctttctctctctcctctctccgtctctttccatctgtgtgtccctctcttctctgtaccgtatccaaaaatgccatactccccctttggcccacccattttgtcccaaaagcaattccactccacccaaggaatgcgtgtggttggcacaatgccaaaaataaaaaaaaatgcccatttctcaccgccattttttcgcgctgcttctgctgcaacatttgctgctgttgttgtgccatcatcacgtcctgttgttgctgttgctgctgttgttgttgctgtcgtgccacgatcagctgtgccaatgccgtgatcaacgcctgctgctgttgttgttgttgtgccaaagtggcggaagccgtgccgttgatagcgccagcgtcgccgtcggcacggacgccgatgccgtcgccaatgagtgcacttggaacattggcatcatcaccaacagttccatctccatcggcagcaatgttcaactgttgcagcggttccactccatgctcaagggctggtgacaatgtgaccgcggccggctcagtcttgacgccgccgtttgcctggcgctgaaatggcacgcgtattaatttcttgggatggcatgagaaaagccatgcagcgaaaaaaggcactcttttagctaagcgatagaaatactcagttgtccgagtctcgagaatcttgggtctgccggagaagccggacttttgagtcccacagactctcgtgaaaatcggggaaacccattaaaaatgagaaaaaaacgaatttttttttccatccccgcctcggttcttggcaaaatgtgcgacactttcggtcttatctcgagattcttggcaatctcacggatttttaaataaaattgatcccgactcagtccgggtttggcccaaatgatgctaaagttttcggcccggccctcgtgccgggaatttactctcgagagagcaaatgccaaggactctcgtgccagattttcccgactctcgaaagaaatgccaaagtctcgcacatccaatctcgcctcccgtcgcgtgtccactaccaccaccagcacctggttcgctggttgatgccgtcttcctccccctcctcctgcttcattttgctagttggttagtggtcgtcgtcgtcgtccgtcgtcagcag

SEQ ID NO: 10138 - DNA, 1184 bp, Heterodera glycines
gaagtggcggcgccgacgatggcacgcccagtggctcgccggcggtactgacagtgccgtgctcatttggcgtcgacattttttttgttgcgacgtcaaagttttttggtcggattttggcactttttggacgagcaatttgaacaggaaaatcaccaaaaagaaatcatttgttgaacaattagtaagttaatctgcaaagaaagctggaatttaggcacaatttggtcgagagttttgtgccggcatggtctcgactcagcaaaagtgccaagaatagcgcagaatgccagtcgagtacattggcctcaaggttcaatggcacggcataaaaactaggttgaaaaccaaggggagagggctttttcggaaaatagggcaattaggcatccttaattaattgtagtttaatttccctataattagggcttaattgcctttggacaatggattttaaggcattattcaattatgtaatattaaagtgaatgaaaccaccatcataattaaattttgacaattgtcatgagtctaattaaagtggcaaaattaactaattaattataattaacacctaattagtgcgtgtgtgttttttgggagagggtacaaattgtacaacgtaataatatgtgtgttatttgttatgcgagtaagatggtagacacatgtacatattggagacaaattggcgacgagcatacctaattaccaacggcggcggaatgaatgattttattgatggattaattggggggggggggagagagagagagagagaggtttctgtataaattgagatccgcgtaagaccattggaaagagtagattgagctctacaataacgtatggtatgaaaaaatagttatttctgggacttcttcttaattctcaattacttctccaatgtggtccaaattttatgcccccagccacagccccttgcttctcccaggcttaaggcttggatttgtcaaataaattcgagactcccaattactaatcaataaattctcttaaaatttttttcaacccaattcaaaacaaggaaaaaaatttgcagtcataaaattattcgaatttctcccattttgtttacataatttccgaaagtaattccgtatcataatgccaaaacataccgaaatcgctttaaaatattcctttctggacttgacttggtt

SEQ ID NO: 10139 - DNA, 1512 bp, Heterodera glycines
tgtgatcggtgatttatcctttcatttgtcccgctcagccattttgggactgatttttggagtggaagattgaaatgtatccgtccgtccggcgcagctgattgggattgattttggaggactaaaatcgtgatcggtgctttatgaggggggttgaaatgtgtccgtccggcgcaaccaattaggactaattatgggggggggggtaaaagtgattggaatcgtttaattggacccctctccggttcgtccgactcagatgttttaaaaatattttttttggggggggaggggctgaaatggctcgtgcccattcggctgttttgttatcgtcgccgtccattcccccgccgccgggggccaaagtgtgtagtaatccatcaacatttttgcttagttttttaacggattttgactgtgaaaatgaatgaatgtgggctgatgggtttggttttgggtcgttgccgtcgtccgtccgtccgtccgtcggtcggtcgtcgcccgcggggcgatttgatggacagggcaaaaaaatgggcgcgccattttctgggaaaaacattttttgttgaaaagagcgacggctgctgcaaaaaatgatttatgctcttcgcccaacctttgactgatcaaaagtagtcacagtctcccccgctttttgatcaatgtttggtcataaaaatgctgatcagatatgatgattgatcaggggtcatcagactcaaaagggcggcaaaaaaggcgatttatgtattttccttggtgatcaaggctatccttgaaaagtcatcagtccgctgatcagtttttttttctttcgtcaaaaagacatgctgatcaggtcgacagattttcatggatcaaaattcggaaaattgtgccagtatcttgcaagaaattccaatttgcccttgaatagtccttgggagttcggcttttgtgacaaatacaattcggtggtcttcttcagctctactcaatttgtctttgatcagtcagccaatgaaattctgatcagcacagggcctccaccaaaatggcggaaaaattaatgcgcacggttcttagtcaagcagaacgatcagcaggttgacattaacaagaagtgatcagggcaaaagccaaaaattgatcaattggagtgatctggtatggtatctttgatcaggaaagggtcagtgaccaatggagagggagggagagactgattgatcaagcaacaataaacaaagccgaaaagcctgtttttgatcactgaagtctcgtttcagccctgctgactgatcgaaggcaattctaaagttttttacatattgcactaatcgaaaaatgatcagacagcagcccacttatgcataatgatcaaaatttgatcagatatcccaagtgatcagacacccaaaaatcggacaatttcaaaaaaaaaattgaatttcctctaaaaatgagtttcataatttcaatcgtccaaagaagcgcaactttgtttgtgttatgagcagctggagttgg

SEQ ID NO: 10140 - DNA, 5321 bp, Heterodera glycines
  misc_feature (1688)..(1688): n is a, c, g, or t
  misc_feature (1724)..(1724): n is a, c, g, or t
atggattataaacatctaatagatattttaatgtgtattgtttttaaaccgaatactaattgtaatttgttgttttttttgttgttgaggggacaatggaccatattttcatgctgtgtttgtgctatgtatgatgacgtaatattattatatttattactaattattgtttagtaaatgcgaaattcgctctaatttgatgatgaaaaatgtcacccattttcactgtcatattaatcagagcgccacgtgaccagtgggtcgagtcgagaattcccggtcccgtagcatccgatcttttttaatttcaactttggcgatgatgttggcattctgttttttcacacagcgagtctttgacaaaaaagcaaaattaaaatgaattctaaagcctcaagaacagactcgctgtggaatttcgtattttacataaacaaaaagcccttttcatgtgattgcccgatcacccactcctctctgttttgggtgtgatcagaggaagccctttttcgatcactaccgattgatggtcagtgaaaatcactgctcgatcacaaccaaccggcttctgctttctgctgttgataataatcaatcataaactgtgaacactgtttttttacacatcccacaaatgttgttcaaaatgataaaattgatagggtttgatttgggacgaagaatacaaaattaattatgtctgaaaatggaatttttttttgtatcgatcccttccggcgaatttgttcagtcacagcgtcgttcaattggtgtcctttttcgagttcatcatctaaactttgtcccgatttaaaagttttgcctgcccatgaaagttttgttgtctaatatttgtgctgacatttccccctttttatgcaaattcccatataaaaactagcaggtgtttcagtttatgttttggagacaggcacataatcaaaattttcccatttcttggaatgaattaaaaggaaaaaaggtgcaatttttgaaaaatatgtatcaattccacaaaaaaagggatcttcgggttcgccgcctctccatttctggaccgtaaaggcgcctaaaacggcgaggattttcatttcctagccattgtgccagatccggcgtctggcgccagacaaggcctggtatttctgtgtgctttccaccaaaaagtgccggtcctaccccaaaccaaccgatgaagtggaaggaccagcagcagcagcagacactggcacatcatcgtcttcggctggtgcctttgcgtggccggatgtcgacggtgcagcagccgcttcttcctgctgcggcgtgtgccgtgcagctccaccaccccgtcctgtggtctcatcctcctcctccttgccgccctggccaccgattgcctccgcgatgcgacgccacaccatgttcaacagcttggagtcctcgtggatttccgacccgtccatgttgaagcgctgcaaatttcgggggcgatttttatttagtctttttttgaaaattttgtgaatccaaaattgggcttataccatttacaaaaaattggaggcacggcgtgcatttttttctatttatttgcaatttttagggtacccacattttgacataggccaaatttcgggcccgaaaatatttgaattgccatccctaagcatttaaataaaacgtaaaatggaaattccctatactanacatatagtgatgaatttagtcacaatttttcttanaaaaataaatctcaaaaaaagttttcatgacacatacactcttttgttagcatatgtacctgtgcattttcgcacagcaaatccacgtctgcgctcattgggccaacattgtgtattgtcctcctcaattttcttccgaatccgttgcaggtccattgggcgttcaatttggtcataatagtcgggatattcacgccgggaaggcaactgcacgaatgggccggccaactttttgccattgctaaacattcgaaggatatttcggataaactcaaaggatcgattaggaaaaatggccaggttcgggatctaaatcacggcaaaatcgatctgggatcaatactttttcaaaattcatggctctggcaataagtaatcagttctggcatttatttaatgccatttaaaattgaaaaaatatccataaatttgaagccgatcgcaattaattttctggacaccgaaaaccccggggtcattaatgtaagaaatactgaattgtatgtccataattctagaaaatttgcccattttctcgaaaccggtaaccaaaacacgccgtcgccgctccccctcgtacctcgtcttgtagttgagcagtgtgttcaaacatgcgttcagcttggcgtacagtttggggttggccggcgatttggtgacgcgttggcgctttccgggcccgcctccagggccacggcgtcccttcggcgccgcatcatcattgtccgagtccgcctgactttgctgtacacggagagggggaaaaatttgtttaaaattttcaaaaaaatttttttttgttttccgcaaaaacggtaaatccaatgccatgcgtaattgttcttgtgccgtgtctcatttattgtcagttcaacccattcattgtttgtttgtgtgtttcccacctccaattccaattgtgtgccttttgctaattgtttttttttgtgggatttaccgaggaatttttcctgtttcttgtttctcttttcttcggcaacacctaaactaacaataagttagcaatattgtattaggtaattataaaatttgtttgtttgtttattcgtcatcccctgggggtgcccattttgcccggaaaatacggcatttgccgggtttcgggagtccataccgggtttttgagtttcggaatgacattcatgacacattcccaatgtgacgcgcttccagtccctaattaaaacgaaaaaaccctggcatttttaagaataatttagtaaacgcaccttaaaattctgaaaaatcgctaaaaacgaatcttttttttaaatttcgaaggggggggaacgaactgctcacaaatctcggacccaattcccgtgccgtggactcgaactacaacccaaaacacacacacgaacctcctcttccgggggcagcgccttcttgcgctttcggccccgctgttttggcacagtggcgccttccccgccggcaccggtcgttggtgccgtcgacgccgacgtgcccggctcgcccggcccgccgtcggcgcttcccttgcgagcgcccgccacggggccacgcttcttcttttgctgctgctgttgctgcagcgcttgttgttgttgctgctggtgatgtgttggcggcattggctcgtcgtcgtccaacccgtccatgccgccctcctcatcccagtcaagttggcgaagccagtcccgatccgacagcaaatcctaatggataaagaataagataccaaaaaaaaaaaagaaacgtacactgatttgaaaaaataatggtaaaataaggagaagggatttatgtccaggaaatgaattgctttcttaacccgtccgacccgtgggtgccatcagagatgtatgccgatgcccccaaaaattttgtaaatctgaaatcgacattccgacagacatatcccaagtggtagtttcatttcgatattttccaattaattgaaatggatgattgaaaaatgcccaaaagttgttgccaccattttcaaactgttcagacagtatttccaacaatttctcgtatacatttcataatttgtggtgtccacctgtgagtagttgacatccttgcgccttcgtctgcccccttccgtaaaggctggtgccgggttgctgttgctgttggcctgctgagcggccgcggcctgtggacaaatttaggggttaaattttacaaaaacaggatttaatgtgacattacgggcggcttgagaatgtgcattgggaaaatttttttttagaaaatacggttttgagtgggtgcaccccaaaatctcgccggccgaaatctcgccgagacaaaatctcgccggccgaaatctcgccgcagaaatttcaaaaaaaaaacttcaaacagaaaatttaaagaaaaaaattgttgaaaaattcttcagcaattttttttgaaatttactgtttttttgaaaaattttcaaaaaaaactaagcaaatagttttttttttggaattttcttataaaaaaattttctaaaattttttccttgaaaaacttctaagtttgaattttttttttgaaatttctgcggcgagatttcagcctgcgagatttcggcggcgagatttcgtcccgtccccgttttgaatcccgatttttttttgagggagacgattcacgggtctcggagtaattttcagtctcgagcaaaacaccaccctcgtgccaaccctctcaaccacagcacctcctcatcctcggtgaagcgacgactctgttcaatgatcgtcttggggatttcgtcctcctcaatcagacgcggctttcgccgacattccatggcctccgcgcggcgacggtcaatgtccattttctaaaacggcaaaaaaattttgaaaattttaaaattcatccgtccacttggaagatctcaaactcctcctctgatctggcgatcatctgattgatcacttcatcatccggcacctcgtcctcatcgttgtcatcattttcggcctaacaaaattggaaattttgatcgtggattccaataattattaaaaatgccaaagtttcgaattgcctgaatgatcgcctccagcatcactcgtcgttcggcgccggtggaccgctggtcaaatttcccggcttggataacctgtggagaaacaaaatcaaaacatcatctagtgtacatctcctcaaaaccattttaggggtacatttccccgaccaaattttaaaatttttttcaaaaaattaaaaatttcatgaaaaattgcattttttcggacccaccttttcgtcaacattgagtttgaagcgggcagcggccaagatcttctcctccacactgttggcggtgatcagacggagcacgcgcacttcacgcgtttggccaattcggtgggcacggtcttgcgcttgcatgtccttgaaattgacagtttttacatttttttggcgtccaatggttggtttcacccgccgaaaatttgcgaggatttttgcctttaaaaaattcaaatttccaaattttttatatcttaggagacaggacatatccattgtttctcaatctgtacgtgcgcccattagaaaatagttataaaaaataaatcgtcgcattgaatccaa

SEQ ID NO: 10141 - DNA, 1358 bp, Heterodera glycines
gaaaaggtcgcgtaattgttcgctcactgacatgtttgctgtcaatgagcagtcccttctgcaagtgtttgtagaggaggcgttgcagcgcactcatgtcacatttgatcacgtactccgtcttctcgggcaactgggactccacctgaacacggaaggaagacggattaaacatgccaaacattatttacaaatttaaatggtatttttaatgaatttatcactgaaaaacattgggaggaattagaaaaatggaaaaaagaaatgaaaaatgtcaaaaatgaaaataatttcatgccatccttggctttatgccccaaaacccataaaataaagtgcccaaaacgcacttctttcttcagccgacgcaaaaggaacggacgcaacactttgtgcagacggcggatgatcagcatcgtctcctcctggttcagctccaacttctcgcccgtggcggcgaagggcgcgttgaacctgagaatatatatatatatgaatgaggaattatacaggaatcaccatcagggacggtcccaggattttggcttggggggggggcacctccccccgtgcgacgacctttttttttttttttgcttttcacacccgttttttatgtggcgcggtttttccgaaaaattttttttgggggacaggggagtaccggagcattgagactccggtgggttatgcatggcttccgatggtcaaaacggattctcgtggccttcctcacttcgtcatgtcggacaaaagtcaggagtttgaacttccagtaactgccaacttgtcttcaaaatactacgaatttaagccattgtcctcttctggcacgagagaggtgcgtcatttaacaaatatttgtttcaatttataaccgacaggtgtcccccaattttgatctcaaatttgttgaatatggtcgtcctctattccgcgttcgacttcgactcgtttcgtcagtattcaccaccgatgaacgccttcaaaacttttttcaattgtgtcacctgatttatccgaacataacccagtccaaccggaaccctttgatgcaactacccaattcttcatcgaatcgtaacttcaaacattcaaccaatatgaatttctatgccaacaacgcctccaaaaatggatgctctgcttctgatatccaagacgacagtttgtccccaccacattttgctattgaacgtgatttggttgaatcaattgaggtagcttcatactttcttacaattatatattcggataaaatatctcctagttttcaatttaaagggatgatacaaaaaaggttcctttgtttaaaaaatggtatcaattgaacttgaccagttggattcttttcttgg

SEQ ID NO: 10142 - DNA, 1851 bp, Heterodera glycines
cggtggcaatcgccagacgcacggcacgcggagacagacgtacatcaacgtcagggcagcatttgtccatgtgctcggtatttgttgagaaaggcaaataaacaaacttcgaattttgaggtgatctgatccaaagtgtcggggttttgttcgccggattgctaatttattggaaagtaatttcgaattttatttggggcaattaactaattacagccgaattggcacattctcgacccaatttgcacgttgcttttctccgcaattgttctcagcaccaccatttatatcatccgcgatgcgctcgttgtccttttggaaggtccgctttttatatcttcttttatttatttcaacttttttaggtcgtccgtcgaccatcgattttcgccatgtttttggtaatccaaattttttgcttacaattaacacttttaatgagtttcagacgcacttgagcacattgaaggggtaagttactaattgttccttcccctttgacagcaaaattaagcattcgatttttcctaagatttccgcttactcgtggacaaaaaaataataaaataattcacaaaggaagcaaatggataataaataacacaaataaagagaagaacaattaatagaatcgcaaaatataaatattatatctatattaaaaaaaatgcaattttaagaaatatataaacttcgaatatgcaccaaatatccaataaaaattttttggaaatataataattaattaacaaataattggttttcgcacttttttcggtcagaatagaccgatcctttcattaatcgttcaggtcaaaaaagtgcatgaccttcgaatttgggctctcactatggacaaaggttgttttttgtgaaaaaataaatttttaaattttaattaaattatttttcttatttttacataaataaatgtgaaaatgacttgaatcgtttctttggcagttgcaatttcggtccatttggaggtcgaatcggctgcggactcccaacaaattctgagggccaccactttgatgcttcgacgcgacttcaacgtgcacgagtcgaccattcaaattgagggctatcagcccgaaacggccaattgtggccaatgtgtggtgccgacaaagtgaaaaagggcaaaaacggaaggaaaaggagaagagagagaagcagttaaaccaagcataaaatgaagaaaaaacaactcgagtttttgttgactctttgaaaatgttaaataaattaaaggcactaattaattaattggcgagggaggtaatgatttatctattttctaccattaaaattaaccattcaattcactgttttctctacaaaaagtgatcgatcgttcgattagcttttccctctttttcgctcttcaactgttcgttttgctcagctcttcccgtccgtccgcttctcatttcctttcttttttatctccagagggattactctcgaattttgcgatgaaattttgaatattttcgccgacaatccttcgccgtttgcgtccttttccgaaaagttccgtgccaattgcttcatttcttcacatggttggcacatgcaattggccttcgacttcgttctgatcagtgccatgaggtcgattttgatctgctccttcacttccttgttgaattcccaaattgtttggtttggctttttctgctgtttgtctctctttggtggcgacccgaaaatgcccttatgacccaacaaatgcttcttcagctcattccatttgttgagcatttcccactttttgcacaccttcaaattatgatcattgatcagaaactcaaaaaccaacagaaaaaagagttttaaattctcagc

SEQ ID NO: 10143 - DNA, 3324 bp, Heterodera glycines
  misc_feature (2107)..(2107): n is a, c, g, or t
  misc_feature (2138)..(2139): n is a, c, g, or t
  misc_feature (2181)..(2181): n is a, c, g, or t
cgtcgtctttggcgaagctttttgcaatttccttcaccgtttgctcgtctttgtcctcttggcccgcttttcggttgggactgttctttttgcctatttttatcggaattggattagtcgccgttttggatggcgattccatggctaaacattagtttttttcgaaatcaaaccaaatagacttaatggcaattctaaacaaataacctctcacggaaattacagaaaagacaacgcagcaaaagccgagcgaataaagcagcgaagcatttttaagaaaattaattttgtttattttatgcatttggttaatttttaaaaagaatgttcaaatgagtgccactgaaagctatggccttataaaccaaaattaatgcgtctttcatctgcatttacgtaaatcttaatcattaatcgcttaaatggtcatattatgtaattaattgacatattttttcacatttataattattatttataaatgcttttgcttaatatttatgacgttaacatccgccgagaatgtgtaaaaaataaaaatgtctgtttgcaaatgtaaaaatgggcggaaatattttgaagttgaagtttaaccgatttcaagcccttttaaaatgtgttattcttatcatttgtaaggatcaacaatgaagataaatggatgagaatttaacaaatacaatcaaagagaaaagaataaatgtgcaagtgtggagatttctttctcgacaattagtgttttcaaaatcatcaaattaattcacaaaaagcgtccgcgaccgacgaccaaatgaattactggcgacgggctttttaccagagaacgtgcttcggcgacagacatctgaagggaaatgacgagtaaactattttaattttgcacatacattcactgtcgactgatgttggatgaagaacacctaattattttaaaaaataaatgtttaaattcaaatatttgtgcaattccttacccggtcaccttgcatcaaatggccatttttactcgcaatggacccacccgttacttgatgaacctgaatatttcgcaatgttttcctttcctactctccaacaataccaaaattgaaaacggcgcatttgctggctttgatctctctgccatcgtgcgcaataataagccaacggcgccctcattaattccctgcggacgatgcagaagcacggtaataatgcgatattgtgagtagtcatcgaagctgagaacatttcggatgatagccaactgaaaaagcaattctgggtttgagttaagcttttcgcctgaattttggccctggcgaagtagggataacaaaaaacagagagactaacttcgtgttgcgatggctccatcagtgctcttttgcggcaatatttctgctgaggagttagcgcacagtcagatgaatttgacgcgatggttgttgaagcagatttggtgaccggaaggaattgggattcgacgctggtcgacggactttcgcttgttggcatcggcggtcgtccagatccaagtgccgacgcgatggttgttgaagcagatttggtgaccggaaggaattgggaatcgacgctggtcgacggactttcgcttgttggcatcggcggtcgtccagatccaagtgccgacgcgatggttgttgaagcagatttggtgaccggaaggaattgggaatcgacgctggtcgacggactttcgcttgttggcatcggcggtcgtccagatccaagtgccgacgcgatggttgttgaagcagatttggtgaccggaaggaattgggaatcgacgctggtcgacggactttcgcttgttggcatcggcgatcgtccagatccaagtgccgacgcgatggttgttgaagcagatttggtgaccggaaggaattgggaatcgacgctggtcgacggactttcgcttgttggcatcggcggtcgtccagatccaagtgccgacgcgatggttgttgaagcagatttggtgaccggaaggaattgggaatcgacgctggtcgacggactttcgcttgttggcatcggcgatcgtccagatccaagtgccgacgcgatggttgttgaagcagatttggtgaccggaaggaattgngaatcgacgctggtcgacggactttcgcttnngtggcatcgcggtcgtccagatccaagtgcatcaaactgtanaacattcatttctagtaaataggaggggatagtaaggagaaaagggggaaaaagggtcacgcatgaaaccatatttttccccattaaatctcattcaaccgtttgggctttcggctgaccttcttgatcagatagtctatctttctcggttgctgcctgccacttgttgtcactgttcccatgctgcacgttctgttccgcgctgttttgttaattcgtctgtccatctcgtcaaatattcgcgtatttggagaaggtgtcgtcggagttattgccgaaaacaataaaacagtctcggataaaatttgtggatggtgtgctggaaaaattgtaagattaacattaaaaaaaatacttatcctataattaattattatcgagtttctgacttttagggcaacgcatacggttgcgggtgtaggcatggacaaccccggggaaaggtacaaatgaaccgtactccccttccccaagtgggtaaagtcggctctactgcagcttacgcgtcaaaccaatgaccacataccttatcaaacttacattcttggtatcaagcgaaaacttagtctatagaattatttatgtaaatacctaagtcaaaaatttattcaaatggaattttggataatgattttttcagtgccaatgtttgctctttacttgtatttattaattcccgagacctaaaagctttcttttgataccaggaataggctttgaccaaggaagaaaaaagatggcctaagaaactgagatggtcattgattggaaagtcgattggatgataaattgccgtaaactattttttattaactatactactaattcgatggtgtaagtccccattttaaattggactatttattgacacgaaaacttgcaaaataataaaaaataagaaaatgatgactgaaaagtaaagtaaacaaaagaacatatttaacggggacccgcgcgtttcggcgctcccgtttcggcgctcgcgtttcagcgctcccgtttcggcgccagctcgtttttccacttaagcttttttctttggcatctaaatctaacaatcttggtatcattcgaaagctcttaacatgctctattagccttatcaaaaacgaaaagtttttcaagcctgtaaaaattttatta

SEQ ID NO: 10144 - DNA, 5608 bp, Heterodera glycines
attgacaggtacgaatgcttgaaagcggtgagaggggatggtgaggacttcagacaattcgtaaatcggcacaaaaagctgctgtcggatttcaaattcgacgacttgaaaaaggagcaatttaattgtttgatgttgctgaccgcattgaaatcgccaaacgacgcagttttaaggcagcgaatccttgctaaattagcaacggatggcgacaatgtgaggtatgacggagtcgtcgaagacttgataaactatcagtcaacgatttcggaagcaaaggcagtcgaaatgccatcaaacacgcgtgctgtaaatgccgtgcagaaaaagggacaaggaaattccccgcaaaagtggtcaactgaaaagacacaaaacaacgcagctaaaatgaagtgctggcgttgtggagaagaacgacaccggccggacgattgccggcacaaaacaacaaaatgcaataagtgcaattttgtaggccatattcagaagcaatgcgaaagcgtccatgcgtggtggaaaaagatgaagtccaagagggctacgacaagcaaagtcggtcatcttcgcattggcatggctggaacaacgaacaccccaaatacggcgctcaaggttaagattcggatgaaccgaaaaccagccaaattgtatctcgacactggatcggacgtcataatcattgacgaagggacacatgccagcgttgggcacccaccgatcaaagagtgcaatgaaattggaaaaacattcgatggcaaaagagtccaattcatcggaaaagggactacaacgtttgaattaaacggccagtcgattgttgaggaattttatgtggccaagcaagggtcactaaatctactgagtcgccgagcaatggacaaatttgggctgttaagggaattaaggcagaaaatcagcaatgcggcagtgaatgcatgcacagccggcaacaaaactggacaaattatccctgatggcgcatcgcaaattgacggaaacgaagctaaaatctaggtactataatattgcttcaccgatgagacttctaaaggaaagtttatttgctttaactcttattcaaatatgaatttaatggatttcaattttacactgattaataatcttttccgttgatttactgtatttggtatgaaatagaccgataattgtttcgtgattattaaatgagagccataacaatatcctaccatatggagtgggcagctccaattttgattgcgaaaaaggccgacggatcagcacggatgttcattgactattcaacgggattaaacgacacgcttctcgactctcaacacccactgccaattccagaggatatttttgcaactctaaacggaggaaaaatattttcacaaatcgatctgcgtgatgcctatttacagatcgaattggacgacgaatcaaaattattatgcggtttggcaacgcataagggaaattatcgcatggagcgattgcccttcggaataaaaacggcaccagcaattttccaatcgattatggacaaaatgctggccggattgaattatgccaccgcttacctggatgacataattgttgtcagcgggacaatcgaagaacacactcaacatttgaaagaagtgttcacccgaatccaggcctatggactccgagtcaaattggaaaaatgctcatttttccgcaaccaaatcaaatatttgggacagattattgatcggaatggtcgccgtccagattcaaccaaaatcaaggccatcactcaaatgccggcaccaataaacatttccacacttcgctcatttctcggcatggtgaatcattaccaacaattcgtcaaaaatatgcgtttcatccggaaaccattggacgacatgctgaagaaggagaatgaatggaattggtcggaaaattgtcaaaacgcatttgagaagttaaaggaaattttgacttctgatttactgctcacacattacgatcccaaattggagattattgtggcagccgacgcatcagaatttggaattggagcggtaattcaacacaaatttccgaatggacaggtcaaggcaattgcgcatgcctccaaatctctctctcccgctgagaaaaattactcacagattgagaaggaaggacttgcgctcattttcgccgtaaaaaaatttcataagatgctttacggaagacattttacactgcagacggatcacaagccgttactaaacatcttcggcagcaaaaaggggatccgccaatgcagtgcaaatcgattgcttcgttggtcattgacacttttggcctacgatttcgcgattgagtacatcaacacgaaagactttgggcaggctgacgcactctcgcgactcattgccaaagacacaagcggtgaagacgaaagagtcatcgcttcattttgtgttgaaaaagaaattgaactcaatttcgacacgaccattgaaaaattgccgatcaaatttgcagacctcgtcaaggcatcggaaaaggatgaaatcatccatacaagtgaaaaatttagtcaggaatggatggcctgacgaacgccaattgaagactcgaatcggaggcaatccagcttttcaacagacgaaaagctgagctttcaattttaaaagaatgtctcatatacggagaaaggattgtggttccaaaaatttttcagggaaaaattatgaatttgctgcacaagggacatcctggaatgaagaggatgaagcaattggctcggcaatacgtctattggcctaaattggacgccgaaattgagcaatttgtgcaaaattgccagccttgtcaagacgcagcaaaagccccaacaaaaacgaacttgcactcgtggccaaaatcgacgagtccatggcaaagaatccatgttgattatgccggaccatttttcgggaaagaattccggattgtcgtcgactcattttcgaaataccccgaggttttcgaaatgacgaccaaatccgcggccgcaacaattgatcgtttgcgttatctcttcactcgtcatggaattcctgagacgctggtgtcggataatgggacgcaattcgccagcacagaatttgccaaattcatggccaacaatggaatcacacacctattctcggcaccgtacaatccaatgtcaaacggacaggtggaacgatttgtggacactttcaagagggcttttaagaaaataaaaagggagggaacggcaaataaggaagtaatcgaaacttttctgatcacttaccggacgactcctaatgattcgctctcggaatcaaaatcaccagctgaaatgcttctcggacgcaagccgcgtaccacgctggatctgctcaagcctcctccaccaaggccaacggagagagatgagaaaatggagcgaaatttcaaccgaagatttggcactcgtattcaaaattttggacctcatgaaaaagtttgggcccggcaccgtctatcgcaaaattggaaggcgggaaccatttttaaaagcgccggagtgatctacaaagtgcgatttggcgatggaacagctgggcgcttccacgcaaatcaactccgcaggcgtcagacatcaactgatcagtgcccattaaatgtttttaatgatgcatttaatttgccaattccacgggaaaatttggaagacgggcaggaccctcaaaatatgcctgaccctattggggaaccggacaatgttgtggaacaacaaattgtagaagagcagcagaacattccgcaaaatcgccgcagtcgatcgccaccgccacaacaggtgcaacgtcgttctgatcgccgccgaaggccacctgtgcgattttcacccggatgagaagacttaaaaggggaggtgttcgggtggtaacacctaaggaccaaaaggaagacattttttgttcttttgttattttcttttgatgtctcactctctctctgttccatagtctctaatcgctgtctctgttcttctcgtactctgacctattgattaaatgtccatccttccccatgatgcattcattcatggtctgattatatttgttgttctctcttctccaaatattgtgcttctccgtccaatttaatttatttatttgttatttaattttcttcaaataaatttgtttgttaaattgtttttgcttcggtgtcaagaccgaacattggcgacgcccgtgattaaccaaactgtggactgccgacaattctgatctgtcgatcatacgattttgaaatcagagatattttgcgctgctgtcttagtaccttggcgatactaattcagctcatccacgcgcacccacttgtttagcatcttggcgctgttaaacaataagtggtgaacgacaatttcggcacttcaaaaaccccgaacagtgtggtttgatcattcacaatggcggcaaatgtcaatctccaagatttgatcaatttgatggcccaacagcaacagcaaatgcagcaacagcaacaaatggttcaacagcagtcacagcaaattgcgcaactgctgaaccaaaatgcaccgaatgccgcaggattggcacagccaaatctcatcaccatcatcccggctcttcccgacatttcgccgttcgaatcaaatgatgaacgcagtcgcgtcgtggaatggctggaccgtttcaagtttgcgctcgattgtgctgcaccgatggccaatgacgaaatcaaagtcaagtgcctgatgaacaagctgagcgaaaacgcattcagtgagtacagccgatcagtgcttccggccgccgtcaccgattttgattttgcgacaacaatccaaaagctggagaaattgtttgccaaacctcagtcaattttcattgacaggtacgaatgtttgaaagcggtgagaggggatggtgagaacttcagacaaatcgtaaatcggcacaaaaagctgctgtcggatttcaaattcgacgacttgaaaaaggagcaatttaattgtttgatgttgctgaccgcattgaaatcgccaaacgacgcagctttaaggcagcgaatccttgctaaattagcaacggatggcgacaatgtgaggtatgacggagtcgtcgaaggcaaggaaattccccgcaaaagtggtcaactgaaaagacacaaaacaacgcagctaaaatgaagtgctggcgttgtggagaagaacgacaccggccggacgattgccggcacaaaacaacaaaatgcaataagtgcaattttgtaggccatattcagaagcaatgcgaaagcgtccatgcgtggtggaaaaagatgaagtcaaagagggctacgacaagcaaagtcggtcatcttcgcattggcatggctggaacaacgaacaccccaaatacggcgctcaaggttaagattcggatgaaccgaaaaccagccaaattgtatctcgacactggatcggacgtcataatcattgacgaagggacacatgccagcgttgggcacccaccgatcaaagagtgcaatgaaattggaaaaacattcgatggcaaaagagtccaattcatcggaaaagggactacaacgtttgaattaaacggccagtcgattgttgaagaattttatgtgg

SEQ ID NO: 10145 - DNA, 2392 bp, Heterodera glycines
tgacttggtgtgataaatcgtatgcgggagacgattctttttgaacgggcatcagggctatgatgagccatcacatcgtatcatcgcatcgttgatacgatgctaatttgaataggccccagataaattggcgaccctcatttgcgccaccactcgcctcgcacttttcgtctcgtccttttgatagcagacttttagaccataattttgttgcatcattaggttgataaattatatccaaattttaaatggtttaatgcttaataacttttttcagaagcaattcaattttgatactttatattttagatatagctccaagaatttttattaattactttaaattgataaaattttattgttatcaaaaaaagttcgacaaaataacagttgagtctcaatttcaatattttgtggtaagaactttgtaaattttataagattgtagatgacatggcatgtaaagtcatcgcatgatatcattaaatttgttaacatcgagcaaatttatgatttattggtcccaaaaattgcttttatgatcattaatatttttcacccctactttgcttaacaaaacttttaagtatgcatcaaaaaataagatttcaataactgattgtccatttgctgttgagacgatgccgagcgaacgaatttaattgtgttttgccgataaaaagcaatgatcggggaaaaacgacgacgacaatgttggtccgtataggaggctccggcggtgtcgagaaaatttaatattgtaattaaactacgcaaaaattttaatcatttttaagaaatttaaattgcccacaatttttcaacattttatcctatgttttctacggcatcattgctaacaatttttctaagattttttaataaaattgtccaaatggtctctttttggcactccagctgaagatgcgaaatacagttttaaaatttttgaatttatatacctatttggtttagtaataaacatataatagcatttgtttatgcagtaatgggcacaaacatttcgagtaacgaaaaggctcacaactttgtgttgcataaaatttcacaaatttttgtatattttttcactttttcccttagtttgagaatttacagaaatttcttatgaaaaatcaaaaataatttttttttttgaaaatgttaccgctaaaatcgattttttaaagagaaaacatcaaaattatctattaaatacataaaaccgctgaccaacgaaatgtccaagccacgaaatgtccaagccacgaaatgtccaagccacgaaatgtccaagcctcgaaatgtcaagccacgaaatgtccaaacctcgaaatgtccataagggtaaaaaacacgaaatgtccaaaagtctaaaaagcacataaaaacccggaaaacggatctaatttagggtttttggagtcgctgagtacgaatatgacatttacataactcatttcctaacccaggacccaaatataaatataaaatttcaaaaactaaggattccatacaatatggcgaccaaaattcaaacaaggttttagattcccaaatgatccaaattctatctcttgacaaacttcagatagtgaaaatgaatgaatttattaaacattcaatgaaaaattcattacggaacatggacaatgaatcatcaaaattcccgaaatccttcaattttcctgaatgttcttcatcttgaagaccgattgccgtcaccaggccatggatttatttcaccattgttgttgcatttcgcgtccgccaaaattctcataatgacggcgtcctgcatggtgtatcgctttcgtcacatgcgaatgaaatggcgagcagctcagatcgggcagcgtccatcgtcagtcggtgctttcattgatttcacaaatgaagtccgagagtgcagggtggtggcagagacctttctaaacatatattttttaatttgcctgtagtaaattaaaacaaccataaaatgcagatggattacctccagtccattgtttgtatgagcgagggcagacgtggcctgcgaatgcatgttccaaattggaattgggaagaggggcgcccgaaagatttcctcccacacgtgaactaaattttttattaaatataaacgaaagaatcgtgaaaaaatatatccctgaaggcgttgtttcgaagtcgatagcgcgctcaaagaatattgaacaagctgttcttgtggagtctcacgatggttggccatgtaaaagttgatggcgccggtgagccgatgccgaattgtattggagtagccgcgtagctgtgttctgagttgatggtcgaaatttttgtcactagttcagcttaaaaataattaaacttttggaaatcgatgcaaaaatacgaaaaaaaacatcgg

SEQ ID NO: 10146 - DNA, 2540 bp, Heterodera glycines
gctattaaaatttttctttttttcctcgaaattaaaaaaaaaatttggaaaattacatttttttcgggggaagagagacgacatgggggagtgtagcgtactctaatcggtccactacgctggcagtgtttacgaaacgacctcgcaccgtataattgctagggctcgaaattatatgcattaacatattttttctgcgcatatgctatgaagaaaagagctcaaaatagcatttctacgttaaaattttggctctagtgcactttatgagtccaatcactggtttttatacaataactttgttcatactcgaacaaaccctatctttttggtatcattcgaaagtacagagtttaaatagtgttataatacgagaaaccaagaaaattctaacatttcaagaaagttacaaacgaaaataatatgtagagaccggaaatttcaaatttgcgggtcctgttgcaggattggaattcaaaattttttacaggacaggatccggcaggattaatcctgcatttaaaatttgcaggatcctgcgcaggattgcggattttaggaaatttcaaaaaattctgtattaataaaaaagtctttcaaagtataaaaaagtattcaaatatatttttaaaccaaaaaatgatgaagatttttgcttacactccaaacaatcgactgaatcttctttaatgcgtttaaaaagaccgatttgccaaattgggtggctcataataatagcttaaattaaagtaaaataatttttatttaaatttctttgcaaaaaaagccataatccattatgtatagggatgggatttttaggcacaaaaaatcgcgaactaggcacttaaaaaggcagaaaaatcctaaaataggcacgaaaatagtaaaaaaaaatttattaacgctttttaggtagcaaaacacataaaaattcaattgtataaactttttcgaataaggataagtttttaaacgaaaaatttttattaagaaaaaaattttgaaaaagaaagtttctgaatatttggcattctatttttaaaaattttcaaaaaatcaatgcaggatcctgctgaatcctgcaaaaaatcaaatttgcgtgccctgttgcaggattggaattcaaaattttttacaggacaggatccggcaggattaatcctgcaaatcctgtattttccaaaatatgcaggattgcggactgggatcctgcaaaatcctgcgcaggaccctgtcctgcgccggtctctagtcattagtaatcaattttccacatatatataatacactattaattttacacttctttttcattttgttattgaaatagtgagaaataataaattatagaaatgaatcgaaatacatagtgttacgaggcttgtgcctcttatcgcttgtgaatggcttcagaaagggtgggcattgtgtgccaagtcagttacgctacttcgcctcttgctccattcgaccgatgttgcccaactcgcgctttacattttcggcactgatccttttttccggtgtccaacatttttgcataacatccgcaagaattatgcagtccaacgcgcactttatgttttcggcactgatccgtttttccggcgtttgatcccaacattttggcataataacagcgatttcttcttggcagtctttcggcacacccggatccgcacctgttttgacggcatcgatcacatcattgtcatttgtatagttgtcaaatggaatttcaccaaacgagaatatttcgaagagtagcacaccgtaagaccttaaaatgcagataataaaaatagtattactcgagtttgggtcctattttttggtcaacttttttcaatttttttttggattaataagtcctgaaaacaagaacccgggatttttcaaagtcgcttatcacgaatacgatacttattttcgcctattccgaaccccgaacccaaattcgaacaaaaagtcgaacttttaaaaacttgcttttgtattagaatctgaacaaaaatatccttttttgatgtttcaatgatttgtgaactttttgcttgtttaacacttttagattcgcactagaaaaaggatgctatttaggtacctgaaaatcatcacatttcttaaaatatgcaaatttataggttttgggggtcgctgattgtgagcacgaatccggctaattttttgtcgaaagcaagtcagtgtttgaaatgcaagccggatttgcgattagcaatcccttatactattaattagaataaaaaatatatatggtgccaaaaggcatgagccaattttcggggtaaagaggcagaaaaccgtacatctattggtttcgatggtaaacgttggcctaccaaatgtccgatttgtgcgtgaatttgttcttagtaaaacattctggcgccgaccaccgtgttggcattttggaatggcctatgtagtaatccttcgaccaatgcaaatgtcgtgacaacccaaaatcggatatttaacacaaataggcggtcgtgaggcggcgtctttacaacgga

SEQ ID NO: 10147 - DNA, 3306 bp, Heterodera glycines
atcataactttttttcaggctggccaaattttataaatttggtatcattcgaaagctctacatgtttagaagcttttgataagttatttctaagcgattgaacaacttataaaaaagttgaaacatgaacactgccaaaaagtcagaatttttgcatattttaatttataacttttttatttgtcagtatatctttgtgatttttaggaagccgatagagcttgttaagagctttcgaatgataccaattttgttggatttggtcaacaaagaaaaaagttatgatgctctaaacttggctcagacgcaactggcccgtttcgaattttgggcacaatagtaaggatttgaaaaataaacaatttaaaatttataaaataacacaattaatttgaagcacattaagtttttaatcaaattcggaaaataaaattttaacgacttgtccactcaaagaatagaaaaaatatttttttcgtcaatatttatctcacatatttagtaccaaacttaaaaagcaacataaatatttaatgaatagaggaaaaatgagcctgacaatggaggaagaatcgaattcaaagttaattgatcagagacaatacacttcgaacataatatttagcagaagaccaaattgtgacgaaaacaaaatttggaatgagtcagtgaaaattgaaacggaataataaaaactgacaaaatttttggtcgtatttagaattggaaatgaaaggtcaaagatgatcgcccgtataaacgaattaacaaaaattttaaaagcaaaaactgttcgtttgttgcgaacggcacaaatttcgtgttgtctgatcagaaaagaaagttgaagaatccctttgcggcctgtttaaaggaaaaaatcattggattaacaaacaaaaagcagaaaagaaaagaacacaaaattaatgttatatttcttgttaattgcatactgattcaagagacatgctcaactgaaccatcgcttggtgaaccgcatgctttaaaaattcgttgtccgaactgattggtgggtcgtaacgaagctccaaaacgtcataatgcttcttaaaaacaattaatattattttatcatttaatgcttcagctaaaagttataattgctcgttcccaccggacaataaaatgtaatttaaattttataaaaaacactggaatggcaacactggtgaaataaatattttaaccccagaaatcccggtccggaccaagcatcaagccggggccggttcattttcaataggaattccatttgaaaattatggtgaataacactataattccaagtccagttccatgaataaaacctggttttacatatttaattatcaaaaaatttataggcacaattttttataaaatggtgaggtattgattttttattttaaatcatgactcattcggcaacttctctggatctttctttgccaagaaaatccgtgcaaaggctttttttaatgtcaaaatttaatctatattaaatatctttaaaaagtaaacaataataaaaagcatttaatcagctgtaaagcttcattaggccatacatattaaaaagtgcaaacgaccttgtcgacaagcgtaacgaatttagcacttccaaatgaaattccggtcacttttttgctgatcgcttttgctaatgcatttctctgtaagggattataacaaagtaaactaaaatagtgataaaaaagaattgtaatatgttatttaaatgcagatgaaaatagatttcttccaaattatttaagttatcaaatatcatgaataattaaaattattttaccgatttaataatggtttggtcaccgatgcaaagcgccggatcaattgccacggccacgtaaaaggtcctattggtatgaacagatttaaatgcgtaaatagtctttacatttataatatataaaagggaacaattaataatgaataggaccaacgcgtgcggagaactcgtcgtgtaatcaaaaagagtggcaaacacttcggccaatctttgcgggtcctggtgaattcgtggcacaagaacgcgcatgtggtaacgcgagtttaagagatcggcgtcaattgcctaaagcggagccaattctaatcatttttgaaaacatcagaatggatgaaaagcgcaatgaattaatgaaaaaattagttataattagttggaaaaattaagaaaattaaagagagaaaagcgattagaatgaacggaacgtatgaggcgggagggattgataagatttaaagcatatgaagtgctgatcagagaagatgattaattgccgaacagttttacccaaactgtcagtgggcgtttccaatttttgccatttttactcccggttataaaatggaaaagcaatgagttgctgatcagcagctgtctagcacgcgaatctgtgctcggcacccacaaaatcaactcgtaattcaactcccggggaagacgcaatcgttgttggactttgctgcgtggcattgttttgttttgggtcgctgcgttcaagctgatttgggtcaatggcatttgttgttgcgcagagcaaccgcggtaacacacactgacagaagggcactcgggcaagtcaagcagaacaagtcctatgcgtaagtgtcggaaaagttcattttcaattaaaagcaagcaaaaaataccaaacagcaaagaagaaacatttgattgatttcatccggcagcttttgagcaccgcttcacggacgattgtatttcccggttcaatttataaattacaatagaaaattacaaatttcaaataatttcccgtgactagtagagaatgaaatgaagaatgaacatcgagtttgatgagagaaaaatttgcgcgaattttgtgcttataaatatttcaaaataaaggcattcattacctcgattgtattaagttccatcggtgacgatttgaatagtatgtaaaaacaatccaaagatggcaaaactaaaaaatggaaatgatttgataatgggaagaaattagttaattgtatatattgacggaggaatttgtaatgaatgaaaatgcaaaaaggacaaagaaatgtaaatgaacggtggtcggagggagggaacggggggaaagaggtggcactctctgcccccggcaatttaatttctctgtcgtttttttctctgtccggaattgtcacactttctcttccatcacattacaacggcagagtttttcttggtcctttttaccattgggtcatcgtgttatgtgtgtatcatcacacaccaaatgctttttattggcaagtggacat

SEQ ID NO: 10148 - DNA, 1177 bp, Heterodera glycines
tgttttgggtcgctgcgttcaagctgatttgggtcaatggcatttgttgttgcgcagagcaaccgcggtaacacacactgacagaagggcactcgggcaagtcaagcagaacaagtcctatgcgtaagtgtcggaaaagttcattttcaattaaaagcaagcaaaaaatgccaaacagcaaagaagaaacatttgattgatttcatccggcagcttttgagcaccgcttcacggacgattgtatttcccggttcaatttataaattacaatagaaaattacaaatttcaaataatttcccgtgactagtagagaatgaaatgaagaatgaacattgagtttgatgagagaaaaatttgcgcgaattttgtgcttataaatatttcaaaataaatgcattcattacctcgattgtattaagttccatcggtgacgatttgaatagtatgtaaaaacaatccaaagatggcaaaactaaaaaatggaaatgaatgggaagaaattagttaattgtatatattgacggaggaatttgtaatgaatgaaaatgcaaaaaggacaaagaaatgtaaatgaacggtggtcggagggagggaacggcgggaaagaggtggcactctctgcccccggcaatttaatttctctgtcgtttttttctctgtccggaattgtcacactttctcttccatcacattacaacggcagagtttttcttggtcctttttaccattaggtcttcgtgttatgtgtgtatcatcacacaccaaatgctttttattggcaagtggacattcgcgggtcgccgctcgcgagcggtcgtctgcgaacggtcgcccgcgaatgaccgtccgcgagcggtcggtctctaagctaagctcattgatttgaacacagagaccaaaaaaaatacaccaagaaaaggtgtgcacaaaaatcattaatgattatcctttctcagtaaaatttacctaatcactcaccacagagaccgaaatttgaaaaagtcaggaatcgtggcatcaggccgggatagttttaccggaattcaattcccgaaaatatttaaatttttgcctgcggcaccttttatgtgaaagcaatgaacaattttggatctcttcccgtctgggttttaccttgagggaatcctactaatgagaaaatcttaattttactta

SEQ ID NO: 10149 - DNA, 5039 bp, Heterodera glycines
cggtacttgtgtacagcattcacaaagtggtaatcatccgtttcgtgcagatagtgtacgtctggggttgggtctttgccgtgcaccagcctcatgtacccgcctcgccacggtctgaactctttgagcagctccaactctttttgctttcttatggcctgttgctgtcgtttaagctcttccaactgcttttcctcctcttgctttttcttggtctcgttttccgctctctccgcttccgcctttgccgctctctccgcttccgcctttgccgctctctccgcttccgcttttgccactctctcttcctctgcctttctttcttttgccactctctcatcctctgcctttctttcctttgctactctctcctcctcagcctttttatccttggtctctttctcgcctttcttttcctttgctattctttgctcttccttcttttcccgtgccaatttttcctcccttgccttcttttcacttgcctctttctcttcctttgccttcttttccttggctgctttctctgcagtcttccttctatcttcttcttctgtcttacgacgcctctcctcttcttctcgccgtctacgttcattttctcgctgctttctctgctcctcttcccttcgctttctctcttcttgtgcccatttttcatgccgcaacgtttcttgttgagccgctgattgcttggtcaaatatgaaagtgggtttaagggcgcttcgcccgtattgtcttcttcctcctcaacaaacgagacgtcaagaatctcgccctcctcctcatcgtcgtcgtcaatgttcccaaaacttgcatgcaccggtgcggacctttttcgtgtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgattttcgcccacctgtttgggtaaattatgcctgacagtccaaccatccacccgaccccatcgaacaccaacttctttggcaagtgcactttgaatttgtttgttttatttccaacaaagccaggcgtgttgctcggcaaaattacaaagaaagagtttgtcatttgatcaacaagtataaattcttcaaaatgagatcgtccttatatcatggtgtgccatctcggttcactttcccccatctttgatccagcggaaactctttgccatcgtcgtcgtcgtcgttgccggttcatccttcttttggtgcttcatgatcagatctgtgcagtcaaagttcagcgttgcacagtcttggcaaaacgattgggtgaactcaaggcgttgctgctcgccattctgattgatgagtttgaatcagctgttcccctgccggaaattgtcatcacgacactctttgcacatgaacgtgaacactccgtacttaagaaattttcctatttgttttcaaattaaatattagccaaaaccttggggcgggccaatttccaaaatatggtcgggtactcaaacacattggtcggttgttttttgggcgattcatctactaaaatttggctaattcaaagaaatttgcagaaaaagccaaaccttcagcttccatggcttttgctttcttcattgcggaagcaatttcctcatggattttgtccaagcgaggcttgcgtcccctttttgagggccccggttgtaggtcaagcagtgtttgagtgttgttgtctccaattgtgattacgtcatcatcattttgaggggaaaaattttcccgtttcgactcaccatttctttaaatttaaaattattataaaaaactcaaaaaatgattacttttgttctcaaacaccaattgatcattgatttttctcggggccattacgattaagaaatagtttatgattataattgttaaaagcataaaatgaacctgcgaaaaaacacgtaattattgattgatagtgagaggggtgttagcgcgcagcgacctccagacgggctgtcccttttaagcgataggccacgcccatccacaaacacatagacgagagagtagttgttagagaaagatacaacagggcgccaattcaaacacacagtgaaacccaagccaatttattgattttttacagattatggtactccctctgactgctgccctatccaaactgctaaactgtaaacctgaaaatttagcagaatatttgaacaaccccgaggcggtgaacaaagcgaacgcttacctggccggcaaaaaactcaaaacaacataccagggtcgtgattccaagaccaaagaggtaaagttcggcacattttcggtgaaagccgctacggaaacctacgcctttgagggatttcttggcaagtttccaaaaattcagtttcggtctaacacacatgcgttcagaggttaaagtccaccagtatttctacataaagcaccggatccgcctactgtacccttagctgaagtgcattattgagtaccacaacaagggccactgcaaatactatcccttgccgccggcccaagcttggaagacggcgtaaaagaacaaaaggaaatgactcagatggcataaacacttgtccatttttctattgttgatattctgatggactacccaagaataaatgaaagtgaactcgcttttcccatcccttcggggattattgtcagcggtccgtcctcatcgggcaagacccagctggtccttcgcctgttacggcatgccaacgtgatgtttgacccgccgcccaaggcaataggtatgtgcaaaggggtttctgtgcagtgggctgttgctatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaaattggccgatctgtacaccaaaaagtcacaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttcccacgcgagcagggattcctgatggatgcctaccgacaggcgtgtgccctaccgtacggctacctgttggtgactctccacgcgaacagagacaacattatacgcctaaggacaaacattttcccagacgacgaggagagaagcatttttgcccccaaaaatggttaagcgagaacagaagatcggtgagcgggttgtgcacaactacgactattttaagaagttgggaaagacaacgtcggagaagaagcgccgtcatttgttgaacagtgccggttgtgaggaactgttaacgcttgtcgagatttgtctcaacgttttgaacgggagtttctgtctgagcagaaaacaaaagcagagacttgcgccatttgcaaaagacatcagacagttggcacgtgtgcgaagcgagaggggtgcgcgaaaactagtgcagcagtcaggcggatcactttttgcccctttgttggcccccattctgattgaggctgcccaatacctgctttcgcgcagcaataatggccaataaacttattctgctgccgtacgagcactacaaggggctggttgcagcgagggagacaaagaatgacgacgacgacattgctgagcggacaaacttgggctttgtcaaacgacaggtgaccgctgcagtacagaagcggaagggaaacgtcagcgagcggaacgcaatgtacaaccagcagctgcgccggtaccttaagatgcgcaaggaacataaggagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacactgggaagcagccgatcacccaggaccaataagaaagcagcaaaacagcaaaaattgatcgagaagaaggaccacctgttggccatcattatgtctgatccgcagagattcggcgcaacagaccgtgggaaaatcattaacccaaagacgggccgagagtttatcgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggtgcgagtgccctgtacgcggcggtgaagaagaagcacccaaagttgaagcgtaccgagtttgaagactttttgcagaggaacaccacctacacgctattcaagccaaagagggagaagttacgacgcctacgcactgtgcctacgggtttcatgaccggtaagctgtactggggcttattgcgaacaattcagggttcagatgttcaggcggacttggcagatttccaggcactttcgcgcaagaacagcggctaccggtacctgctgttggcggtggatgtgttgtcgcggcgaatgttcggcgcgcccgtaaagagtaagcgaccggcggacatgaaaagggcgtttgaggagctatttgagcaaatgccaagggtgccggacacactgtacaccgatcgcgggctggagtttgtggcaaaaccgttgaaggagttttacgcggagaaggccattca

SEQ ID NO: 10150 - DNA, 4132 bp, Heterodera glycines
  misc_feature (12)..(12): n is a, c, g, or t
  misc_feature (126)..(126): n is a, c, g, or t
  misc_feature (137)..(137): n is a, c, g, or t
  misc_feature (4116)..(4116): n is a, c, g, or t
gaaaatacaccnctagaaatgaaaaattttctcaaaaattgatcgtcaaaatttaatttattttttcttgataaaaaattttagttttaaaaattttatttattccaaaaatattataagaatatntattaatcatntaaatgaccaaaattaagtttatttggttaagttttacctgttttgttccctaaaaatccttaataaaaaaaatttaaatgccttttttcatgcctttttcgggatttttgtgcctttttttgcgagctctacttatcagagaaagagctcttatgaatatagtgtgtcgtgcaaatcggaaattggaaaataagcgcaaaaacaattttctttttccgcaagaaattttcccttttttgtgtcaaaaacctgttttattttttacacactttcatgatgaataaagcgcttttgtgttatgctttgcttttacgcaattataaaatacaatgacaataaaaagaaagttttccaattagtaagcaatggaaaaatgattaatataaaagcaaaaatgcttttcctttttattcattttggaattaaaaaatttttctttttatttatttttaattaaattattcaattttccttaaaatcacaatatatgcaagttgaaaaaacaaaacgaaaatttattttggaattttggactgagttctttttttaaattatttttacaattattttctaatttaatttgtattaaaatagcagtatttttgaatttatttttccactttacacaatttatcttctcttctgcactaatcatcaacagcagaaaatatgtgggaatcaattccatatttttcttgtttttttttggctatttggtggttttactttacgaattcatattttgttttcgcgaattatttttttcatattttagaatttttaaattcatctaaaaaatcgaaaatattgtatgtgttttcaatactcagtttaaaatccaaactaaacaaaatatgaaacctttcaaattttaaaattcataaaaatatatatatatatatatatatttttttttttttggttttacattttcagcatattttgaattaacaaaatccaacaaaaatgcatcaaattattccgtttatttaattattttattttatttcaccgttttattcctcacattttgtcatcattaaaatcgtcggcgttgtttttttttgtatgattcattttccttttcccaatgatgaattcattcatcgcattctcgcctagagaatgctcaacaacattcattttgtttgtttgtttgtttgtttcttattcatttatttattcatggttgggaaatttttcaatatttatttggaataaaaattttcaattatcattctcagcaaaattattttttctaaatttaaaataaaaattaaactgtttaaaattgtaaaaaagtaattaataatttttgaacattctctaaattgtgaaactaattgaaatatttttatgttaatgaattttttcaatttcttatatttttaatttttttccctaaaaatgctaagaattaattatttaattttctttcctcaattataagcatcccactgattaaaagctctttagagggaagatcgaaattaagccacggagcttaatcatattttaaaaatagacaaatttatttcaaattaatccattttaatatattttaaaaactttaagtccataaaatcttccaaatttactctaaaaatgccgttgagccctcgcattggccacaacccgtcgtaccatgttgtcaaggaggtggagatcattcgtgaagtgatcacctccggtgggccaaccattcaacacgataaaatcattcatctgctcacttcgccaaataatgcccaggtacaattaataatttaaatttaaacaaattaaattttgtcaaatttttcagcgccaagaactgctccacaactaccgtactaagtacggtggtgctgatctggcccaagcgctgaaggaaaagttgccgccaagtgaagtggcgaccaacagcctgtatttggcactgttggacacaccggctgagcatgacgccaaatacttggccaaggcgatgaaggtggtaattttttcaaaaaattttactcgagacagtaaattcccgattaacaaacggattcgcacataataatagcttaactttggtaaaattattaaatccagggttaagaattttcgaaattgttttttttttgatcagcgatcttttaaaacattaaaagtatatttaatttaaaatcaaattcctcatatgatcaaaaatgcctaattaaagaaataaataatccatcaatcataattaattaatcaattaatattaattcttgctttcttccagggatgggcaccaacgaagacatgcttattgaggtaaccacataattttttttattagtttttttaaataattattttgcaattgcaaaatttgttccctagattttggtgacccgcagcaatgcccaactgcgtgccatcaaggcggcctaccagaagttgtacggtcatgggttggagaaggacctggcggccgagacaagcggcagctttaagactctgctgctcgacttggtcgaagcgaaccgggatgagtcgtaccgtactgatctggccaaggcgaagacggtactatcggattaaaaaaaaacaacttacattagccctcccctccctccctcccgaaaccgaaaaatcaaaaatttctaaccaaaaaggggaaattttttgacaaagtataccggtttctaacaaatttcgttaaaattttcttaggcggggcttgtttaaaatttttttagtccctgcccaaaatcgacaaaatgcttaatatcgtggacattaaagtcaaacaaaaatggctagctaattgaaaacaaagattcctgacaatcccgctaattaattaaattcgccacctattttattaataaatttaggatgccgagaaactttacaaagccggggaaggcaaatggggcactgacgaagatgcgttcatcaaagtgttggccaaccaaaacttgagtcagcttcagctgatgttcaacgaggtgagaatctaatttagatttaattaaatattaaattaattaaattttaaattaatttttaagtatgaaaagcttggcaagaagcacaccattgaacaggcaatcaaagctgaattcagtggagacgagctcagtgctctgttggcaattgtcagctttgtgcgcaatgggccaattggcgaaatggcggaaatgctgcacaaaagtttgacggtcagtcagcaaaatgccaaattttagaaaaaatattaatgacgtcattaaagtgcaaaagataaagtaaaatttgaaaacattaattaaaaaataaactaataaaggttgtttaatttcaaaaatgccatcaaaaaatagattcgattgtttcaagccaaaatttttaaaataaaatattttcgacgaccaccaaaacgccaaaaaacaagtatgaaaatgccaacaaaaaacaaattacctttcagaaaggtggtaaggacgatatgctcattcacctgattgtgtcccatgctgagcttgaccttggcgacattgcccacgaatatgagaagcgcttcaaggtgtgtgatttttgaaaattttagatttaaaattaaattccattttaattagactccgcttgaacatgcggtagagaccagtggaaagacgacgacgttgaagaatgcgcttgttcgcatgatcaaaggcaacaaataaacatgatcagaaaaaaacaaatgatcatttgacactctcggagagagaaattccataatagttatgttggaagataattaagccttcgctaattgctttttttttaaatttaagcaacttacgtattagtaaaggagataaaatgggcctcgtcgcagttatgcacgtttaccatgttctaaaaatatggcaaacttacactatcgtaagtgagattatcataccgttgataaaacatgccagaattataaataagcagttttaagaatgacttttcaaacacatgactcattattactaccacgcttggtcattcagngtgcaacgactctaga

SEQ ID NO: 10151 - DNA, 1302 bp, Heterodera glycines
aatacaaaatttaaatttttaaagaatttcctatttaacattaaaaaaaaaacatttttttcatatttttgaagaaatattaaataaaaatcctaatataaattatttataaataaaatttaccaatataattttgttttaaatatttaaacataattgcaaaaaataaaaatacaattttccattttaaatgtgtcttggtgtgatccctccattcattgctgggccaatgccattgttaatgatgatccatggccttggaggtgttgccaaaggcatcactgttgccgtactgcgagcaattttgccgtatattttgacaacccatgggaaatgttggtcaaaccgcgcacggtattcggagctgaatttttaattttttaatttttttaatcgtcaaaacgccaaagtagtttaaatatcttatctttgtacagaattcgagtctttaaaagaattctacggtattaacaatgtcattgtaaacatttctgtgcttttagttttggcaaattttgttatatttatgtgtattttccaaaatttagagagttttaggccctttttttgtgtgcatttttatttaatattaattcatatattttgcaaaattccttgcaagtaatttaaaataaacattttttttaaaatacgggtaaatttataaaattcatataaaaaatttcgtttccgttaaaattttggaaaatcaagatgaatttaatataaaatacaccaaaatcggcgtaattagtacaaaactgataaataaaacctatatggcccctatgttttcaacttttcagtctaattgctacctcattatgtaaagcaccggtgcatttgcactgtacacagctattgtgaggaaggaatatacggtggagtacggtatatggatgaacacgttggccaccgaacaagcttgcaaaatcagatcaatgatgatttttgtgaacactccgatcaggtttagtgcgatgatgaacatcagcgatttgttcagtttgcgattgttttctgtcacgtctgtttagaatagtaaaaataattaattaattttttatttaaaaaaagcgcgtccaacaaaaaagtcaaaccaactttgtgaggttgaagcaaatttgaacacaaagaaccaacaaaatgtgtacacaatgataatgagtgcactcattgctaggccgctaaatttcattatgggtgctaatgagctttgaagcatttcatgggtggagcaggacggcgtgctaaacggggggggtggtttaaattttcatttgaaactctctaaatatttgg

SEQ ID NO: 10152 - DNA, 939 bp, Heterodera glycines
  misc_feature (31)..(31): n is a, c, g, or t
tataaaacaataaaagaataaaccacgccanaatatttgttggcttccgttgtttgatacctaaaaaggaaatttaaaaaaaaaataacaatttaaattttcataccaaaatggacacgcaacggcaaacactcggtccaacccggtgaacaccatcaccggctgtgccaaagtgccaaacaaacatggcacaatgagtgcccaaaaacagtgctcataacggatgaattttgtgccggaagcgacgacaaaaaagctgacaaaatagccgagattcaataccagtgcacaaaagctttctgtggctatcaaaatgttgcaaatgctgcgcaaacaactaaataaaaaaaattatattaaaaaaatattttattttttttaattacggcgttttgactgtgatgtacacaatgccaaggtcgaacagaatgccaatggtggcccaaagtgcacggaaaccgtacataaaaagcagcattagccattgtggaccatccgcagtgaaatattggtaccactacaattaaaatttaaaatagaattagttaattaattctcaattaacctatacatccgtttaatcctggatttattatgtatacatatttttattttttaaattagcgcattttttaatataactcgttttctaaaaaaagaactatttttttctttttaaattcagacaatttataaaatttataaaataaaatataaaatataaaaaaaatgcctaatgatttaaaaaaaatgaaaaaatagaatatattaaacgtttttttagattaattaaatattattgtgtcgttttattttttaataatttttatacaagtttaggaatatttttaattttttatgcttaagtcaatttccctaatagagttaatctgctaattaatactttaatttataattaacaaataaaattttatttag

SEQ ID NO: 10153 - DNA, 2316 bp, Heterodera glycines
tgatcttttttgaacccttataattttgcggcttttggaattcatttttgtgttttttttgtaggggtccgttgataattctaaatttttgcgtccgtcctaaaaatgaaatttttcgattattatttttttttgttaggctattgctttctaggaaaattgaaataatcatttgcttatatattttgatcatttggttaaaaaaatgttatatggccttggggaatttgcaattttttgggtttggaaattttgcatgttttagttcagaatttttgaaaaattttctccaaaattttccaggggaccgtgttctttttcctggaatttctcaattacttggatcaactgaatgccgagccagagaacacggaccaaatttggcacaaaaagctgcgctcatggctcaaaaacacgggcggatcgaaccaatgggactcggacattgtgtacacggaaacgggcactttccgagcctatcggttacaggtgagaacggcactcattgattcgttgattttgattggagaattttcatgactcaaaaagtgatcaggcccgttgattgagactccaactgatccaaaaagagatcagaatcattgattgagactcccacttttctaaaaagtgatcagaatcattgattgagactcccacttttcccaaaagtgatcagaatcattgattgagactcccacttttccaaaaagtgatcagaatcattgattgagtccccaattgaatcagaaagtgttcagactcattgattgagacttaaactgactcaaagatttaagctgatccaaaaagtgatcagaatcattgattgagactcccacttttctaaaaagtgatcagaatcattgattgagactcccacttttccaaaaagtgatcagaatcattgattgagactcccacttttcccaaaagtgatcagaatcattgattgagactcccacttttccaaaaagtgatcagaatcattgattgagtccccaattgaatcagaaagtgttcagactcattgattgagacttaaactgactcaaagatttaagctgatccaaaaagtgatcagaatcattgattgagactcccacttttccaaaaagtgatcagaatcattgattgagactcccacttttcccaaaagtgatcagatccatttattgagactccaattgatcaaaaagtaatcaaactctgggctttcaggtggccatgaaaaatattgtggagcctgatcagcacaaattggcggccaaactgttgcgtgaaattgccgatcgacaaccatttcgcttggaaatttaccatgaggcgttcccatttgctgatcaatatttgatcattcttccgtcaacctatcggaacgtaaggctgaactgatcactgaataattctttcaaattttttttaaataagttttcaaaaaaatcttagaaaattgttctaagaaatttcaagaaaaggtaaaaaaaaatttctaacgattttttcaaaattttatgattgatgaatattaattttcacaattttccaaaaaaaaaaaaaaaaattaataaataaaaatttttcaagatttttttataatttaaaaaaaaagttttccgagggggatattgaccgatcaaaaaacacttgaaatctgatcaataacttatcccctttccaaaggtgttcatctcgttgttgtgcatgacgatcatcgccattttgttgatcccgagtattccgtccggtaataaaaatttaaaaattttcaaaaaattccccttcattttaagccattctgatcattctctccattgtgtccatctccacgggcgtgttcggctacatgacattttggggcgtcaatttggacgcgtaaatttaaaactttgaagaagaaaatacataaaatttccggcattaaaataaaaaatttcccaaaataaaatttatctttatttaataaattcagaaaattttaaacattatttttctctacgaataaacaattgtctgccggcaataaagttatgccggatgttttaaaaagttttcaaaatcttgtcacaataggccaaggcggtggaggaaagcgattgatcctccccaagggctttatggcaaaatcaatggatttattattattgtcagaaaaatttaactgatcactgatcaaaaatcaaacaaaaaaatttcctacaaaagcaaccccattaatttaacccggattttgttaagcgtctcaatgatctccatcattatgtccattggatacgcggtggatttgtcggcacacattgtgtacgcatttgtgag

SEQ ID NO: 10154 - DNA, 5004 bp, Heterodera glycines
  misc_feature (3029)..(3029): n is a, c, g, or t
ccagactgatcagcattggcccatccatcattcgaattttcagcggtgctccaggcatcagcaggattttcaacagtgctgcaaccacgaaaaaattgttcagcaatggcaccaacatcagcatggtgttcggcaacgcgttgaactaacaaaatttaaattcatgcaacaaatccaattaaatcgtggattagaaaagtcgattccacatataaaaagtttaatttcaattaaaaattgagtttttctctataaaacgtaacaaatttgttagctaattttttaatttaattttttttgttgaaaaatctagatttatttgattttgtagaaaaaaatgtacgaacgaactgccattgatctatttatttattgcgccaaacattttgaaaatgcttgtttttacgccaaaataatgcatatccatcatttttaagaatttagaatggcatattatcaatatacactaaatatttatcaaaaactaaatcaagtatattgtaattatgttacgacctagtgcaaaaatgaaaattaaacaaaaaaaaaaaccaattacccatcaacattttgccacaacaaattcaaactcacatttgatgatttcacccacgggcacttccttcgtgtcgtaggtgcgaaaatcgttgtcgttctccaccatcacaatcactttctgtgttggggaaaaaaagggaaattaaaataagccatttttgaggggcatataattttttttacattcgattcgttaaaaaaaaaattttttttttttgctcatttaaaactttttgaaaatttggattcattttttggtttgaaattagggatttttctcgtaaacgaaaatatagcccacaaaagcttaatcgtgcgtgcatctattcgaattccgaactcaaataaaaaaaagcattttcgaaattcatttatgccaccaaactttttgacgcaaaaattaaaaaatagattttaaaattgttttttcagtgttttgtccgaattcgggtctggaattctagttgttcgaaatgggtgctgaattcgtgaaacccccagaaacaagttttcacgagatttgaaaaaaaaaattcgaaaaatgggggggggcgaggaaaaagttggaattttttgacctttccttcgagttcgaattaaagaattggtcaaaaactgatgtcaagttcgtgtcagtgaaccccgaaaaccttttcgaacaaattttgcacgacttataatggcaaaaaaaaaaaatttttttttcgaactacaaaggcacccccccccctccattttggtttttcgggtaccctaacttggtaaagtgccaaaaattgtcatcaaatgtaaattaaaagtgtgaataattaacaaacctgatgcttcatgtccatcgctttggcataggcaattcgcaggcatttgtccaccgggcgaatgccgacatacatttggctgagtttgtccgagtcgttgcccgtctcgtccaaatccttccattcctcacttttgctgtggccgaacaaatcttgggacatttcttccaaaatgggaaacaaattggcaaattttatatgctaaaaagcaaaaagattatttgaaaatgaaggcaattaattatagtttgttggcatttcaacggaaaattttttaatttggcatgattttttaaaataatttaatagttacacaatgataccaagattgtaaggtttggttggacatgggaaaagttggaggtcaattaaaaaaacaataaatcgttttcctcgaaaaatctttttttttttttgcaaataaacatttcgccaaataactatttaaatgtctaacaattcattcattttcagggagccgcttccacaattgtcggcatttccgtgctgtacactgttgatgcgtacattatcctgacctttttcaaaactatttggtgagttagcttaaaaaaaaattgttttagtcttctaaaaaatatttgactttttgaggaaatcaaattaggtagataattaaatttaaaaatgtattacaataaattatcaacattttaaataattttaaattaatataagtatgaaaaaattcatgaaaatcctgaggattccttgcaaaatcccatggaattatttaaaatgggaaatgatgcttcaggttgacaatggtcatgggtttggtgcatgggctggtgttcattccggtgttgctcagctttttgcccatggcattcttccaaattcggcacaaaaaaccacaaaagcacaaagaacaacaaaaagtggtggcaaaaacgaattcgttggcggcaaatggcacaaaaagatgacaattctaaaaatggcactgatcagaggcatttccatatccggtgaagaaaatgactgaaaatcttcaacaaacacacattatggccaaatttggcacattttcattttgttttgtttttttttgacaaattttcattgaactttggtttttaggggtataatttccattttttccggcaaattttcatctaagtttaatttttaaatgagttatattttccattttccatgcaacattcttttatgaccttgaccatttttcatccaccaaatttttcggtggcacaattggccctcgtgtcgggtgtagaattgggtgttgttcaattggaacggcacaaaactcaacaaaacaagagccgtttttttgtgccctacaatttctgttcttttttccttttttttcttcttcaaacagttttttgccgaaacggaaaaacgaaaattgaatttaccgaatattattatttgttgcacatatatttttttgttgctcaaactcattgaaaaggcatttcttttttttgtttgatcaaaataaaaaaaattgattgatcgaaatgttgcaaatatccgactttttttggatcaaattcattggcatagcatggagggggactaaaggggctataaccccatgaaaaagaaaaaattttatataccgtatatgctctaattatagcccatgggggattatttttncacctcctcagaaaaggggggataattagagactgggagattatgatagagggattatttttcaaacacctcgtagactgggggataattggagactgcgggattaatagagactgggctataatatagcatatacggtagcctcctttcctgccgaaaacgaaaatattttttaactttttcctgactggcgttgtttatcggtatcgccggtccctacctccaagaaatttttgaaaaaaatgcggcaaaaattaaaagaggtcgttgttcagagtggttaacccccccccccagaaaaaaaaaaaaaatctcacacttagaaattaaaaaaataattggaaattttttcctcagaaattacaagaaaaaaaaaatacttttcaaattgaatttttcaatttcggacagtttattttattttttgaaaaattagaggcaatttgggttcgttcactaatgcattagacaaataaaagtttaaatttgtaagtgatcagtccttccatccgtgcttgttttgtcagtcgtcatctcttgcggaaaccacttgttcactgatctcggtcattgcgttaaatgtgtggttaagccctgtggagaggggtaattaattaattaaaatatttactaatgagcggaggacagacttttaagaatccgtatattataatgtggattttgaatatattttttaacctacccataaaattccaccagtaaatttattgaaaaatatatttttattaatccattcatgattagccctaacttggttttatgaccgtgcagattttgggttaagaattggaatgatcagtctgatcattttatctgtcagtggatccgctcgggtggtaattgattagtcagtctttttatgccggggattaaatcttggtgaaattatcagcctttcttatcgctgatcactccagcataattgattcgtcagtcgttttatgggtgggggaggctaaatcttgatgaaattccggggggattaaatcttggtaaaattcacgggggattaaatcttggtgaaattatcagcctttcttatcgctgatcactccagcataattgattcgtcagtcgttttatgggtgggggaggctaaatcttgatgaaattccggggggattaaatcttggtaaaattcacgggggattaaatcttggtgaaattatcagcctttcttatcgctgatcactccagcataattgattcgtcagtcgttttatgggtgggggaggctaaatcttggtaaaattccggggggattaaatcttggtaaaattcacgggggattaaatcttggttaaactgcaactatcttatcgctgatcactgatcaccccacccaaatcccatcttatcccccctcacattgtccgatcatcgacttcttcggctgcggtttttgctgctgttggtgctcctcgacattgtccgtcgtgaacacacagtcttcatcatccggataatacaccttgtcatccaccgatgggccctcaaattagggaaatgaatctatgaaataaagaggctgggaaagcttttgaggaaagatttgatttgtccctcgcgtggatttgatttatcgcatatttaaataaataaaaataaataaaaatcaaacatttatttataactttgctctaaagcaaccaaattttttatccttgatgtcattcgatagacaaaaatgtttttttttattagtcagcaaaatttcaaaaaattttgttaactttcaaaaaagttatggcaaaaatattttaaaaaaaaaaacaagatttttttcggttcttttgcttataacttttttgaaacttaacgaaatttttttaaattttgcaggctaattagagaacgctttagggctaccgtaaatgatatataattaggtaaaaattttgttgctttggaacgaaattatgaagaattttttgtagaaaattttaatattgat

SEQ ID NO: 10155 - DNA, 1866 bp, Heterodera glycines
ttgtttctgtcgtctgtgaggagcattatgactattatcatccaacagagtgagaaaagggcgaaaaattaattaatttaaattaattttttacttttttaaaatacaaaataattattcaaaaatcatccaatttttacagaaaatggcttctcggcgtcgtggcattgcctttcattctgtgcggcctttgtgccaatggaatgtccgtcgccattttttcccaccgccaaatgcgccaacagtccgtcaattggtaccttctcgttttgggtgcgattcgctttttaatttaatttattttaaatattttttattttcctccatttctctcctttttaggcttcagtgatttgatcgttttgctcggcgccttcttcgttctcactttgccgaggctaagcgaaattttgcactggtggagagggacggcgataaggtgaaatattcgaattcatttccatgagaaaaaatgaaattaaattttaaaataaaataaaatgcagttattattcgacccccttgatgtattcgctgatgacaatggcgcaaacgaccaggtgacccattaattcattcattcaatggcaaataaagcattgtcttatccccccccctttttcgcagtgtttggatgaccgtggccatgtctttgcatcggttggcacccccaaaatgccaatgtccgatttgaaaaattaaatccccccaaaggtttgtcggcgtgtgctttccctaccaatccggcaccgttttggccacacgaaatgtcaaatcactgattgttggcattctttttgtggccatttttttcaatggatgccgattttttgaggtttttctcaagtttccttcctttctccactttatccgttaggtcagcttccaagtgtgtcggatgaagccaataaatgtcgaattgcccgtcctccgaatgaccgcactcagacaaaacgaattgtaccgcaaagtgttctatgaatgggcgtacactttggtcagacaaagcgccaattgggcgccaaattgacaattcaaaaaatgagctttcgtttttcagattatgttcgccattccgttcactattctgattgttgtgaattcgatggtgattttggccattcataagtaattaaaataagaaaaatttaagtatatttaataatgattttttgaggtcacggaaaatccacgccaaaatgaacgcgcataacgacgggattcggaagcaagaattagccaaggagataagcacctccatcatggtacggtgtgaaaggggtactgtatatgcaaaactgtaatgagaccatcgtttagcttgttgccattgttatcgcctttctgttgtgcaacactttggtgagttgtttttgaataattatcatcgtaattattccgccgttttaatccaacattagaacaattaccgtacccaattattttaccgtaccttccaccttttctaaattccccccgcttcagactttcgtggtcaatttgatggagaagttcgacctgaatgagctgtacgtgctgctagtgccctggagcaatatgctcgtgctgtgcaacgccagcattaacatttgcatttactgtattttctcggaccggtaccgtaaccttctgttccattatttgcactgctgccgacggaaagggggcgacaacactttcaacaacataaactcaatgagctatttatgacggaccgaacaattggccaattaaatgtgtgatattattaaaatgtaaataaatgaatgaccaaaaaaaaaactcaaattttcgtgccaaaactctccgccgtcggtgtttaaatgggcggcaaatgaaaatatatattttaaattacgaatttac

SEQ ID NO: 10156 - DNA, 2339 bp, Heterodera glycines
  misc_feature (2320)..(2320): n is a, c, g, or t
tgacggagagaaaggaaaagcaaagaatgggaaaagacactcaaaacgatggaaaatgtcaaatttaaacgaaaaacgaaaggaattggcatttaaaacaaaacaaaaataagtgccattttccgaatgttttgagtaaaatgaagtgaaatttgggggaatgaccaaagaaagacaattggcatccactgatcggatgcctttctcaataaaagcgaccgttgccgagctgtgcgtttggctgcacgaggcgtgcctttgagtcggcgtaagcgtcgacgagaagcgcgccgttgagcggtgccaacgattcgggcggcgactcaatcgtgtccaacaatttctgcaacgcaccgggcaattgctgctggagggcaaactcattttgggccaattcgtcgaagagcatttccttagggagagagaggggtgatcagagtggattagagtaaagggagagatttaataggagagagcgagagagagaagtagggagagaaagggggaagagaagtgaattgctctgaaaacggactttgttttggctgacgtatgtgtacagctcgttcagtgccgagtacagcatgaactcctgcgaatgctcctgcgactcgtccgccagcagcatgctcatgtccgactgactgatcggctccatgttggcaatggtcgcgtaatacctacaaaagtccgctttgcattaccgtaccctctgtccgcttaccgttgcacccattctctgtacttgtccatttcgttggcgaacaacaacttgctgctgggcgaatccttcgtcaagtgttgctcttgcgtggagcaggcgtccatcagagtttgggcgacgacgttgagggacccttcgattttggtgggcttttggatgtcgaagatgaagtcgggattcttgatcagattgacccaaaagcgcaacggaagggcgttgcttttccaagcgtggacaacctgagaaatgggaagggagagagataggaaatgaagtagccagtaatcggaatggtaagtgatcgcaaatcctcccccctgtcattgcccaagtccatttttgcctacctccgggtcggtgatgccaagttcgtgtgcctggtcgtccaagaagtcgaacaagtactttatgcatggcgggaacggacattggggggtggaggagacggagaacaccgcctcgagcagttcctcgatgaatcgttgcagagtccccttcatcgtcagcaggcgagtgaggtaaatttcggttaccattttttcctgaaatgccatggcattgccttccctttttgcccttttccgtcctttttcctccacctgtccgtcctgcatgttcattccgcgttccgtgccgcccgtcatcggcttcaccaaatgaaacgcccgcagcgtcgcacccgcgtcggtcgcttcgcgcgagtgccctccggcggaactgccggtaccgccgccgccgacaaaaaatccgccggggcgatggacaggcgaatttgtggtggcagtgggagcaccgcggacagcggacagtccgcccgaggcggacgatttgtcggatttgtcggagatcagcgacagattgtaggaggaggaagtggcattgtgcggcacaagtgccaaagtcgctttgtcttccaccgaaaacagaaaaagacaatgccaaagcaaaccaaaggagtcgatatgccaaaactcactttgtaatgtgccaaagtgttgtagcgccaaaagccattttcacagcgcgaagtgccatccaagtcttggagaagcattcggtgggtggccgtgcgcagttccaagtcgacttcggagggcaacggccgttcggagtacggtgtggtacggtatttggcatccaaacagcgcattttgacctgaacagtgggatgatggatttgtgaaggatgccagtgaatataagtgcctggctgatcgagtcgcagtcgagcacgcgcacttgcgtatcgcaaatggcggaggaacagtccgccagaataaacagagtcaactcgcggaagtcgagcgaggcgcgcaacagcttctcctcactgagcgagtaacgcgcgtccattgtgatggcatcttgcggccccttctccgtctgctgtttggtggcccagtacagttggtacaacggtttgccagagaagcgacgcacgaatttgtacatgagaaaggcgaaccaagcggacaacttcaaagggagagggaatttggagagggatggcggagagggggagggggaaacaggggcgaaagggacaaagcatgggaggaaaagcggcgggagaggacatggaaaatggaagagggntggggagggagcactgctg

SEQ ID NO: 10157 - DNA, 1825 bp, Heterodera glycines
  misc_feature (176)..(176): n is a, c, g, or t
gacccgaagaactcaaatttgatcgactgaccattcgttcggctacgctttccgctcttctgaacaaattcttcggatggaattttccgtcagcatttcgtctgatcagttccttcagcaattgcttcaacacttccgtacagtatgccatcttctcctgaaagggtacggtaacncctgcccattggcactaattcgctcgacctgaaggataaccatcagcaacgagcccacatagacgcggtccttcaccagcaaatatttgttggcgtcgatggaacgcacaaaagagaccaaaaagtgccgattctgaaagtgtcgggaaatggcattttgagcgtgtaatttgcgtgccattctttggccacctgaagcaaatagtgcagctgacgaagtcccgactcaatggccaaggcacggtcctggtcaactgagaggggacacagcgcgggatgggtgtgtccggggtaattcgggaacagaatgcgcgcggcataatccgcgtacggcagaaaagggataaaagaggtgccctggggcacgctgcccgcgagtgcgttgatgttggtctgcagctcgtgaaaggcctcctgcgaatcggaagggggaaggcaatgagtcagaaatgctaattgatctatcagtccgtaatttgtcaatcagttgatcatttaatctttggtaagctgtttgtttgttagtaacattgttaattagcccatcattaactaattagtttggctctaattgtccctcttttttccgctcactttgcattcttgcgcgacacgcatttcgatggaattcatttgggccttcagatagcgcaactggcggttgtgagaagtggactttctgcggtacaacacgaacagtgccaaggcgaggaaaacgccgaggaatgcaaccgccaccgccaaaatgagccattccgaagggtcttggccccgcgggcgttgggacgcttcgccaaccttttcactgaaaggacatttaaaattcgcaacattttagcttcgtgtgtacattttgtctccgatgtgaaccaaaacgtccaccgcgtcgtcgtgcgcgtcgtccaaatgcgcgggcaacacgcaagtcaatgtgttggacgcgagtgcgctcacattgcacggcaaaccgcccaccgacacgcgcacatcacgcggcgacgcggccaaattcaaattctgccctttcaaaacgaggtcaccgccgggacggatggcgagcagttcgggcagagggacgaggcgagggtcggggaagacgaggagcttggggaaagcgcgatcagcagtcaaattgctaaacggaggggggggggcgaattgtaagactaatcggaagaaaaagcgaaggggggacggacccggtcagtgtgccgtccaagtcgaacccaaagtcgagcctcatgggccgctcgacggacaactgcgccctgcgctcagttggcatttccagcggcggcgtgcgacagaccttggcataattggcgattgattgattaaggatatggcaaaatgccaacccaaccaaccatcaaatgctcatccacgccctcacatcgagcaccccaaaatgtttgtccctcgtgcacaactgacattcgcgcgcgttgcaaaaggtccaaacctttgccctgaacgtccaattggatgccgccggaaacggtggagacgggacgggggacacggtcaatggacggatttgcactgaataaaatgtaaatggtggcggaaggagaaaaatgggggaaggggggggggggacggggaggaaagagtgccaatgaaaaatggggaagggatgccaatggtat

SEQ ID NO: 10158 - DNA, 1174 bp, Heterodera glycines
  misc_feature (1062)..(1062): n is a, c, g, or t
gcaacttttagtgaaaaaacttttttttttgctcaattgttttgaagaaaggagctcaaaaacgcatttctgcgttaaaattttttcatttggacgtcacttttcgtcactagaaatcactattttagcgtttcgtcacttaaaatagtgaaaattcacttttttggctttttatcactattttttcactttttcgaaattttttggaaaatccttaacaaaaatgcaataaaaacaaaaaaatacacccctaagaaccgacctaaattttttttttaaatacacgcctaagaatcgacctaaaaatttttcaaaaaataccagttagaattggaaaattttcataaaaatttttcccccaaatttttttcttacaaaatttttggttcaaaaatttcaatatttgctaaaaaaatgtaagaaaggaatgtacctcatttgtaactgcaatcagtgaataaagatttttttgctcaatttttggctgaaaattatgtcactattcgtcactattttggactttttccactattttgtcactattttggcactttttcgtcactattttagttaactatttcgggatttttcgtcactaaaagtcggttccctaaatatcactatgaatttgccgtttaggttgactaattaaaaaaatcactaatatttttgaaaaagttccaatcagtaattttaaagaccaaaatgatggaataatttgaggctcgtcggcagcgcagtgccgtggctggctggctgttcgtttggatgttcaaattttttgtgtgcttttttatgtcctcactttgaacgcaatcttcacctatcaccataatttcggcggcggacaattcttccgtctgcataacttgaccaggcccgtagccaggggggggaaggggggggggaattacacttcgggtccttcttattcagccgccgcatattggtgccatggtcgcactttcaactggaaggaaagtcaagaaggggtgtgtgaccaccggagaagtgggtgcaaatgggcaactgattgaaattggcaatgtgcaccacaaagcnaaggcggcgatggatgccaatttgttggacattatattgccatccgggaacaagaagcattttcaacgagtccggagtgtaagaaagagaggaatggtggcacattatgccg

SEQ ID NO: 10159 - DNA, 2178 bp, Heterodera glycines
aagctagtctaaaccgggagttcggtaatcagttgtcggtctccgtgagggagaaagggaaattggacccttggcagtttgtctgaaaaaattgtggaattccatgcaaattttcaaacaaaaactggcaaattcttaaattctataaacttatttgtattcgttttgcctcagcgtaggcacatcgagggaaaaactgaaattggaccttggcagtttttctgaaaaaattctggaattccatgcaaattttcaaacaaaaacttgcaaattcttaaattctctaagcttatttgtattcgttgatattgtcagccattattattttctctaaatatcttcccctttgttatttctctcatttttccacactctctctctctcttgcctgacaaaggagaggtacccaagtgaccgtgggactttcaatgaaacttacagggtaggtagattacccctcttttgtattataaaattttttttatttttgctaaatgaagcttatggccgagatatgaagcttttcctttttgctatatcaatatcatttacaaagaatgtaaagccgatgtgagcgtctctggcaattttaaccttaattttttttatttttattttatatgatagaataaaattttgtttattgacctattatttttatcagaaaaaggattaaaaattcttttcgttggtcctctcatctgttccctctccaaactttgacatttttgagaaaaatttaggaagatataaaaaattgaaaaatacattcataaaaagcactttttcattgcttacaacattgcaaaaatttttatttctttcgaatgccgaaagtaataaccagggatgatatggatggtatatctgaggctttagcatcattttgtggttttttgataggtcaatgaggctaaattttcaaaatgaggctttgaggctttttgtggttttttgagaaaaacggcaaaataatgaattttttttaatgaaaatagggtcaaaattcttaatttttcccccggcggcgcctgtcggcaccgccggaccataaaaatttgctcaaaatcacaaaatttggtcatttttgtggacaaatctgttaacaaatcgcattaaaaattacaaaatttttcccggcggagcctatcggcgccgccggacccccttgttcccaaaaattttttggaaaaagcgccgcaaaaaaaaatcaatttcaatttttcatgctaagattttcacaaaatgcttatttcaaacaaaaaattgctcaaattggtcatggacagtcaaaaatacaacatttgaacattttaaacatgttttgaataaatttaaatgatgcttttgacccaaaatgaggtttttttgcatgccaaatgaggcttttgaaaatattcatctgccatccctggtaataaccctttcccttttcgtccgtccccagtcattcttaaattcagtccgcatttgccattcatctctctctccatttatttattatatttatttgcttctgactttatttgattgtgttcaataaatattagtgtttgtgttctctcaaccaaagaacacaaacaattacatcaaattatataccgtatttgctctttttatcctcagggggataatttttcaaccccctcagatactgggggataattagagactgtgggataaatggagacttggtgattttttttcggcagatttttaaaccaatcggggtttttgtgcctaatttcaaaaatacatccctaagaattgaaaaaattttccctaatattgatacggaaaataaattatttttttaataaaaatttttggtttaaatttttttgtctttttcaaaaaaaactaatatatttaatatttgcataattcgtaagattaaaaatgcaggaaaataggaaaaccctgaaatttgagaccgaactctgagactcttttccgagggataaaccatcatgacattatattagagttcaaaaatgataaataaaatctttttactcaatacaaaaataaataaatatattttttttggtattttttaatgctttggcattgatcaaattctttgccatctttctttacatcataatcaatcttctttctcattcttccttctccagccatgctcagaaaatagctaaaatattttttttaatattt

SEQ ID NO: 10160 - DNA, 1300 bp, Heterodera glycines
  misc_feature (1291)..(1291): n is a, c, g, or t
tttgttgttgcaatgtagaccttggcattcacattttccatcttcggtgcatgctttactgcatacgtattggttaggaggcttgcaaagcggtttaaaagggtcgttgtatttgtaaccgatgcaaaaaccccatcttccttggcatccgttgatgcggaacagctcgctgccatccgctgtgcgtaatgcaattaatttaattgaaaaaaaaaattattttaccgtttttctacaaaacagagaagggtcctcctctgctgctgcagctatcctaattacccccctccccacctccaaaaaattggcaaaattttcccaataaaaaagcaccaagttagttaggtaattttatttgaaaaagcagtgtttctccaaccccctctttgatggcatatggtgtttttttttgcataaattttcttggtaaaaattttctcgattttttgataggaatttacgaaatgacacactcctagcagcacctgctgctgctgctacaatatgcatatcatatggacaacaaacctcgtgtacaggttattgtggtgcaaccataaacttcgccttcgcggcaatggttatccccaaggtcaacatagttctttagatcaactgaattaacagatagatcaaatttatgtaaaagtaaacaaaaaaaaaatcaattgcaaaatttgttgattttttttttcaaagtttcagctatttttaagcattttgttattatgctgcatttattttaagttatatgtattaatatttgatttttttttaatttggctccaaaactttgtgagtaaaaataaaaatcatttttctcagccaaaaaaccaacaaaaaatatttaataataataataataaatttaaaattgagtttctttataatataataggtattattacaatctttccatttgtcttgtgcaaaaatctctccgaatcccggtggatacggttggcctttcgtgtgatcggcgtgtcggaaggattgtgtacattgaaactctgtttccaaaaaagtgtattataatttgtcgaaactctctagctgtcgttttatgcacaattaacaggaccatacaaaaatccaattacagtatgcttcttgtttacggggtttgcccaatttttcaattatgattttggcactgtaaaaaatccaattaacgagttcagaacaacagataacccgggagtttcctgagtcgagactcaagaacgaacttctagaacatcattagaaaataacctcaacgcagtgttgtttgtacagtaaacccaaaatntaccgtacg

SEQ ID NO: 10161 - DNA, 3130 bp, Heterodera glycines
aaaagagattttttttacttccctaatgattggcttttgataaacttaaatttaacacatttttggtaactttttaaatttaataaaatttgatttgcacttttttcacacggcgacgcctaaaaccccaaattttttcttaaagacatgatcaaaatcgaaaattttgtcactttttggtgaaaacctattcagtacgttcaaattttcaaaattttccccggcgatgctaacggcaccaccgaacccccaaaattccctttatttttttaattgacacaaaaagaattataaaaaatcgccgagccatatttacggagagaaaaaacttacaaatttcttgttttgtgtttttggagttataatatgtacctaattgaatttaaaaaaggaaaatggttaagaaagactcgaaaaaaataaatgatttttaagcaaaaattttttgaaaagtctcgggtttttcggtctcggagtaaaatctcggtccgaaagagtgaaaattagggaccggcgaggggacgggatccagacacggggttttgcggggtcctagtccgcaatcccatattttttggaacctgcgcgatttgcgggatccgaattgtattgtttttgaaaatacaaaagacagaatgccaaactaaataaatttactataaaatcaattaaagataaaccaattttccttcgcaaatcccatcaaaattttgtgaagattttcccgcggaacggctccactttattaattctttcaaaaatgactcaaaagcggatttattcattttttgggcaaaatcacctaagaaatagaactaaattttcaaaatttcccggcagcgcctagcactgccggaccctctccccccaatgttcccagaaagttttttgaaaaagagcagctgcaaaaaagcgatctgaaaagcaacgtaaaatcaaaaatcatcaattccgtgggttaccgccgacccaagctttaggcagaaaaattcgaaggtgggaggaatcatatttttttttgctttaaaaaaacattttttgtcttgactttagaaggaatcacttacctaatttaatgcctgatcagacttattcaattgcctaaataatctttaaaagatttttttattgttgctaaagccattgctagtagtaaaaaattcggtaacgcttgaacaaaattttcaaaattatattttcggcaatttctaaatacgcaataaaagcggttcaaatgcatgaaatatttgtcttgccttcggaatcgtattcttcgttttatttcatgcattttattgcatatttagaatttcaaaagggggggggggagtaccatccgtactatttccaaaaattcattcactggcgtaatgcccactgttcaagtcctcttctatacaaacgaattcactgtacaaatgtccactgtcgagatttccactgccctgaaactaatcttttacagtaaattttttagcattttgctagtttccttttgattggtaatggaaaatgcttggtctgctctacgagctcttcggatttcttttcaaaaacggacaccgcaaggcttagctgatgggttaacgattcaccatgtggccatgcgcttgaatttctgaatttcgttgcgacgcaaatgaagacactcgcgcaccaaatgcttctgtggaaactgcgcaaaaagccaaagtgagttcacttgtttaatgtgcaaaaaagcataagacatgaattcagtattactgggaagagtggatttttcattttgtttttattaatggtaaagcaggccttttctcggttcttttaaattgacctaagtggttttttgaaggattttttgatttttgcgatcaaacctttgctctcgcaagcccttgtttgacttttaaaaattcaaaaaaaaattctacctttcattatattaccccattctcctgtggcgatctctaccaccagccctcacaaaattcttatggcaacgagaaacctctgatttaattttggttcaaaaataagattcgaaaaagatcaaattaatgcaataaagattcagcccattaggttatacatatctagacggctctatccccttgatctttagtggaaggagcaagcatgaaggatgttcgcaattgcgcctgcagcggcgagggtggcaccgttatttctatggtgcacaacgaattcggcacaaaaaatgtgtgtgtggcaactgttcgctgtgcttgcaatagcgtgtcaaaattgacttatgaactaactaagtggggacggcgtaaaaagcaagtttattttataagaaatatttggcaccaaacatgcaaggaaaggaaaaaatagaaaatcaagagagaacaatttttgactaaagttttggtactttttaattatcggtactcacaatcagatttcactttttttagcaatgaatttgttttaggggttttcagggtaggatccgatatttatttcaaccaattccggacccggactcgagcaaaagacaaatttattttaataattgggttatttagcaatggagaaccaaccaccaacatgagttgtattcggttaattgtgatgaaaaacattcaactggaaaatgttgagaagatatttttggctatgcccgaggactattcattggtgcgcatgaatgaaaaaatttgggccaataattttatggacgaaatagtgaagttgacgaattagttgtattttcttttgtcgcataaatgttatttgaagaatacccatttttctttatttctttttatttaataggtcgtgcaattaaaaaactaaacgttggaaattaggtgtgtttgtgccaaattgtttaaggatttcattgcaatgcttgccaaatttagtcaatacccgtatcttttttcaataaagttaacgaaaagccacatttggcgctgttgtgcgaattttatttgaaaaaagtgatgaaaataaaaaaaatgtggaataataaaatgaacaaattaataaagacccgtcaattacaaaaagaaatgagatttctttgagaaaacagcaaaatatataatgtgaatgatgggatcggtcaacttcattcgtcgtcagaaccatgggtgccacgaggggtccatgc

SEQ ID NO: 10162 - DNA, 1463 bp, Heterodera glycines
gcactttgatggggttcacaatgttcaggtgcgggtcgtcctctgccgcctttgcgaaaacatcccacagaatgggtcgaagccaaacctccagcgaaagtgcgtttaacgaacgggcaattgcgggaagagcaccgacaaaatggccttaaaaagggggagggtggagcgagtaaattggaggaattaaaaaaattgtgtatgaaaatcggcataccgtcaatggacaggccaaggaagtgggaaatgttcggcgtcagacggaagggcacaggacgatttgcgtcaagttcaactgcaaaaattaaatgtacatagtaatggacaaaaatgttggcaaaaataaataaattcttaaaatgggttcaccccaaaaatttttttaaaaaatttcagcggcgagattttgtccccttcctctcgaaattatccctgcctgtttaaacgtttttattcacacaaattaagacccaaacagtaaaagaacgattttcacagaacagaaaaacaatttttatgaagcaaccctttagtgttatttatagtaaaaagaaaagaacgtactgaacggcactttgccggcgattgtctcgcacacttttttggtcaggtcaaatttgtagtcggtgaaaaagagttggccggtggacaggtccaggaacagcgcgtcaggacgcattgaggacagaaagagcgcgtgttcagagagaccgagcagagcaaattgtatggccaactgacaaaaatataaggcgatgagaacttggcattgaaaatggttggtcattccgagctagaaaggcacgggaacaaacccatacttttcaacatggactcggtgaagaaatttcgctttttagcctatttattccatttattacaaaagattttggttaaaaataaaattttaaaaaaaggattaggtcagtaaatttcaaagaaaaagatttacttatcctaaaaaacaattgtttcacctttttcctggccatccaaagcgttgtcgcgtccccgtaaaattgtgccatccaccgggacagcaaatccttcggcacagtgaccagcgatgggcgatgggagtgttgctgttcagcaccagcaatgactgcagcagcttcacttttggtgccacaaatttggttgaacagctcgtggatggtcttgtgtgaataactgaaacaaaagaaacataaacaagtttttttcttgctcttgtccatgcttttaaattaggatttcaataattattaagaaatttctctatattttctgaatttatcttctactgaaaaatgcaatgaatgtctcaccgctgctccgccagccgttcgtagtactggtcgatcaccgtgagtggtgacaatggcacgatctcacagtcagtgccaacggcggcggagttggcactgcgccgtgcattgatcatgtcgcacagaatgtccgtgaacagagcaaaattgtgc

SEQ ID NO: 10163 - DNA, 1532 bp, Heterodera glycines
agctgctcccgttttcacggatttttagaacaacaacaaaaaattatcaagagggtggggggggcggaccatcggcaatattacctaatgcattaattcattattcaattcgttctttgccttctcccgtcagaacaccgccctaatggccaccggaatgatttggacccgttactgttttgtgatagtgcctaagaattactacttggccagcgtcaacttctttgtcggatgtaccggactcgctcagatattgcggattgcgcactatcagtacattcattctgaggaaacaagcaaatgaatgatgagaatggatggacctcttaaatagattgtcttctcatgcgtgttttttgcgggttaacggctcaaaactcggtttttctgatcaaatagtattggttatttagtatgttgtgatcgtaaaatttgtattggtataattattcgtaagcgaaatattttaagagccaatggccaaatttgagattctgttttcgccggttcttttccattattaatgaaacagctaaatttcgagatgccagcagatggaagaaaagactaacaaatacagggaaaaagtatagacattttaccaggcatattttaggtgtttatgcaaagcacaataagtaattgtacatttatgtaattctttcgcttctgatcatttgcaatcgccgcacgttttggcacacgcccttcgctgtcctctgttgaatttagtcgtcccacttttggcatcgcacagtccatcgcccttccattggatgcatctgtcattttggcgtttcgtgccgttccctccctccgtcatgcttttcctttccttccctccctttggctttttccattacctttcgcctctgtccacacattccctcctccccccgctgctgctgttgtttctgttactgctccttctccccttttcgtggtttgtctccatcatcggttcaatgattaattcgatgggcggtggtccgaccgccgccacagattttgcgccgttcgctttgctcgtcgtagcctcgccacactttagacacgttttggtgcagaatttgatcatatattctgcaaaacatgcgatgaaaccaccaaaaggctaattgttaagttcgaaattctttcatctctcaaatttttgcctcatttcgaaatgattttccaaaatgtgatgctaattaactgactgattgatcagttcgccattccattattttaccccctaagctcggactgttgcaaaggtgcgcatttgtggtgcaattgtgcactttgtcagtgcattcgggcaccaccaatcggtgtttgcttttgggagggcctaaaattaattgccccttttgcgtgacaaatgctttgattgtgcgcttttccatccgatggcttcgcttttccttacgtcccaccaccaccggtcttccgctgtttttggttgtgttgtcccccttttgctcaatgtttcccttttcaacgggctctcctccgccaattgtcgcggaatttctccggactctaga

SEQ ID NO: 10164 - DNA, 2545 bp, Heterodera glycines
agacttgcgaacacggcacgaattgtctgacgaacggtttttggtacggtaaacggctgaatcctaccgtagtctctacaggtggacatcgcacaaagtccacaagagcccgcacagaagcgagagagcacgccaaaccatttcttctggtgacacttgtccaattgacgtgaacagtccacgacgcctttttttggggggggggggcgttggcaattttggaaagtgccggggtaccattttggtcatcttcgcatgcgtaatttatgtcctcgcagcaaatgccgcacgttttacggcacgattccgcaatgtcctcaagacctggcaaaaaggagtgaactcataattaatttattgatggacgctataaactgaactctccaaaaatgagcacccttctgcccctcgcctaatgaaccaaaaaagaggcattccctcccccgccacattttcggcacttccattccccgtccgcccacttttcggcattccctccccgccccattttcagcacttccctgcccctgtccccttccaccctgaaggttgcatttgatgtccctttgtcctgtccgtgtgtcaatttctttgaacagatagttgcacacctgaactaacaaaaaaaagcagttggcaatcgtttgacattttaattgccttatcacttcgcaaattgcgacacgtcgtcgccgaggggagcaattggcgcgtgtcgacgttttggcagcgcaacatcagagaaatggactgttcagtggaactttagcaaaaatataatacaatcccaataattcattcgcttttccacctcaattcgcgccaatttgaactcgcttttccaccacctcaaaatttcggttaaaaaatgcgtcaaaattttctcccaattcccaaagcatttgcaaaatgggctcctcctctttttggccttcacttttaattttctcttcttcttttccccccttcagcacattcacttttttgttgttgttttttgttcggcgtttttgcgccttttctcattttgttgctgctgctaattgcgacgcgatggccatccttcgaagagggaccatttgttaactgtgaaaatcgaatttatcattttactcaattagaaccccccccccccccatcctgaaataaagccccccttttgagtggggttgaaaaacagagccgggggctctaattcagtaaaatacggtattcaaaattctcttctctgtctttctcttcctccctctctcttgcactcactctctccttctccctctttctatcacactctctctgtctcgcagtctctcactaattactgtgccttcgtttcctttctaataaattaccttttcgcgcctttcggcacttttctcgactgatttcgaaacgcttcggtgccttcggtcctccaccattaattttgttgtcgaagtccaataattgtgccttttcggcaccgtcgtccatctccaaccactcattgtattgatgcgaatttgcggcgttggcgtaaaacccattggttcttcagtgaatggcttaaaggcaggccgaaacgaatgtttgtggtccgttccgtttacctttttctcctccgtttgtcctttttcctcccccaccgctcttcgactgattttctgtttctcccattttccactcgttggagttcgtttcttcagattctttttgcctttatcttcggcagaataccttttctttttttcattcatttgtctttggtgcgactaaaaattatcggcattttggttcgtttgttataatttgcggcaattaattaacaattactttggccactgaaaaatcggccatcggttggagaaatgaataggaagggtaaaaaaacaccggcaacttcttcacattttgtttttgcgacatacgacgtgcaagtttcaacgtgtctccgttgtcaaagtggtggtaaattttcgtaccactggcgaatgaaattgcgaaagattgtgagagggatgatgacgaatttggacataatgacaatggaagtgaaagaaagcggcagaaagggcggataaagaagtggtcgacggaagaaggaaagtcacggaatgggagcgaagtgaggaagaggaggacgaaaagggcggacggaagcgaaagtttgggacggggagaaggacgaagacaacgcatgacacgataataaatggtttaagactaacaataagacagtttctcaccctccttttatgcaattcggtgggctgttgtggtcactgctttcctccgtcagcgaatgtttttgctggccaattaaagtgggcgttttggcctcgtgtcaccgttagtcattgtacaaaaccattgtgaccaataaacagcggagttttgcacaatgaccatcaccctcgccgaatttgctcagctgaaaccaaacatttctctcattttatttatctcttcgaatggcctttcctttgctaaatgagcctttaatttttcaaatgattgaatattaaaataaaatttacaaaatgaatgaattaccgtattttagggt

SEQ ID NO: 10165 - DNA, 1646 bp, Heterodera glycines
  misc_feature (78)..(78): n is a, c, g, or t
  misc_feature (1552)..(1552): n is a, c, g, or t
aatgagcattttaactgcttcgaaagtgtgcactttgccacggctttcttccgctcgctctatgacttggtggtgggncccggagaaaaacaatgggcgcgaagttgttggccccactttccacggggatgaagtgtgttgacttggcaattgtcaaattattatttgtaataatttggttccgatagttttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggtcacatttcgtcgtacattttctttggcattagcattatttggattcgatagattattattattttttctgtttaggccgagtttgaggcactgacgccttatggctatctcacagtcactttgttcttttctatgcttgggcttactattctgtacgcttcgtttgttaggacttacggtattcagttataggtactttgactcttatttatattttttgaacagtgacaaaattcaatgaccgattgcctgacactttcgatgatgaatataaagtttgttttgaagttttaagtaattttcaaagcaaacaaaagtattttaggaaagtcaggccgagcgccgtgtggtactggaaagggtaagcaaattgcgatgccatttgagtcctttgagaattattcgccaaaaaattcagggccatctttatgggccggcctactattacgattacgataaaaatcgctggaagaattgaagaggaagaaacgaccaaactcgaaattaaattcgtccgaatatttattttaggactacagtatatggaataataatatctatatttattgctgttcattggttattttaaatcagtctattcagaaaataaaaaatatttggctttaatcataaaaataagttgtattacctaattgattatgaatgttattttcgaaaccatcaacggcaccatcataatattttttcttactttattttgtgcctcaaccctttcataaaaggtttagtttacataacctattacaaaatccaagataccaaaaagtcctctattttttgatcatcataattaattttcacaatttatgccttctgtgaaccgtataaaaagggatcatttgttgaagttgcggtccaaggcgcgacagtctgaaagcaactttaaaaagccagctacgaaaaaatatacagagagaaagttagtgcagcataaaagcatcggaaaatgcatcaatttttataggagacaattggaagacagtttttcgaatataaacgcagaattaatcagccaatcggagctccctcataacgcaatttcttcttctgccggtttaaatgtttttatggacattttaaaaggttttgcaattaatccgactgttttctgttagtttcttacaaaaattgcccacattttcagttcgccaagtcattgagttggacgatgaagaacaaacnccaacccaaatttagaaggcgaaagtgacccaagagaagaacagcaaaagcttgtgaagaggcgaaattcggaagaaaagacgacgatggaacg

SEQ ID NO: 10166 - DNA, 3558 bp, Heterodera glycines
ccgaagtactaacgaagtaccagcaagtgattgaagagcaattcggagcgggagtgatcgaggagacgacaatcggcaccggacggagcgagtatttcattccacatcaggcggtgatcacgccaaagaagctgagggtcgtgtatgacgccagtgcgcacgctaagggagcgccctccctaaacgactgcctgctgagaggcccagtgtggctgccggacttggcaggcatgctcatccgttttcgagcgtgtcaagtgcccgtgatcgccgacgtggagaaggcatttctgatggtcggaattgaggaggcggaccgtgaagtgtgcaagttcctatgggtacgggacccattcggaccgttgacaacgagcaatttggtgccctaccgatttcggcggttggcattcggcttaacacccagccctttctgcctggctgcggtggtccgccatcatcttcgtaaatacggcacagacttcgccgaacaactcatccgggacacgtacgtcgacaacgtactcattcccgccgacacagtcgaagaagcgacggacaaggcacgagaggccaagcggatgttttccgaggcccaaatgaacctgcgggaattcttgaccaacgaccgaggtctaaacgacagcttcccggaggcggacgcattgggcaagacaacggcaaagatgctcggactcgaatggaacgcggagaacgacagcctgcgaattgtctttccgggagacactcccgacggggcgcaccgcagctcaagaaggacagtcctcaggaccatcgcacgattattcgacccactcggactgctggcaccagcaacactcaatgccaagcagttcttccaaaagctgtgggactccacccacagctgggacgcgcctctcgagtcggacgatgggcgagaatgggacagaattttggcaagttgggagggacaatcgatcactattccccgaggagtgcgggcggagggcggtcgcccggtgcagctgcacgtattcacggatgcctcggagtcagcttacgcggcggtggcttacctccgatcagaagggcaagacggaagagctcactcccgactcatcatggcgaagtcaaggttgaagccgaagaaggcggctgggacgtacaccatcccgcggatggaactgatgggcctggtcgtaggagttcggctcgcagcattcgtcagagcgcagctgcatcgcccaattgcggaagagcacatgtggagcgattccatgatcgcactgcattgggtgaggaaccgtaccccccagccccaattcgtcgcgaaccgattggctgagatacgaaaagcaaccgccttgacgttcggacatgttccgacaggagacaagcccgccgacgcagcgactcgggggttctcccccgcacagcttcagcaagccaatctctggtggagcggaccgacatggcttactaagccgtgtgagcattggcccaaggaacttacttttacagtggactcggaagacgggggaacctcgctggacgaacgagggctgaccacatttgttgcacggcgggaggacactcccgaaacttcgacagaacggactgactggctactcgatcggtgcggccggtggacgaaggcagtacgagttatggcgtggatgcgacggttcatcactgggacacatcgcccaagagatgacggcacgggcgaccctcggtgccaagacacgagtcacgggcggtgcccgcccgtcctaagcaacgaagaattgacgcgagcaaaatggcagctcattcggtcagcgcagagcgaatgccaagcacgggagggcatacggaccaaagtggacggcaacggagtgaccaggctgatcagtcggatcggctggtgcgcggaggccgaagtcagtaggccagtcatactcccgaagcactcaagggcgggagcactcatcattgacgacatccatgggcgacttcatcatctcggtgtagacggaacgctggccgaatttttgagggactggtggtccccgagcgcacggcagcaggtgcgaaaggtactcggccaatgcaggcagtgccgacgactcagggggatgccctaccccctaccgacaatgccgcagctaccgatggacagagttcggcggcgcatcccgttcgagtcggtgggccttgactacctcggcccgaccgtgaccctcgacgcgaacggacaacgacaaaagacgtgggtcttgctgatcacgtgcctgacgacgcgagccatttacgtcgacgcaacacgagacttatcggcacaaagcttcatctccgtcctgcggagattcatcgcgcgccggggtgccccgagtcggattctcagcgacaatgccccaaccttcacagtggtgggaaaaacgctgtccgacttcggcatggcgggagatgatccgcggcattttacggactcccgtggcattcagtggcgtttcactccccagcacacaccatgggccggagggatatttgagcgagcagtccagctcgtaaaacgagctttgcagaagacgctgggcagtgctgtgctcggctatgacagcttcgccacgttactagctgaagtggaggcaacggtcaactcccgaccaatcacttacgtcaacagcaaggcgggagagcctctcccgctccgcccaatcgacttcatccaagagaatgggcggctttgggtggacccacccgacacgactggtcaggcacaggacgaacggcgggacccgccgcacaagcagctagccaggcaatggcgggagtcacagcaacgactggaacatttttggcgacgatggcaccgcgagtacctaatgacattgcgagaaaaagccggatggaaccatgctcagcggcgtgtgaacgcacccgggacaccgaaggtcggagacatggttttggtggaggataaatttcacccgcggaacctatgggccatgggccgaatcgaggaactcagaggatcggacgggcacgttcggagcgtgctgatcagaatggcgaacggaagaatttgggggagaccagtgaataaaatttgcccattggaagaagcaccgccaaaaatgcacgaccaagctgatcaagcagtacatgaaccatgcggagacgacgcacgggcagttgagactcagagcgaagtgaggagtcggaacgaactctcggcagcaccaaaagaagaagaaaatgaaggaaatgtgagcgaagaaagtgccgaaaagcgaggacgagaagttgaagctgtacagcccgacggaagggttaatcgagaaattcggaacgacaattctctggggaatggccccgacgatccggacgagaaattcgatgacgcaacaacgacggaggaaatggcagttttcgaaaaagcggcagaagtgccttcggcagcagcaggagaaacgggaattttggcacacccgcattcggctccgagacatgagaaaaaatatttgggagatagttcgacggccccaggtctcctcgatgtccctacaaaagttcagccgaatccgacgagatctg

SEQ ID NO: 10167 - DNA, 2383 bp, Heterodera glycines
ggacaacgaatggagaagatcgaaatatgctgctctgacggttgctggacgaccataccgacgtcgacagtgatcaactacgaactgccggacgaaatgctcatccatggctactcctgcagcggccaatgctggcgagggttgggccccccgttcaacgtcactcagcgatgcccagcgagggccgagtgtgaactgatcagctgcgccttctgctgggaacagctagccaatccgacatgcaatccgcggtgggcttccaccctcttcgggttcggcgcagcactaatgctggcagcgctgggctgctgttgctcaattgcctcacgattctggtcgggagcgacaattttctcccgagcaatcgcatggggagtcagctaccccatcactttcatcaactgggcgacaggacgacacctcccaaggccaacggcgaaccaaatcgagagtaaagtgcggaagggagcgagagtcgcacgtgcagaggtgcgggagattcagcgacgcctacaactcagccgaagagcccgagcgatggcacaggcatggcagcaccccgaccgagcccgggggacccgcgcggggacggcagcggcgacactcattcctctgctactcatctgcggaacgacaatggccaccaagccaatctccgtcatggtccggtccgaggactgcgcgagatcggcagcgggacttgagtgtgtgggaacagcagcaactgtgctcacgctcctaccagtggaccaggtcaattcattcgtaattcgcacccaacaagacgaactgctcggcgccgttcggctacgactggccgccattaccatggtgtgcgtgccgaggaccgagagctggcaccgctcgtacacaatttcaacggtcgcagtcaagcgatgcccaacgccggctcgtgcagagagaacaaatgcggcacgattcggagcggggatcaaatccccgagcttgtctcgctgaatcatcgtcccggccacactttctgcatgcgcagcaccagcttttggcagaattcatgtgggctcccagcgccgtcctgcctcttctaccggtgggcagcggttccgtcgacgaccacagtctacgaggagtactcgtgccttgagtgggacatgcagataagtgcctgggtggaattggagacgaacagcggtcgcgtggagtcccagcgactgaccatccatccgggagtaccagagcagtgggggaacatgaccctatcggtcgtccccacctctctcccgcctatgcctgtgctgtccgctcacttcatcaccgacggacgggcggtggccatggggagacctctcccctccgatttgcattgccccgacgaggaggccgcacggggctttgacaattgccagctgtccatcagcgcatgccaaaaatgtgcgcctgaccatgacaacggcacggtgcattgccattgccgggaccttaccattggccgagtcatgaacgaccctgagcatcgtctaccattggatgtcgctcgacttcacctccacaacagcggaccagtcgtaaaggcggaatttcagtacacgcctgtgcaggtgcacatccaactcaacggattggagttggtcagcgagtacagcaacacgaagtgctgggtgacatcacccaaactcagcgggtgttatcgctgtgtcacgggcgcagcgctcacagcctcatgcaggacggaccacggaatggccttggcgaaggtcaaatgcgcggatggaactctgttcgcccttcattgcggtggcaacgactcgacaacgacggaggcaataccattcgaccgggcggaggtgttcacggagtgccgggtgaaatgccccgcggggatcacgaactttcggctaaaaggggagcttgcctttctccccaagcagcagcagttcggcttcaatcagcgagactcaaccggcgggcgggtcgagcccgggattagcctcagcctacccgactggcgaatcgaccctttcccccttctccatctcttattaagcgggaaaggactgctagtggcggtgggagccaccgcgatcggactggcagcgctcctcgttttcgtcaagttcagtccgcacttcagagtgtacagatcattaatggctatggccctaattacggtggtaatcccgatagtggggaccaattcagcgggtgaagtcacccgggccaaattcccggggacaacgaccaaagcggcgatcaatggactcagcaacggcgagctggacggggaaacgatgcggcattttcaatcggatatgggggcctacccccaccgtgccgtcgctattcttctgtttggcgcagcaggtggcgtacttggacgattcctcctgcaccaaaagcggcggat

SEQ ID NO: 10168 - DNA, 1022 bp, Heterodera glycines
agcgccgggggcgtacgagcccaaaaggggtggttccctaagcagcaggcggccgacgcccctcccctcccagcgacggccaattcgccgccggcggatttattcattcttcatttcgttcggcagggagatctctccctttgtcccaccggccgggccaagcccagccattactttcaatttgatttttcagattaatccccaacttttgtcaatgtcttttcacgaatttggccgagcgaagcaacgcgagagggccaacagcgggagttctctcccgccggcacaaccaaggagagaaaacggacgccaacagggtgagcagggagcacagccattttgggaggacgcccgcagggctcggcaagagcgggcgggacgccaaagcgttagcagcccgagagcgggcagcacgcaatggcagatgggaccacggcggagtattttgggagcaccaaggcctctcccaccggctgagcacgcggagacagtggcggacgaggtggaggcgctgaacgtcccgaattggacgaccgacccgtgggagcgtgccaaggtggaaagccacctccgccggaaggaactcaagggctggaggatggttcatctgcggacggggattgctgcaccaacaccgtttgtgctgggactgactgcggctcaccaacaactcatcgcgccgggatggacagtcagcaggtacttagctgagcaccgagagttgccgctgagacacgacgattgggcgtgcgtgcatgtgccgggcggagtggtcggcacctcgaagcgcagccgacagcgccagcagcagaggggagcactcccctggcgagcaaacgaagtccatgtggattggatgccgctggccatgattgtgtggaaggaacaagccgtgatcgaccgtgaggcagaggaagaaatggacggcgcaccagtgggtcataaggaggcgatgcgtgcccagccgggcggaacgggggctaggaggaacggagatgtcccgcccggagagtgggattggg

SEQ ID NO: 10169 - DNA, 786 bp, Heterodera glycines
atttatcaataatggatgatcatgaataatgttgaatagtgagtatccattgtttatataattgttgatcgcacagcaaccgacagaaagtgccacaaataatttgttaattttggcacaaaattctagcaaattatttcaatgaatgtgtaggtcatttgagaccggactcaaatggcgtaaaacttaaaaagcgccaaaattgttcggaatatgtacctaaattggctgtggtcataaatccggcctctttcaatcatggtcacttgagcatatatcatcaatcaatcactctgatcagcagtgatcgtcgctctgatcacttcgcccattgtccattacactgatcattttcggccataactttttggcagctgatcgacttccgcttgctccacttgtgacgcttccactacaactggttgcttcggtggtgcaacaccagaagcaaccggttggtccgctggatcaactgctaaattattgacattcgccagcgaatcactctgaacacctcctgccagtgctgctactccttcaattggtggtgctggtggtggtcctcctatcaccggctcggccagcgcttgatttggcgccacaatggacagaatgccaaaagcgacagtgaagcagacaaacagcagcaacgggcggcacatttttgtgtcgatttggcaatttgagcgataaaatctgtttttcggctgtaatttaaaaattaatactaaaacccgtgaaatttcattttttggcaataatctaaaaaacgatttacaatcacgt

SEQ ID NO: 10170 - DNA, 2313 bp, Heterodera glycines
aacaaagaatcttttttttgtgttgaaaattattttttaaaaatttcaaattaattttctttttttattggctttaattgtttatttgttaaactaggggtcaaaaggacagctcccttaaatcacaaaataagttaatataattgtcgtgttcttttttaaaaatttttttttatttttttgctttagatacataaattaatggcatatttatcaaaacaatattttaaattcatcattttatatagaaatatttttcagtttttgaattctaaaagaatcgcgtcatgggcaactttatattttgtcacacaattttactattttattttgttgtatttgtttggctcaaacagtttgtcgttaattggtaaacattggaccagttgcattatcgcttgtatcattattatatcttattatgatccatgcctaatttcgtggcgtccaagttcagagcaattcacccccccccccccccccctcctccgatcaatcatttctttctttcctttcgtttcgccgctttttggcgatggcggcgacggcgatgatcacgcaaaagtcctccccccccgtaaaacaggttctgagccgttcatttcgcagccaaattgggcacttcaccaatcattttcattccatgtcaaacatgaaattctctccttttttgagtacattaatatcattgtttaattgtttgattggacctttaaagtcagaccatttaaccaattgaaactgtttatcattcactgattattccgcagggaaatgaataccacgcgcaaaagctttgactgaaatgaaaatttgggaggcttaaatgcatccgatcacttcagccaagtaaaaaaaaaaattttaccactgagattctcatggaaattccgaggcttacatgtcagcccaaaataatacacataataaagcatttttttgtttttaataaacctaaaacagtgacaataaagacaataggtaaatgatagaattttataagtggtcagcaaattatattcattcttttggtgcctttcggttctgccccccccccccccccctccgaaacttatcggtgatttgattttctctgattggtctgatctgatatggttaaggcaaggtgtaaaaaaatcaatcgtccgaattaattttatttttaatgaaattttaattttcatttattttacgaaacgaaaaaaatattagtcgaaacaataaaatatttaaatcctttctttccctgcctctaaaaataagtcaacaacaatccctcttctgtgaaatgaatgctttagctatttttagtctctttgtccaaagcacaaaaagccgcggcccgggcgaaatattcagtgaaacatccatcagctgatgatgatagccaaaaattgagaagaaagccatcattttattcactgtgcttttattttattttatatttttagttttttttattttacatttatttttatggtggacaaaagccatgcgccattcattgtcattttgctgactctcgtcgtcgcactgcttatttttattgcgatttcacgtaaataaattaacttttgaattaatattttaaaattcttctttaagtaaatattatattttattagtttatttggctatatgaattcggtaataaaaaaatattatatgttatattcaacatttagaattttggtattaaatatccgacttaaaagaatcacagattcatgcaagaattaaaatttaacaatttttttcaggcggaagaaccgaataatttttttgcttatttttttacttttgaatgccgcaaaatatttttttaatttggatattatttaaaccttttttaaataattaaaataaaacaatcatatttttttatttcaggtccatcagttaatgtgcaaaaaagcgttgaaaatgaagtgtcctcacaacaaacacaacgaacatgaacatttttcaaatgatcaacagaaaggacaaaagttaacataattaaaaaaataaaaatgaattaacaattaattaattggcagaatttcgaaaaaataattaatatttaaattaattattaaggatgagtcagcacagtcattggcccactttagccttgaaaacgatgccatttgagcaccaaatcacttctcactgttctcatccgctgatgatcgatcatgtcaaaagcaccgatgctcaatcaaccccaattttttgataaattgccactgatattcagctgatttattttttacaaaattttaaaattaataaaatgatgaaaaatttattttatcccgaaaaagcatt

SEQ ID NO: 10171 - DNA, 1326 bp, Heterodera glycines
attaattggcagttgtcgcgtttgccactaattagtgacgaaaattttgctattaatcttgccataatttgattcttaatttctaaattttaacttaataattttttggcaaaatatcgtattgaactcctaaattccaaaaagcattcatccggtggcattgttttgagtttatgtcgccactaagcgaaaactgtttgcactatccgtgttctgtgcacaaattggttggggagttttccgggtttatatggttccggcttaaactcccaaccagcctccggttctatcccgaaattgcatcaaatattttaatatttatttaaggttaagtcgggaattaacagtcagtaaataataagcacagtgaggaggtgggagagaagcaaaataatcttatcagtcggcatttgttaagggtcaaagagaaggaaaagagggcaatacaatgtttaggaaaattacataataaatgctgggtcaagatttggaggcgggagtaaatggagaaatttagtgagatcaaagtacatgaaataaaagatttaatttccaaaagaaagtgttaacggcgaacactgcactgttcgctagaggaaagcaattatattttatacattttgccaccacaatttggacacagatcacttcgatcagctgtttttgcgattatccactgctgatcgcccgaaactttgccctcccttccccttatcattggctattatcgcccatttttctttatccaattcatacgatggctctcttttttgtttcgtctcgtccatttccttcgtcatttcctcctcctcccccattcttcttctgacctcctcctcccttctcccctcaatcttcccgtccattcgtcttctttccctccccttttcttctcattttctcaaatccgtccatttttctcgtcaggcgaaggacaatgtcaaggccgcggtgccgtccaatcgccacgctcaccgcaaaattcgcacaaccgctgccgatcgccggaagaatgctgcgctgcgggggaagacgggggcgggggaggacgggggcaccgcgtccgtcactcattaggaggaggcgtttttgtcattgcggtgagcgacgtgtgggagagcagcgggggaggagaaggaatggaggaagacgagagcatttgccgaccgaaccgagttagaattcgccgcaatgatcaaatcactccgccaactaactgatcgcattcattgccaccgaccgatccgtgtcattcattgcgtttgatacgaaccaaaataatggttgtttgccgtgtcgaaaattggggaggaagaagccattggg

SEQ ID NO: 10172 - DNA, 1230 bp, Heterodera glycines
  misc_feature (101)..(101): n is a, c, g, or t
atatttttcaatcaatttaatttctctccccccccagggtgccatttgtcggaacagaatcagctgagcaagccgagtgccattcgggtgaacaacaaccncaaccttcgcattgttactacgagaacaactgctacaaccatgagaaacaagcagaattaaatttaataaacatggttcaattcttagacagtttctcattcacttcgacttgtgagccgggcggaattcgggtgagtcactaattaatcactcttttttggaatttgaattttgcaattaaagtttgatatttatttatttattttttaatttaatatttcaatggaaatattgagttcaaatttggctactttctttatttaaatatttcaacaacaaaagtttttatttgttttttttaatttagaaataattttttatttcattatttgacttattttattcacacctttttccaataaattcaaccaaaagccgagtttttgtcattttcttattcacacttttatttaaaaatataaacaaaatttaaaataatttttttacgatcctttttaatctaaaattaaaaatttttaaaaaatattttaggtccgagtcgattcgcgcatcccttacactggcgcactctacggcttgtacgacttcttctcgtgccgaattgagcccaaggagtccaaactgttcgactttctttttccctacccgcacatttccaagaactgttcggacagcattcgcattatggtcaaattaaattaattgttgatcatctgattaattaactacaagaggaggggatgccattttacccttgaaacctggcatttggttttggggtcccgtgcccagttagttttgacagtcacccggttttttagaaatatcgcacaaaactcaatttttaaattttcatgattaaattcactaatttgttgagacggttgaaaaatggtgctaaatattctattttgatgcacgaaaatctcggtcctaaagagtctcgacatatttcttcaacaaaataaataaatttgctcaaatttttaattactacatataaaattaaatgttcctcaaatttgtcagggccaagaagcactgctcgaagttgtgctgtctacggacggagtggagccgctgtactttatcacagccgacgatttgacctatcagacaaaatgccctctgcccgagcacagcaggtgagcctgctgtcactttttg

SEQ ID NO: 10173 - DNA, 1222 bp, Heterodera glycines
cgtagtttaattagcttttcttttcctttattactttgcacaatgttttgaagaaggaaaagtgaagttgaaatcgtccgaattttcgaacacatacaaaaacatggatctgaaattcaattggtcaaatggcatgtgccgattggtccaaggcagtgcccaactcaccggtcgtcccttttggaggcactgaccgctttgatgttgttcgctttgaactcccacctatggcttccgctcgccaacccgccgttcagttgcatttgtcgtttcatctgcgccctttggctgtcctccaacacgtggtacagaatgatctgacatttcgtggaggggttttgttcagctttttccagttaaataatccctccatatcctccccccccctctttttttctcacatcgtccgcattcacattcaaatagctcggcgtcagcattttgttcagctcctgaattagcactgggaagcgcgaagaagtaatttcgatgtgctgagattcgatgctttccatgaaaaattcggtccaaaacaaaaaagttttcttgtcgcgttccacgggggacagttggagagtggcggtgcattgattgatcagtttgatgttctccatggtcgacttcagaaaccaaacaggtggcttcaacctgaagagcaatcaatcggtcgattagtcaatcaaaaggtgttacagtaatgacagttcgtacaatggaattcggtataataaactttttttgttagattttatttttctctcacattgccattttctctgctgccaaacaagccttgttgtaatcttcggccagaactgaataaacagtgaatttcactgcgccgaaatggcttttgaaacccgaaacttcgaagaatgtggccacgtcccaatagtccgtcatattggccaatgcgccctttcggcccaacaaactgttcagcacaacagcaatttgctgaagttcgggcgactcttcgaactgttccccgcgggcccgcagcatcgttgtgaggtctaaagatcaaaaaatgaaaacagaaatcgaaaagtgacaaagcaaacgcactgattccgctgtactccaagggggacagtttgaaagctttgcgatacctaaaaaggaaacgatgcgaatttcagataacaataagccttgctaaattattttgccgacctccccccctccccggacaagaataaattagccatttctccgacca

SEQ ID NO: 10174 - DNA, 1958 bp, Heterodera glycines
agttagcagcgatttgtccctgtcgccgtttttgttccgacgattcaacgcaaaggcatacaaaaaacggacggcctaaaagtgaagtgcattcattgtcagagggacggacaaaggcggaaaacacctgcgcatgggtaatttgcttctggtcaattcgctcgaggtcgtcaataagtccgatgattccgtcataatcttgagtgtccctgcaaacgaagcaaatggacagaacgaagcgagggaaacctcaagcaaagcagaaactgatgcacagtgtccacggagagaacatctgacgggggaagagaagcgggtcaaatgttgctaattgaaagaacggcaaatgccaaagggtgagccaaaagcgagcgattagcggtcaaagtgaaggaaaggccaacaaccaccgatcagtcagtcagtctcacccgggttgtccagtcgcgtgcgcatcctttccagaaatttgttttggtcgggcggcgattcgatgtcgcgcactttgcgcaggtcgctgagaaacttctcgcgggcgtgcgcattcgcctcgatggtcacattgttcagtgcctgccgaatacggtcagagaacgtgccctggagaaattatttggtggtcaaaattgaaaattggccaaattaaacaatgccatgagtacgtaagaatcgcttcggcctttcttcaacattttctgatatcgctcgtgttgtgagccaaactttgaggatctgtccgcggagagtaacgtgggcaaatcgtctttggacagaaagtaaacaatcagcgaacaatgtgccaacgttttcttaagtccctttcaattatcactttggtatttttgcccaactttcaatgcttcgatttgcatctccgccttttggtcgtccggcaaatcgggcgagtacattatgatgatgttgtaagtttggcccatcgattctcgtacactttccaaatgttttatataattcggaaataaacaaaacgaataaataccccacgtggtaacagagactctgaacggtggggatgaaaagtattcactggtcgttgttttcgaatttgaactcaccggctgttgctgagtgatggaaaagtctatgagggcaatgtcggcgttgtaaaagctgagaaatattttggcgttttgcttattataatttcgttctcgggtccttttacttgtcaagtgtggacgactcgccgaagtcaagccggtcgaagtcgatcaactaaaaatgccagcattggttttgttcaccaaaaaagggcacttggaggttgacgttgagcatcgccgccatcgcctctatctcttggcatgccatctcccgaacccgcaggcatttctgcacctttttgtccatcaccagcaccgtcttcagcctgcgcaagttgccgctggttgagccgactccgccgtatttgtccagcgaatgcgacgactgtttgaagacattggcccgaaaagtcggcggccctaaaagagaaattcaagcggtgggttgcggcagaagagcggctgacccgagccggcaactgagttcgaatcgagagtttgcccaaaatccattcaaaaaaaaaacaaattaagggccaaaaggacgcattcttaaaagggaaattattaaattaatggaacgaaataataaacaaataacagaaggggaaagacgcatttctcttccctgcttcatctcatgtgccatttccatttcaaatgctcacccccccccccgcccatcccttcgaattccatggccattttagacattctttggcaatttgacgatgaaacagagaagcataaatggaagggaaaagaaaagtagagacggacagaatggagagaatgcaaaaaaggggggggggaagggaagcatttgctggaaatgtggcaggaatgagacggcgcggaattaaagcaaaaagaaaacagaaacgttttttatgt

SEQ ID NO: 10175 - DNA, 926 bp, Heterodera glycines
aagcataaaatataaatctcgaattagtaaacaataagcttagaaaagtgccttttatattcttaggttgagttagcaaaaaaaaaaaatgacaaattgctaacaaaagccgcttcgaaaatatttctaaaaaataattttctaattatagtgacggcttttcggatccatttgttatgcttggcttggtgccaaggggtggcagtcaaaggagccctggcgcagatgatcagaattcgccaaccaatgtgattaaattaagaaaaaaaaatagttttaaagattttaattatccactaattttattttaggaaatttcggaagcggattcgtctgcttcagctgctgacggtggtgccggtggtggtggcaattccgcgcgaaaaaatccgctcctgcaacgcttcagcggctcatttcgccgcaaagcgcgcaaggcgcgcggtgagacgcaaacatttgacgccgagaacggcattccggcacgcatcatcaaagcgtcatcagtgcagcggaagacgctgaacccgaaatggaatgagaagttccaatttgtgattggcgatgtgactgatcgcttccatttggacatttggtgagatttcggcatcgaatttttaaaaaattgggtgccagaccaataatttacagtgcctaatttaccggcacttacaagggaaccgttcaaaaaaaatatgggttgtaaacacgggaatgtttataaaaaaattttgaatatatgaaatctttttaaatttagcaggcagaaagtatttgtactaaggtatttctctgcaaaaattcatatttttctgaaaagtacgaaacgaacaggaaaatcagcatttttaaattccgtgaatcttataatttaaaaatcattttaacacagaaaaagtaagaaaattttctttaatgaaaataat

SEQ ID NO: 10176 - DNA, 4822 bp, Heterodera glycines
gagattcaagataaaatctcatcaacaaatttcaatttttttttaatatttcaggcattggtcatcatacaccaacatgccatacaaagtgatctcaccgaactgcatcaacatgtttggtaaatactatttttgttaattaaaaattattctcatttaaataaattgcagtcaatggttggcctatcttcaaatgattgaaatgggcatttcatttgactgtttgtttaatgtttttgagcagctatgcgctaaatggaagcccatggaacttgataaggtcctccagctaatgaataattgaattgaaatttattacaaaaatggaaataaactattaaaattcattaaacatttttgatttatgaaattttataaaacaaattattttaaatttatccatgaaatccttttttacttattattagttaatattaattaatccttatttaaattttaggatgaggagcatgtttttgcagattcactgattcaatttattgagcattgccgatccacaatttcgaaccaccggcttcagcttcgtgtacgtcgtgccggatcaagcagacgacgatcaccctcaccaaaacgcagtgatctagaagcatttggcgaaatagtgcgatgctttaggcgtgttttggaaaaattgtttttttaattaaacaaaatgacatggatccattgaattttaaatttagagatattttttatattttttccattatctggtttataaatgtattttgtattgacaaatttaggctcgtcagagagagtgccgtttttgcccaattggtggcacaacctcagaaaaatttttcgtcagaattgcgcgaactgttggcgcaaagtgccgtgctccattttgataccatccaagcaaatatactgcaacgctataaggcacaaattgatgctctccaagcattggctttacttgtccaagcgttgaacacaacaatggcacggtgtgccaaatttgagtcaatttttcggcattatgcaccggaatgtgactatgccgacattgcatatgagcaatttgatttgctggtaggttaaattcgctattggcttaattggaattatcgtaaatttgtaattgctttttttcatccaaatgtattttcaaatttattagtagtcaaaattttttcgattgaataagagtgggattaaggcaaaaaattttttcaatttctgatcggattttattaccatttagttcaaaaactatttagcttatttttatcattgcattattgaattcaaatttaattgaaaattctctgagttttaatttggcaaaaaaaaaaaaaattcatcagcctttcagctccatgaacatatcatctcgaaaatgatggatgaacagcggggtgcacttcggatgattatgcaaatttgtcacgctgatccatgccctactgacaatgtacagcttaccaacgtgttgcatgtgcacatgacactgaacgagttcagcacgttgcggcacggcacaacacgaaggtgtacaaaaatggaccaattggactggtccgaacattttgacaaagcaattcaacgatggcttgagctggcattgggtgaggaattattttttgtccatgtacataaataatgtgcatgctgagttttttttgcagcagttttttaatgcgaaattcctttaataaatttttttatcgcgaaatttcatttattttcaataaaaattgaaaattgggttaaattattttattattttaaatgcatttttttaatttaaaattttttacattttgtttatttttttttaatcgaaattgcatccttttttattttatttttattttcttccaaaacatatttctttgtgaaaatgaatatttatttttttttcagtaaaagcttttgctcgagttgatttctcgttggcattggacgtgcaaatgccgatcattccaaataatgacattcgtcaaactgtatccggactggacacttgtcatattatggaacaactgttagctgtctgggagcgattatctgtacatgaataattttgtttaattgtgtagaaaattttgccaagaaactgacgtcatagcgaaaaatccccgtttttctggttttaaaacatattttaaatccatgaaaaacctcgaaaatggttaaaattgtagaaaatataccatttttgcaaaacttttaattttcatcacaaaccaatgaaaatacaaaaatattttaaggtgacaaatgtattgctcagagcagaacttacagtacggtaagctttaaaaaacaatattacaaaattaattttaaattgtttttgctttttaagattggtacgattgttatgcaaaattgccaagcattttgctgatcaactaatgatgcgaaggccatttgaaaatatggccattcatcaacagaatcagccagcagcacaaactgcttccacttcatctgttgatcggctgagtactgatcaaatcgaacaattcgcttcaatggtgccaaaaataatttatacattaatttcgacaaaaattgaagaacagatttaaaaaaattaattcgaaaagagcttttaaatacatttttcataaattgatttttttacaaatcaaatcaaataatattttttatctgaaaaatttcaacccttggtcccaaattgctttgattcattattattattcataatgaatactaataattcggattaaataatatagataaatagctgtgagcaagttcgtcgtactttggcatgcactgaccgtttacggcttgatgaactgactgaactctacgaaaggaagacaaaggcaaaacctaattatgaaatttatcatagcattaattaaaataaaattcaaaggattaaaaaatttttaaaatttttgtagaacaaagaatttcgttcacatgttgaacgaccgttggacgcgtgcactcaaaacatggtggaacaaattgaactgctaattgaccaatttgtacggcggcagacggcgcttataaaaaggtaattaatcgggctaattaaaaattcctcttataaaattctaattttaaattaattttgccaaaatttgaaggccattttccatttggtgtggagccctgccgcatgtccaactgatgagtgcttgaagccattaattaaactgttagacgaggagctttcgctcgtccatcggtgccttatgcataggtaaaatttaattttattaaaatatttataattgtttttttagaaattttacgcgcgtaatgcaagcgcaaatgcaattactactcaagcttttccaggttgtaaaaaaatagaaaaacaattatttcgatgttcaatttatatataatttaattttccaaaaattgctaaatttacaaaaattgaattgctctgcccgaattttttttttaattaaagcctaaaaaatgttagtaattaaatttagtattaaaaataaatcaaaattaaaattatattttttgcgttaattttttacaaaataaaacaggagtgtgtgaatgagaatgtgggtcttgagccgagcttttatcgacgcttaaccgatgcgttggcaattttgcttgattttttccatgccgatggcaagggtattgccgtcgatgttttcgctgcttccaacgagtacaaacgatttcatgaacaaatttcgctgtatcaaatgccaactgagcgactgattgaacatttttatgcccttctgttgaaagcacaagatgaggcagtgaaaaatttgaaaaaactttaaaattttaaatgttttcaatttgtaggtaaatgagtgtaaatatggaattcttaaccttcgtgcctattataatccacattcggaacttctggtcattgacggtcagcggttttaattgatttaaatttttacatagatataagaaaatcaaaaaatatttaatttattttaaattatgctaggaggaagggacaaaaattaaaaaaggaattttcaaaaaaaacaaaaaatttttgtgagaaaatctaaaatgctgaaaaattctaattttttttcttgaaatttcatataaagaaggggcaaatttttgaaaattttattgtcatgggtgaaattattaatgaaatattgaagaaaatgacaaataaataattcatttttttaaattaaaataattatgattttttagttttaagtgcaaagcagatcattccactagactctaatgggcttagtgacccttatgttgttcttgaactgctcccgcgtgttcattttcctgatcagccaagactgaagacgaaagtggtgaatgcaaatttgaaccccgtgtttggcgaaacgtttgaattgtgggcattttatttatgatttttttaattatcaaatataataattatttaattatatttattattgtaatcagtcaataataatttggaactaaataaatgactcatttttcagtcatattccaccatatttgccacagagtgccttggtccattttgttatcatggatcacgattttttgaaggtatcataattttgcggcaaaattttaatatttttaatcaattattgggtaaaattaaatgtaccaaattatcaaaattaaatttaaaaaataataataaattttattaggccaatgattttgcgggtgaagcattcttggacctgagcgaggtgcccggctttgcacaaggtggcattggcggcagtctgaagcagttcaaccttgtccttacgcacccatccgcgcaaccttcaaacgagtcaattgttgtggtgctggcatccagaaaagatgacaa

SEQ ID NO: 10177 - DNA, 3543 bp, Heterodera glycines
ggggggggagtgaccgcgattcattggcaattatcctcactttttcttttattacctgctgctgctgctgctgttggctgatcatttgttgatgtaattgcctttgtttttccaaatttggcgaaaatggctaaaaatttcacatttttcccacgaagccaaaatttaggataattcagcaaattttaaggaccagccaaacaagaccacaaaaaagtcattttgctcatcttgacaataattagcattgcccatttgtctggaaacaaattggcattaattagtttgttctgaacgaagtaatttgtcggcatattttgcactcggcacggacggcacagcacacacagttcttttttttgtagcgtctgtgtgaagtgccgccgccgtcgccaagtgattttgtacaatatttgcacacattagggaggcaaaatttgttggcactgtgttggttgtgagtttttgaaatgccaatggttgagtgataagaaattggagggaaattggcattttggtattaaaaaaattttccaaaaaaaaaactaaatgcttttatgttaaatcaattaaatttttaagagaataaatgaaatttatgataaaattattatttttttgttaagagaaataaaattcatctgccgcttagctttaattaacattttttagccaaatcttcgattataacaaaaaatagtaattctaaaaaaccctgaaatcattttcaaattagcataaaaattgcaaaaagaattaaaatttcaaatttcaaaaattcaataaattaattaggaatttactgttaattgaatgaaaatgcttgatggaaacagcatttttgggtctgcctttgtttaaataaaatttgttgaatgagaaatggcaacatttttattgcgctcacgaaaatggcacggtttttttgttccaaaatttgttagccgtgccaaaatcattggtccaacatttgttgctcgcgtgccgaacgcatataaaaacagaaaagttttttccgggcattacctggggtggtgtaaatttttgccgccccgggggctgtcacgcaattttttttttcactattgctggcacaaatggtgcatttcggcacaacacatcatcgctcatcagccaccacattctatgcgcgcgatgtgccaatgctccaatatttgaataattcataaccattgcgccaatttcttgccgagaatttctcgacccatttcccctcgggggctaaacttacatcttttctttttttcttttccatttaaatttttcttttcacctccgccgatgtatttctctcatcattttcttgtggtgtgagcggtgtgccgttgttgttggttgtgccacacatttattaattgactttgtgccgtgagaaagatgcgcgaatgttgttggcggataatgaagccgcagcatgccgagcagtggatggccaaggcttggcgccggaaaaccggcggaaaaaacagagccagaggcacaaaaaaatgactaaattcatatcacaatttaattgttttgttttgccaattttggtaggcatcattaaggaagttgaaatgatgaaaataaattatatatccaaattaatttaccgcaaatttttttgtataatttttaatgaaaaataaatttttatgtgtattaaatttcttacaattcttaattgaaacttatttgaaaaaaccaacaaaatcaaacaaataaatcgcacaatttgccagacaatgcctctgaacagaattccagcgaggcgatcttaacaagcggaaaaccgagtttgaattgaggacagacaacaaagccacaaaaatgtgaacggaatggagtagagtgccacgggaccgggactttttggctgggaaaaccgggaaaaaaccggaactagtcccggtcccggtcaaaaccgggaccttggtactcagttgtactcagttgtccgtgttcaggtcccggtcccgctgcactctagaatggagcgataaacttgccattatttggtgtcattattttttgtaattattggattttttcttataaattcttaacaaaaatgcacagtaaatacaagaaatacacccttaagaataaaaaagaatttttaattttcgaaagaattatatggcaaaattgtcatttaattgaattattttgggattttttgccagcaacaagggcattattgtacaattccattcaattattaatcaaggtcaccagcagcagcagtcctcggcaccagggatggcattctgagtccgcaaaaatttttcggaattctttatgaggctcaatgtttcgaaaatctgaattaggacaaccaaaaaatcggaagtcggacttccgtgccatccctgcttggcaccgtccttcgtctctccgctaagcgccaattcggtacttaccgtattttctctaattatcgcccaatctccattaatcccccaatctcctccaattatcccccagtctaggaggggtttgaaaaataatcccccagtctccatttatcccccaggggtataaatggaattttttcaaagcaattaggtaattctaaattacaattcgtttaaatgtttaatcaacatgaaaaaataatacggaaaaataatttacttcaccctgcttccgaaccatttttgtattaaaaaaaatatccacttgaaaactacgtaacaccagggctggccatgattgaatttccaatcacggatatccgtgatccgtgatcacggcacggcaccccaaaaactccgggattgccgtaatcacggccagccctgatgtacacccacccccgtttggtccgaattccaaaatgaattttatttttaaaacttactttaaaactatgataaaatataaaataaaataccgcttgtaatgcaaaaaattgcggctttttcttgtgttttaatttgtgaaaacacaatttcagaacggagttctgattttttttgaaaatcgaaagtttccagaattctggaaaatttttcatctttaatttataaaaactagagtccggtaaaaaattttccgggaacgggaaaacgaaaaacaacggggcgggattcccgaacggaattcccgtgttttcccgtgggaatctcgttcccgccggactctaataaaaaccaaataaaaaattttattcttcctgtaccaagggtacccgcattagcaagatgccaataaggatattatccatacaaattttctaattttatttttgttcgagttcgggtcaggggttcgacattggcaaaaatgggtgctgtattcgtgatcagcgaccctaaaaaccccttaaaacttattttctaaaacacatttataggcatttaaaaatgtatgttatttatccatgcgaataacttttcttatttctattttcgtgcatttagtatttgattggagcaataaatgcgagttttgatgaacaatgatattttcgactttttgttcgagtttggagttcggggttcggaattggcgagaaagggtgtcatattcgtgatc

SEQ ID NO: 10178 - DNA, 5345 bp, Heterodera glycines
gcggggcacttcactttgcattccgtgaatatttctgcacggtcgaagggaatcgcctacccttgctgagtcattaccgccgcagtgaagggcaaacagtgtctcattagcgcacttgactttggccaaagcagtgccgtgatccgcgcggcatgttgcgttgaatgttgcgccctgaatgttgcgcccgatgtgcatctatagcacacactgagtgtgggtgaggacacccaacattttgtattgctgtactcgctgatcagctccaggcccttgagttggatatgtacctgaacgggtgaatactgaaattcagctcggatcgaagagccgtgattgtgaaggtgcaatcgtgccacgtccaatggcaatcgttgttccgggttgttcaacacccgtccaatgtcgaggtctctgcagtgacagtgtaccgtgccattgtcgtgatcgggggcgcatttttggcacgccccaatggagagttggcatttgtcgaaaccccgtgctgtctcttcgtcggggcagtgcaggtctgacggcatgggtctccccatggccacagcccgtccatcggtgacgaaatgtgctgaaagtgccagcattggcgggagagaggtgggtatgactgagatggtcatgtttccccacggctccgaaactcccgggtgtagcgtcagtcgttgtgagtcaatttggccgttgttggtttccaattccacccaagcgctgatctgcatgtcccattcgagacacgtgaactcctcgaagactgtggtcgttgtcggcaccgcagcccatcggtagaagaggcatgaagccgagggcagcccacacgaattctgccaaaaactggtgctgcgcatacagaatgaatgcccaggccgatgattgagggcaataagttcgggaatcgtctcccggttgcgaatggcactgcacgtgtttccgcgacacgatcctgccgatggacatcgcttcacggctgtcgttgagatggagtaggaacgcagccaactttccgtttttggcacacaaatcatcgtgattgaggcgaggcgaagtcggacggctccgagcagctcgtcctgttgggttcgaatgacgaatgagttcgtctgatccgatggcagtagtgttagcactgtcgccgctgttcccgcgcatttcagtccttccgccgatctcgagcagtcctccgatcgaaccattacggagatgggcttggtagccattgtggtgccgaagacgagcagaagagggagaagtgaagccgccactactcccgtcctggccccatggccccgttcgggatgctgccatgcctgggccattgctcgagctcttctgccgagttggagtcgccgctgtaactcccgtatttctgcccgcgcaacttttgctccctttcgcattttgccctcgattcgttccgctgttggttgtgggagccgtcgtccggttgcccaattgatgaatttgacggggtagctgactcccaaggcaattgctcgggagaaaagcgttgctcccgaccagaatcgggagaccaatgagcaacagcagccgaaaacggctagcacaagtgccgctccaaaaccgaagagggtggatgcccaccgcgggtggcacgttgggttggcgagctgctcccaacagaaggagcagttgatgagttcacattcctctctcgctgggcaccgctgagtgacattgaaaggggggcccgacccccaccaacactgaccgctgcatgagtagccatgaatcagtacctcagccggtagttcgtagctgatcactgtcgctgttggcacagttgcccagcatccgtctgggcagcaaatttcggctttccgtagccgccgaccgctgcttgtcttcacgccgcgtttcgtgcattccatgtggcacggcaacatcgtcgtgcgcatgtccgggtccgattgttccaacggtggtagcgatggggtgggttgacacccccatgccaaagttgggcagataagtgccatcattaccgccaaggcgaccagggggaatttgctcccccttttatcgaccttccgatgctcaggtgaccaaattctccgtggcttgcgattccgctgtgattttcgtcgttcatctccctgcactgctcgaccctccgacaattgttcgttccgctgcgtcactggcggttcttcccccagcatttgctcaggctcgggcgtgctttccttcgttcgttcatccgtgctgaagggagtattgctctcccttttgtccttgtctgcgccgtccgcttcatttgcttcgccgggatcacgatccggcgcctctcgttgatcgctttcttccgtctcgggacccgcctcaatggggcaaattttattcacaggtcttccccaaattcttccgttcgccattttgagcagcacactccggacgtggccgcctgatcctttgagttcctcgacgcgacccatcgcccacaaattgcgcgggtggaatttatcctccaccaaaacgatgtcccccactcttggtgctccgggtgcattcacccgtttctgcgggtgattccatcccgccttttctcgcagtgccatgaggtactctcggtgccatcgccgccagaaatgctcaagtcgttgttgagagtgccgccattgtctcgtcagttgttcgtgcggtggttcgcgtcgttggccgttcggttcggaggatcccggcggtggattcactatgagccgaccattctcctgaactagatcaatcggtcgcagcgggagcggttctcccgggttgccattgacataagtgatcggtcgagaattgaccgtcgcttcaacttcagccaaaagcgtgctgaaaccttcgtaatcgaggacacagctccccagtgtcttctgcaatgctcgcttaacgagttgcacagcccgttcgaagattccaccggcccatggtgtatgctgcggggtgaatcgccattgaatgccccgggagtccgcgaattccagcggatggtctcccgttatgccaaattcgcccaaagttttgccaacaatcgtgaatgtcggtgcattgtcgctcagaatccggcttggtgctccgcgacgagcaatgaacctcctcagtaaagcgatgaagctttttgctgacaaatcccgggttgcgtcgatgtaaattgcccgggtggtcaagcaagtgatcagaagcacccaggctttctgtcgttgtctactgtcgtcaagagtggctgttgggccgagaaaatcgagccccaccgattcaaagggcacccgtcgccgcactcgatccatcggtaatgggggcattgtgggaagggggtaggccatccccctgaggcgtcggcattgtcggcactgcccgagtactctccgcacttgttgccgcgcgcttgggcaccaccatcttctcaggaactcggaaagtgtcccgtcgggtcccgcatgatgaaaacgcacatgaatgtcatcgatgatgagtgctcccgctcttgaccctctcgggagtagcactggctggctgacttccgtttcttcgcaccatccgatccggctgagcagtctctggacgccattttcatccttttccgcccgaattttgtcctgaatttggcaagtgagttggactgcgcgaatgaccgtccattgggcgcttgttagctcgtcgcaacttgggacggacagcgattgtccgccaagtttggttttgctccgcagggggctttcttcccccgtgtcaaggctgggagttttcggtctcccattttgtttcctctgacagcgttttcgaacattcgtggtgaatcgcctgacccaggcagtcacgcggagaacttttgcccatttactgcagcgggttaagcagcgaattgggccattcttccttttgacagggagtgccctccctttgggctacgagcgtggcgctggtgagttcctccgctggggttgcttcctcttcgtcgtcatccactttgaactcgagctcatgtggccaggttgcgcaggaagtcgctaaccaaactgggcctttccaccataactcgaattgctgcaaatgcgcgggggagagcccccgagttgccgagtccgctgggttgttgctcgttggcacgtagtggaatgttgcgtccgtggatttgcgtatctcggccagccggttggcaacaaactgtggctggggtgtccggttcttcacccagtggagagcaatcgtcgaatcgctccaaatgtgctcttctgaaattggcctgtgtaattgagtcttgacaaacgctgccagtcgaacgcctaaaacgaggcccatcagctccattcttgggattgtgaacgttcccgaagccttctttggcttaagtcgggatttggccatgatgaggcgggagagaatgctcccgtccactccttctgatcggagatatgctgcagcggcatatgcgttttccgatgcgtcggtgaacacgtgcagctggcaatattcggccccttccgctcgggcgactctggggatagtgatgaattccccgtcccaacttgccacaattctgttccattctcgcgcatcgtccgcgtccagcggggcatcccagctgtgtgtcgactcccacaatcgttggaagaattgcttggctgggagagttgccggcgcaagcagtcccagtgggtcaaacagtcgggcaatagtctttagcaccgcccgccttgaactgtggcctccggcaccggcgggagtcactcccgaaaagaccatccgaattgagtctttctccgcgtcccattcgagtcccagcatcttcgccgtcgttttgcccagggcgtccgcctctgaaaagctgctgttcaggttttgatcatttgtcaggaactcgcgcaggttcattttcgcttccgtgaacattcgtttggcttcccgagccttttgcgatgcttcttcgactgtgtccgccggtatgagcacattgtcgacgtatgtgtccctgatgagctgctccgcaaaatccgagccgtacttgcgtaggtggtgccgcaccaccgcagccaagcagaacgggctgggcgttaagccgaacgccaatcgccgaaatcggtagggcaccaaatttgccgtcgttagcggcccgagtgggtcgcgcacccacaaaaacttgcacacttctcgatcggcttcttcgattccaaccatcagaaatgctttctccacatcggcaatcacgggcacttggcatgcccgaaaacggataagcattccggccaggtccggcagccaaaccggccctctcaacaaacagtcgttgagggaagggactcccttggcgtgtgcactcgcatcgtaga

SEQ ID NO: 10179 - DNA, 943 bp, Heterodera glycines
tttttatttgccaataaatctctgtttttttccatctttcaataccttttgagcattaaattcattttcccttttcttcaaatgtaattgaatgagaaatggacattaaatatgagaaacggagaaagatgcaaaagtcggcgtaatttgcataaattgacccttaatgagactgacttttggttccttcggcggaattcaatccaaagcaaaagagttaaaagggaaacggagggacggcaaatcggcgaagaaaaccttcaaaattgggccgcatttgttcgaatttccataaccataaaaggcattcaccgcaaaagggcagaaatgggcgcggaaaaggacacaaagccaatgatgagcttaacttcactctgctcctctgcttgtcccgcttcactcccttccgtcgcttttccttttcgccccttttccctttcctctttctctcctcttcactcgctttttccccttcctttttctcttcctcttactcttccttttactctttctctacctcttactcttcctcctctttcttcctctccctcttcacccgccttttcccctcactcttcctcttcccatcccttctccttccctcttcctcttccaattccttttcatcccctcttcctattcttccttcctcttccctttcatctttcctttctccaatttgcccctccccccacttcctttgactgaatgaatccttccgcgactgttctcatccctccattttctctctctcttttctgtcccattggcgcaagggacatttttcactcttccatcgttaattttgttttcctcccgggaaaatgccgtacaaagaaaattagccgagggttggatttggcagtgtgcggggggaggggaggcgtgagcggcgggggttatgtcattgtcatgccggaaggcccggggggggggggggggg

SEQ ID NO: 10180 - DNA, 3161 bp, Heterodera glycines
tcattctcttcacttgtcagactgtgccgaacatgttcatcttctcgctgtcctgctccgatatcctcgtctgttgcatctccgccactatcactcccatctccgcctttcgaaaagttattttcgttaatttatttttacacagttttggtttttccaggattgggtcttcggacaattcttctgctcaaccgcccctttcattgcggtcggtcttttccatttgtttctttctctctctcccctattttcatgccatttcgtctctggcattttttttggcatttcgccttttgtctcggctaacttctccgcttcttcagggtgtcagtttgtgcttctccacttttacactcgccgccatctccgtcgatcgttttatgctgatcatttttcccacccgaaaggctttttcccatggccaagcattgtttattataatggtcattaatttttgaaattccaattttaaaatctttccctcttctgaagaccatttgtctgttggcttccgcttttagtcttccgatgattttcatgcaaaaattgcggaattatgacaatttctgcggcgagttctgcttcgaagactggggacaaaacattggcattcgccgaatttacgggtcaattagccgattagaaattgtgcttttccctattcatttattgtcattccgtttagcactcttttgctcactgttcaattcattgttccggttggttttgccttttttaattaactaattaactgtaaattggttcagctcgctctgatcattttttgctacaccgccatatcagtccgacttggcaaagtgcgttcggtggtatgccggagggggggggggtggggggaagccccccttctgatcagtaaatggaacttcctctgatcagtgaccaaatgaagacctatttccgatcagtgaccaaatagaacaccgttttgatccgtgatcaaatggaacgctcaattctgatcagtccgtccccttccacaacagagtgccaattttcggaacaaaaaagcaggcgaatggcaaatgccggtgagtgctcaaagaaatgccgccacaaaacgacgacagcgtaccaatcgaatgtaagcatcaaattaaagagttaaaatatttaagtcatgccgctaactctgcaaaactttaaggatcttaattattgaaatttgtcttttaagtcttcttaagtttcttaaaaatattaatttatttgctatcgaatttattgaaaatatatatttttaaatctaatcaaaaaaatttacaatttttttcgtgaaatattcaattttttactagtcgaaaaatttttgatcataaaagcgaatttggatcttttgcttgctcctaatattcatctcaggttgaagaagtttatgaacatttagatgccaaagtgatgactataaggatgcaaattatatgcaccaaaacgtgcaaaaaagtgaaaatatgtaaaatataaaattgtcagaagtgagggcaaatttttttttaattctttaaattcgttaaatttgagcaaaaatctcgtaaatagctaaatatggtaaaaaatcatttaaaaaatgcttttactgtcctcccccaatttattaggttcatcgccatggtcatcgccttctctctgagttgggtttggagtgtgctgtacaatttgcttcgcgactacgagtgccttcccctgctcatctctcgccaagagttcttcttcggcattctcacccattgcatcgctatgagttccaccgtttggtccgtaagccatttcaatgccattgagtcgcttttgactcattaaaatggctaattgccccgttaattcgcaggaatccaattttatacgctttgctgaacctccaactccgcgccgccttcctccaactcattcctgaatgtgcaaaaaatgttctggtcgaattatgcgggagggaacagacgcagcaacaacagaggaattcggccgagaaaagcaggtgggccaagcgaagcatagactgagagagacattggattgatcagtcaagaaggaactgatcggatactgcgggatgatcaaggaatattgattggactgatcgggattgaggctgatcagccaagacgggactgatcggatacagcgggataatcaaggaatgatcaaaattagagctgatcagccaattatactagttgaactcattaaattacattaagcaatttaagattaaaacataaaggatttttggttactgtattaatttttttttcaattttttcagacttttggacataaataatggcataaaagaatctgaggaacggacaaagaaattgctgagctgtttcctcacttcgcgtggttcggtcgaagtgtcgacaagcagcgaatttggcaaaatgtcggagggaaaagcaaagacagcgcaaaacgcactcaaactgaagacagttcagcagaagaagaagacgaagaaggtaaaggaaagaaaagacgagaaaagaaaagaaaagtgattggaatttaaagggcacggaaaaaagaaaagatgaaaacaacggaagaggggacgaaacgaaatgggagggaagtgatcggcggaaaggggacgaagcggaaacgacagaaacggcacaatgggagggaagtgatcggcggaagggggaagaagcggaaacgacagaaacggcacaatgggagggaagtgatcggcggaagggggaagaagcggaggaagagaagcggcagcagggagacggacatggcacagcggcagacatcaaagagatggacatggacgaacagatctgatcagacggacggacatgggacagatcaaagagagggacacgaagagcacatatgctgatcagctgaaaacggcatacagcagatttgaagagaaactcaaagtgacactttgtattgtaaattactttttgcttttttatttactttttttttgtacatatggacagctgagagaaatgatcatttataatttgtgtttggcaatggatttggggggggggggactcgattaattcattttcctttccaacatcattcatttatgggtgaaaatgatgacgagatggagggaggggggggggggggatcttcttcccctgctttagcttctgcttttgtgccatgtc

SEQ ID NO: 10181 - DNA, 3761 bp, Heterodera glycines
caaagacaaaaaacctatttgtcaatgaattaccccgtaaatgtgaaccatggtcaataattcttccaaattatttgttttgttttttgtaaggtgttgcctagtcatgcaaacttttcttatgtttttaagagtcgcttatcacgaatctgaatcgatcattccgagtgtttaatggagtttgaaacaaaaatttgaaatttgttaaattaatttttcgaaattttgttcgaattaggattcgaaattaaccaaaatggatgtcagattcataatcagcgaccgctaaaactccggtgaataatttttcacgattttttatcacaaaaaattttcaatgattttccactatggtttttgataaaattcaaaatatacactttgcacatatattacttggaattttcaactgatttgtccctttgggtttcagatgtttttgaataaagctcgcgatgttgctgacctgctcatgccgtcatttaatgccagccctttcgggattccgatgtctttaatcaatttgaggaccggtcgaacagggaattacggttgggcaagcggtggttgctcaattctgtccgagtttggctctttggaattggagttcaactatctgtccagactgaccggcaatctgacgtacatgtcaaaatgtgctcgagttcgggagtatgtcattgaactccaaaaaccggatggactttatccggttggaaaacaaaaatgtttaccactttcaaacaaaaaaactttactagaattatctcaaccctcaaactgggaaatggtgtcaaagtatgttggtcttacttttaaaacattttggcaattaatttttgcttccattaattgtaagaacatgtttcggtcggagcgcttggcgactctttctatgaatatttgctcaaaatttggtagactttacggctgtgcgtttttcttatttcattctgtttaggattttcaatgggaaaagagacgaccatttgaaagaagcgtatcggaatgccataaaagcgatagaagaaaagcttttacacaaatcaactcaaaataatttgtggtattttgcggaaatgaaaagcagccgaattgagcataaaatggaccatttggtaattatttgggcaattagtttccttatttccatttcaggcttgttttattgctggaatgttcgcacttcagtcgctccaagagaatgatgaaacaacgcgcgtgaacactttgaaattggcagaacaaattggacacacatgtcatgagtcataccgaaagacaggtgcattttaaattgcaacaaatcttttgaaaactttgttttcagtgactggcattggacccgaggcatttcgcttctcatcggacgccgaagcgcaagcgacgcgcatttccgaggcgtattatattctaagacccgaagctgtcgagggatggttttatctgtggcgggccaccggggatgagaagtatcgcgaatggtgttgggaagcagcgcaggccattgaacggcattgccgggtggaggcgggctattcgggaattcggaatgtcaacgcccagcaggtacagccgtttaacaaggaaaccacccgaactgtctagtaaagtgcctataaatttggtaccaatgggcaaagcagtttatggcgaaaatcaaaaagttatggggcctagctggacttaatccgaatggttcccttgcaaatataagcaaaaacctttttagattgaacatgacgatgttcaacaatcgttcttccttgccgagacgctcaaatatcttttcttgatattcagtgactcaacagaaattccactcgatcaatgggttttcaacacggtaattcagagtttagagaattcaaacaaacattatttcttattctaggaagctcatccttttccgattgcacattctgctcaacaagttcagtgaggtcaaaatagcgaataccaaaattaaatggctttgttttaaaagtcatatgctcccagtgatacatacattaacagacgcacaatttaccgaatttacactgctttcaattgtattctacgcccttctttttttgcttctaatgtcagtatatataatgttatccttttattttcttttcatgtcagtacacactattttcgtccagttctgcctattttgtttcattaaaaataaagtgtttaacgttggttgcgtggcttcaaattgtcacagtcgttttcaagtaataatttaatttgtgaatcgattaccgatatagaaattaatgggacttgttagatataatagaaatttggtcatcatcataaatttttgtcgggcattaagcatcaattctctttttcgtctcattgtcagtgcttcggcaatcattaatctcattccgatcccttcgtttcgcttccaaatttctcccagtgctcgagtgcctaaactcatattttttgttgtcatataaaaagaaaacttacgcgttgttcactttcgagcagtccttccaagtaggagacaattgccttctggtaattaataatttcatttttttaatagttaataatttatttgttcaattattcatttttccctccattccgccccatcccccaatttgccttaatgtcctctctacgctgcttgaacagtcggctgtactcctcgcgaatcactttgctcatcaccagaaagtctttctccatttggtccgctttgttctcacactctttcagctcctctctgcactgagccgctttgtcagttttaccggttaagtccctttgaaattgagtaaaaatagcataaatttaataaacgccacaactcacagacgcgccttcgtttcgcgctttcgcgtcaaagtttgctgctgattctgccagttttgccaacccttcacgcgttcgtagaaaacttctttaagcaccgagaggagctggagatgctcctatataaaaaaatgtatgaaaatttaatagtaattgaaaaatttgcaattcgtgggaaaaaaatgccggacctttttaaggggaggaggtgggggtcgctaataaattcattaaaaaattccataaaagtttcccggcggcgcctacaggcaacgtcgggcctcccaatcccgataagtttttatctgatttacatggcttggtccccttcgtagagttaggcgtcgaccaccccgccccccttgacacggaaacagccagaccgacttccccctcacattgacgacttcctccaattgctgtgcgtcctgttccgcttcatgcttctccactatggccaaattctcgtgggtctccgctaattttgatagaattcgtgccaacactgtgttctcctcgcacgatgccaacatggacaatgctttgcttgactgatcatcgctgaatgccaaatccctgcgatgagtgaccaacgaatcgacgtgcgtttgaagacgggtcagcatctcctccaactcatccacctgactatgcacttgctcaaacctgcaaatacggaaatggcatataaggaagaaagcagaaatttcagaatccatgttaaaaaaccaaccaacgatcattctcatccatcggaaaggcgatttttgaaaacacatctccaacagatttgaacatcttaaacggaacaattaaagattgatttagttccaatggtttctattactgatgttggatgttcccagcagtttcttatttttacccactttccgcatactgctcccgctgaatgcagaagtgtggaagacttggca

SEQ ID NO: 10182 - DNA, 2625 bp, Heterodera glycines
cacgcgtttttatcggatacttcaaaggtgggcaccacaatttttctctgagtccattttcctctttcaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggttcgcatctcatattatttcaatttgtttacactgcctttgttttttcaggtttgcagggcgccgttcgtggaattggtggtcctggaatgggtgggcccatgcagcccggatacatgcaagggatgccgcagggaatgccgccacgtccattttgatgctcgattttgttttctttgttcgaccattatttgttttcttacttttacacaatgatctgtttgtttgataaataagttatcgaactttgcttttgacatgtgtttggctgtattgcactttgccagtttataaattattcgttttattgtatcattttttccattcattcttgatattagaaatagaaatgccgccaaaaaagcaggttgagcagcaacaccagccaattctcggtcgattaggcacgaatttaaaagtgcatttaatacttttttcggttgaccaattccccttgcctaaattgttttcagatgggcattcttggcttaccgaatgttgggaaatcgacgttcttcaatgtactcacaaaatcggaagcccaggcggaaaatttccccttctgcaccatagacccaaatgagagtcgagtggctgttgaagacacccgattcgattggctggtggagcactacaaaccgttgagcagagtgccagcctatttgaccgttgttgacatcgccggactggtcaaaggtggatgaagctttttcactattctcatgagcatttcaaattcaggcgcatctgaaggccaaggacttggcaattcatgtaatatttgattgattgtcgtccttcactttcgttgctcatttaatttttttagtcctttcccacgtcggcgcttgcgacgccctcttccatttgtgtcggtcctttgaagacactgaagtgacccatgttgaaggtgtgccaaaaaatcaccagaacatttattgaataattttaggtgacgtggacccaatccgtgacttggaaattatcaacagtgagttgcggttgaaagaccaggcatatttggtgggagcgttggacaaagtggagaaattggctgtccgggccaatgacaaaacgaagaagttggagcacgacactttgttgaaggtcaaagagttgctggagacaaagtttgtacggcaacacgaatggaatgagaaggtgagacagaaaggggcgaaatttggaagaattttggcaaagtttaggaaattgaagtgctcaacaaacaccttttcctcaccgcaaagccaatcgtttatcttgtgaatttgagcgaacaagacttcatcaaaaaggtaggacagccaacccaaccaagttttgttcggttagcccgaaatataaccaaaaacattttcagaagaacaaatggcttccgaaaatcaaagcgtggatcgatgagaatgacccgggcgctgtgagtaaacaaaattctaaactcccattccgtaaatggccctttacaggtattaatccccttttcgggtgcctttgagttgaagtcggttgaactggaccccgaggcgagggcccaattcttcaaagatacgggtgcttgcagcgcacttgacaagatcattaagactggctacaagaccctttgcctcgagtatttcttcacgtgagtaagcccttcaatttccaaaacaattaatcatttgtcaaattgaagagccggcaaagacgaagtcagagcatggaccatccaaaaagggaccaaagcgccgcagggggctggacgaattcataccgattttgagaagggattcataatggtgataatataaagggaatgatggttggataataaatatgacaatgcttttgtttttaggccgaagtaatgaaagtggccgatttggtcgaattgggcaacgaaaatgcagtcaaaggagcggggaaatacagacaacaagggaggcaagtgccaatggggccaaatttgatggtaattccggtcttttaacaggaactatgtggtggaagacggggacatcatcttcttcaagttcaacgctggtgctggtttgactgctgccaaaaagaagtgaaagccgaaggtcgcatttggtatttattttctcaatgcctctcaaaaaaattgaaatgttataatattttctgaaccaatgtgaggttttgggattttgcaaaatttgtgtccttttaataggaagcttccttttttgttttattgtatttgaatttcttgttataaataaaactgcttggtttatgatggtttttgaaattttaattt

SEQ ID NO: 10183 - DNA, 354 bp, Heterodera glycines
cctccccccccccccctccccctcaatcctttcggggaaaacgctcaaaaacacattgaaacgtaaacccgccccttcaaacaaaacctaaagcgggtgggggatgaagcgagtttgaatttgaattgaatgcgtacggaggggggggggggaacggcggaaggggaggggcccaggaagtcccacccgtgttctttgttctcgccaaaacacccaaaatttctaccgagaattggggacgggaatttgatggaagagcaaagattaatttatgattggcttttcattgatttctccgtcggatggcacgcactttcttccgttgcgttgtgtccattccgtttcgtttaggtg

SEQ ID NO: 10184 - DNA, 2486 bp, Heterodera glycines
caatcattgggactcaacccaccaacattgcaatcattgggactcaagccaccaacattccaatcaacgggactcaatccacctgcatttcaaatcactgggactcaatccaccaacattccaatcaacgggactcaatccaccagcatttcaatcattgggactcaacccaccaacattccaatcactgggactcaattcttctgcatttcaatcactggtactcaacccaccaacatttcaatcattgggactcaacccactaacattccaatcattgggactcaattcttctgcatttcaaacactgggactcaatccaccaacattccaatcaacgggactcaatccaccagcatttcaatcattgggactcaacccaccaacattccaatcactgggtttaatcactgggactcaacccagcaacattccaatcaacgggactcaattcaccagaatttcaatcactgggactcaattctcccgaattcatatcactggactcaatctcatcaatccttcagcaacacaattaccgggactcagttctccgacatttcaatcatcggaactcaacctcagcaacggaatacagaactatttaaaaggaatccagaaattgaaatataacccataaatcaaaacactatggtgtataattattgcccccaccccataaattcaaattaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggctttttctttcattttttattactatcataacatgctttttattcaaaacaaatatcaaaaccaaatcagattcttttcatattataagcaaggaaaagtacaaaaaacttttttaagtaacaaacctttttcattcaaacgaattctaatgcatttttttaaccaaacaattctccattatcgtttacataagcaaaacaaaagctttcacatcaaaatcaaatcaattaacaaaaacgaaaatttagacaaaaaaataatgataacagcaaacccacaaattttttcttacacacaaaaacagaaccttcatataccggattttccactcaaacaaacacaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgccccctctcacccgccgctgcccgcgtagacagacaatcagacagtgcactattttcccacctttccctcgctctacttttttcaaatacatttttaacgcaaaacaattacaaaacgccacacaaattcaaacactggacacacacaacagacactcaactttattatataagattttgtcaatgtccgttgccatccctcgttttaagtgcaaattataataaatacaaaaatctatctccaaatggaagacattacgacacataagtcagttcatcatgaagaaaatgaacgaggcaagtcgaagtggatcaaaattagtgagtttcattttaaacattttatttttaattgttcttatatgaatgctcaaaagggtaatactgcagaatagcggtcccgacgaaaaatatttttatctttcgtggggtaaaaattgtactgattacgaatctgaactcaaactttgaaaatcattgatttttatcacatagattttttcaaaagttttaataaaattaactccttgtaccctcccccccccctttctttgaaatgaaaattttcaaaaaaaaattttagaaataagttgttttataggttttcagggtcgagaatacgattctaacatacatttcgaaccttattcatttcgccaaatttgaacccttttgaataacttccaaaattgttgcgcaaatttttgtttcagtttaaattgtttggctctattccagtttacgcgtgccaatgagtgaccaccctcacttttttagaccataaccttttttttacttagtcaatccgaacattcttggtatcattcgaaaggctaaaggttaaggaaattataaatacaagaaaagaacaaatacttatattactgaaaaagattgcggtgctagacgattgtcgcattctgtgcccttcttataccgacaaagaaacgtgggaggaccacttttggtgaacaatacgtgggaggaggagtaggtggagcactttttaggaaaagaggaaaaaatatgatgaataattggacctaaaaacagaaaggacagaaaattattaagaaaaaa

SEQ ID NO: 10185 - DNA, 2719 bp, Heterodera glycines
  misc_feature (1292)..(1292): n is a, c, g, or t
  misc_feature (1324)..(1324): n is a, c, g, or t
ggtaaataaaaacaagacagtgggcggcataagtgggggcaaaggggggcctgataatgggtgggaatttttctttaatcccttgggggaatggccacaaaaatagtgatgtgatggagggaggcatgggggtgagcaagactgtcatagtagagcctggcgtatccattcccttcgcataaatggcgcaccaatgagagccctccttgtggtgggcggtccctgttcacggcgagcgctgcggggtactgtagtgtgaagggaggcggcaattggtcactggcgaagcagccccgaaacgctggctcggtctgccgattttcgctcaatatccgtataatttggaggcgtgcgttcgttagccagagagttgatacaaagtagatgcagaatcggaggggggaagagcctcggatatggcagcaacaacgacctctgcactctacgaaagccattttgatgaagcaatttcggaaatgacacaaaactgatcggaatttacaaattatttcattttttcaatatttatttataaaatgatagcataaaaataaatgatcattgatcaaaaaaatgcctttaaaaaaggcttctgcttaaaaaacgtattgacgctgtattgtccccctgcggcagcattacttttgactcaatgctcgagcaacaaattcagaccacccaaaacatcatcgacacaatcttcgaaattgcccccaatcttcggcattagccaactgcctattctgcaaaagcttatcaaaagcctctctattctcaatcattttttattggcgtttcctttaccgttaaacggtttaacatattctaacacatcattaataaaattaaacacaatttggtacgcaatcgattcttttgactcgggtttgcacacattatggtgtccttcgtcaaggtggtacaccggtcctttgcccattatgcccgactccacgggcacgagcatcacttctcttccgaaaacccttgtcttcttgcactccaatacggtcgcaatgaatgggatttgttccgctgctttgttgaaacggttggccaatttgttgttctgttcacttttgggctgaagaagcaaaacgtcgctagacggtctgatgaaataggggcggagttgagaggccacgggagtgcccaaatggggggtggccatgaaaagcacaccgacagtcttcgagaggagctgctcattttctgaaccaaattgctattttaagtccaaaaatcaaggacctaatgtaaaacaaaatgataaatagtattattgaccattnaatgtaaaagtggaccgaaattagacactttntgaggtgtacctaaaagcaactgtttggccagcagtccgcccatactgtggcaaatgaatacgattggtctttctccaattccgtttctcttaaactcttcagcaaaaagttgagcgcgtgcttcaaacgtttccattgatttgctcagttgaaaaaaacgcgaagaataatcgacggcgatcattcggacggattcctttaggtcgacggccaaccaatcctaagaaaagcgaggccatttggcacgctgacaaaacgaacttttggccaaaaaagtgtggtcctttcgttcggtctgtctttttggcgccatgtccgaaacgcacttccgcgcagtccgtggacaaacacctgataaatttgaaaaaccaattggctttgtgtaaggaaaataggactgttttgatagctttttgtaagttttaatatataattttattattagggcccgtattattttgtgggtcctttgtccgtgggccctttgtcactgcaccttggtttttggtaattaaatttacaatgtcaatttgtggcattttgttgctcattggcttatgcaattcgtaaaggtgcgccggcaattcatttttctcgcgtccaaaggcgaaaagaatgttggacagaattttgtgtgataaaattcgttcttcgtcgtgtgaaggatttttgagcattgacgaaagaagcggaatccaatctgaagaaagccatcggaattaattgtgcgttttctcttcgcttaaccttaataatacaaataaccttttccttggttttctatccccccgtcgttccccccccccgaaaaacgttttgaaaaaaaaattccaaatgtagaaaatttgacaaaaaaagttaacgaggaaattttttagtaagaaatttcaagaaaaaaaagtttaaaaatttcagcgattttttgtaaatttcttttgaaataacttattagttcaccataaatttgaaaaaatcgctgaaaaattttcaaaaaaaatttttgaaggagaacgacgcggggggggggggagggagctctgttagagagcgaaaaaatcagtcaatccgtgcccaaccctttttgggccgtccatcttataaatgccaagtttcaattccgtccatttgatcttccgaatataaaacgcaaagggtcaccggaattggcgacagtttgagccaattcctttgaagacgcgacagaattagcgagaattttcagcgacgtcagcacgatgggtttgttgagagtgcggtaagtgtccaccaaattaatgagaagtcgcggcaattccctccgttcgctgttttggctatttccatttgccagcatcgccccttttcgttcccgtgtcatctgaaaatggcttttgcttccatttctgcccttttca

SEQ ID NO: 10186 - DNA, 2804 bp, Heterodera glycines
taaataaaagcgaggacctgagacatccgttgcaattatcgcaattgtcagtgaattgttattttcatttttgccgcattttcgtccatattttgggaaagaaatatttttattaattaattatttaaaaattttgattgaaatatttcaaaattcataaaacagaaattacatatgttttttaatatcttattattttccttacaaatcaaaaactaatgaagaaaaaatttgtacaaaaattcaatgaaatgacaaatgaatataaagaaaaaagaaaatattcaagaaaaggaatggcaccaaaattatgatgaaatttgtaagaaaattggagtaagccaaggaacaattaacaattagaaaatggaaggaaaaactcggattaagtggtaaaagaatcactgagaatgaaaaaaatcgaaaaaatgaaaaatgttggcaaaataaaaaaataaaaattcaaaaatgagtgacaaagaaattgatcaaattatgaaaattgatagaagagtatttctattcgtacgaaataatttggagaagaaattttggaagaatcattaatttctgttattaagtattacacattaataaaatgagaacaattaaaaaaaagttttgcaaaataaaacctaaaaaataaatttttgttatttttaaaaatttggcatattatgatcactcattttgtatttttttttttaatttttttttcattaccaaattatttcttcaatttcctaattatataataaattaggcaaattttcttgctaatttcggcgagatcagaaatggcacacttattaattaggctcattagatcctttaccttgacactaaaaatgagttggacagcatttacgcacctttgacaccgactcttcagacagatttgaagttgatgacgaaatacgattaattttttcaaaaaaaaatgtttatcttgagaaaatgaataaaatatttgaaatatttaaacataaattgtcctatttttgcacatttttgtcatggttttggtcaatgcaaagcttttcattttttaatgggtaatgcttagcgtttgaaataatttcctaaattcattaaaaaatattaattttatatagagttgagcgggaccgggaccggggcgggtaatcccggttttttcaggtcccggtcccggtttttggaaaaacagaaatcccggtcccggttttgccagtcccggtcccggcgggactaaataagcactggtaagaatgggggtctgggtgagaaaagagaagggaattggtgagggatcagaaatttttgataaaaataaattaaattatttattttcatttatagcatctgtgcatctgcataagtggtcaagtggctaaactttataataatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattgccctaattataccaattgaatcagaaaagaaaaaacttcagcagaaatcatttggcgaaatatttggagaaaaatgggaagaaaaagaagaagaaaacgaaatgaactcaaaaaaagagaaataattggaaaattttataaaataaaagagaaaattaagcaaaaaggaagaaaatactcagcaaaagaatgggataaaattaactcaaaaatagcgaagaaattggggacaaatcgacaatatatttataaatggatcaaagaatttggtcttcaaaaaacgcaaaatcctataaatcaaaaactgatgaagaaaaaattgaaattgtcaaaaaatttattgaactgacaaacgaatataagcaaaaaagaaaatattcgcacatcgaatggcaacaaaattatgccgaaatttgtaagaaagtcggagttagccatagaacaattaaaaattggaagaaacaatttggaattagcagtaaattaacggagaaagaaaaaatggagaaaatgaaaaaatattggcaaataaaaatagaaaatccgaaaatgagtgagaaagaaattgcaaaaatattgaaaattgatagaaaaagcattacaaattggaagaaacaattagttttgaaatgaataaatgacccaattctttcttttttttattaagaccaagaatttgttttgttgagtgttagagaggcaaataattcaaatatttgcaattccctctcttgggctctttgaccccatattgattttccccatttattcatgcccttcccttcatccatcccacaattcattctgttaattttccttccttttgtgtgctccccaatttgctccgtccctccgacaaatattatttgtattatttttccatttgtgttaataaatttatttggttgttcgacttccacaaataattgtttgagcaattaaccggctcaacattggcgacgcccgtcttcaggacttcacttcgaacatttatcgtgttgaaatcgttcgaaatattggaaattcaaaaatcaagtgttgatttttggatttcgcagaaattcttcaaaaaacca

SEQ ID NO: 10187 - DNA, 2215 bp, Heterodera glycines
tttttactagagttgagcgggaccgggaccggggcgggaaatcccggttttttcaggtcccggtcccggtttttggaaaaacagaaatcccggtcccggttttaccagtcccggtcccggcgggactaaataagcactggtaagaatgggggtctgggtgagaaaagagaagggaattggtgagggatcagaaatttttgataaaaataaattaaattatttattttcatttataggatgtgttcatctgcataagtggtcaagtggctaaaccttttactttcattatttgtctcttcggttcaattccccgatggaacagaaaatttttttatattttctttaccattattttaattgaatttaattaataaaaaatattttaatttaaaattattatttttttcatttttaatagcctaaaaacccataaactaaccaaatatttggtcattttttgacaaattctgttaaaaaatctcgctcaaaatttcaaaatttttccggcggtgcctatcggcactgccggactccgccccctcccactgttccaaaaaatttttttgaaaaaacattgccacaaaaacagcgatttaaaagcaaaaaatttaaaagattgtaaatttatttaaaaaatacagaattttgggactcagaaaattccaagaacccccctgaaaacaaaatttttaaaaattttcctcgaactcgtcccccaaaacgtaaatacaaaattttatgggtacatttttgaatattggcaattttcgtaacaaagcgcacttaaattttcaatttttttcaaaaaaaaaatttcacttgggaaaagtcccggttggtccccgggttttttcgcggtccgtcccggtcccgacgaaaatcgatgtcccagtcccggtcccgacttttctagtcccggcaagtcccggtcccggtttttgtcaaatttcccggtcccgctcaactctatatttataaaatttcgctcgtcaaattattacattagtaattttttttgcaattaataatttttatcaagctttatcattgagaaatatgaaattgcatttatttgcatttttatttttaattgttgaaattacaaaagttggaacaaaagagaaaaagctgcaacaaaagtcatttgccgaaatatttggagaaaaatggaagaaaaagaagaaaaagaaagaaatgagaagaaaaaaagagaaataatcagaaaattttataaaataaaagaaaaaattatgcaagaaggaagaaaatattcaaaaaagaatggaataaaattgaaggaaaaatagcaaaaaaattggggacaaatcgccaatatatttataaatggattaaagaatttggcctatataaatacaaatcaaaaactaatgaaggaaaaatagaaattgttcaaaaatttattgaaatggcaaaggaatataagcaaaaaagaaaatattcacgaaaagaatggaaccaaaattataaagaaatttgtaagaaaattggagtaagccgtgaaacacttagaaaatggaagaaacaatttggcatacgcagtataaaattaacggaaaaagaaaaaatggaaaaaatgaaaatttattggcaaacaaaaaaagaaaacccaaaaatgactgacaaagaaattgcaaaaattgtgaacacttctcaacagaatatttccaattggaaaaaacaatttgtggctgaataaaatcattcgatttttagaattaacatgaaaacttttttgataaattttataaaatcatttaggtttgctgtttttttcaaatgtcgtaaatataccgaattattaaataaatatttaaatcaaaaaatcgaattttccgagagaattctatgagaggcttttggagaaataaataaattaaaaactgataaacagaaaattgaatacgaaaattcattaaagcgaataatgcaaataacaaaatattcaaccaaagaatggcgacaaaattatgccgaaatttgcaaaaaaatcggagttagcctttttctctaatgagttaattatttttcaaaatttttccactttctccttaattactccgattttaacccatttgtgctgtcttaattaatatataatacatacacgattaaatttggaagttgattccatgctggaactttcattttataaaaataattttatcaaaagaaaggaccgaaatttaatataacc

SEQ ID NO: 10188 - DNA, 1141 bp, Heterodera glycines
ggccttatcgtgaaatttaaaaatctcggaacaataaaatggccattgctctccgcccctctactcatgctgcaaagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctgctcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaatttctctcaaaaaagggagccacttttctggcctaatct

SEQ ID NO: 10189 - DNA, 5766 bp, Heterodera glycines
caagtacaactacacgggccaggagaaagcagccatccccttagtgagggagagcaaggccttattgttagccagaaaacattttggaggggaaagcccggacttttttttgttcttcgggtcaacaatttcttctcaagtcttattttaaaaatcgcagtgctggagagcaaaaaacaggaatttatattaattttcgccaaaaaacaggactaatttttgccattttggggtcaaaattgttaatgtacctttttctttaggtcatttcaatggccaagggcgtccagtcgcttatggtcaacatggacacggactttgccgtcgccatccgacagcacatttacgctgagctgcaggactttgtcggcggaccgttgcgcgaccttttggccaaagccgtgaagcacaaaaaggacattttgacggggtatcaaatctttttttttttaatttttcatcaattgccataatcatttgctatatgatattcatttaaaactaatggaagaataattttttcaaagatttcgttagtttttttgggctaaccgttcattttcgaaaaattcaaataaattatcagccaaacaccggaggatggataataattctctacaatctggcgcattgcactttccatcacttcgatttcagtgtgatcagctcaatcatggagacgtgctctgatcagtcggccaacagcggaggaattgcagaccatcggccgttgaacaaattcaattcccgctcctccgacctttcgtcatcgatgcgttcgttgggcggcggtggcggcaaaaagtccaaaaagggcggcgccgacacgggctcaatgcccgacttgcgcggccgaaggcgcagcgtggtgccaagcagcactcaggtgccatcaaaacagtcaaaacccattttttaaatttaattaaaaataaatttggaggaaaactttttcgagttttccattgcttgccagtcaaaatgttgttttttcgtagctttatttggctcggacgatgctggaatcgctggtgcatgagaagtcgtcctcgacgggccgacgaatttatcggaaggatttggacgaaaaatatcgcgagaaaatggtaatgaataagaacgggatggatctatggaaatgccaagaaatggcactccaaatttgcgttttcaggtgcatttccttcgccagtcgtatttttggcccgcactgctcgacctgaagcagtcgctggacgaaagtgtgaatttgtcccagctgtggttccgcgagttttacttggagatggcaatgggcaatcgcattcaggtggcaaaaaaagatggataaattaaaacattggcagtgagtgccagggatggaaaaatgaagcaaatttataaaaattggtgcggaacgcaaaataaatgaaaaatcaacacacaacagttagtgcagatggaaattagagctttaaatttcaaatgttcgggagcgaaactcaatttttaattttcaattaatttccccctcatttttgtatgattctcccctctcatcagttcccaattgacatgtccatgccgtggatgctcaccgaccacattctgaccacgttggacccctccctgctggagtgtgtgttgcatcagctcgacctgtacaacgacgcggccgccttcgcactgggccatttccgcaagcagttcctctacgacgaggtggaggccgaggtgaacctgtgctttgatcagttcgtctacaaactgtccgaggcggtgttcgcccattacaaacagcgggcggcgacgtaattcgggaaaacacagaaaatgttaaaaaggcccctgcatgacaaattgttattgttattcagaaaatgaattgaaattgattttcatcatcattttttggtcctctaatccctaaaactaaatgattttttttaattcgggtgcattatgaacactttaccgtacagaatgctgctcgacaagggcttcaaggaggactgtgcccgttatggaattgccatttttatgcccaattcggtacgctttgaaactctgcttcgacagcgtcatgtccaagtaagccgcagcaaatttccgactgtcttttagctttatcgtctcaatttgctttctaattctgttttatcttcagttgttgggccgttccatcgatttgaatcgccttatttcgcaacgaatcaacgcggtacatttttccaccgggggttatgtaaattttgcattttataggctttattgcgctcattggacgtggccatctccaaatttgaagcggacggtctcaactgtattatggtgagttttttttggtggtctgtttttgaaaccccttagaatcgattcacaattccaactttaaatgaattttaattcattttgccgtggtcattaggtgctggacaatctgatcgaggtgaaccgtttgtgccatcggctgctctccgaccatttgggctctttggccgactttaacgaccttttgctggaggcaaatcgccaagtgtccgcccccaacggacgcatcactttgcacgcgtttgcccagctgacggacgacgtgttggtcaacttctgcttcaacacggccacgcgccgatttgttcgcggaaaggtgattgagcttaataaacgattgtcatattgcactgcaaattcgactattaatttcgttttggtggctcagttggttatttgctgtccattcgcttattatggcgttggatcgcttcccgccacgtcccgtgtttttaaaaatttaaccggaaatgatgataaatacagacctgtatggaaatgcaccatgtcgaattaaacctctaagaagttctgatccggttaatcctttttaaattagccattgtttttttaatgttccctgttcagttgaactatcgtaagccgtcccgtggtcgtccgcccgctgttgcggcccagtatgaattcggttccaaatcgttgaactcctccttctccaacttgtcgatgatgtacggcggtttcgttggtgtgccccattttcgtgtggtggccaaattggttggctatcaggtgtttaaaacataaaaactaagaaaataaataaaatattaacgaaggccaatgaatttaacatttagtttattacaatttccagggcatttctgccattctgttcgatttgttgggcctggcccaacggctattgaacgatcagataaagacgcactttcggtcactgctcggacttatgcccaaaatgtgcaaattgcaacgcttcgaatacggcgttgaaggtgaacaagaaggaaattgggtggcactaaattgttattttttccacttgccataatccgcgcattcatttggcattccggtgcgcttgtcggattcccaaattaaattattacttaaaatttgcgtttcaatcttgaaaatcccgttttgaattaggcaatctccaatatttcatccaccaattgcgcgacttttccgcctacggcccgctgagacgcgaatgttgccaaagtttgcgtgaattgggcaacgttttggcggtcgctttgctgatggagttgggcatggcgcaggaggaaatgttcgatgtgtttgccgctgccgcgttcaccaaccaaattccgaaaccttacgcaaaaagttcggtcaattaattaaaaaggaataaaaatattatttttttttattgggggcaatttgttttttcaattaaatttcataaaaaatcacaaattttatcagacttggaggatcaagcgataaaaatgcacaaattggagagcaaatattcgcgtcttcaaattggcaaaattgtccatcagtttggcactgaaacggtcagtttgcggccacaattcagcagaaacccaattattttccattttctgccatcttcggttcagcaagccaaaatcgcgctggacagtgcagtgcttaccagtgaacggctcagttgcggactgaggatcttcgacatggtgctgatccgactgcacgacactttgctgaccgaccccatttggcgtggcccggtgccgaccaacggagtgatgtgggtggacgagtgccacgagttccaccggatttggtgcgtttttaatgggagggaatgcaattgaggctgccaactaatcatggatgttgttgatcaggtccgccttccaactcgccctttcgcttgcccacgtgcaaacccacggactgtcccatcagacgtccgccattggcagtgcgtcgtcgtcgttgtcgtcgatggaaaatgtttatggaacgctgaaaaagggcggcggaccaccggcaccaatcggtgccaatgtgacattggacagcggtgtggcatcgacggctgcacaacagcagcagcaacaaggaacgaccattgagtgagccaatttgggggaggatgggggatacacgactgaataaacgaaagggggggggggaatccgcggaggaagtatttggagtgcttctcgtggcgtgggacacactgatccgttcgttcatccacacaaatccctgtgagtgcttaaagggagctgttcggcgatggcatttattgggcgggctgtgccatcgttcgtctgctgggccaacatcggcgctttgaagtgctcgacttctcctaccatttgttgcgcgtgaatcgggcggttgggtcggcgcctaatcagcagcagcagcaacaacacggcacaacggcagggccaaaggaagggggaagcggcaacaaagcgcagcaacagcagcagcaacaacagcgaaatgtgagcaaatggaaaagggaaatctttagccatttccgccaaattttggcctttttcagacaaatttttttgcaaaaatatacgaaaataaggatccgccgggaaaatttggaataaatttattttttaaaaattagttaaattttaaaaaaaaactattttttctgatacaaatttcgggagaggggcctctcgcggggcttaacccaccctttattgtcacatttgtagactttcccattttaataattgtggaaatattatgcacaatgggaatatctcaggctaacagcaaaatgtatcctttccgcagattgtgcggctcatcgaacgaatccgtcgagttcaggcgcaacacaaacaggtgttcgccctgctcggcaatttctgcgttcacgtggaggaacaggagcagaaaattcggcattttgcaccgcccgtctatcagccgctgcaaaatccgtacgcaaatggccgcgaaggcattgcgttgtgacaaatgggcggcgctgtgaatgaacacgacaaaaaagaagcgacagcaataaaataataaataataatgcacatacgtaaacataattaattacacactgcctaattaattactaattaattaacattattcccgctttaactgttcactttttaatttattattttgtaattatttttaacacatgaaaattaaatgccatacaaaaaccaaaagtcattcgacatgttgccaatcacacggcagggacggtcccaggattttggcttggggggggggcacctcccaccgggcgacgtttttttttttttgcttttcacacccgttttttatgtggcgcagtttttccaaaaatttttttgggggacagggggtctaggcgccgccgggaaaatttttgcggtttaaatgcggtttgttaacagattttgtccaaaaaatgaccaaattttagattttgagccatttttagcagattttcattaaaaatttgtg

SEQ ID NO: 10190 - DNA, 1820 bp, Heterodera glycines
gtaacgaaccatcattgttatgatttccgactgtccatataataaatctatctacaaattatttagaaaaaaaatatataaaaaattttgaataaaataaaaagcatgtttttcacggcggattttcttgtgaattaataaacattttataattaaattttaaaatcattcaccagtgcctccttgttaaataatcgtaaccggagctttggtcttaaaattttataaatcctcattgaaacgcagaaaatcttcaaaaatcttcatttggataggaaaaattctaaaacttttataaacattttgaattaagtgaacaaaaccagcttaacaataaacaaacatttttttaatatttacccaaaaaccttaaaggcttaaaattatttagcaaatatattctccatacgctgctctctcttccgggtgaagaaagtgcacaattaattaaggtgaaaagagagttaaaaattaaaaaaattattattttggcatcttgcgtaatgtccagttcagtcccacacacatttgtttttctccattgacccattcaaatcattttgtttagggttggtcggaaccgggaccaaaacacggacaactgagtaccgaactgccggttttgaccagttttgatcgggaccgggaaattcccgggttttttcccggttttcccagccaaaaagtcccgggttttcaacccgaaaggtcccggttccggttttgcccaaaattcccggtccctaccaacccttgtactttaaatgatacgaagaaagttgagctttttaataaaagttataaagtgttaaagtccgtcacctatgttttttttcaaaaaataccccctaagaaatgaaaaattctaaaaaatttctcaaaaattcattttttttatttatttattttcatgacaagaatttcagattttaaaaattatgtatcgcattaatgatttgacataaaggcccaacccaaatgtgatcgtatttaagccccatgatttgttcatttcatggctccgatcgtacaccgaataaagagagaaaacccagtaattgggtattcggtagcccctccccctctccttcctctcctacccccaccccgaaccatggacaacgaactgtcccgttgcggcttgtgggccgagccgcaacaagtggcgaccctggcagggacaaactttggtggggtttttggagatttggtagggaagggggagtagggacctgaagaggcgcaaacaaagcacaagttgaagcgctcgctaatcattcagggcagagagcccggaactcaaagggtggcattgggccgaaccctccaaacgtcagtgtgccgagccaattgaacaagcggcaaaactgaagatgcgaaattgaagaagcgcaagcacaggcgcacacattggagaagcgcaagcacaggcgcacacattggagaagcgcaagcacaggcgcacacattgaagaagcgcaagcacaggcgcacacattgaagaagcgcaagcacaggcgcacacattggagaagcgcaagcacaggcgcacacattggagaagcgcaagcacaggcgcacacattgaagaagcgcaagcacagacgcacacattgaagaagcgcaagcacaggcgcacacattgaagaagcgcaagcacaggcgcacacattgaataagcgcaagcacaggcgcacacattgaagaagcgcaagcacaggcgcacacattgaagaagcgcaagcacaggcgcacacattggagaagcgcaagcacaggcgcacacattgaagaaagcgcagcacaggcgcacacattga

SEQ ID NO: 10191 - DNA, 2151 bp, Heterodera glycines
gcgttagtcagtctttttcaagtcacaggttcgaatcctttgagtgcaaaacctcaattgaggaaagcaatttaatttaaaaaaacaataaaaattgaaaagcggatgattccatgaaattgaaaagaattatttcagatttttcgccccaatttgtcgcttttttcgctcctatttacgtccataaattttttcaattttttgcacctaaaaacccgagccatattaatgagaaaagcattataaatatttatcaatcagcaaaatgctcactgctggagggcgtgggttctattcccagccgaggcctaagattttgtcaattcttattaataataaaaactcatatactactgtaagagagagagtcgaaattgtcggggttttactcgtttaactgccgaagctctaggatttcattattttcacatttatttctttttgcatttaatttccctttttactaattgtaccgtcctcccagcgataattgatcgatgacatttcacttttcacttgtatttaatgttcgccttttcaagcgaacggagctcagtcgtcccgagaataaagccacttattgtgtgaccagcgagtgtgggaaggcaaccccgggcttgatcaccccgtggacccatccttcgggaatatgtggcacattccctttccctcccaattccgaattccaattcccaacgccagcacgaccaccgcgctcggccgcgctactggtagcaccggatggttcacttttgtgaacttttcatcaacctgggcggaacaggaacagcgaaagggaggtgagtttgagtgagggacattgaggaggcgcctggtgtgaaggaaaaggagaagaagaaaaacgcttcggcgatttaaatgccccggggatgaaaaatgaaaataaaaggcactaaatatgagagaaatgtataattgttgcctgcagatgtactaattgccgatgacagcacaaaataaaaagcaaaaagtgccaataaaaaaattttagaatttttcctatccaaatgaagatttttgaagattttctgcgtttcaatgaggatttataaaattttaagacaaaagctccggttacgattatttaacaaggaggcactggtgaatgattttaaaatttaattataaaatgtttattaattcacaagaaaatccgccgtaaaaaacatgctttttattttattcaaaattttttatatattttttttctaaataatttgtagatagatttattatatggacagtcggaaatcataacaatgatggttcgttactaagaaaaaattatttacaatagaagcaaattcagcgtatccaattgagaaaaataaacggattttatgccagttattttgacaatggttcgataaaatataagaattaatcagtttttatgtcgtaaataattttcttgtttgaaaatttatccaatttttcttataatcatccatttaaatcctccaaaatctctcctccaaactgtttcttccattttgaaatggtccttctatcaatttgcaatattttagcagtttctttgtcactcatttttgggttttctctttttattttccaatattttttcattttttccattttttctttcttcgttattcgtttacagctaattccaaattgtatcttccattttctaattgtgtcatagccaactccgattttcttacaaatttctgcataattttggtaccattcatttggcgaatattttcctttttgtttgtattcatttgacatttcaataaatttctgaacaatttcaagttttcgttcatcactttttgatttataacttttctttttttgaagaccaaattctttgatccattgttggatatatgtgcgatttgtccccatttttttcgctatttttccataaattttatcccattcttttgctgaatattttctccctttttcctttattttctcttttattttataatattttccaattatttctctttttttgagttcatttcgtttttcttcttctttttcttcccatttttctccaaatatttcatcaaatgacttttgttgtagttttttctcttctgtttcaattggaataattagggcaattagaattaaaatcagacagaataataa

SEQ ID NO: 10192 - DNA, 4893 bp, Heterodera glycines
  misc_feature (4831)..(4831): n is a, c, g, or t
tttgataacggactcaacaccatctaattgatgcttatgagagaagttaagaagtttttaacatttaaattttttaaattaattttaattcttaaataataatatagttgaatttattttcacaattataatcttcattcatatttatttttccaaaaaattttcataatatataccaaaaataaaataaataaaatagcattctcaatatatctaaaatctaaaagcacaaagtcaaccgttatgatcaatagaattagagaaaaacccagcaattttattaggtagaataaattttttaagtaaacaaaataaatgcaataaataaaacaaattccttaatttaaaaattatgtaatagaattttaataaaatagaccatcgaacaacataatctgaactaaacgaccaattatgattatttatttttatttcccataattaatgtattttgatttctgatcccttctttgagcaccccctccccccgtaattctccttttccccggggggcaattcaaattgtaaatagccccgcgtcttctgccgtcctttgttaaaaatcccatttctgccagttgggtttgcccctttgtcccattttgtaccatcccttcacaaaaattcaaattcctttcttcagccggctcaactccggccaattttgtgcaaaaaattttgcagaaaatttctcacaaaatttttcttttattaaattcgtttgctaatttgcatttttttgttcgtccattttttgtgcaaatttttgtcccattttgcaagatgcgcttatttgtgcccgcccctcgcaaaaatttttcctatttaagcgcccccagccaaggggtcgctcattttcacttttctgctgctcctctgtattccctcttcctcctctctccatcttctcctccccctctcttcctaattaactttctctctctctttctttcttcccctcccttttctctcgctccgcttctcttttttgtctctctcgtccttcctcccttttctctctcttttttcacttccccctcccatttcccctttttacctctcaactttccttcttttttcctctccctccttttccccctcgaaaatatttattttttttgcagttttcttctattctttataaaaattgaaaatgggcttcgaactcgtggttactgcgaccaataaccaagactgctggtatgtgccggtgcaggaaacagatagaattgtgaaagttagaggtattgcggcaggactgatgggcaccacgggggagaatgtgcgtctccttttgaatggtaggtctatttctggtggcatctattgatgataaagcgtatccccgtttaggacgaccaatggatctacaacgcacggtcgcacagtacgcacagtatggactccaccaaaaaagcaaagtcactgttgagcgcttgtggggcgccgggtcgtctgctcggggaatccgaaaagcccaagatgattttgccgatgacctattgcgatgatttttgtgacatgcatgaatgtgtgaccatgaaataggacacctgtggtgagtgcctattaaactttcccctaatattgatcaaattatgaacaattaaggaattgtccaccccttttcaaaggggctatggtgcagcacagcgggggagcgggcgttggttacgtgtttcgaggactttggcgcttctttctgcccattttacgtcgtgttggcatcacagtagggtcagaggcgttgaccactgggaaacgagtgctggagcgcgttgggaacgatgggataccgactaaggaggcgctggtcaccgagggaaagctaggaatagacaccgtgctggacaaaggaggactgcctaagcagtttggtactggacagaagggtataaaaagaagacgaatacgtgcgccaagtcatcaaacaataattggcggacccccaatcgccgtaaagcagacaacaagaaagcgtgttcggtcggacgcctttggactctactgattagcagcaaccagcaggatgacatttcataaaatcgacaatgactccgtgaactcaaccaccaatgcgctggactttttccgcattccgccgacaaatgtcagcgtctcttcatcaaaggtgtttgaactgcttcccagcaaccctctgacggacacacctaccatttcaaacttcattcaagtcaaaattacattgacctctccaaatgctatttgctcaccgagttccgaatccggaaggaaaatgcgaatggtcaacttatggacctgaccattgacgacgaaaacattgcgccaatccagatgattgggcaaacattcatccgaaacatcaaaatgagcatcaaagggcgtgaagtgttcaacgcaaatgcactgatggcctacaaaacctatttttcacatgaactctcctactcaacaacagcaaaggactcgcacttgaatgctgcaggctattaccgggatacgggcgagacattggagacggggccgggatgcattcaacgcagggatttgtttgccgaaagcaaaacagcccaatttattgccaaaattgataccgacctattcaatcagccgctgtacttgattaacttttgtgaattggatgtcgattgccaaatgacaacgattttgtgctaattgcacccgccatcggcggtgtttttcctcgttaccgtttcgaggtgatgggactcaaaatgtatgtgaagaaggtgtcattaatgacggattagcgctggacattgcgcgaaagcttgagataaagcctgcacgttatgcagtaaggaaaactatgatgaaatcgatggtcatcagtcagggtcggttcgagtttaccgccaatctgttcatggaccaaattacccgtcgcatcacaatggggcttgtttcaaatgccgactactcgggcacaatcacgcggagcccgttcaattttcaaccgtttaatgtgcgggaaattgggatcatcgccaacggccgttcctaccccgaggccccttacgatttggactacccgcatggtaaatatgtgcgcgctttcaacgatatgaatgaggcggtcgggttcgcaaactcgtcggaaagcaacggaataacctttccccaatttgggaaaacgcattgtatctacgtgttcaacatgacaagcagcggtgacgaccaagccgcgctctttgacctgataaagaatggaacaaccgcggtgagcataaaattcaatcgtgcggtaccagtggggggactgatgctggtcgtaatgggcgaatgcgactcgctggtaatgctggacaagaaccgatcgataagcaccgataccactatataaaaggcgccgatttagtgtatttctctcacatttgttacattcgctgtttgccaaaaattaaaaaatgtattttaaaagcgctactgctgatattttattctttttggttgtttttattggtattggaaaatgtgcatcggctaatgcaaacaacaaaaccaaatcccgaggggcagtaagcacccccgtcaccaccaccaccaccacaactgtcaatccacagaagattgatgtgtctcgtttggcatcatcaactcgaatggggaaaggcagcgtgactggcaaaccactaaaaattgtcaccaccaccaacaccaataccaacaggaacataaccaccgccaacaccaataccaacaggaacacaaccaccgccaaaaacaacaaaaacagcagcagcaaaatcaccacccctacaacaaaaactgcaaaattggttgtggatgagcagttgccagtcgcaacactcctcccaacattgattcaccaaatgtgcaaggatcgccccggtgaggaaaacttttatcagcaagccatctgttgggcactttttgcgctctatttaatggtgattgtcagtctggtacttcatcagctttgttctatctgttggttaaagaagaaaaaggagtatggacagcgcgcagatttcgactattttgaggcaaagtcgggaaaccgcacgagttttccggggctgtttcccaagtgaccagctcccagcgccggacacgctacggtacccagcggcgctagttgtgaacaacgacccacattacaaacaaggatcccattggtgcgcgatttatgccccttcaaagacggaggaagcggtcatatattttgatagtctcacaaaaacaattcctcctattgtaaagacatcatttatggataaatttccaaaaggttttgttacaaataagcacccgtaccagtccccgctcactaccacatgtgcaattcactgtatagtgttcatttatcatatggccttaggtcacccatttgatgcatttctgcgcatattagacgctagtgaaagccccgacatgtattctttgtgcattttgaataaaatgattaatccgtatttgtgtgtgcgtgccaattttagtctccctcggggaaagggtatagggaatgattgattaatttattataccacggcgcacatcgcgcgctgttggtgcctaccgcatatatacaatgaattgacatgggaaaggctcacttttttcgcaaaaataaattaaaatattaataaataataataatgtcgttggaagatcacaattattgcggcgagttgggccgcaacgaagaaacgcccacaaagagaagaaaaagaaatgatgatgatagggaacagaaatttcaaaaaaactgcattcgcactctgagcgccgacaaacagtacaaccaaaagttcaaagtgcagagcgtaaagtcgacttttgtcatcgaaaatttgcccgccaaccncgagtcaatgctgcgcgcattgttcgctcactgcatgtcaaccgccctggacgagtcacagc

SEQ ID NO: 10193 - DNA, 923 bp, Heterodera glycines
aatataatgccaaaattaaaaaatatttgcttaaacattacgccaatccaaatttataaagaaatttgacagatttttcggagaatcaacaaatcaggacaaaatttggtcgctacctcaaaatcaggacaaatctgacaaatcaggacattttaattttggacagatccgaaccctgcactagcgccaaaatttgtttttgcaaaaattacgtacgaggcatctaccgtatgctcaccccccccccccccgcttataccgtatccgtaaacaatcccaatttcacctttaatttattttagaaacaattttgccaaaatcggtgcaaagagtaatggaattttggatttcctaaaaatttgtgggcgccaatcggtttgtaaaatgaacaatgaacttttttaattcaattccttttttaaatgcttttttggccctcacgcctaaaatataataaaaatttggccaaaaagaaaaaaatgcctcagatttacatatccgacattttttcagtttacggacggtactcagttgtccctttaatacctgtgtaacccatttaaaaataaggcaccctattttttgggagtttggccacttcccatgaaccaatcgagctgaaattttaactgtacgtagaaattctgaaaatattaagattctgaaagtgagaaaccaaaatgatgccggaaaaaaatttttacgaatttttttccaaaattggggtgtaacattagaataaggacactttttcagaaggctgtaactttttgagttgagcattaaaaaatctgaaaaaataaatttaaacttatcttttggtattgatcaaaaaacttaattgcaccaaattgataagatcactccttcatggtgatctgaaaatcctaaaatggcttgaaatcgggaaatttcaaaaaaaa

SEQ ID NO: 10194 - DNA, 2675 bp, Heterodera glycines
  misc_feature (211)..(211): n is a, c, g, or t
aaaaagtgtccttattctaatgttacaccccaattttggaaaaaaattcgtaaaattttttttccggcatcattttggtttctcactttcagaatcttaatattttcagaattgctacgtacagttaaaatttcagctcgattggttcatgggaagtggccaaactcccaaaaaatagggtgccttattctaatgttacacagtgtaattntattttaagattttcttatcataattagggcttcgatttatagttgctaaaaagtgccaaaataattaatttttggtttctaaaaaacccccaaaatagttgctaaaaactttcaaatcgaggggtgtaaaaagaaaaaatttattcaaaaaagtaaaaaaattaggccaaatcagtattgtggtaataatttttaaaatcacaaattcttgtctacaaaaaaataaataaattttggagattgttttttaagaaaatttttcatttcttaggggtgaatttttgaaaattttcaggccgattcttagggggtgtatttttgaaaaaaatttttaagacgatttttaggggtgtatttttcgcttttattgcatttttgttaacaaattttgggcaaaacgccaaaatagttgaaaatagttttttcaaaaattttaaagttttttagttgctaaaaataaaaaactagaaaatagttgctaaaaactcgaaaagtagcttaacaacagccgaaaaaaacatgtttttcttgcatttcaggctacggggagctcaggaaaaaaatagtgaaaaaactataaatcgaagccctaatcataactttttaactcccttaattaccccccccccgttcactaatcattaaaactgaagacaaaaaaaatttacttaaacacaattaaatgtttaagattaaaaaaaattaaagaaacaaaaaagagaattaaataaataacaaattcataataaaatggaaaaaacaaattaaaattatgataaaaagttaaaaacaataaacagggcgcaaaacttttggcaaaatttgctgttatttggaataaaaaattcagatttaaattttaaatattagaaataaacaaaactttaaaaatcgatattttcgcgtattagttaaaaaatccgagccctgcttaataataaaaaagcgatgaaaaaagacactttttccactattcaatcactctcatcatcaatatttaaattgtaatggcaattttttcgcttcctccattcttaactgatggttctccattgtcagcttttcaatgaccagtctcgcttggaatgcttgctgtaaaagggaattttctgtttttaagtgcctttgaattattttaggaacggaatttatgaaatgaatttaatttttcaaatttaaatgtgatttttgttaaatttaaacttacatgttcgccttccatcttcattaatcgctcattgagcccagcttccatcttcaccatgcgaagctcaaactcattcttctgatgttccaacgccaatttgttgtccgccttttgctctttcagtttcgctttgattgcccgctgtaaaaaggaaagaaattgtgttgctttttttagctcttttcaaatttcgaggaattcatgaacaattttctcacattttcgagttaccaaatgtgaaaatcgaaaatttgagttttcaatttttgttattaatgtgtcagggactcggaatgggtcgaaatgggtgcccgatttgtgatcagtgaccccgaaaaacccaaggttcatatttttgtcccaagtttaaatgatttattttttaggaatttttctcacattttcctgttccaattttaacagtcgcatttccatgtccatttgttgtcgctgtttcgctctgttttcgtttcactctgtaaaaaggaaattgtttcttttttagttctttgaagctgctgcttatttagtaaattgttggaattaggaaggtttaattagtaaatgagaattagataaatatttaaaataaaaaatctaattgggcctattgtaaatgagaaaaaatctaattttttcaatattaaacttgcaggaaattatctattttttggagatttttttattataaataaaatgagcgaatgcattttaaagacaaaattgaatttatacggtatgtaggagagaaaattacggtaagtgcttctttaaatatattgttaattttttaaataaaaatgaatatttacttaaattttgtctctttaaatagacaatttctgattggctccaagcaaaactgagatgacagatggacaaactcagaagagcaagcgcgaattaaatatataaatttggtaaatgaattattaattgggctaaattattttggggttcacattttgaagggattaaatattgtcggcaccctttgattgaaacaatttcagtcattttctatgtgaaaattaatccatgagttaaatggcgttgaatttgaaggtggaattttccaaaacgaaattaatccgctttaacaaaaattattattttcaatttgtttattatttaaaaagcccaataataaacgtaacaaagcaggggtatcatttgaaagcttacatgtttagaagctttaaggtattaattaggctaaattattttgaattttcccattttgtgaccgattaaat

SEQ ID NO: 10195 - DNA, 714 bp, Heterodera glycines
gtattgagatatattttattttttggacttatgtggatatatttaattttataaaatcatttattggtttcacttaaatggtagttcatattgttaaatttatttttttaattcactaaattatccgcaaatgtcggctaaccctctcatctcccccccctcccctcccttccccgctggccacttggccttcgatggttttgtgttggccgtccgatccggcaactgcacaccaacaccttcgccatttaatagtgtaaaattcactttccaccacaaacatctcagttcactgtttcccagctctttgtatttaaaaaaatatcgtggaaaatgcaattttaaatgtgcggccaaatcaataaaaattcactcaaaatgcatttttacatttacactgacaaatgtgtcattaattctaatgacgtcctttaattgttgttgaattcgagcccgaacttccagagattcttgcccaatacttagccttaaatctaactgcacaaaaaacagaatgtgcctcttcttgggtcaagactcggaaattcattttttaatattcaagaatgaaattactggcatttattgcccccgaatgtcgaaaacccattttcatggatagaaaattgtgaataaacttcttctcgggtcgagactctttcacgattcgtcaaaagacttgaacagcaccagtactcattaagtttgctggcg

SEQ ID NO: 10196 - DNA, 6121 bp, Heterodera glycines
ctgcaaattggaaactccaaaaagaaattaaaaattttaaaaattattttttaaaaaatcttaggaaattttttcatgatttctaacaaaacaaaaacatgtttttttaattttgtagagagtttttaaatgatttttcctcagtcaaattattttttctcctaattttagctgtcaaaggcaaagatcgaggagctgtacaagaaaaacaaactaaaactggaaggattcagcggggcattgccgaacagctcacttacatgtgcggcaccagttccaagcactaaagtaaatgaaagtccgcgaaaaaattctgggacacaaaaaattttccgggatccgaattagatttagcggacaaggatggtcccaggattttcggaggggtcgaaggggccccgccgatcgggggtcccatagggcagtaactttttttttcgtttcacattgttaaaaaaaagtgaatcattccatcaaatggtcgattttaattgtgaatttttaaaattacgcccccatagcaagaaatatagtaaaaaagtaatgaggccttaaaaagcgaaatttttatcagagggcccatttccagctttgttcgtttctattaattccccaacctttttatttggttgtttttgtttgttttttgcttattacacactaacggaaattaccattcttttaggctcggctgttactgtgctgtttttcatctttttgatgattgcggcatcattgtgtaccgaatgattgtgcttcgagttttttgtgatagcacatttttgcaaaaccatcatcggacattggaaatttggtcggtgccataatttgcgaaaaaaatgagaattatacaaaattttgaatatttaaatcttggaattaatggttgtcggattttctttttaattacttaattaaatacacatcaaaaaccacttacatgtatttttataattttcaaaaaaaacacaaaattttttttaataaaaaatttttttttcttattcaagacccacgccgttgccttttgtcgtattgtttctgctgcccacccgcgcaagttggttttggtcgcgtccggttgagaacagcgtgcacttctcggtaaatgagcaaataaaaacgaaaatttcattcaaaaacttgtttttgacttatcatgaaaaatgggtccaaaaaaatcaattatttaaatcttggacagaattttgagaataattaatgtcctgttttgccaagtagcgccggtgtataaaattagtttttttttttcaaaatttaattttattattttttttttgttccaatagctttgcatcggcccacccttcccgaacgtgacacttgacaaaaaacggagtatttttcggatgccaaacggatcatcgattacgtgttggtctacgaggagaaggaaatgacgaacagcaactacaacaacaacaattgcgatgacaacaaacaacgcgataattcacgttcatcccccaacgacacgcacaaaaagtgagaaataaataaaatgagaattttttcaattgtctaacttaagtttttctattaaaaatattaaatttgtttcaacactaaaaaaaatttttttccaattttttattttcaagaaatccaagaaaatttcaagggaacattgaaaattttttcagcagttgtttctctgctccgtctgagtgcccatttcttagccggtcttcatgcgttggaacggctctgacaactttccatggatgccaatgccatcggcggaggggcgaaagacaacgcaaagggcggagagacggcagacgccgaggcaaatttgttttaaaacttaaatttagttgtttattttttgtttcttcagctccctctgcgcagtgcttccctcgaaaaattggatctttcatccaatgccttgcgcagagtgccgaccaaattggtggcccattaattgcattccctcaaagttttgagtttggcggcgatttcaaccgaacggatggaaccgaaattaatggccaatttcagcgcattgaaacaggcaaaattaggtaatggacgttgaatggacaaaccaattatgtaatttggccattttcagttggacttttcccaaaatttcttccgttttttgccctttggaattttcgatggactcgacgaattgcaagctctgctcggattggcctcccttcaatgggtcaatgtcagtaaaaatgcaatgggaaaagagtaaatctaaatgaaaattcagttggaatggtgcccaattcttgccgaagctgaacagatcgaaattgaggcgaacggaaacgaaatgttctaacgagatgaattggctgctgaatgcctaggcctccgccgttggcacggacttttcgcaggaacaaatcaatgccgcaaagggcggcgtaatggacatagaaagtgccaaatatgtggtgccattggatggccaacggaaaaggattattgatacaacggtgggcggtatttgctaattatcagagggtaattaggaattgatttgctaattgtcgccattttcctttccagccctttgactttctgtgtccctattccattttctgtgccgtcggctgtcagtgctgccaaatcaaccacgcagatgaccacctcttctcaatgccaatgctcgagtttctgctatgaaaattggtatcgtgcgcaggccccaaacctaaaaaaattccggagggaagatgaagatttttttttgctcttcggtcttgaaattttttctcttatttaattttaatatgtccagctattttcttccccattctcctgattcctgaattttttgagtctttgtctatatatatttttttaaattaaatatttctaataattcaaaaattacttttaaataaaatttgcataaattgccaaattcctaaattaaaatttaaattttgttgcattttcaggagccgtacattcctttcatggagaaagcatgccgtctctgtggctcggctgtcactatgctgtttttcatctttttggtcattgctttactgttcgacatcattgtgtaccgaatgtttttgattcgagtttttatgccagcacattttcaatgcctttttcgagattgcttatccgtaagtaaaatcaattcaatttcaaatgaatttagcaattttattttatttttaaataaaaatggaattagtcacaattaaaatcaatatgaaattgaactgttattaaccagggttcttgaccgaaacccacgtttaaaaaaacctggattttttcacgacccgaaattttttttgaacgtcactatccaaaccccatcttccacaattcctgacctgaatttcaattcgggaatattttacttacatcccgataaatcaaaaattatgaattataaatttttatgtttatttaaaatttaaatttttttaattttaaagaatgctttcctattgggttcgacgatggtgctttaaaaattccagcgacaaagaaacaaaaatgcgaacggatttgcaaagaacggcgtcaaacaattaaatgtatcaacccgaacatcaaactcagattatatgtgcagctgggtgggtggtggaagagaatttttcaaattttttaataaaacttaaattatttttattttttatattaaatttgcctaaaaaaattacatgttttcatgttcctaaaattagaagccctggggggtttaatttatattccatatgactcattttaaatgttttgaggtaatacaacttggctttgtcaccttgtttgttgccgctttcccattagcacctttgtttgcgctgatcaacaacatcctgggtcttgaaaattcgaattcctatggccgtcaaaaaattttaaattttacaaaaattcttaattaaaattaattcagaaattacatggtttccttcaaatttactttttcatttactaaccctatctaatgattgcttgatttcttttgatggtttttccactaattttttcaatgtttttatttatttaaagattactcaacaccttttcaatagaaattttatttttaaataaatataaatttttatttttaattaaaaaaaaaattttttttcaagacttctttgtcatttcccgcaatacaatcggaagcccagcagatgcccaactccgtcgctgctactccttgcgcccacaacccgttcaacaacaatcacttcccacaatcagatgcagaaaagtacaacaacaaacagtgttgaagtgcttcagaaaaatgagcgatgacaaaattttgctgtggttttgatggtcgacaaaaattccgaatgcttttttattttttaatttatttatttgatcggaataaaaacaaggtattgcaggaaaaataattttttttaatttaccagctaaataaagaataataatttgggctactccaaatgcttctttatattgaaaaaaattacacaaattgattgacaaaacgtcaagtacaatgaattgcgttaataattttcaaaaaatttcgacatcacccaattgcgatggtcttttcaatatttattactacaaaatttttaaattttttcaattcctctcaacatacttaaaaatttatttgtaggagataaattatttattttaatttttatcaatgaactgtgaaagtgatagaaaccctcatggattttaggatgaccgaaaaataatttttgaccaaaacaaaaatcatttgtgctttttcatgaaacagaaagaaatgcttaatcgttatattcgaaacaaaatgaaaaagtgtaaaaaattttattcataattttgctaaaaaaactaaattcttaattcataatattatgacacggatacaacaacgaccggcggtttatgattatttgagcacagcaaaaatttgacacaaggaaattcatttttcattatttcatgatatttggagctaaataaatatatttatttttttagtgtatttatttttttcattctttacctgcaaaactttgtgagaaatcccgtacaatgaattgtatttcacgtttttagtgaacatgtgcacgtaaaagtgaaattgtacccaaaaatgaattgtaattttaaatttcatgttttctcgtgtacaaatacacgtaaaagttaaatcgttttagacccacaaaattgtaatttcacgtttttagtgtataaaaacacagaaaattacctaatcgcaacttcacgttttattgtgtaaaaaccaaaaaatgaattgtatttcacgtttttagtgaacatgtgcacgtaaaagtgaaatgtacccaaaaatgaattgtaatttgtatttcacgttttcttgtgtaaaagtgtacgtaaaagttaaatcgttttagacccacaaaattgtaatttgtaatttcacgttttcttatgtacatgtgcacgtaaaagtgaaatttatttggagagaacagaaggcacaatttgacccatatatatttttgatggaacattgacacgaattgttcacatttggaaaataaatgatagtttttggctttgctaacaaattagttaggaaccctctatggttttgattggctcactaaattgctaatatttgaaaatattatgtttgaaattccattcagcaccaatcgtcgtcgtccatcggttgcccattaatcccaccgtcgtgagatggaattttttttattgatcccccgcgcaaggtccgcttggaagcatccctcccattcccacgggggaagatggtcctccccaaattgatcacccccccctaacaaataagggcagggaagatgaactgctgctggagtttgatcagaggaataatcctagcaaactcatggatttgtgcacatttggcaaacccattttgcccattttgatcattaccaattttactggctacaaaaaaaaatttttttttgccacccaatttacataatttaaaatttttaatgaattaaattgcaaaaaataaattaattaaggggggcaaatagttgtatgtttctgtgtcagataaatagaaaaaaattcaaaatgacaacagagagaaaaaatattactgagactttttagtttattttttggaaaaccttaa

SEQ ID NO: 10197 - DNA, 5427 bp, Heterodera glycines
ccaactaattaaattttgggggtgcactgtgaaagcctctgtaaaaatttaatttacgatgaatagacaaacaattttttatggtaaattttatattttgggttttctttatttaattagaaaggcacttttagcctttagaaaaaaaaaaatcaaaatgccattttcattgcctactctcgacaaattgggtcacaaaattaaattattatttttagcgcaatttttaaaggttataaaatggacttttatatcccatatttatccattttttggcattttgtccatatttgggttccatttcttgatttcaatttttttttaatttgctcgagaaccttttttaattttaacttaattaaaaattggtaaattgggtgaacaaaacgaaaaattgaaattttcgctttttcaatggtttttaaacaaaagattaaattgtgtttttattggtcaagcgtttaaattttcccagaaaattaaaaaattttcttttttccaatgccattttaagatgaaaatagagctgagcgggaccgggactggtactgaaaaagcgtacaaatgagtaccaattcccggtttttttcccggctttcccagccaaaaagtcccggtttttctcaaaatttccggtccagctcagctctagatgaaaatgacagctgacatatataaatcaaaaataagacagtgaattgcgaagaccaaagctaaaaattttagaaataaattaagtaattaatgccaatttccatttatttgcctctcaaaaaataaaaataatttaaaatattttagaaagaaatttaaaggatggcctcgattaacaccagctcaactgatccggtaacaaaacgaaaaacattttaaatttaaaataaaagaaattattatattccaatatattaattaattccagttaaatttttattttaataactgttttcagttttatttggcctaccgtttcgccggtccatccgccgatttgattgtgccggccgttgcactcaatttggttgcgttggttggcattgtgttgaacggcacagttttggtggtcactgtcaaatccaagtaaatcattttttaattaatttaaattttaatatttaaatttattttcagttccctccgcggctccgccaattttctgatggctttgatttgtctttgtgaattggtccaccaaattgggcacactttcttcctggttgttgtcatttcgggcacaaattttgtcagtttactcactgctgacttaattatgacggtaaattttgaaagttaaaaattatttttaaatattccaatttttagccaatgctatttgcatcaaattgtggcttaatggcaatgttttgtgctgcttttgatcgcctttttgccgttgcattgccatttaagtaagggaacgaattaaaaaatattttatttaattaacatccacaaaacactaattaaacctaattaattctttctatttaaaactttaattatttaatttttagacattcctccatttttgcacattacaaattcacatatttgcttggacatctgttaatttgtgtaatttacggtgcatttacactgaattatgtgctcgcttatgcattcgaaaatgcgggaaagtatggcgcaattataattaaaaataaattaattataaaattttaaatttattcagtccaaccaccggtgttgtggccgaaactttgctgggccccgttggttataaattcttcgccggcacattcattatttcattttgtagcacttgttgttatgtgtcaatttttgtaattatccgatgcaaaaatggcggtaattttttattggcattttgccaaaattaaaaaataaaccgaaatttttttacagtaacccaacagacgaacacacgagttttacggtcattggtcatcattttgtccattaacattggcgggtatctgaccaatttggccatgtatcagttgctgtatgcatttggctcaattttggggtattttaaattaattttatttaatttaaattttccaattttcctaaggcccccaattcgtgcatggcaatttggttttatttctggcatttttttaaatgctgctgcgggatcaaatgctgtcgtcctttattttaacaggtcagtataataaataataaataactaattttaatgaattttaattaatatatctctatttcaattttaataattatttattgaataatttatcattttaaaattttaattatatattcatcatttaatatattaaagaatatttttaagctctgaatatcgccgcgtgttcaagaaagcatttcgagcgttgaagggttattttggcaacaaaaatggtatttttaattaatgtttatttttattgtcaatatctagaagtagaacgtttttagctgtccacgccattggcacaatccaagtgcgaagtgccaacccaatcaataacataaacatgcgatcaagccaacagataaatgcgcaatccatccaattgaatcgcttctcgattcgattcattttattatttgtaaaataaaataaaattcaaattgaattaaatggtaattaaattggatttcatggttattactgggggggcatttagatgaatgagactgaaatcgccggggaaaaattttgaaaatttgaatgcaatttgttaacagattttcaccaaaaactgcctaatttttgcgattttaagccatgcaacgactttttttgtttataaaaacgctttttttacggcgcgctttttaaaaaattttttgaggataggggggtccggaaaaatttgtaatttttaatgcgagttgtttacagatttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatattgttgaaaattacaaagatttctcaaatttctttgattttttttaaacttttccaaatgctcattttcaaggacgtccttgcatacaaggacattttttattttcaagaaagagggcccaatttcaaggacgtccttgccattcaaggacggatcccatccctggttttattgcatttttgttaaggaattttccaaaaaatgccgaaatagtgaaaaaatagtgacaaaacgccaaaatagtgaattttcactattttagtgacgaactcgccaaaatagtgatttctagtgacgaaaagtgacgtccaaatgaaaaaattttaacgcagaaatgcgttttttgagctcctttcttcaaaacaattgagcaaaaaaaatagttaaatcactaaaagttgcggccctactcattacctttaaagcccattctaaaacaacttatggataggttctacaccattcagaacatggatttatcaccaataattagggcccggatttttatgtttttacatattttttttgcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctagtcatcagatttttttcgctcattcaaataaatgtagggtcagaaaaagtaattttcaataaaaataaaataaataaacgaatgattgacggtggcaaagcataaatttgtgggaaaacaggcataaaagttcaaaacgtaatcagaaacaaagagtgaaagtgaattgggccggaggagagagaaaaatcaaacaaagtcagacagtcaacccaatcaatcaatatctcggctttcatcatcactgttggctgttccgagccgactcccaattgttgctggtgtcaccgtttcccgtcgcgttcagatctacttcaagctgctgctggtagtggcgaactgtgcagcaaaagggaggagcgttttttggtatttaaatgggtttgtgactaaagtttgaattttcgtctttttgttcgaatttgagtttagggctctgaattaatagaaaatgggtaccgaccggtctcggactccatttttcaaaatgaatttgaattaccaaaattgggctgctgtggcgttccgccgccgtccgccaccaccgcactccgtgccgagcgttgcgacggattgcgcacaattggcgtgcccccactgctgctggtagtcagtgtgcggacagaagtgtcggtccagaagtcgtcgttgcccaaccgaagcaattgggccatggcactgacgcagcggtggcgcagcagcggcggacagtcagggcgagcggagccgaaaacgagcggaccgagcggaacggacagcgcgtcgatggtcagcagaccgaacttgaagatgttttcaataattgtcagagttgtccgaattttgggggtcggacaattttatgcaaaaactaagaaattatgccaaaaattcgatggacataaaatcttttaattaacgcatgactcggacataaaatcttttaattaacgcatgactcattgtcagtagaaagagttttgccaaatgctgaaaattcaggaaagagcaatttggaccataaaatttggcctattatcaaatgaagtggaagaaaaggtttgaaaaccccgtggaaaattgggccaacgaattttatggcataattagtacctggaccggttgaccggtcaaaaaagcccattttaccggtcgacccgatggtttgtccaaaaacgggaccgggccgcccggtaaaagctcaccgggccccatccggtctcaaattatgacttacaaggaattctgtgcaattttgaaagagtttctcaccgaattcgcgaccagacgattccaatg

SEQ ID NO: 10198 - DNA, 2815 bp, Heterodera glycines
cgggggggggaacgccgggggggggggggaaatgaagtgcacccgtttttctcaatccatttgattattcgcaattttctgttcactcttagcccctggggcgtcaatcccgttccgatcactgctgacaatgtggccgaaagggctcaacttttggctgatcagtaccgtaagaaggcccaactgtacggtcacaacacacttctggtgccactcggcgatgactttaggtggtcatttaccacaaattggcacatattccatgactttttgtcttttcagatttgacgaggacagcgaatggaccgaccaatatgccaattacaaattgctttttgagtttatgaacgccaaaaaggagtggaaaattaacgtgagaaattagagaggaggcaaagggtccacgtgtttaattttgactcttaaaaggcgcgctttggcactctcggcgattacttcgatgcgttggagcgtcgtttggtggaaaaacaggcggacgacctgcgacgtaaaggcattgttcggcacagcgttaagaaaccagaaaatcggtaaggaaaggtcgttttaaagctttaattccgggggataattttcttcgtttatttttgatgccgttttttgtcatcccatttgtgccgtcctccccccaatcgtgccatttcaattgtccatttgagtggtgccctttctgctgattcgccctcttctgccgcttcgttgtcgcttttgccgcttctgtccggcgactttttcacctacgcggaccgtgacgaccactattggagcggcttcttcacctcacggcccttctacaaacatatggaccgaacgttgcagcatttgctgcgagcggccgacattttctacacaatggcacgatgggagagcaaagggaacagtgaaaagggagaggaggacggaggtatgagaagggggggggcagattggcactttgtgaggagggcacttgaccaacaattcggtcatggatctattatcctgcaattagttaactgtaagattcgaagaacttttttgaaaccaatgaaatttttcgaaattttgaaggataatagagaacaattagagctatcaaatggtatcaaatttgttagatttgtacaactatcacagaaattataccccagcaactttcccaacaggcgacttcgacttgcttttcgacccattggttcgggctcggagggcactgagtttgtttcagcaccacgacggagtcaccggcacgggtacgacccgacaaattgtcgttcaattaaccagggatttactcattcctcccccaattcagcgcgaaccaatgtgatgacggactacggggaaaagttggaaattctcccaaaaaaccgtcccaaaccctcaaatttaaaaggatggcccaagcgttggaggactcaaagcgcattttggccaaaagtgtgcagcgattgttggccattcccaaattgcacctgcgggtggacgaggcgcattttgtcgaccgattgccccaaaaagttgtgcttggggcgaacacggcattggcaattgccaacccaatgggacatggacgccgagaagtgatttgtgtgcatgtggacagcgtggagagacgcattgaaagccatggagaaggaggaggaagtcagacggacacagtgtcacagcaaattggtagggaagaaaacccccgaaacccgcaattcctaaatcctgggatatcccccacaaatcctaatcatgggatatctcaaataaacctaactcttgggatgtcccccacaaacaggccccgtccttttcgtcgacctccgcggccatctcgcccattttcacgacaaattcgagctgtgctttgtcgctgaactgcccccgttcgccatggctcacttccgtctggtcgagtcgtcgtctcaactcggcgacggggcgcagaaagtgaccatccgacagtcaaagaattcggcattcgaatcacggtgagaatttatcaaaaatatttgttagacattatccaattttaaatgccgccatcgattttagtgttttcgattcggagccgatcaaatcggacgagcaaagtgttgcactgcgcaattcccatttggccgcctccttcaacgcttcttccggccttcttagggtaggcaatcacttctcaatgaactcgaaatgtgtttctttttggcattttcctcctatataaccatcgaccattgtttgtcctcctcatttttcagtcaatacgtcaagaggaaaatgccgaaattggagtggaggtttcatttgtgcactatggagcacggacccacgacccaaaccgtggtaatgttttgcaaatccaacaaattatttcatactttgtaatagccggatgtacatgctaatttggtgtctcttttctattgtataaattaagccccaaaagatctgtccggagacagtcgttccggtgcctatctttttctgcctgatggtccggctaagcctttgtcggcggatggcaacagttttctggtcgtttctggccccgttcgacaatatgttcatgtaaaaggtcagagagggtaataaaggggatcatttggaaattcaatcggttgcattctctcaaaatgcccaggacccgtcgaagttggcattcgtcaccaaattgcgctggacgtcgatgcgcggcatttggccattctaaacaatgtcaatttggctaccgagtcggccgctgaccggggagacagggcacagcacggcgcaaacatcgaattggccatgcgtctgcgagtgccgttcatgcgtcaggacaattttttca

SEQ ID NO: 10199 - DNA, 2687 bp, Heterodera glycines
  misc_feature (2064)..(2064): n is a, c, g, or t
ttgtacactttcggcattcggtctctgctgaattctgaaacccatgcgccgtttttcatgcccaaattttccgcatttaaagggcgtggaggacaatttgttgacggagagtcgcttccatcttctgctcgagcacttcgaccgcttctcctcccctcctccgtcttcttccgccgaggggacaatcgcttttcattcattggccgcccaccattcgtcacttcgtctccattatccgcccatttcactcgccggacaaatggacgacgccaaaggtggacaagtggcacttcaaacagagacaatttgacaaaattcagagtttaaagcccgtcgtccatttgggtccgtccttcgccattccttcccctgcaactttcacccggtgactctgcgaacgcttagccatccgacggtctactcgcccaattcctcctccacgcggccccgggacgaagcggcgctaattttgcaccgattcggcatcgaatgtcgcctgggcacgtcgttgggggagagcagttgcccggcaggaatggcaacggcagaagtgacaattaaatattcaaaatgttgaaatatatcggggacagatatcttttattatatttatgccacccacctccgaattgttgtgtccccgtgtttaaggctttcagccatttcaaattaccgttttaggagagaggaatttattataaggaaaagcattgacaaataattataagttaaaaaccggaaataagtttgggtaacaacaacctcagagcattttgggtgggtcagtgcaattggttatttgggaaaggattgccaaaggcaaggaacggcacagactgacccaccgcagacatctcgcagtcctcgagggggaaattgagtggacttatatactggcacaatggggatggatttggatagcatgaggggtaatgacggtaaaacacaaagggaataagagagattgatggcatttgcaacagaggtgaatggatggcacggtaaatgagagggaaggattggcttgggattggatgaacagacggacaagtttatgacgggattgggtcggggaaatagggcaatttacattatgcacaaaatattaaattttgaatgctgcggatacagcataaattttgtcaaaaatagatttatattgctgataaattagagtgctagtgcgtttcttaaaactgccttccctaagcctcatttcaaaaaactttgaaaatttttgaaaagtaaaatatttttaaaaattaagcgaatatattcaaaatttagagaacattaaatatataagaaattttattaaatttttcaatgaaattttctgaggttttccaaaaatataaccatttagggctaacaatactgtatggctaaattgcattttaattttcttcaatttagttttctaaaaattttaagaattctcgaaatttaaattatttttcattttaattttaaattgagggatggcagttttaagaaacgtgccagcatgacaagtgagtacaaaccaggggtgctatgtcattatttaaaaaccatcattatgtgcgttatttaaaaacccatcaaaataaagatttttgcttatagctttgctctaaaaaggccaaatttttaatacttgctatcattcgataggtctaagtgttctttatgaatctgtaaaatttctaaaaattttattaagtttaaaaaaagttacggccaaaaatgttcgaaaatcaaggttttttgagttcctcgagctatagcttttttgaaacttaacgaaattttttgaaattctgcagactgatagagaacacttagggttatcaaatgatatcaagaattaaaaatttggttgctttggagcaaagaaaaaaaacgagaaattttggacattttgagaccaaattttggaaaaagaaaattggtccggcggttagaaaattttgggccaaatttattaagaaaataggataaactttaaaaaattacccattttcgtttaaaaaatttaattttttttttcagggggttggagcagcaattacccccccctcncccctggttatgggcctggtactgaaaccaggttctcttatcaattgctccccgcctcttccgatttgtcaaaattttaaagttcttagtacactccacctattattccctttcaaagacaaaaggattttcaaagttatgcttttgaacaaaagtgcattatggacagtatggataggcaaaaaagctggggaaatttcaaatataaaaagaaaattatttaaaaattgttaaataacaatggaaaattgcaaaagaataaggacaagtgggtaccctctgctgataatatggccaaatgagcatttattaatgtgaatttggagtgtactttttgctgccaacccaaagaaaaattgacggaacatttgggctgatgaggcgaggggatgagggcgaatcgtcgtgtgaatcgatgggcaacaaaatcgggtgacgggggggggggggaagaatggaagaatgaatgagtggtggtggtgttgagggatggggcgatgtattgatggaaagaatgaacaaatgggggagggacccacaaaacggggtcaaatacagctgaggaagtgttgggggcacagaaaaggcattggacagacaaatgccaggaaaacaagcaaaca

SEQ ID NO: 10200 - DNA, 3722 bp, Heterodera glycines
atccctaataatacattcccagcagcaggagcatttcagcactatccgccgcaatggtgggacagtttttataataaataatttttagggttccaaagagatctctcgagcagttcgctaactgtttgtcccttattcctctccacactctctcgccttctcttttctctctatttaatacgttccagcacgttaatgggattttaccagggatattgatcgtttcgtaaaataagtcaaaaattttattgaaaaaataattgatcaaccacttttaattttgtaaatatttcgaaaattttaacatttaattatttgaattttactacacttaaaaataataaaatttgattttttcattgctttttaaaaccaagattaattcacatacaaaatctattaacaaattgcactcaaattttctaaatcttactaggcaccgcctcccccctccactaaaaattttggaaaaataatgcggcaaaatttgaaaatttgttagcatatcatataacataattttaaggaagttttggagaactttcaaaaaaataaaaaaattataaattttatgaactataattttaaaaatgtaaaataaattgattccgaataattctttttgattgcgtaaattttgagaatgaatcaaaaaattttcaaatttttcagtaaaaaaaaattggtgttttgcgtttcgtattttattttaaaattcgttttttcgtatttcgcacttttttcgatttgcaataacgcttgattgtatcgattaatataactgtttagtttagaaatattaatattgcataaaaatttgtcaggttcggaaattatgctatgacaccgcccattggtgcttggcctttacagggcgccccggtgtttagaataccccaaacatttccaccaagagcacttggaactaatcagcaattctcgcaaccgtatgacaatatttgtttaattggtattgttttaatttctcactggttttagaacaaatcaagcaatggcaaattacccttttatgctttcggcatctgttcctcttcctcaaacgcagactttccctctgccaaatgctttgccatttgccatgaattctaatggcggttctttaacatatccaacccaaatgaattacgcgcaaatgcctgcgcctgcacagaacactcattctgaacaagttccaaagaagaaaaaaaatacttcaaaaaagcaaacgaagtagtaagaaaaaggcttgagtcatgatgagttagtttcgatcttttgacaaatgctatgagaaggaaacgaattttagggcaaaagccgagaatgttttaggccgctttagcactgtttcaatgagccgagcttatagttcaatccactcaaatttattataagcccaaaaaatgcgtttccttaatgatttatcattcatttgtgtaattttttcattcttttttagatcattttcttaacgtatgtaaatttttctctttgtctacagatgaaacttcggcttcgaaaagttcggtcttcggcttagggtaaactaggcgaaattaggttatatgacaattttggtccggtcaattgttgcctgttggaagccagacattgcggccgcggtcggccattgcattgatttcatgagagccactttcggacatttgcgctcgatttcataagggctactgatgtgactgagtcctagaccttttggctaaatggtatatgactcagtcacaacaaaaaggaactttgtttttgtctctgaactgagcacgtagccacaaacgaattcacaaaatatgccccaccctaatgatggggatcttgactcgatttttcggtgtcgaaatccgattacgcacctacttcctcccctttacacaccctactctgtgcttatcggcaccacaatgctgccatggcggccttgtagacattgctgacctatttcgcgatttttcttacataaaaaagaatgccctaattatgatatatttatatatattatgcaatatacatagaaatacatgtacaaaagataaactaatttatatttttttatttcgcgggatttctttgacgcggcgggatttcgatgcagcgggattttgacagcgcgacagactcaacattttcaaatgctttggcattttttcttggaatatgcttaaatgataatttatcattaataaatttatgcgtttttgatttatttgcatgctcaaaaaatgtgaaaattgcaaacctccttttgcctataaagcaggggtgtgatcaaaaaattttccaaataagaacatcaaggccaaaaaataagattttagggtcaaaaataagaacattttgcaaaattgcgtaaaactgcttgtgtaacaatttaatcaattaaaatagtataaaatttcgtatttttcgcctcccataatcatttaacaattttggggaggagattagcaaatcgtacatttaaatgcaaactgctcaaaaaaatcagatttttaagaatttttttttgcggcgcattttttcaaagactttttgggacaagcggggcggaaggtcggcggtgccgataggcgccgccgggaaaaattttgaaaatttgagtatgttttgttacagattttgtcaaaaaattgtacacattttggggtccggtggtgccgataggcaccgccgtggaaaattttgaaaatctaagtgacattacgctataaaattacaaattttctgaagaatttttaaaaataagaacaattgcccgaaatcagaacaagcgcttaggcggtgccatttgttagtattagtgcaggtgctaaattaaaaacaaaagagaaaaacaataaatgcaaaaataattagacaaaattaacagcaaaaaagaaattatattgcaaaattgaaaaatatttttcttaaatagtacgccaatcagaaatttttaaagaaatttgacagatttttctgagagcgacaaataagaacaaagtaagaacaatagcctgaaatcagaacatttcttacaaataagaacatttttattttgtaagatttgaaccctccaaatcagaacatttcttataaataagaacagatcacacccctgctataaaggcaaaagcgatttttatgaaatgaaattttaaattttgagaatttttcgactaaacaagaaaaaattcgaaaatttgaacattcaatttttgtttgagttctgatccgggatcagaattgcacgaaataagggtcaaattcgcgattaacgaccccgaaaacccatagaatcatgttttttatgagtttttttatattaaaaattaaaaaaaaaagttgataccaggggcaatattacccatgcgaaagttccacccgaaagaaagatttctggaaatttaaattttaaaacgaatgcttcaatgctgtaaaatggcagtagggggtcagttccgggacccacgcgtttcggcactggcttttcggcaaaaatttcgacttttcgaaattttcatgtataacttttttggtaattgtctaatcgcgaagcaatcgcttagaaaaagcttctaaacatgttaagctttcgaatgatatcaacaatgttggatttggattagatagaaaaaagttatagccaaaaacatgctggcgccgaaacgccagcgccgaaacgcagtggaccctcagttccgtcttgggccagttccgtcttattacta

SEQ ID NO: 10201 - DNA, 1553 bp, Heterodera glycines
acagatcacaacaaaatttaggtaatttgttatttttcatttgggactcggcaactgaaaaaaaaatcaaaggcggcgcgcctttttagtgtcgacggattttaaagccttcaatgattgtcattggaagactaatcaaagtggtaaggaagcaaaaaatagctacgaaaatctcaaatccttcaagcggggttgtgtgatggccttcggtagaaaagggaggcggaggcgccgaattgccaaatgaaacgacccgcacttagtgctgggcgagacgaacgaccatgtcagtgccaaggccggcggacatgcaagtcaacagcaagtacagaaaacacttttccaagctaaactctcggcgaaaaatcccatgaaaagcccttttccttcgtcgtgatgtgttgttgcctttccgttggtcatgatcagactgatcagccagagccagtgaactaattctcgcatcttcaattaaatgtttaattaccccatttggaataaaattctttgtttagaataacttaattggttacctttaagaatttcagttactttctttagtaaatcaatgcctaatttcgcaaaatttccaaattcttctttgtttttgctgttgaaaatttccattttcgccaatgttcgaagactttctccgtatatttgctgattcagtttcaaattgttcactgatgttactattgaaatccctgcctctttccatcctttccaaatgcttttgccatttttccaattttgacaaaaattgagtcgcttttcttctaattctttaaaagctaacaaattgtcatctttctttgttttgtcatttcctttctcatcattttttgctttcatttcgattccacacaaaaactcaaaggctttttgctgaaaattgtcacttttcgcctccaatgcctttccattcgctttttgtggtttaagtccatcatcagatttattctccgcctgtttgtttcctgggagttcgtcgagaagcattttcccggtctcaagaaattcgttggccgccataaaaggacctaaaaacaaaacaaaataatatttaaaattctattgaaaatattgttcaaaccttttttgctttcatcgtttgtgcccaattgaccactcgataagtttattgccgcaaacagcgacagaaaaaggccaaaccaaagcattggtgcggaaagcagtttcttactgatggaaaaaataaaaaatgccatgcccataaatgaaatacgcgcaaataggggatgaaggcattaacaaagaaaaaatgtggcatcatattgaatgccaatgactgacgtaagcaaagctagcgccgaaacaaaaaattgtttttattacaattactaatttaatcatagttttaaccttggccgattcaactaacgaacagggaggcaaatttaaataatgcccgaaggggtcactgtaataaggatttgcaaacagggaatttttccctaatttaaaaagctcctcgtgaaaaaattggaaattccttaaaagtctctttttaacattcattatttaaaaaa

SEQ ID NO: 10202 - DNA, 4069 bp, Heterodera glycines
ccaagtctaaggtgaatttttccacataattatccacaatttttacacaagacctattcaaagaatcgaaaggaaataattggtgatcggaagacgaagcgaacaaatggatggtgtttaagcgttgtaaaatataaaattttcaaaaatttaaaacccaaatgttggccattctttgtgaaaatcagtttcaggttggccaagtcaacgccaaacccaacaacatcatcggcaccataaatatattcggcgtttcttattttcaatgagccactaagccaaaaagtgccatcgctttcgtatgcataagtgccggtccgattgcaaattcgttctcccaattcgctcgactgtttggggcaaattccgatggtagcccagctgaaaattgtgaaaaattgaaattaaaataaaaaggaaatgcacgcaatcggattttgaattcaaaaaatctgagattttgaaaatcaaaatttttaattatcaaaattcaaaagaaatattttggggcgatgaaacgcgacaattcaacgttaggcattttaattaagaaaaaatggggtttaaaaatttggtcattttttgataatagattgtccaaaaattagcaaatttagagaatttttaaaaaatattgaaatttaaacactgcggtgccaataagcaaaaatagagaaaattcaatgaatttaaagtgatccagatttatatggacaaaaaaatccaacatatggattatataatatggatgaaaaatagcaaaatatagacgaaacatggacaaaaacgttgaaagaaaaaaacatgaaaatatggacaaaaaattttctgaaaattagtaaaaaaaagcaaaaattagtaattttttttgtaaaaaatattttttaaagcaaaagttgcatgaaatttttttgcacattttttgttatttttccgaaatttttcgattttaggggcatattttccaaaaatttctatctttagggggtgtatttttggaatttttagtgaaaataccaaaatatggggatttacgtggtttttaggccgaaataaatgtgcaaaaaaaaatatggaaatccatacaaatccgggccctagttatatgacactcactgtttcttttttatgatggaaatttcgaaataaaaaatgccggaagagtcactgcccagcaacactggctgttttgcgaacaccgaacgccaaccttttgacaaaaatgtgatttgtttaaaaacaaatgaattacagtaatcctaccgtgtaaattttgtcccgtatattcggcagtcaaatgaccgcaatcagagatttcgatgtcactgtgacacgcggtggcatcccaacaatttggggacggatctgctttaatttcagcaatgtcctccgtcgttgtttgtacagcctttggtattatttttaattatttattatttcaattccctcatttttggaacctcaaaaaatttttcgatgtttttgaaattttagagctattagaaaagaaggattttatcaaattaatgtacaaaatacgaaaaacacatttttagccggaatttattttaagtccattaattgtcattatatattatagttttgtatttatcgacctttttaaagtcaattctgaatttttacacaagtactggcttttttgagggttaaaagccatttttgacagtttttaatgcatattttatgggcatatttggcattttttaatgcacacccggcatttagtgtttgcttcgtttacctgctgctgttgttcattctccccatggaaacacttgacgaaaaggacaatggactcattctgaatgccgtaatggtccaaggtgtaagtgtcctcgagctgagctcctatgtaaatgagtttttttttaaattatatgtttcttttctcgccaaaaccaagggaccgaggggaacaaatttcattggcattttccatatttttttgaaattttccattggggttgcctcacactaggttgattggccttcccatgaaattcgcctacagcgccgtgataccaaagtgccttcatagagatgcttcagattcaaaattcgggaatcggataatctgatgcgccaccattggcataccacgaaagatgagccgttgtcggtccgttggaatgccattcctctcccgcactttggatttgacctgctccacagtctcgctggcctcaacgtcgagagtgaatgtgttgttgtcgatggatttcacgatgatttgcattctcccaccgatattctgaccaaaacaaacaaaaaatgaagtcaaacacatagacagacagagacaacttgtctaatttttaatttttttggcaattcgccgccctttcagtccaataccgtacaccagaaaaacggacacttgttgtactttttgcagtttacggtacgatatgaaaaaattctttgcgctgttttcacctttaaagtgtccaaatcgaatttgaattccggcccaaagttggcctcaattttggcgccaaatttagacaatgtgacaaatggaaacagcggattatcatcgtaatcatcatcattatcagaagggggaatgaaaaagtcgggagtttctgtaaaaaacaataattaacggaaaataaatgatatggaaaattaaaaaaaggcctaaaacatccaaaaagcacattaaaatggattcattattttccccccacggaaaatcttttaaaaaacaaagaaattttctggcaaattttagcgtttccattttaatttcgcactttacgcacccaaaagttgtccattttttgtgaaaaaaatctgccgtttctctgaatagatgccacatccgaccacgtctccattcccgaaaaattcatatggattttgccgttttcgcgaaatccaaaaagtgcctccgctttcgtatgcgtaagtgtcgatgcgactgtaaattcgttcgtccaatttggcatttcgtttgggggcgaatccaatggttgcccaacttaaatttaaaaaaaaacaaaaatatgcaaaaaatatatatatatttggattaattggcaaaaaagttctcactctttcatatcgatgattgaaatttcaaaataaaaagtgccgctgggattgttgctcaacaaaattgggtcttttccgaaaacggagcgccaacctttaaaagaaaaagaagtaatattgataaattaaaacaattttcacaaaaaataaatagcctaaaaataggtgcctaaatactagatatgacaaaaaaaaattaatacaaaaaaattgaaaaaatttgattgatattgtcaggttatttctcaaaaaatttcctatttatttcactaaatttttgacattagaaattactcatttttcggaagacattaattactcaaaaactcaattgtttaattgactaaaacaatgcttttctgaaaaaacaaagtttgaatttaaaatatttgaacaatgagaagtaatttaattaaaaaaaaataattatttttattggacaattttttatgacccctgaaagattttcaaaaaatggggaatttttcggaatatccaatgcatatcggaatgtattcaatttttctcaattaacagagataaagaaatagttctccaaaatgagaggtgattagtatttttctctgctccccctctctctctctctcaattcgttgatctctccttttttgactcgatgtgattaattcagtccaaattttgaattgttttttttaattcattttaagaattgataattttggtaattgtctgataaaattaccatttccaaattccttgaaaatgaccgccaaacactttgggccagtgattgtgaggtcgtcgtggcacgcatttgcatcccaacaattttgtgctgatttgaaaacatgaaattttaaattcatttttgtttaactaaataattataataattttaaaaaaagtttctcacctcaactctgttcagacgaaagtcggaagagcatccttctgaaaaatggaggggatgagaatttaacccaatgattgaaattaaaagcatactcag

SEQ ID NO: 10203 - DNA, 5885 bp, Heterodera glycines
  misc_feature (4646)..(4646): n is a, c, g, or t
  misc_feature (5877)..(5878): n is a, c, g, or t
agaggaacttagggctatcgaacaacactaagaatgcttgatttgatggataacgagcaaaattatggtccgaaaaatcttccggtgacatttcgactcgaccccccgagatttttgggcggaccggtaaattggacaccaaatttctcacttaaaaaatttgtttacagaaaaaatccataaattagggctaggcctagcgcttaggcttgcttggtttaggctttatttagtataaattttatatccaacagtgtcaatttatcgggaaccgttttggggtgcacccgtcccccacctcattgaggtgccccgctgataggagggcagcgtcaaattgtcatcaaattgttcgggaatggtactgtagaaaaaaaaaagaaatttgggattttccgggattttttaaatttttgttcgacttcatttcgaccgactcgccgcccccaagcaaatcgtccggccgacaaattcgcaaatttttttgccaatcgctgctgctgctgcctccgtgcgccgaaccggtggaatccatgcggcgcaactgaaaatttccaaaattttagcttaaatatactcaaaaatggcaaataaattattaagaaatttaaaaaatattaaatttattaaaaattcgtaaaaataattgtttattttataaatcatataattaaatatttattttatttttgttttttgctggatttaagcgcagcggaaaatttttcaatattttaaataaaaatataccaaaaattgaaaatagaaaataaattaaaaagaatttaaaaatatattaatttattaaaattccctaaaaagaaattaaaaaattatttattttttatataattaataattcaatattttaatatttttcttaatttaaattgattattttattaattcttaaataaaattattttttctgactaaaaataaaataaatttttaaataataattacagtagacaaacacagtacagtatgcttttcaaaatgattacagtgaaattcctccggaatgttcttcgggcaaagttgccgacagctcctcctccccctccgccaccatatgatggcttatgatgactttcactctcatcatcctcctcatggtccgaagcggcttcctgtggagaaaaattgaaaaatattaaatttttttattttggaaaaggcactaattaattaattaaatttttaatgacaattttcagtaaaatgatttttgaaatttaaagtggaattaattagaatttattgaaaaaggcgcccatttttgttttgttttttttattttaaatatttaaattcccaaactttggaataaatttcatcaatatcttatttgaaacattgaatggtataaaaatttatttaaaattatttaaattattaattttttaactgtgccgaccttctccaaaatgccgaccatggcaagttcgacaattgagaagaaaatgtaagtgacacagcccatcatgaaccaatccacgcctttgatgtaactgacctaaaaatgggaaaaacaaatttaaaataatatttaacagtggaaaatgcaaaaaataatttttatatttttttttataaatattttaagcaattttaataaaaataattgcaaaaaatattttattaattttacagtattaaaagtaattttaaataattttaataaactcaaattaaaaaaattttgcttgaaaataattaataaatttaattatattaattattttttaaacaattttaaatttattataaaataaatgagtgaacaaattgtgtttgttccacctttggcaagctccttgccacattggcatattgcattgttaatgccaaaattgaagaaacgcccaaagttaccctggcaaaatttgaaaaaaataataaaatttttcaattttactttttttacctggccggcaatgacttccggtccagccaaaatgagatccatgaaattagcacctaattaaatgggggaatatttattatagtctaattaaaaattcaccatgcaataagtgggcatataaatttggagaatgtaaaagccgtaggcacgtcggaaataaattttaatgttcagctaaaattatataagaattttaaatcttattaaaatttttattttaattaatttatttttaatttattaaatattataattatttaaaaggttaatattaatatttttggattaataacttttttgacaacaattctgttgtaaattatttaatatttaagttaaaaagtttatgcttgtttaacaatttaattgctgtgcaaggtataggcctaattatcctactaattactcgattaattaatgatcaatatttataaaattattaatttgcctgatcccaaacaccagctgggtaatggaatgtggccttttcaaacagaaaatgggacagataaaaatcgggcaaactgaccttgaaaagggggaaataaaattaaaaattaaataaaataaaataattttaattaatttaatttaattaatttaatttaattacgttggcgatcagttccaccggaatgccttgccgtttccaatgcagccgaactttgcccacattgaatgaataactctcgaaaactgttgtgcactcaacacggtccatctcaacaaaataatacaattaacggttaattagcgataaaatgtaattaaaagtttaaataatatttaacaaaaaaaattgaaaaaattcttcatcagctaaatgaataaaatttgcgtcttttaagtgcttaagagtttcgtaataaataatttttctttaaacataagaaaatttctaaaaaaatgacaaataattctaaaaaaaattttaaatttttattaaaaatttttataaaatgaaaatttttaaaaaagaaaagttttcaaaattcaattttttactggaaatgttgtgaattcaaaatcacacggcgattcgacggcaatgctaaaagcattaaaattggataacaaattaacttttggacgattaccgataattgagccaaacagtaccattgggaaaaatggcttaaaaattaattaataattaatttataaaataatttttttataccgagaaaaatgttaggggtgggcgaagaatggatgaatgaggatttggagttgaccagacaaacatttgggatccaaatgttatccaccttaaaaatttatctgtttaatgttgtctaatatttgcaatttataaaaaaataaattttattatttttttgattcttatctcatttttaaattattgaattaaaatttaattgccgtcttattttttgatttatttattttcacttttttaaattagataatccaaaatttgaatgttgtcttaaattttgaatttatttataaaatcaattttttttttattttcatttatttatttctaaattttaatttttaatttgtttattaattttttagttagaaaatgtttttcaaattattgaacatttgtttaaaattgcaacaaattgtttatattatttaaaaatcatttaaatatatcttttttttaacatattttaatttattattttactttaatttaccattcgatatgacaatgataaattggtcaagcattgagcaccttcttcttgctaaaacattttaaaattagcaattaaattttaaaaaattacctcaaaattgaggcccgggtcgtgccaaatttggctgagcataatgtccattttggaggaggacaaaatttcattcatttcgctgacctaagaacatttaaaaatgaaataaataacaaaaatattaaataatatttatcaaataaatcaaatatttttaaattcaaaaattttaaagaatatttattgaataaatcatttatttaaaaaaaaatttatttataataaaactaaataatcggtaaaaatggaattcattcaattcgaggttcggaaatcggattttagtcacaatttttttgaaataaaataatattaatattttagggtctttcaaaaaagtaatggtccttaatgaagtaattaatgaattaactaattaattaatgagggaacaactaataaataacccactttttgaatgagcagttcaatttcgacgtccacgccctttatgctgggcaccaaattgcggtcgtacctcttcagaatgtcggagagtatccttaaattttggaacaattaataaatgaaaataaaattagtttgtaaaaattgaaaataaaagaaatgacaaaaaaaaattaatttgaaagaattgaaaatttgtttttttattaagcaaagaaaagattttctaatgttaaatgataaaaaaaatgaaataaataaaaaataaaactcttctatattttatgatgaaaaaataaattgaaaaatatttaaaaacgtgtaaatttgttaattaattgctaattaatgcaattaattcattgattgcttttcccacctcgtcgcgtgcttttccgcctgtcccagcacacattgctgatcactttcgttctcctcgtacatcatttcgctgatcatcatcggcggtccgccgtcaacgccggacattggcgaggggccaatttttgtggcaaaatcgccgtaactaaaatttttanatttttttaaattaacaaaatgccaaccggtttgacggtaattcggccggcgaaggagtcctcaccatcacacaactgccgctgacttttgagcgatggaaaccctttgaaaaatgcaggggaaatttggggtaaagtgatcgaacagagatcatcatcatccaatcaataactgatcaagcccataaaatctattgggattaatcgaaaagctatcgagacaggaatttgtaaaattttgaatcatgatcacgattaggggactggactcggaccggatttcaaggatttaaaacgctgtaatgcttattaatttgagtacagcatcaaacacggattacacctcccctacttttttactgtatttataaattttaaattttggagaattttctgaaatttggcccttcacctaaaaatattactgtaatacaagccttccaaaattcacactttccgcgccattctctctcacctgtcggcattcgcagctcactttggcaccaccgtcggctgtcggccgccgtttacagtacgaagaacgcaaatcacacttttggcattctgtactgctgccggtgtccgatgccaacattggcggggcgtacaacggcgccgttgaggaactggcgacaaattcgtccaggtcggcagctggaaatttagaaaaaacatgacataattaagtataattaatctccaatgctgctgaccaaaaagaaaagtgattgatttttcatgtaaaacataaaagggagcaccgccccggcgggacggactcgaacccacggcccttttaaacttggttaaaatcccatggaattctctgccattaaaattgggacaagccactgattactgaacaatcaatcagtgattttgcctatcaatcaataatcaatcagtgattttatctatgaaaaagcgcttaaaattttaaacaaaatcattggtgattttgttgcctcggtcatcatcaccttcaccggagccgattggcattgcgattgaattcgcggcacaaaaattgatatagaattgagtgctgattgttagcaaaagtacagcgccaatgggaaacggtaacaaatttgaaattggcgttcttttggcaacaattattttggcgttgctgtttttgttgcgtgagttggcgttctgtttatattgctgcttacactgggtccgtacttttgggcataaaaatgctaaattttatacgacctgcagnngcatgca

SEQ ID NO: 10204 - DNA, 6021 bp, Heterodera glycines
ccgccctttgacttttcggtgtcgctcagtgacgacgatggcccatcagttgcagaacggcgaacatatcgctgacgaatgcagcaccaccacgcgcagcaaacaatgccaattgcgatgaccatgctgaaaatggggaacaaattgaagacggacagacggaggaaaatggcacggcaaaaaagcagcagacaaactcacccaattaaaacggcgatgacaatggtggcccaaattgggagtttgtcgagaatacttcctttttttggagctggaggagacttcgtcgtagtcgttggaactgtgctggacttagaatgaactctgctgaaaaatgggaaaataattgaccgagaaataagcaaaaaagtgaggccaaatgcttccgattccgaaagcttacccatggcaacagtcgaagcagttcaaaatgaggacagcaaagagcaacagacggagcacaatttgtggaacagtggaagtcatcgtggcaattgtaaggcaaatgaattggaaatgaggcggtaaagccacttttatagtgacgctgatggaaaatgtcacttaaaaacgaagtatttaaaaaatttgttgggaaatttaaaaaataaataaaatcaatcaaaatttaattcaacggaatggattatttgtattcaacgttcccgaaaaatcttataggattcatctatcgggttaagattaaaaaaattggattttcgtgggtcagcgaaaaaaggggccgcttaaaaaaggcgtcaaaaatttatgcgcaaaattctctccccttataagggggtttctgtgttcactttcgtcatttttgtttttgtttcaacttcaactacaacaacaaatgatgccgtcacgttcatttttcatcaaattcaaatgggaatttgcctttgtcgcgtttctgctgctgctcagtgaatgcttttgctcggttggcgcacaaccaaccggcggccgaaagtaaaaatgccattttttttttttgcaaaattttccattttcacctcccctttttatttcagtgtaacaagtccaagtacgacgggatcaacaggttcaactatgacgacgacaacaacgacgaccactaccaccaccagcagcacgccaacgacgccaaaggggacgacgacggaaaattggagcgaatcattagcggctgctgttggcggaaagaccacacttgtgctgatcatcgttgggtgcgtttgtcatcattcattggggaccgaccaaccatgacgaagtcgtgtttttttgaatgtcgacaatggcacgaaattccggcatttttggatcgttgggggaccgatcctgacaaatgagtgtttggagtgccggcaatgggacgaaattccggcattttgggttgttgggggaccgaccctgacgaatgagtgtttttgggatgtcggcaatggcacgaaattctggcatttttgggccctgggatttcatcatcatcacagcagataaaaagcagtagtaatttcacatttttccccatttgttttttcagcgcactgattgcaatcattgtcctgctcgtggttgttgtgtgctgctgctgctgcaaaaaacgcaaacgccgccgccgccacacttctgccgacgacgacaacgacaaggaggacaacaaaaagcgcaaacgtcgccaccacacttctgctgacgacaagaaggaggaggaccaccaccacattgaccagcacaataaggaggaggagcagcacggaaaggaggacaacaaatcgccgatacaaagcgaactgaaagtgtcgacgatttccgccgtgccaagcgactacaacacgaacaaacggctgggcgcaacagatttggacgtggaagcggaagaggtgccgaagacgaagccggttcccaaaaagccgaagtcagaaggaggcacaaagcgcaaactgtccaatttcttttggtccaccggcaccacggagaagcgaccgagcgcggcggaacatggcgtggaagtgccggaaacgattcgtgatgatgaagattgaagatgcttgaatgatggtgttgtattctgtatatacctatattatatattgtatccagtattctgtgtttagccatgcatatgtttatgtattgtatgtgcgtattattgtattatatttacggtattcaaagcgatgtatcatttaacacattcattgttggtatataaattttatttgtgttgttttgtatgtatggtctgaaatttcggaaaattcgcatagttctcaatgattttgtttttccgatcgactccctcagcttgtttaattttgttggcccacatttttttgacaatttcagctccgccgatttttcagagaaattgcacgaattacaatgactgtatttctaataaaatccctgggggtactattattcaacttggggcttttatggataggggtggggtaatactagagatcgggccggtcggtttttgaccgaaaaaaaccgaccgagaaatttgagtttttcggtttttttagttttaatggaggggggggggggagggctataaaagagattcaaacaaaaaagaaaaataccgacgaaattgtactgttttcaaaatggaaaaattgtctaatttcaaaaatcgaggcacaaaaaatacaacgttaagcggcgctttacttcccttatacaagacaaatacaatatgtacatacagaatatacacagtgaaatcagtgacaaaatcagtcatttgatcggataaatacaatttatgaaacgataatgatcagattatataattccatccgattgtccattgtgattagggctcatctgctgctgctgttgatccgcagtttgaaaatcctcagttcagccaggcaacggtctgaaaacgaaggaaaagcgtaagaaaaagccgaacataaaatttgtcgattctcgactcgtccctcatacccaatttcgtcatccgagaagccaatggtcacccaattcgggggacgttcgctgttcacgcgcgacacgcgcaaccaggacaccacgtcagcatcacttaactccaccggacagcgcagaatcttcaccaaggacacaacgccacccacagctggatttgcttgcacattgctcatcagcgtcagcctttcctccgtccgaatgttgaccatttgttcactcctggtgtagttgaattcgaacgaagtgagcaccatgtagttgaccgggacggacgctgcagtgaatgactgtgttaaaaagaatgggaaatgcgatcagatcagttgcagattaatgatcaaaaaagggactctgttgcagttcatacggtcataaaaacatttgacagttttaatacagcataactttttctagaagcattcaaattcaacattcttggcatcatttgatagtccaaagagtcctctattagtcctaagttgattttaaaaaattcattcaaaattgaaaaattttcagaaaatctattttttgaagttttctggttacaacttttttgaaatataataaaattctttgaaattatgcaggccaataaaggacattttgggctatcgaatgatacaaagaatgttcaatttggatgcttctagaaaaagttatagtgcattaaatttcaaattattttatcgtcgtgtgaactgcaatagagccaaaaaagagtaatgaaaaactgaaaaatccatctccatcgatcaaaatcatcccacgatacccaccgagagcaattggttgacgaattggtcccatccattgttacatttggtcaatttgaacaccttcggacgaccgtcagggcgcggcatgtgcagccacatgtacaggtcacgggccgatgtatcagcagcataattggtgttgtcaacggtcggacgttcgggcaaaatcggggtgaggatttcgacaaggttcggacagtcgaagaggacggttggcgacacgtgtttgcgcatcagtgccagttgtttgcgcttcaggctgaccagcgtgcggagtccgttcctcaacaggggccaaatgtgccgtgccatcgcttgccaagcgcgaaattccgtaatcagatggttgaactgcagcgagatgttggtgctgaacaggcggcgatttcggcgcaggaacttgatcacttggacgtccaaatacctgcagaaaaaatgtgggggtgaacaaaaatgccattaaattcaaaattgagaaaatgggcggcgactaccaaatgttgaatgtgccgttgaagccgacgacactgtccggcatcggtgtggttgccaatggcaatgagaagaaggcgccttcgctgttcaagaccatcacttctgcgccgctccctctcgacctgcgcttattgatgtgcaactccgtcaagtaccatcgcctctgctgcaactgcgtgtccaccagggcggcgaagcgggcattgaccagcgcaaagtaccagccgatttcttcacgtccaagccatgccaatgtgtccagccaaatttggtcggtgaaagtgccgcttaaaaaacaaaattttcaaaaacattttcctttctctcacatttgttccatgcgttgccgtggtgatgcctcaactgcttcgccttgttgctggagttgctccgctcgctttgcttctgtttgttgctgctgtttgtcagttgtcggctcttccttctgagtcacttttgcttctccttcttccgatgatgcttttgattgtgcagtgcccagttttgttgtttgttgtgtcgtcaatttgtgcacacttctgcctgtgctcagctgccgttgatttgatttgatggcacggacggaggagaacagcagcggcaataaaatagaggaaaaattaatattatttggaatgaatggccggaaatgctaacatcactcccttttatactgctcattcattcgaaatttgaaatcctttttttaccgaatcagagccccgagcccctataataagggtcgctgatcacgaatctgacatcactttcgactaccggattaagatttaaaaaattggatatttcgtggctcagcgaaaaaaggggccgcttaaaaaaggcgtcaaaattttatgcgcaaaattctctccccttataagggggtttctgtgttcactttcgtcatttttgtttttgtttcaacttcaactacaacaacaaatgatgccgtcgcgttcatttttcatcaaattcaaatgggaatttgcctttgtcgcgtttctgctgctgctcagtgaatgcttttgctcggttggcgcacaaccaaccggcggccgaaagtaaaaatgccatttttttttgcaaaattttccattttcacctcccctttttatttcagtgtaacaagtccaagtacgacgggatcaacaggttcaactatgacgacaacaacaacgacgaccactaccaccaccagcagcacgccaacgacgccaaaggggacgacgacggaaaattggagcgaatcattagcggctgctgttggcggaaagaccacacttgtgctgatcatcgttgggtgcgtttgtcatcattcattggggaccaaccgaccatgacgaagtcgtgtttttttgaatgtcgacaatggcacgaaattccggcatttttggatcgttgggggaccgatcctgacaaatgagtgtttggagtgccggaaatgggacgaaattccggcattttgggttgttgggggaccgatcctgacgaatgagtgtttttgggatgtcggcaatggcacgaaattctgcatttttgggccctgggatttcatcatcgtcccagcacatataagcagtcgtaatgggtcccacccttgcgtattcgcaacagcaatgtgaaaatgcgctctttcaccgcgtcgattcggctcaacaaacgctttttctccgctgccaaacggctgaaaaaacgattcaattaaatttttacattttctatatcccaccaatcctcacccgtctttgtccgtgtactgcttgacagcgtcgcaatacccttccattgc

SEQ ID NO: 10205 - DNA, 1325 bp, Heterodera glycines
  misc_feature (1298)..(1298): n is a, c, g, or t
ttttcagtaccctcaaaatgcaaatggccatgatgctcggacggcaacaaattttcctcgagctgccggatggtgaagacggactgctgggggagctgaacgcgaactcgcacctgcacaaacacttcctggcgttggcccgcgagttggacataatgacgcccaaatcgccggacgatgtgtacaaaatgcacttggagcaggcgcgtccgttcacgcaccaggtgggcaccacagcacgggtaaatactcatccatttttaacacatttttggaaaatttttcgcgattatcgggttcaaacatagattttttcaattttagatggcctaaacaactttaaataagtgatcgaaagtgattgtgtccaatagtttaatcgtcagcgaatttgaaaaaataatcatttatccagccaacagaaagttatacagaatgagtcaaaaaaccaaatttaaatccgattttggacatgcgcttaaagatctcaatgcgaatgcaactgaaaaattgctgtttcatatgtcaataatgcttttcccttcgcttccaggccgtcaagacgactacgacgacaccatttgcgcagtttgtcgaagtgtgcgcatatgcgggcaccggaaatgtgctgaaggtgcagaaaatgttgcacatttgcacggaacacaccgacaaaaaggaggtgagccgaccaacaacaataaaaatggaggattttaatgcaaaataaatcccaaaagtggaacgggaacactagcgaaagaccatcagctgatttgtttttgcctcataacgtttgttttttttttgtcaaaaaagtttttaaaaaatcggtaaattcaaatagctctctcattttagtaccgaaaaaaactagctgaatgaataacttgcaaaaaagtgccgtcgggaagacatttatgcttatgcctaaaattttgtttgttttcattccccgaaaaatgccaaaccccccaaaatacttattttatcggtatttttgtaataaaatcatccatttaaaacaatttttgcttattatttgtttgactgttgtgaaattcagtgccgtgccggaccactcgttgaagcagtccatcgccaccatggggaatcgcactgattgcaatgggcgaggacattggctgtcagatgagcctgcgcatcttttctcaattggtcagtcagcaaacggttttttgcataagcaaaatgcattcatatacaaaaaaaaaggggaaagttttctacgcgattttctgggaaatttatttaaaaataatacattttgaaaatanaaaattgaatgggatggaaaactgagt

SEQ ID NO: 10206 - DNA, 3765 bp, Heterodera glycines
  misc_feature (3755)..(3755): n is a, c, g, or t
ttttcctacaaatcgttgggaaaatctggcttattgttagaaaatttttttaattctttggggaacgaaaacgatctgggggaaatgaaatgcactccaaaattcattggcataaatatatgctttgttgcgcttatttgaccatattttcactttcgacagacgcgttacggtgacgcggccattcgtcgcgcggtgccgttggccctggcgctgctgaacacgtccaacccgcagttgacaatcatcgagacgctcagcaagtacagccacgacgcggacacggagacggcacggaatgcaatctttgcgctcggattggtcggcgccggcacaaacaatgcccggattttggcaattctgcgccagcttccactccaatgaccaggtaattattgaaaatgcagtaataaatgctaagtttagtgcagtaattagtaacaaggaggattttgtttctttgccactttttataaacgggtacttgggccctgacaaattccaccaaaagatatttcaatgatgatgatttttcatgtagagcatggttgatttactattgccaatttcggcttttttggctccgttgccgaaagtgatcagaaaaaatcgatcaaatgaaaattcaaccaaaaatgccttaaaatttagtgccattttttcttcttacgttcaaatgaccatttttcatgggtttgggggtccgttcggcagacgatgaattattttgatttttcttctaagtattattccacctagcatcttttgatttagtattttatttaatttttgatcctattataatagaaaaatttacgctgaacgtttttacaaaagatttacgaatcaagcataaggttggatttttaagaatttttaaaaaattaaccattttccaaaactttggtcgattttttctgatcacttttggcaccagagccaaaaaagccgaaaattggcaatagtaaatcgacactactctacatcataaaagtgtcagaaattaatttttccatgaatttctcttattttttaaaaacattattttgcataattgcacatccaaacacagaacacgatgatgctgctgcggatcacccatggactgatgcatttgggcaagggcactcaaacgttgaacccattccactccgatcgtcagttgatgtgccccgcaattgtgccatttggattggtgaacgaatgggaccaatgaaaagctgacattgaacatgatttggtttaccgatcgccctgttggggagacggcggcggttcgcagaccggtccatttaattttgctaatagttcagatgatacgacttctttttgaaaattttaaaagttaaaaatctgttcctatgggttttaacggaattcgcatgcagccaaaaattagaaaacacatttttgcgatcgccgaaaagatggcgccaaaataaattatataccgtatatttcagtttttttgccaaactactgttaaaaattaaagcgaacgtacaataagacgcattattgatttttttggcaaaatgaatttttgacttttgttcgacattcaaaaaaagagtcataccatctgaactattaatccatcttttattaatgttatgacataaattgcatatgaataatatataaacatttgctttgtttaattcattcaaattgccatgaacttttagccctttgtctccgcccggggcccggtcaaatcagctaaaataaactttttggaaagcaaaaatacacacaaaaaaataattcgatttttacaacattttattgaaacaaaatatttacatacacagaaattacatatacatacaattgatacagtttacatacaatggtgaattacataaaatggttacataggtggacaatttagttacataacataaacaaaatatttacatacaaaataattaggaggaggaggagggagggggagagatgggggcgggcgcacggtcttgagcacactgctgatggaagctgacgaagttgatgaacggtgttatgttcttcgcctccgacgatgccgccaccaggcactcatagtactcatcgcgtgtctcctcgggcaggatgatcggttggaagccgcggcgcatcagaacgaagttcatcagcagccgagcagtcctcccgttgccgttgaagaacggatggatgtacaccttagtttttaacaaatcttattttttagcaaagcttttttgggaaggattagcacattaacagtttatggaatttaatttagaaaattgtacaaaatatgaaaatttgttgtttttggggaaaaaaaacccgaaacttttgatttttaggatatattttggccttttttttgggttttaacacaaatttttgtgtttttttttcacatatataccgtatttcctaagatagagttcatgggtctttgtttttaatttgttgattttggcaaaaaacggaatttgctttttttttcgtcattagcacattttttgatgttttttttttatcatatgtgtaccgtatttttcagcccgtcaaaaaatgggggggggggtgtacttaaggaaatacggtatgctttgtttcagaatttaaactcaaaattcagattgccttgtaggagtgatctgattgatcacattggtgcaattggcttttttggtcacaaacagttataatagcgtgactttctgatgatttcgcaaaatttggggccattttttaaaataaacattaatgccgatagtatcgattctcaattttttaaaataatttattggttacaaattgattagcgatgaatttttgagcaaataaatcagctcaaaacacagtaaaaaatcaaattcgatactgtcggttcccttttatttatttatttttcaatttttctcacgagagtgtggtgcgcccgcgccgcaaattccccggcggtcatcgacttggcctcaagatgttgattgaaccatctgatgaagtcctgcattgctgccggcacttcttcaggtggcatcgggctcgaagtctccgaccgtcatgttgaatgtgcgcaagcagcccgcccgggagtcgcgtcggcccatgacttccaagtggagttcaaagaaggtctgcaaaaagtgttgtatttccaacggaagggcatgtgtaggcagcttttcaccttgagcgtgaactgctcgacctggaaggcgggcttcagcagggctggcagcagcttggcatcatcggcgaacttcgaataatgaatgtcgtcgtcgtcgtcctcctcctcctccgcttcagcttccacaacggctgcttcagcttcttctacattagaacggtgaaggtgccgctctcgggcttgcttcgttcctccttccttttcggcatttttactgcttgaattggtcatttttgtgctgtaggcaaaaaaaaagcgttagcgacaggcaattgagataataattattgtgtgctaatgctccgattccatttttaagcgattactgtagttttgtgccttttttagattttcctatcgtaattaaattgttaatttattttcatttcattttctgatcagatgttgaacaccggcatttaggagagtggtgtggtgaagacgattggatgagtgagagtgacgaaatgccccgcgatatgcctttttcaaataattattttcagttgccaagggaaattacacagtaactttcttgtactgtaataaggtgggcagttcaaagtgataaaatttccanaatagcttaa

SEQ ID NO: 10207 - DNA, 555 bp, Heterodera glycines
aataaaattaaaaattcaaggaaaaaatcttaataatttacatttaaaatatcagtttttgagtttaattgaatgtaaaatgcaaaaaattaagaattaaaaatgataaaaaatagtataaattaacatttaatatttgtcactttgtctataaattaaaaaattaattgcattttttggaattggtaacaagcacaataacaaagatattgtcttcgttaacagaatttttgattgattaaagaaaaattaataattatttatcatctgattgtcggtgatctttaaaaatttgtaaatacataaatagtttggtatttccttatattataatttctaatatattgtgtgaagaaaatatttatcatcggacatttaatgatgaaaacaataatgatgcacacagcaatcaattacaaattttggagttgaccatataaatcacacacttaaacaaaacaaaataaaataaaataaagggtcacaaaaactaaaacgaaacgcaaaaataattcaaaatcaacaatgatatgacattccaaatattgttataac

SEQ ID NO: 10208 - DNA, 5026 bp, Heterodera glycines
acatttattttttatttaaagtatatattaaatatacgaagcaatcaattcacgtattgtattaaaaaaacgtaaacgacacaagagataaaaaagagccaaaacctaaaaccgaaaaaaattgtttaaaacataaatgaaaaaaaaattaccaatttttaaacatatcaaaatatatattatcaggagttttatcataaaaatttaagatttaaacgctgatatgtattaaaataaaaagtgaaatttatttttagagtattttattcgaattcaagaggaattattgatatttatgcaataaaacttcgaatttttagcaaaattatttttcatttaaatcagaacttttttgaaaaaatcaaaatatttttattttgttaaatttgaccctccaataatggagttactatatacattgaaaggtggcggtggatcaaggttttctcgaatggttccgggtgtcgtgtgataacgagagcgcattttgaggcatatgcctttcttctgtgtgcaatagttccgatatattaagcataaaaaacgctgtttccgcttggtctgaagcttatacttcgacttttattttgcctttttttgcctttttggcattttaccgttttggtgtctttttggagttttttccgaaaaattccattaaacttcaataaaatcgggaaaaattcggtggtttgtaaataaaagtattttataaaaaatcaatataataaaatcatttattttttatttatttttatttttatgagagttgttgatcggtctatgtcagttcgtcccccacggttcggccccagcatgtttttccactatagctttctataacttttttctttgtaatccaaatccaacattgttggtatcattcgaaagcttaatctgtttataagctttttctaagctattgctttgcgatacaattgcgaaaaaagttatacattaaaattgcgaaaaagtcaaaattttcaatttttttcttaataaaattttttccaggcttgaactattcgcttttggtaggctaatagagcatgttaagagctttcgaatgataccaagattgatggatttggataacaaataaaaaagctatcgtggaaaaacatgctggggccgaaccgtgggggccgaatcgtgagggccgaactgacgggttccgttgttgatacctttttatacacttcgccaaaatactatttaatttgtaacaaatttaaaaatataaaacaaagaaaaaagcatccaagagatgaagttcattaaatacggcgttacctttaccataagctgcagcatcttttaatacgcgattaggttaattaaaagctaaaatataatattagcaacacaaaataaataagttaaacaatgtattttctatctattcgcaaaatatcttgaattttttcaatacagaaaaaacttttcaaattacatttgaaatatgatataaaaacatataattaaatttagaaatatttaaaaaagaaattgtttgatattaacactatgagacaacaacaatatttaagtttgaattgagttcatgaaaacagacggcaatcttcaattttatcatatttacactaagcattataaaattacccaatccaatgcgtgcgcagaagggccaatattcaagagaaataattaaaaatcaaagaaacttccaaaataattattaatattaaaatatatgataatgtaaaattaaaatgttttttttcccaaaattctttaaacagtaaaaaagcacaaattaatcaacaattagaaacaaaagaaacaaatcattattagatttttgaaattcaagaatatacttttaaaattgaaataaaattggaaattttttaaaataaatcaaatattaatgaataaaattgaatttttatttaaaaattcaaatacaaataacaaaaaagtgaataaaagaataatttgtgtcatcgcttcgcagagcgatgacgaagcacggaaaaagaaagaaagaaatgactaatcataaagcgaggacggaggccaaattgactgttatttaaccgccaccattttgccttttctgtcagttgaagcataaagagcaaatttgttgggcttttcaatcaataggcaaataatttaatattgttcatttaagcttgtaaaatttcgggttcctctggcggctataccagagaaggttcacttaatttattataacagtaaataagacgtaacaaagtggtgcaacggccgaatcctaaggcaaacagtttgtgtaaaataaaaagagtgcagtgggtgaaccattataaatgtcggaaccaatcagaatggctttagggataatggtcgagaatttaatcggtagactgaatgaacttctaccaattgtcagagcacagcagaggaacgaagagggattaaataaattgagagaagatagaatatttttaacagatttattagaaagaattgagcaaaaaaaccgtgaatgggatacatatataagagaaatatgagaagctcagaatgaggaaaatgaaagataccgcttatttacccacgatgggcgacatttttatgaatgggcagaaaggggaagagaaatggtcagcagaattaatattattctagctaatgaagatggagaaagtttagcagagagtgtgaaatcaataagaattgggcaaagagaaaaaattgaaacagaaggaaatggcgacaatgaaaatttacttaatgcaaatactaatttttttagaataaataatcagggccaaagaaatgggaatggtagtgataatgtgaactaccctaaggcaccatggccacattttgaaggggatccattaatgtggccggcattttggcaacaatttagtgctaatgctggagacaaaaatattccggatgttcagaaatgctcttatttacttatgagcctaagagggagagcagaaagagcagtaaagggttatttagctacgggagaaaattatccgttaattgtaagtactttgaaaagacaatttggggatttaaaggtaattagggaatcgcttcaaaatgagttgttgaatctaccgaccgcaaatgaatcagttatgtcactgaggccatgttttgaagaattagaaagaatttgtcggcaattgcataattctggattaaatgaaggagaagatagtgagtttatgttaatgacattaaagaataaattcccaagagcaattgtgttggaaattttgaaaaaggagaaagattctgggaaaaaatggaaattaggagagtggcgaagaaatttgaacgatgcgatatctttaagagaagaagctgcccgatgtactcggagcttaaatttaaatccaagcgaattcagaagagtttttagtatacaaacaagtggtcggaggcctggacaaaattctgaaaacccaagaacgggaacaatcccaaattgttttttatgtggtaagacgcattgggcagcaaattgcaaacaagttattggaagagaagcaaggcttagaattataactgagcaagggagatgtcataaatgtttaagaaaaggccacagtaaaaaccaatgtactggaaaaaattgtattatttgcaaccataaccatcacaaagtcatttgccctaagggtcaaaataaccatcgaactggagccaatgcaattgaattaggaaaccaaaataatttcagacaatcatctcgcatgagtactgaaatgaggaacgggaacataattgcattcaccaacgtaaagaatggcaaagaaattctattaatgacaaggagggtaaaaatatttgcaggaatgagttcagaaaggtatataacagtactattatttttcgatggcggcagccaagtttcgtttattacggatgaattaataaggaaactgagacctccgcgtattggtgaaggatattttggatttatttgcctataggcagcaaacaccgacaagaattattcacctaaatattatgtaaaggttgagttagaaaacggcgaaaaagaaggtataatagtgagcaggattgataacataacatgcaaattaaaaaggcttaatttaaagtcaggagagattgaattaattgatgaaaaaccagatattttgataggaatggcagaattttggaaattctttaagagtgtttctccgataacagataaattgtttcgggttaatacgacagtgggtcctatagtttgcggtcaattggactataattctgaaaccccacaatttgggggagttgttgcgactgaaaaatgtgaagaagaacctaaccagttttggaacttagagacaataggtgtctgggataacccggaggagaaagatgatgaaattgcattgaaaatgtttaatgaaacggttgagaggaaaaataacagatatgttgtcagttggccatggaaacggccaaaaggagaacttccaaccaatttttcggttgcgtatcgccgtttaataaatttgctaaataaattaaaacttacaccaaacgagttgaaagcactaaatgatgcgtttcaagaaaatttaaaggaagaaattgtagaggaatcaaagattttgggatttaatgagcattttcttccacatcattgcgtttttgcgtcaggaaaaaaccgaggattgtgtatgacgcatccgccaaaatcagaggaggtaagagtttgaatgagatgcttttcagaggtcctattgagatgccacaattgcctggacttttaatgcggtcacgtataccaaaaattgcattatgggcagatgggcattttggacattggaattaaaagaagaagaaagagattatgtaaaatttttatgggttagagaagtgaataaacccataacagaaaaaaatcttttggtactacgttttaaacgagttccattcggcgttatttcttccccgtttttattgggggccacaattcgttatcatttaaacaatatgaatctgaactggcgagagaaattgaaagaaactt

SEQ ID NO: 10209 - DNA, 1055 bp, Heterodera glycines
  misc_feature (956)..(956): n is a, c, g, or t
  misc_feature (1005)..(1005): n is a, c, g, or t
tgatgaatgtgagttttacaaaaaatggcttgaaatcccccccccgcagaagcggcggaagaagcgggggaaagagagacccccgcggcgggggacaaaaaatggcatttattttgtcaataataaacaacaaaaaataaaagccgggggcggggacggcgcggcgggggcacaaaatgccaaagtcaacgcatggaaaaagtgtgaaaaagcagcagcgaggggagaagaagcatttgggaaagccagtccccccaaaaatggaaacacataaaaagccgagggtggcacttttattagtaagaaaatgggggagggggcggaagcgggcaaaatgccaaaaaaaacgggggcgccggaagccaaatatgccacatatttaattgaatgcttttcctgttaattttgataagtgtcgagtggtgccaatgtggataatgccatggagatgaatgaatgaagaagccattctgagaggaagtgccacaaacatgattcttccatccggagaggggaaatggcataaagatgaaggcaccccgaggggaaataatggcacgaggaggagaagccacacaacattagcaggcttttcctattaaattttaaatggatggaaccatcaaaatggaaaggatttctgatggataatggatttgaaatttgtgaggatatttttttatccggaaacaatactcaaaataatataaaagtccaaaaactgagtcttcaaaggccagaataattttgtacgatatgaattccggtcaaatacagtacccttagaccattggccgccaattgaccggcggaaatccttgccgatgcaaaataaattttttgggaagtttccaatttttgatacttcaatttttcgtaagttttgccgttttttaaatttttgacggtagtgttgaaaaatgtttatcgttccctttcctactgtatttttgtangaagacttcatgaatgatagggatactgtttgaggaatgatgaacaccnggcattggttttgttcattttatatactgtctctttccggaggggggggg

SEQ ID NO: 10210 - DNA, 4097 bp, Heterodera glycines
ccggcgccatatttttttgtttgcctaaatttggcattctgttagattaattgggcctcattgtcagctttgattggatggtagtcaggctagctaatcgttcaagatgcttgaaaagagcaatttttaattttgaaggctgtggtgatttttgaggtcagggcttaggaaatttcgaaattttttgggcaaggcgtaacaaactttctaatttttaatgggggtgggggtgagtaagaatttttgtgagtgcgcagagggctggctaaccaagtgtcaccaatttttacaactttgcaaaaaatgctttttggcatcatgcgttttgtgatccgatccgtcccacgcttttgcaccaacgcatcccattcattccatcatttattctccgactgttcaaattggggccaatttttgcgccggtgggtgcgtcccatgcggcggcgccgccgccgccgcactttcgtcgcccgatggcacataaaactttccaatcgccgcaaaaagctgtggcccaacacacacaaacgaacaaaaaaaagagagtgatcaaccgaggggagaaatcccacaattttctcccccaatccccctatttatacgcaaaatgaaacaggttttagggcaccatcggcggggtgatcacctcccccgccccgggggaagaaccgataatgtcgggggcggaacggcgcttcatctcccgacaacacataaagccgagcggattaggctttgctttgctttgcttcttcgtccctttccccccgcccccgcgggagatcaattaacaacaaaggcaacagccagcaggcagcgattaattaggctaatggaagtataatgattaaaacaaacattttgttgccccgccggcgggggaaaggaacaattagtaaaatgcgcaaacattaattaattaatgagagcaacaacaacaccaacaaaacaacaggttttcgtggaagaaaatgaaactttatttggcttaattagttgccaaaaatcacagctcagggattggtcagtcaattgctctaagtcaaaaaatattttttaagttaactaattagccagaatgatttcttagggcgggtaattagtagagtccggcgggatcgggactcccgcgggattttacgggagtcccgctcccgactcccgcttttttcagtgaacgggatttttaacgggcgtgggatttttacgggattcccgttcgggactcccgtcccggaaaattttgaactcccgatccgctcccgctcccggaaatttttacccaaaaacgggagtaaaaatgcactggtaagaattgagttttttggtaaaaataatgatttttcattgaaaatccgttaaatatatagacaaatttcaaaaaaaaattttcccggcggaaccttaaaatccttaattttcttaaaaaaatgcctcaaattttcaaaaattggctatttttggacataatctgacaatgtattgtattgaaatattcaattttttccctgcggcgcctatcggcaccgccggcctccctcttccaccctggtcaccaccaaaaagtttttcaaaaaataagccgcaaaaaattgttaaaattaataaagggagtcaacaaataaattatttaaaaattttatttgaagcaatttgaaaaaatactgattttcgacccataaatgtgattttttaatttcaaattctgcttactaaatttttctatctattttttctttaataaaaggattttccttcaaatttgtgcattaaaaatatttttgttagtttttaattaaattttcgaattactcccgctcccgcccgggactcccgtaaaatttctgcgggattttaacgggagcgggattttcacgggattcccgatcccgctcccgctcccggaaaattttgaactcccgatcccgctcccgctcccggaaatttttttttaccggactctattcaacaccattcgtgccgggccggctttttcgccgaatctgctgaaaaaaattgctcagaagcgctgaagcatgccgtcggcgtcagcaatcgaccaactgacaatgaaaagcaatcggaaattggccttggcggtgacggcattacttactctggggctgctggtgattgtccccttgtcgatgctgtcatggtttgtttttctgctgcctcactattttaatcaacttcttgcaaagaatttcatgttccatagtttgtaatagacagtgttttcgaattttcttcccctttcgtgaaaaagtggaacttggataattctgctttctctcctcaaaatttttatacaacaatatgaaatgcttctctgctcttaagccaaaggattaaatcaattccgctaaaattttttcgtttcctagtctttgaagcgttgcccggtgctcaactgtggtctcggctcaaatctgacccacgtcattgtgacctcaacgaggctccagcatgactggagcctccaggattggctccgccggaaaagggaagagatggcggaacgcttccatgccccacagccgccaccgcccggcttgccggaggaggcggtaatttttattattaatgaaaggatttatttttatttttttaggtgtgggtcccgccgcagggcgctgatggtggcggcggcgaggacggtgctggcggcggggacggcggcggcggcggcgccaatttgtttggcggcgaggtttttagtttatactttataaataacatgatattttttgacactgttgtgtgtgtattcctttctttttaggacttgctgctgcttgacgttgcccctctctccctgggcattgagacggccggcggtgtgatgacttcactcatcaagcgcaacacgaccattccgacaaagacttcgcagacattcaccacctgttcggacaatcagcctggtgtgctgattcaggtaaagcaacggcatttccccttttgattgtttctgtgtgaaaactgttcaatttgaggtctacgaaggcgagcgcgcgatgaccaaggacaacaacctgctgggcaagttcaagatcagcggcattccgctggcgccacgtggtgtgcctcaaatcgaagtcactttcgacatcgacgccaacggcattctgaacgtgtcggcgcaggacaagtctaccgggaagcagaacaagatcaccatcaccaacgacagaggccgcctgtccaaggaggagattgagcgcatggtacaggaggcggagaagttttccaagaggacgaggtgcaacgtaaccgtgtggcgccgccgggaaagattttggaaatttcattctgatttgttcatttaaatattgatttttttttgttttgaaaaaattggctggccagcaaagaaagttttgaaggcaataccatgtagcatgacgatgaaaaatactgccgatggtccaccccgctttggaaaaaagttttttctgttctaaaaagtcgtgaaaacacgttttatggggtttttagggtcgctgatcaagaatctgacattcattttgaccaatttccaatcccggaccccaattccagcgaaaattcccgattctcctgaatacactttgatgttctgggctaaacattgtgaacttgcttagttggtcaaagccttactgactaaatgggcataatcgcttagacattccaagcaaatgttttcgttgcgatgaaacaatcgaaggcttttgcctgaggcaatgaaaagggaaaagcaattagtggcaaagggactttctctgaccaatggactggtggacatcagcttaaggaacgaaagagaaagggaattttgagggtcgttcgttggcacttactcactaccggattccaattgttgttgccgatgatcccttcaaaacacaattagacaccaattaattttaattccttcccccggttacccaaacagtactcgcgtgttttcgtacgatccgctaacgccgtcgtctatgaacaacctgtcaattttgatcaaagatgccgcttgcagtccttcaacccactcgttgctacttggcactccattagcccctgctcaccatcaccctccacacctccattttttg

SEQ ID NO: 10211 - DNA, 5151 bp, Heterodera glycines
  misc_feature (3779)..(3779): n is a, c, g, or t
  misc_feature (3884)..(3884): n is a, c, g, or t
  misc_feature (4101)..(4101): n is a, c, g, or t
ccgtgaatttgcgcacaacaatcggaagccgccggacttcccggacacagcgggtcacgctcgagcagtgccaacccgcctcggtcggcaccattcgcagtgggaagagtgccgttgagcgaggggaacaacgcgtggagcccagtggacaagaattgatgagtgagctgaaaagacaaattgaattttttattgtataattttattttcccattttttttaaatttggcattccgtcaaactatagtagaagatacaaatttttgaagaatttaaaataaggagaagaaaatttagaaaaaaaagtgagtgaaaaagagaacaaattggtcattttttgcaggaaaaaataggagaaaataaagatttaaaacagcgcttttggaacgaaacgccacataaataaaatgaaaaaagaaaatgaatgaatgacagtggaattgagcacacaaataatggaagagaaaagaaaatcaattggaaaagagaaagaacataaaagtccgcgttttccctatacacaacacacaacgaatgtgcatgattttggaaaattcaaaaatgaggacaaatcacaaatatgttaaaacattggacatccaaaattgaaaaaaaacacaattttctgagtaaatgattgaaaataattgctaaaaaatgaaaaaaaaattatggaagaaattgtaaaaaactccgttcgacaccatttagtagggacatacaaaccgtacataaaattcatgtctaaaatttgtgcaccatttatggtgttgtttttttctcacctgaatttgtgtcgtcgtttttcgaccattttggaaatttgtcgctgctcgtcgttgttggtgttgcatttgtggaccaccttttcgcttgtcaattgtttttgatcgctgcttcattcgctcacttttgtctgctaaagcaacgaacgcattaatcgctgatcagagacaaatattgtttgtacaaaaactaataaatgtaagcaaaatttttttttcaaaaaaaaatctaaattaaaaaattcattaaaaacttactatgtgaagaccatggacgtggtgaagcagcacttttaccaacattcatttcactgttggtgaacaaaaacactgacaaaaataagacgaagcaaaagtattgaaattttataataaaatttaatctgtcaaaaaagaaaattgttatgtattaatacatggttgaaggtcttacctaatatttcaggatatttttgtaagacaattgtcaaacaaataaacaaaattggaattccttaattgtgttttctgtttaaatttaaatggctttttttggaatttcaaagcttgcgtaatttaacatgcaaaagtcaaaactacgaaatgcataaacatttgttcttcttaagctacatatattgccctcaaaaaacacttttcttttattttttaaatgaataaacatttttattttttcgcttttttatgtatgtacaatttagcgtttacattgcaaatgcccggttaaatgagtacacctaattaggtaaaaatgaaaagaaaatcatattatgtatgtataaaagtataatttttaattctatatacatgaatgaaatgaaattctggaggaatacttaactttttttttttaattttgatattattttacgctatttattgttttaaattctatataaaataaatttgcgattattagtcaatcgcatgcgacaaaaagttgtcgcaaaagccaactcagaaaaaaggttttagacgaatcaaatacatttaagatttaaacctatgaattcagtaaataaaattggtctgaacttcaaaaaaaaaaaaactggtttttggtttctaatttttgatggcattgaaaattgcattgaattcgttagatttacacgaaaacttaatccaaaagtattgataaaaaaggactatcatttgaatagtttactaatgcgtatgattggctcttattccgttcagatcccacatttttttacatttttttcattttcaaataaaaaacactaaattaagagattttcggggtagctgatcacgaaacctacaacccatttctatccccggaccaggactcgaacaaaaaatcgattttggataaatgtgaattttggtgaaaatgaatgttggctttttgttagcattgggtccgggttagaaattgttcaaaatggatgtcggattcataatcaactactccgaaaaccaagtaattaaggtttttatttgcaaagtgaaaaaaaacactaaaaaaatttggggcctaaacggaatacatatgtaagagtccgtgtgatttgactttttaatttgtttgataatttggaaggaataaaaaatgttgggaaaagcacccaattttgtttacagattccgagacccaaactgtttatgacaatgtacatacatataagcgacgcctaaaaattcgaaaattagaataatttcctgacttcagaaatttctggaatttggaatttaagcatgccgagtcccaaaaaaactgtgaattttttaaacaaatcaattttgttcgataaggctatgtatgcacagatacgcaaaattttagtctcaaaatctgtacgtatggtgccaaattatgtcatgaggattcaatcaagaatggaactcttgaattgaatgctttcatttggcacccgcccttactctgcacgaaacatccaattgactttttgtatcgaaagttgacaaaatatggaaaagcttgaaaagtcgaatctgttataagatgtgctaaattagaatatgaaatggaaaaggtctcgttatttttacttcaagaattatgcaaaaaaatttatttaatattttcataaaaattttttgaattttcaaaggcacccattcgaatgtactaatttggtatgtttattagacttggtggggtaaagtcaaattagtatttaaaacacatacttgatgctaatgagtttctttttatttgtgccgaaaaaaatgcaattaattttttttttgcccttaaaatgtgccaattcagtatcattcattatttgctaggctaaatttattccgacttacataaaataaattgccgggtttaattaaacataaaatttctcgaattataaaatggcttaattccttcataaataaaaccgcaaaaagtgctgtgcaaaatctaatcaattataatggtttgtttggtgctggaaattttcgtagaaaaatgtttggcatttttccttagttgccaagacgtcgcggtttccaatcagtacatgtgccggagaaaactcgaactcatctgttgttttccgctgcttcagacccatcacggccgaggcgtaaaaagcgtccacaaagtgaagcaaaacaaaacaaaaacaaaaaatgccgaatttttcaatccaaaaattgtgccgccattttgtgcccaaaattgccgccgttttcagacaaatttcaccaaatcccgcaacataaacgggacgaaattgtgctgcaacagggcggtgttgcgggcattgaacagttggaccccacccaatggacgggcaatcaacgaattgtccattttggtccaatggcacagcgcgacccgttcttctatttctatccgaaaggctgggatttgctttatcccgctcagttcggcttcttcccttatcggactaagtttgtgccgaccgaccaaataaaacgaatatttcgtcaagaaaaaatatcgaaaaatgtaaattttttgcaccccaaacattttttcagcaaatntcttggcagttctgcggtcgtttgtgtgtgggctttcggcatttttttgttcctcggcggcattctgatgatttatttgggctattttattgaatacaaaaaacncgttttggcgttggactgttgaagagcggcaaaacactgtattttcatggatttattttttacaattaaatttaatgatataaaatttaaaattaaatgtgccaaatataaattgtagatggttccgcccgttcaaattgctggcccattgttggccggcaccggccattttgctgctggtggttggcatggtttgctcagtcagcaattctcaggntgtgtatgtgtgtggtgttgtgccgcggcaatttggaaaagcccggtggactttaaaattgccgatggccgattactagagccttaaatttgaaaaaaaaacggggtcgggataatcccgagtttgtcgggatcccgatcccttccgggctctatcgattaccacaaaaaaaacgtttttatccaaaaaattttgaacaacaaatccttgataaaattggtggactttaacagttcaagaaatgatgatttgaattggtaaaaagcgctgggctttcatttttaaaaatgatcggccctcaaatagccgacttttttaagtgcccaaatgtttgcctatgccattggtattaaaatgactaatgttttacaaaatcagtctaaatgttaaagattttgcatatcttggccatttaaaatgggaaattttttttttaaattacaaaaaattataaaaatgccattgtccattgaatttctttcaaattttgcagtttctcagtgataaactgcgccatcaccaccaccgtgatcagccagcctcggtcactgtgtacacaacccattacaaagtcaaaaaaaaactatgaaatttccaccaaaaaaaattccggttttagcagccccgtgccacctacgaagtcagtccttatcagccgttgccaccgccggccaacccagtctatgtgaatccaaatgcacgaactcatctgttagacccgaacaaggagctcaaactgttcccaccggtgtatgagaatttttgggattttttttttatataaagggctcaaatggactaattgaggtggttggaccccatttcggcattggacacttgggtatcaaacaaaaaatacactgtttggggtttaaagagtcactgatcagtgatcaagagggataggtatgtctgatagagagagagagagagaatggagagagagagtcatgggggagagagagagaatgagagaggatatggcagagagagagagagagagaggcccttaaagggaaggagagagagagagagagagagaaagagtct

SEQ ID NO: 10212 - DNA, 1367 bp, Heterodera glycines
  misc_feature (14)..(14): n is a, c, g, or t
gcattattatacanttttgtccaccaaaatttttttttcttttgttgcagcaaaactgtagtcaaatcgaccaccacaacaatccgtcgccagagcagtgccggcgacagcagcggcggtgccgacgcggcgccgccgccgaggggcggcgccggcactcgcggcagccggcgcgagggcggcggcatggtggtgatggcctatcgctgactcaattgtttccccatcatggcacaatttttcaatttttttttcggcatttcaaattaggcaattccttctacaaaattttcatgttccatgcccagaacggagagagaatgcaatgccatttttgctcaataatatataatgttaattgcagtggtggttccggaggtccaaaagggtttccagattatggaattcggatttgctgaggcatgtaaaacatttttgaaacccgaattttttttttttaaatagccgtgcaataaaccttttaatattatttttctacaaatcacaaaatatttcagccatttaaaaaccaatttttaattaaataaaagaaattcggaattttcatcaaataatctgatcctccaaattccggccctgaaaaggtccgaaacatggcaccaccattgatttgttgttaatgctttagtgtgtgccataatctctttttgcctagtgccacattgtgttcttcgtttgccttttctttgctcaattattttagttttcttccaaatctagtcattttagtgtttattttattgctttttatttgtttgtggtcataagagcccgaatttatgtgaataatccaacagattaagccgttttttttgggggggggggctaataaataaaaaatgtctcatttgaaatgaatcctaattttgtaaattatttgtgaaaattgattttctttcacaaattggcctttaaattgttattcctttccattccatgaacaaaattgtatgcatttttaagcatttgaaattttattccatcaatatttttgcatttttgactataaaacaagcgcaaaagcgagcgccgttcgtcatacaataataataaataataattaatattaaatttttttacaaaatttgtcattttaggcacaaatctgggctctatgatcatttgcaatattttgtttatcaattttcattttaaaatattattcattatcattttcctttaataatagtacatcctttgttgggatttagtctttccttctcaaaactagaggttgattagaagaatatattcgtcgcgattattttaattttgttgtgcctttaaaaaatcaaattgatgcaaattatcaaaattaatttattcgtttttattttcgacctgca

SEQ ID NO: 10213 - DNA, 2097 bp, Heterodera glycines
tattctattctttgttctgatcagtagtgatcacccacaatagtcgcatttgtgcaagaaaaaaacacaaagcaaacggacactttcactactcattttatttacagcaaatgggtaattaaacagttaatatatacaaaaattagaaaaatgaattgccaattatatggatggagtggtaatctcaaattgatatgcaatttcaaaagtgatttaacttttggctgatgtgcatgatgaatcccgaaaaaatgttcgatttaactgaactccgtgtgaatcgaactttaaaatatttttgttggtccggactgtgaaccgtgcgtagcccgggactcatcagggcccattgtcagtcttgaggccattctcggccttaagcctcagaaagttctcaatctcgagaagtcaatgcttcgaaatgatcgctcatttctgaacagctaattagacaaaattagaaagcaatgatatgacaaaaagcgattaaaagtagtgattcagaatttatgaaacaacaaaaaaaggatggaatgggaaacgaatgaatgaatgtctgatcagtgatcacattgtacaagaaaaagcaaataaaattctcataaaatcataggtcaccgtcaccaaaacaaaaggtcctctcttttggtcgttatttttgtggcttttcgtcagctaattgcgcagtttccgttgttccgagtgccattgttggaggagggagggaaagtgccaccgccgtcacgggaagagctgtccaagggaaaagtcacattttggcagcataacgaaatcctagagatttctaatataatcaaatgacaaaaaattatttaatgggcaactgggaaagaaattgcactcaaaaatttgttcagggtgagatgggagccgacgccccccccccaaaagaaattcggcaattggaatccgaggtccgagccaaacggaacttggcattccgacccatccctggtccgttccgttccgtggccaagttgctttgccaaatcacttttatttatttgtcgcttaaattgcttttgctctgtcccttttcacctttcgtattcttcgcgttgcaattgcgcagcaaaaagggcgtccatttgttcagcggcactttttgaggagacattttttggctgaaaaataaacaaattaaaaaatcaaataaaatttacaaatttccatttattttttaattttatttttacctttgtcgtccgatgggaaaccattggcctaaaatatgaaaatggtccgttattgattttaaacaaaaagtgccaacattttggggcattggtggtcagattggtgccgatggctgaggcagaaatggacggcacattctttgcaaaccatcggcacgagctgcgaaagttggcaaatggggaaagcatttatttttttatttttgcggcatttttcaaattgccgaaattcacctctctccggaagcagttcttcacgccgcatttaggtgcccaacgtcccttttttgccaactcagaacgacagtcgcgttcgatgtgctcattgactcgcaggtcgggcttttcgccacgtttaattggcaccgtttgttggcacaacggacaaatcggaaattggacattctgaaattggtaaaatatgaaacgtaaaatggtttttgcaaacattgcctttttgtatgactctgtgcagccgtgggagtcgtacgttctgtgctgtttgcttaaacaactcttatttgttaattaaatcaaaattcattatgggttcggttggcatcttcctttaagccaaaaattcaatttttttaatacgattggcccaaaatgaatctctcctccgtaataccatgccctatgaatttaccataaaatgcgcgaacaagcatcgcaagtgatgggcaaatagtctaaaaatggtgggcgtaaatccatgccgtactcccccgtcccctccgtttttctcaccgagttgtcgacagtccggcacggagcaatgctttcccgaatcggggaagtcggccatttctgaaaattaaaaatgatgaaaacgaggggaggaaacagcagcattctaataaacaaaaaatgatgacta

SEQ ID NO: 10214 - DNA, 1988 bp, Heterodera glycines
  misc_feature (1812)..(1812): n is a, c, g, or t
  misc_feature (1846)..(1846): n is a, c, g, or t
  misc_feature (1857)..(1857): n is a, c, g, or t
  misc_feature (1936)..(1936): n is a, c, g, or t
ttaaattatttattttaatttaatttaattttaattttaatagtaaataaacataaaaatttgcctttctctgtcaaaatgatacaatggaataactaatcaaattgaatttcttcattaattccaaatttaaaatgatcattttcacgacattaattaacataaaatatttattcatttaattcagagtaaaaatttttgctaattatttattttcatttggcataaatcagttgatcgaacagtaattttaattaataaattgccacttccaattaccattatcaattaattaagtaaactaattaataatcaaaaactcctccagggtcattcagtcctttgccgggggcggcggtgaatggtcgccaaaacgcataaaaataacatttccctcccccgccacggcaaacagacactttttacgttgtaaatttacactcgcaatacaaaaaccatcgcccctgggctcatcctgccacaacaacaacaacaacaacaaattggaagaggaattgaaggccgttgggttggggagaagagaaattatccaaggcgacggcggggggggggggggcaaaagtgaattttggtggagttttgcgtaaaatcatttgtatatttgccgtgttttttattttaaattgtattatttttaatttattttgtctacgcaaagagcggcgaacgaaacggtcagtcattagtcgctaattgactcattaacaattaattaccccttttaataattgtctttcctcaaatttacaattagtccacagcacagtcacttttcagcttccgttctgctgatgtttcaccacactttttgcacccttttaatcctcacactttttgcccttttcattggcaaatgtttgcccactgttcaaccaaaacaacaacaaaaccaacaccattctcgagaacagacaaagcgtaagtcgaagaaagtgccgaccaatgattctcattctttttgatcactgatttgtgggtcgcgtccgtggtattcttgttgtcttattgttaggcttggttctgctctatccccccccccccttcagcttatcttctcgtttccgttttccttctccattaatccctgtatttttttggatcccatcattcaacactactcattaattaattaaatttaattaattattaaccttacttttaataaaatataatttatttcgaatttcccctttcccaaaggctttccttcgtcccccgtcggccccgcccgttccgtcattcgtcgcgcaccgttcatacgcccgcagaacgaacaaatgcacacaaaaagtgcgccggtcgccgccgcttttgccgtccatccgccggcgattcgaccgccgaagggaatggcaacgaaactgaaccaagccaaactgaaggacttcttcagtcagatcagaatgaagttgcaaaaagcatgacgaagcagcagcaaaatggacaaatttgatcagagggggcgaagagaaaagaaaagaaaatgatcagaaaagtcacttttgcaaaagttcgattgcacaaaacataaataaatctttcacaaattaaaataaaatacagcataaatatattttattaaattaaaatgatttaaaaagggttgttgtctctttgttctaaacctggtgaattcaattgttaattttattaataattagggttgtaaattatatggattaacatattttttctgcgcatatgctatgaagaaaggggcttaaaaatagcatttctgcgttaaaattttttgatttggtgaaggtttttagtccatataaatccatattnttggggggttttcgggaataaatccatatttcgnccatttttggngtttttagtccatattttggccattttttgggaaattttcacaagaaaaatgaaaaaaaaacgaaaaatacacccctanagatcaaacttttttggaaatttttaaaaattacaccccacaaacacgaaaa

SEQ ID NO: 10215 - DNA, 2637 bp, Heterodera glycines
atataataataagcatttaatatcgtaaactctttagaatgcaatttagccagaagtaatttatgtttcgatagccctaagaattctctattgatatttaaaattttagaaaatttcattgagtttcaaaacagttctgaacaaaaaatgctgacttaagattttttgcaattttgtgaccataacttcttttatacttaagttaaaaatataagaaaattatattctgaaagagaacaattaaagctattgaatgataccacgaaatattaatttggttgaatttgagccaggctattaatttaattattttacccattttttgttttcaaacccattgtcagttttaacaaacgcgcatgggtggcagtttttaacaaacgcgctagcaccccagggatatgacttcagaaattttttaagccgtttgaattccgatttaatgccgaaatttgagatgtcggaattccgcttttcgaaatgagggcgtcggcaaacatcctgatttgtatgccttgtggctttgcggtgctccgtactcacctgtacggcggtgggggcgctttagcgccgctggtgcccaggcggaaggcggcgctgaagccgccgtcgtcggcatcgcactccgttggacgcatgccggctgtcagcaacacgcgttccgggtcgccgcgcgtgatcagcggggcagcggctgcggtactgttgccaccggtgccgttggccgcggcacggctggcgcccgctgctgccagctgctggtggcgccggaacgacgccggcgagtcgcgacgcgcgcgcacaactctgtgccgataagtataatttatttttttttaataaatttgagttttccagagttggaaacaacaagttcctgtatcgaaaattcggtcctggtcaaagatagagtctgatcccatcagaggcatttcatagactgaaactattcggcactttatttcgagactctcgatccaggtcgctctatatgttgatggatcattgaacttgaagatattagacacagatcactttcaaagttatgatcggcacttcattctgagactctcgactcagatcactttatatgttgattggaacattcaacttcgagattgctgacccgggaccagagactcgggtcactttcaaggctcggatcgacaattcatttcgtgactctcgattctgatcagcagaaaggagactctgatcactcacgcacgcactttttgcatgtgatcagacaagcagccaccatgcacaacagcagcaacccgcacatgcaactgagcacgatgaaggcggtgtagtaggagctggacacaaccccctgttgggaaaatggaaatctctaaatttccaaaaatccaaaatcaccgcatgatttggctccaatacgccgccttctccgtccgcacaatacgcattctctttgatgccccatggacagtttttgcagtcggacacctgctgccgagaatggaaggaataatgaatgacaattaaatgatgcaattaggcttaagccccaacccttcggcgagtagagaaaagtcggggaatcgaggatgaaattcaccgacaaaatttgtcgtggatttctggtggaaacttgcaaaaaagtcttcgaaactcattcacagcaaaaaaataaaataaaataattttttatttgtttttaaataatttttatttatttttaattgctatttggctatgatcatttgtcagaaagagtgatcaaattgtactgtatataaaaaaagcaagtcaaaaatgattgaattttagttcctaattcggaaattaaatttttggaattttagcttttttctatgatatttttaaatcaaatttgtaattaatttctttaattggtctcgaaataacaaaatcatgtctcaatttctgaagggatcagcagctttaattttttttaataaaaggaaaaaaaagtaaaaaaaattttattattttttaaaatttttattatttttatcccacctgttgctgttgcccaatgcctccgccgccaccgccatttatccatcggcacaatgagaagaagccggtacgacgactttggcaaattgccgtggacggattggctgctgagctgttgcatgccaagtcacagccggggcccaaaagtggtccacgacaagtgacggagaatgccaatgacagtctttttggggaaattaatggttggtacaaaaagtgccacggaatgagtaagaaaaagagaaaaatgccaatgaataatggaacttggtaaggggtggccggggaggatgtgtaaaacgtcaatgactgcctttttggataaattccgtggcacaaaaaatgccaggaaggggtgggggagcggaaaggtaattgccaaaaaaatagtgccaaatattttgtcggaatgtgccataaatagggtaaaatgccgccataaaactttgcgttgtcgagacttatttttctcgagacttttaggctatgtagtgtgccaaaatcgaaggcagggcacatatttttgaaaaactatcccaaaacgcactgtgtgccgacgagtcggccttggagctgtacatggtgcatctgctgttgttgcagctgcccattaccaccaccgccggc

SEQ ID NO: 10216 - DNA, 1583 bp, Heterodera glycines
agagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgcaacataaaatggccatggcgcaccgcacttagtttcatgttcgagagcgtttgacgcatagaacatttctcaaaaaacacgataaccatttttctgaatctctattaacggtaacgtttcttcgtacgctagtatcaccagtggcggcagcccggctggcacccagcggaatgtggcacggcaccgccgctgctggtcagcagaggttggataaaagtgtccacaacagtgacagtgttcgtctcgtacagcgagccgtccatgttgatttgtgggcccaaattatgcacaacgacggcgatggcactctgtgcgtggggtttttttggtggttcgagtccgttgtgcaacatgaatatttttatttatttttgtccaaaaaattaaaaaatgacgatttttaaaaattatttttggaggtttttaccaaccaaactggacaatcttgtaatcattcgaaagcccttgattaggagaagccttttctaagcaaatgctaaacgatttgatgaattcgaaaaaagatatgaacgtttgaaaatttgtttttcttataactcatgaaataatgtataagccgaaaaatggctgtattactgaatgcgttatatttttctctatcggtatgcaaccatttgaagccagatttaac

SEQ ID NO: 10217 - DNA, 1486 bp, Heterodera glycines
cgacccagtcccccctggtctataggagccgctggtaaaaaatttgtaatttttaatgagatttgttaatagcctttttgtccaaattgatcaaattataataattttgaatttttttcgagtgcttatttttaaggacattttgaattaaagaatttttttcaagtgatagggcccaaatttcaagacgttcttgcctcaaggacgaatcccatccctactttaaacagatcaaaaattaatttaaaaaattaatgcacgacaaatgtgcgattttggtctttttccatctatttcatcatcaaatgttatcccaatggaaacttccgcactcccggatatggacgaactgcttgataggcttgagaacgaaccccttcaacttgtagtagaattgccagctcaatctgtggccatcaaaaacgagttttctcctaacagtaacagcaattcggatcaacaaaactcaataatagaacaagaacaacaacaacgagaaaagcaagttggggtgacaacatgcgacaataacgaagagtctgacagaaacctccaaaacatcgtaccaaaaagggaggagaagggtgcatgccttgaagcacatggtcaaattgtgccagagcaagacaaggaaactccaattcaattccaatgtctaagacttgttcatgacggacaaagcgaaaatcgaatacatacggcagaagtaaatattgtaaacaaagcgtaacggtcaattcaaaattttaggaatgcatattagcttttaaagatggatatgaaacaaacaaaaaaaatgacgaggatatttttgaccaaattgatcagatggcagcgcaaataaacgcggaagaattggaccaagaaattgaagagacacgtgacgaagaaattgtgaaaaaatctgatcttggtaagccattgaagctgcaataacacacttataagaagaatcttcagaaagtagttattatcatgatacttttcctatgaaaagtcaatgtcttgaaaaatttgtggaggaaatggtcgattcagttctacaaagggtaattaattcaattttcattttggtattaaatcaaaggaacaaataatttaggtgctggaagaagcgatcgatgtaaatgaaaagaatgggcaaaacccaacagaaataaaagaagaaatggaacaatgtgatggagaaacggacagaggccaaaggaaagccgacgaagcgcaagaggcaagggaaacggaagccgaaaaaggtgccaattttgaatgacacaaatttctgccaaaaaacttattttaatgctctttcagtgtctgatgtctcccccagtcggcccctctctcctcctttgccttcctcctccgcctgcccctcttcttcccattctcaaccatttacttctcaaacaacaagccaccgaaataattgcttggccattgtccacgacctttccattgctttggacgagttcaaactgaccgaaag

SEQ ID NO: 10218 - DNA, 3500 bp, Heterodera glycines
gacctttccattgctttggacgagttcaaactgacggaaaggaattgcagctcggcaagaaaaagccctatggtcaaattctttgccttttctattgacatacgtttccttccgtttttaggattcctgacgaggaatgcttggattgcatgctctgcgcaacgcgcttttccattgtcaatcggcgtcaccactgtcgcgcatgcggaagagtgagtcatttgcattttgtaactgattttattttaacaacatcagaaattattatttagctaataattaatatagcaatcgtttcttttctcctaatttggggttttcaggttctctgtcgtatttgctgttctaagcgtcgacttctcgcctatatggacgaaaaggaagggaaacaacgcgtgagataaagcaaatcaattaatttaaatcatttaaacaataaggtttgtattccatgcaatcggacattggaccgaattgtggaatatgaacaccgaatgaattctttggaccaaaaggacaacgctaacggcgagggaatgggtgaagaaacggagcaaagcaaaaataacacggtatccgaagcgacacgacaacaagcggagcagaaaaggttgtacttgtgatttgtttttgttttacctttccccaaagtgatgccgttgcccattctcttcgccaatccgctgattttgccccgacaaattgtgcaccgccgcgtccaaaaaagaagtctctcctgaagcagtccgctgttgctcctcccaccatcgtcactgcccatcggacggaagtcgctgctgcaaacggaccggacaatggacaaactttggagcaaacgcggccgatagtgggccattgacaagcgataacgaattgataatttatcttacaattagtcagtttcgatgaccaactccaaacggagtgtgacgtttcgggacggcgttaacccaggccatgatggaaccacgcccaattcacagctgtccggacaaaacagtaccaatgcggagtgcgtaattttattaaaatgcaactaattgccctactttgtcattttccgcaggtctgaccgattggttgcaggtccatctctgtaccaatggttggtcagtgggagcgaccgaccgaactcgacagatggccattctcttgttaaaaacccattcattccaatggcggccaatggcacaaatatttcgccaaacgacaacaaaaaagtccgtcatattagtaaaacggagcaatccaatttccatcgaacagttgccacggaaaatgtccagacggtcgagggaaaagcgcatggaagaggaagcacagagtttactaattttaaaagccgatacaaatcaaacgcaaaatgaatgccgaatttggtcggttgaattacgcagtgatgggttcgaggagttggtgaggcgagaattggccgaagttgcaagagaattgtgcgacacggagaaagagagaagggaatggacaattgcattgcgacggaatttccatttacgcattgaacgcgggagaagtgagtccatttccattttaatgtttcttttttcacggtccatttttcaattcacagtttgtgccgaggaccaattcccaactttggccgtttccactcgtggcttggcttcactcggcgtcgatgaactgtttcttgcgtttcactttgacccctcaatttttgcaccaaatgaggtgagtttttacggaggtaataaaatgcatttcaaaaaaaagttggacccaaaatcggacctattggtactgctgcaacagtacgaactgatcttccagcagtggtttggtggacccgcaggaagtccatcagatcgaccataaaatgggaatcagaaagtagacattgggcttttgattttcaattttattcattttacttcctcaatgtcagatgcgtttctcggatgactcggctttatccatcgttcacaaaggatcagtcaatatttggccataaagcagcggcacttctgttccatcgtccacacttcaaacaggtgggcagggacagttgaggtgttgggataagaagtactaatttatcttatggtgattccaattagctccacagttatttaaaaatgttatagattttgaacagacagtatgtttagttaaataaaatgttgttattagaaaaccacagttccaatttttgcctgtttagaattttgccaatttccgtccgccctcccacccttttcttattggtgtctttgtccagaaggatgaacttcctttggccaaatgtgtgccgtgtcgcctgcttcttcgccttggaatgctttatggcggtaagtttcttcttttaattcaacaaaattctttttgaagggttttttcaaggaaaaatctgacttaactttttttttaaaaaagaatttcaaaaaatattggagggtcgagggagatttttataaaatttttccattggaattttcttattaaaattttttcaaatttcttgaaaaatttctgtttgaagaattaaaaatatatgcctacttctagaatatcccttccccgtggtaaatgtccgccgagagcgtcccgttttcactgccaattctatccaatccagcgtattaaaggtatatttcacaaatgggttttttagtaatttgttcctcctcttatctcttacctaaaggtgctcaatgattttcgtttttggtcctaccgaatggcgcgtctttccggttgcattgttgcaattcgtgaaacaaccaccgtcatcattctgtcttcttgggctttggatgacattcgtcaaatagtggcgggcaatcgcaatatggtcggatgggcattggaccaattgagtgctgcagccgacgcggacgaggaggacggagttacggaagtgagtggagggatggatggtgggcttgtgcaatgaacaaccgaacatgttgggtccttgtcagatcgattcccatttggtctgtgtccaagaagaaaccgacgacggagtgacgccctctttcagcactcgcgtcttctccagtagcgaaagcaactcacaatcgacgccaattacgacaaaaaagggtgaaagaattgtctaaatacagttgcattagcgatataaacaattgggtttcttcagtcattggtgtttcatttctgatttttgacggtgcccttcgcggcagtgaacagctttcggtcagtttggttgaggatggactcgtcgttcgactaaatgccgatctgatggaggtactctctttttttcttccaattccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagatttgagagggcctaaaaaggtcaaggaaaggcgtctctgcgttgat

SEQ ID NO: 10219 - DNA, 2278 bp, Heterodera glycines
  misc_feature (60)..(60): n is a, c, g, or t
ttgctttgcgagtccatatcgacggcgaagtgattcctcacaaactgagaaatgggtggnattgccggaacaacaccttgggtggacggtgacacttgatgaacaagtaacactgatgacaaatcacccttttatacacatatattcatttttagcttatcccttttctatatgggctatgttcctggttaccaagcgtttttttcgttgaattgcacacatttattgtgtccactcggccgcttccggctcttactgttcctgacagtcccggcgattcataacataaaaatcacaattctgtctgatttaaagtgaccgaaaatagagcccggaaattttaagtttgtggatcagctgcagtaggaactcaaaattatttcgagggaaaaggatccgaggattaatagatacaaaaatgacatagttttaaaataaaaaagtaataataaatatcgtgtactttatttcaacaataattgaggtcaatcaaaaacaatcagttctcccgtttcccttcattttcttttgaccgactgctagctgaaaatgagcaagattaaaattttagtttcgcaaaaattcagcgaaatctgtaaggcaccggtaaaatgcaagatcggcaaattaaaaacaagcaattcagaagagtcactttgacccgccccctccctccttcatcttatttacctccacttccaccactgcgtacggacggtcgactccgtttagcgggggttgtcgagggcggtgaagtggcatcgtcggcagttcttcgcggtgaatgtgtcgttgacgagggtcgttcagaacctaaaaaagcatagttaggagaagaaggaattggcccatcctcccataattgcgcaactcactcggtgctgtcaccgcttttcttgtcgttccgccaccaccaccgctggcggtcccattcgcttttactagagattgggttttctgtatgtagttaaagcatcataattggggcaattaatgaatgtttcaccgtcattttggtgtctgcgaattcgtttagttcccataatttcacattccgcttcgccagttgtaccaaatagctggacgccaacaaattcaaatcgtttcgtttacccttaaatttttgaatgaggagaatgtaaatgtcgctgattaggcgtaccttttcgttgtctctaactgctgtcacatgcttctcaattgaagttagattagaccgtaatattggaaaattggtgagaatctgtgcaagcaaaaatgaagttgaagataagttttaaatcattactgtaccttcgtcataaatgtcaaagcatttcgtattaaaacataattattttgttggagcatgaagccaagggaccgatttagtcgcaattgccatttgtaacagatggaacgaaaatagtcgtaagtgaactaaaaaaagtggaggtgatgtcaacaggacgagggcgttcacctcgtccgcagtcgctgtctcatcccggtcttttttccgaatttttgtgacacagcccgggtaaccttcgcattccttaaggcacaattaaattaaaatgtgtcgttctttgtttgtttgaaaaacgcaacacacttcattgaaaattgttttgctcgaatgccatcgcaaagtcatttccaacaacatagaacagtaacggccaaagcaatgcgcttcacgctcagaaaaccccgccaaaatggaggtgatgtcgttgaatagcttaatttggtaaaaatatataacatcgttccattttctgtcgcactttgtccatgaaaacaatcgtttgaaaatagcccgttttgattgtgtgtaatgtctcgaccaatttggcgcaataaaccgcctcaacttctgaacaaatcacccggggcaacacacaactttgcagaaagcgcagcatttgactcgtccgatcttttggtttccgaataaaataaatccctttcccattccctcccaatttacttggtgccgaagcaaaaaatgtgtccttttcggagaccaaaatttctttaattcgtttcacatgttctgtttgtctgaatgggtgataatagtttaaattttcggcattataatatttttcacaaatatgccaaccgtcgcatttcctcgctcagtttctgctccaaccctttcagtctctcctcatctttcactgtgcgtcgcgttgccccgccacgcgtggaagaaaccttttgaataaatggcatcgaataaatgcgattttccctttatattgtcagcccacttcgttgttcgtctgca

SEQ ID NO: 10220 - DNA, 5691 bp, Heterodera glycines
tttagctgcaaggcttagctcacttcgttcgctttttaggagtccgttgcgaatgttcgacgtccccggcattgacgcgccggtgatgtcattggtgtacaaagagcgatttccaaaggccaagcagcaattggagagtcgaatcctccaattcctgcagcagaatgcacccctaagcggcttcagctctcagctgcttcagccgaccatcgcttcttcaacgccgttggtgggtcctttttgagggtatatctcttcaatttcttccgattcagcgtgccacttctccccagcccggtcagccccccggtgccatctctgaccattcgtccgtctgtcggcctcagtcgccgctgcccgtgcgccctctgtcgccactcgtcaccgaatcggccactgcaattggcgacgcggtcattcgttcatcggctcatttctcctcccagggattgctctcaccgcaacagcaacgaccttttgtggaagaagcagaaagaattgaaggtttgccttgtcatcattcaatctatgcaacacaattcggaacaggaggagaacgggacggtcgtcaatcgtcgctcgccaaacattcgtcgcctgtttgttctccgtcctccaccacggttctgaccaccaccgaccagaacattcttcggctcatttccgacggggccactcgctttttgcaccaccaattgtgcgaaattgcatccgactgtctgcagaagagcaaagacggaatgctcagctgtgcctacttttgcaatatgtccgtcagattggacgaaacgttggcggaggtcagttgaaaacagtcaaatttaggacaaacatctgaaattatagaattaagcaactcaaataatgtgttttgttcaggctgaagtgaaaatcggacccgattcttacagctatttgactcggttggtcaagcaacttttgatgatcgtctcaaggtctggagatctttaaatactttaaatcctttaaatttgctttttagggccgcccgtttgttggaatgtttggtaagaaattagttacgcaactaaataattttgaaaggaaaaagaggagagaagggaaaagcggccgattgtgtagctcattggttaaaacaccattttggttgagttcaatgcccccatccgatgttttgttaaagtgccactcaaatgagacaatgattaaattaattggtcaagtaaatttatgatctctgtgattttgtcactttatgagtctcacaaaaaaaatcaaaactcagcggggatagtctttttattgtgttctttccactttcaggagtttgaccccgacgagttttatcagctgttggaggaggcggagggcgccgtgcgagttcagctcggcgccggctcggcccgagtgccggacttaccgcaatacatcgtttccaaattgggcctgaacaaaaacatccacctgctgatggaggacgaccaaacggcgatggatttgggagaagaggcagaagaaacaagcgacaaaaggatgacagaaataatggggacgaatgaactgatgaaaaagagggcggctgaagtgttggcacagggagtgccaaaagaggaggattttgagacagtgcgggtgagtgaagaggcaaaacgaattcactcttttttccatggcacattcaatctattcgtttgggtcaatttatggatttgacgatttggtatacaatcaaacaatgctttcagttgattagcaatggtgcatacggcgccgtttatttggtcaaacatcggcggagtcggctgagatacgcactgaagaaaatgaaaaagcaaacactgctgatgcgcaaccaaattgagcaagtttatgcggagagggacatcctcactttcacggacaatgtgagttgacaaagccatgggacggaaaaatgttactgtttcagcctttcgtggtgtgtttttacggttccttcgagaccaagcagcacctttgcatgctcatggaatacgttgagggcggtgactgcgcttcattgttaaaagtccctaaaatttgttttcaattgtaccaattcatttcagtccgccggaactttgcccatcgaattggcccgcctttatgtggcggaaacggtgttggccatcgaatatttgcactcgtgtggcattgtgcacagggatttaaagccggacaatttgctaatcacttccatgggacacataaaactgacggatttcggcctctccaaaattgggcttatgaatcggactactttggtgtcggaaggttatctgctacaggacgacacgcagcagttcaaggacaaccaactttgcggaacgcccgaatacatcgcaccggaagtgattttacgacagggatacggtaatgaatgtgaataaattatggccctaaaaaatattggtagaccagcaaattcactatttttgcttatttaaggaaaaccggtggattggtgggcacttggcgtcattctctacgagtttttggttggaattgtgccttttatgggagatacgccggaggcgttatttgccaacataattaatgaagacgtggaatacccggagggggacgaggtgctttactacaagctgaaatgttaattagccttttatttctttctttaggcattggattcggatgctgagtcgttgattcatcttttgctggagaaaaatccgctggaccgactcggaaccgtcggcggtgctccccaagtgtccgcgcatccgttctttacaccactcgactttgacacaatcttgcggcagaaggccgagtttgtaccccaactcgagaatgacgaagacacttcctacttcgactcgcgctccgaccgttacaaccacgacgccaatgagtcagcggaggacgacgacgcggcggcggtgccaatgttttggtgcgtctgtcgttccttccagtgattcatctcttgcctttctttctgtgaaggtccttctcgacggcatcgcctcggcatagcattgtcgggttggaattgcccgccgggggaatggcaatgcttcaggccgcccatgcagcagcaattgaacggagtgggcagccgctgcagcaacaagaccgaattgtggacgatgaccgggtcgagagccgcagacgactcctttcctcggcaaccaccgcttcttccggcattggcagcgggccaaactcggcattcggtccattgtcctctacacttttaacgcgtaagatagcatagaatttctcatttccctagtcttatgctacttaggtggtggcaattgctccgactcccaagattcttcccacgaaagtgccgttggcagacgagcaaccgctgctgcttctgaattcgcttgcgatgtgatgccatcggcagtcattctgcgacggcgtttctccaaccagcggcaccatacaaatgtttcgtcaaccagcagttcggctggtacaacaattggtacaacagcgggcggtggggtcggttcatcaacagacgactcgtcgtccttggacatagcgacgacgatgcatttagaacagccgagacggtcccagggacagttgccgaggtgcatatttttgcatatttacaacctaattgaacatgcttagacttgcaatatcaccatgcggtaccactttcaactcttcaactgggggtgccattgtgacacaccaacgggaaagtgcgtgtggcaccggcggggaattcttgtcgccggtcaatgaacggcatatcactgccggaggcggaagcggtggaatgaagcggatggagaagcgtccttccgccgttgtacacgaattggtaagtggtgaagaaggagcagttcgtccacccgctcttccattcgttaaccatttagataaccgatgtcgtccgtgtgtcctcctcctatgggcagtctttggcccgtcagtctcgctcctcttcatgtcgcgtcagtaacatgtctcccggggccgccccgtctctcaaattacaaattcccgctgttgggcttcacaatcagcagaattcgtcggccaattcgccacaacaaccgtcctctgctgctgcatccgcttcggtcagctcttcttcccaagcaacaacatattaccactcgtacacgggaaataatgccaaaactatggcgggaacacttacaacggacagaatttgtacgttttaattttcgtcttctgtgattcataagttcggatgctcaaaaggtgtgccaaattgtccatctggccaaatttcgccttcctgtaattcggtgtccagcacttcgtcttttgacagtcaaaatgcgcaaaaacatttgtccactgaaacggcgatgagaaagcaacaggagacaaattatacaggttaggaggggtgcactttacccccccccctcccaaaattctttcttaaaacaatcaatttttcttgaaatatctattgaaatttctatattgggaaatttctctgaatttgttgcgtcccctcaggtgctccttccgctcatccgtcttccccttgctcttcctctttgcttcccccgcccgtctcgtctctctccgtcccattgcatcaccgatccagcatttctggcggcgggtcccgcccaattgttattcggaaagggccccaaggcttcggattttccatacgatccgtccgcgtttatttgagcgaagtttgtgtcgtgtcccatttctttgatttgttttatcaattttctttgcagatgtccgagtattactccattgaacatattgtggccgctgtgcgcgagggttcgcccgcttgggaagccggtctccggacaaacgatttaatcacgcgcgtgcacacccaatcggtcagcagtattcacaatttccatgaccgtgtctcgcccaggtccacaacatgactcaccccgaaatgatgcgccgtctcctctcctgcggcaatgaactcactgtccatgtcgttccattgtccagcacctccataaaagagggcgaaccgcgtcgaaacattggcaaacccttgcgcaagaagccgcgacggccgccaaccgcacaacagaaaaacaaacaacagagtcgcaaaggttctgcacttctgcgacgactcagcggcaaacggacagtcggagacatcgttccaggtgggttaactttggtctatttttaattgcattgtgtaaaaaatcatctttaaacaggcacttcgtctcagaagcaaatgttcattccccgttccgtgtcctcccaagaagggagggctcaacttttcaacagttcgacttcgaaattggagtaaatttgtatattgctagacgtttattcttgtacttcgggtaatttttggattttctatttgaataaatttgaatgtactggtctatattctgtgttgtttggttttatggagccatgtctccttttctcttacataaactgctgtcccataaattcaattactttttgaactgggagcccaaaattaactcgggttaaacaggaaactgcggtttgacgttgactttctgacaaattagttatgacaactcatgcatcagccacaggaaaaaatgttgtttagaaaatctcaatttattttctgtcacatagtgcacaatatcaagagaaagttggagtgtactccggaaacattaataaaaaggaaaaataaattccgtgtacaataagctccgaagaggaggg

SEQ ID NO: 10221 - DNA, 5869 bp, Heterodera glycines
  misc_feature (88)..(88): n is a, c, g, or t
  misc_feature (1039)..(1039): n is a, c, g, or t
gggctgttcattgggcattttgtaagtgtttggacctaaaaaattccatgcccggcatttcgaaagcggcagagggacatctgcgatntttcggaaggggtggcataggcgggagtccaaatttccttgccctatcccttttgcacatattggggtgttcggaaagttctttcatagcggacaaaaatttatttgaaaattcataacatattaaccaataaaccaattttaatcaaaatacgcaccattattctcgaccatcttctcccatttgtgagattttaaaaatgatctatcgattaaattcaagatagttagactcaaataaactgatgggtctacttaaaaaagtggacaaattcaaccactgatttcttggccaagaaaaggctaaaggtacaaaacaaattatggttttgtagagcaaagttgggactatctgacaagctgaaaaagagccaccaagaccgacgggttatttttttaaattgtcctgtctgaaaatgggtgctcaaaagtgccaagattcagcatccactttgtacaacattgttctgaaaagacataataaaatgaaattgatgttttcattggcaaaccaaacccggagaatgcgaatatcgcctcagatttagtcagttgctgttctatgaccctgtactgcttcaacttcttgtcaacgacatggagcagtacaatgccagagaaaattcagagatcaaatctgaggccagatttggattctccggacttgatttggccaaactgcttttaataaatttccaactgatcaaagcaaagttttgacccgtacaataaaagtgatcggatttgggattttgggtgctccattgggataattttaaaaaatcaatttacaaagaaaggaaaatgaaatggctcgtaacatatgcagcaaaatctgctccttgccatagaacagaaagaatttggccaaaggttgcggttgggtgctaaaaaattctaatttacataaaacgaccgctatgaaagaactttccgaacacccccaatatanttatttttatgataattgagtggcattatttaaataagattttttcttgctttatatgcaattttatttttatttttttttgtttaatccttcattaaaatattagataattatttaaaaatgttatttttttattcgaagagattaatttttataaattgcttgcgatgagcaaaaaactgggtcgaatagaggcgttaaaacgaaagtttttcgaacaaaaaatgtgtttttgtgcatttctcgtcgagttcaagccgcataaaaaatatgtagaaacttaaaaattcgcgccctatttatcaggtttttttgttgtttccgtctactctccaatgtaaatattaaaaatgcaaggtggaacgattttttaacaaaaaaaacatttcactttgttatttttttgtttctaggggttttcggggtcgttgggcatgaatattacattttatattaaccaacattaaaccacgaacccaattccaataaaatattataaatttctgtacagaactgttgaaaaaatgtcaaattcatgatcaggttgaccccggacctctatactcataaagaatccggagaaatagtgttttcgaaagaaaaccatcgtgccgctaaaatcaaaaaaatgccctaaatcgaatgtttaacaaatttcttaccgattaccaattaattttgcctttcacacgtccgctcaacccctccccctcgctcctctccctcctccttcccccgcccccccccctttattttgcactctgtccttttgaaagtttgactcgtttctgtggtcagtaaaataagcagatttcacagaacaattctcattaagcaactttctttcatacattaagcaatgggcttttctcctagaaaacaatatttcttcgactgatttatttttaaaataaagtggcaatatttaggtaagctctgcccaatctttgggcattagaatgccatcctaccaatacggtaaattcatgtgaaaaagacccttttcgttccgttgatgcacatactccttgaataaaaaaaatgacgcaggcacataaagcatatgcatgcatagattaaaaaatacgaatgattaataaagttcttatcgattgcaaattgctttcccacgtccgttcaatccccccgcccctccccactttatttttcactctgccctttttcaatttttgaccctttcattggggtcagtcattcattctctgtgccatttgttatttctctctatttattcattattttgcaattgcctgttccttctaatttcttttgcaattttctaataggagcaaacatattttaaaatacaattaattttgaaatgtcttccgtgtcaactcgttttaaaaatttattattgactgggtccgttgctgatttggtgtttgtatttgacgagggtggcgaaaccaaggcatacacttcagatagaattctcgaagcataacatttttacctttaagcatgttcgagcccacaggcaaattttgtggggtatttctggtgagttcgatcgtcttatttccgaagatgagaacaaaggtcgtgccaaaaatgtgaatttataaagacgaatagctttttagacaaacctccaacaaaacccgtggcaatcaaaaacattaaatttgacgtgttcaatgccattcttttctatttgtactgtggcgatatggcagaagtgaaaggcgaaattttgttcgaagttttcatagccggtcatcaaatgccttttttattttgttattttttttgtttagctgaccaatacttcatgagcgaacttgtcgccgaatgtctgcaatttgacttctccgaaattcccaacatttttgctgtgttttccgaatgtctcaagctgaaaggacctaatgtgcgttgctatatataagcaaatatttataaaactcattttacattaagaaaggattaactgtatttgacttaactcgctaattaggggaaaggagcgtttcggcgccagcccaaatttttgtgctataattttttttagtttcaacgaaatcaaaccttctaaacatgctatgagttcgaatgatgccaaaagattgttgattcattgaaattaaaaataataatagcccaaaaacttgggatggcctcgaaacgacccagccaataattgtttttatttagttcgaacattttgcgcagaactgtctccgttttatcgatgccaatgccaaatcactccttttttccgacgaatttctgcacattgatcaaaaaatgttgtgcaaaattttggagcgtgatggacttacaatttgcgacgaatttgacgtttggaaggcggtaatcatatgacaattgaaactaattgcatatttattttattgttaggcaattcgttgggcgcaaaatcagtgccaagaaaaagaggatgaacaaaatgcttcggcattggatctccgcagaatgatgggagacgcactttacaaaatccgttttccaattatcgcagaaagggacttttcggactatatttgtaacaaattattaattagatttcgtttttttttgtgacatgagtccaaaaaatgacgagggcaaatgacttaataattatttgttagataatttttgtagttcccactggcgtgttggacgctgacgacgcgttgagcgtgttcgtttcgtattcgaattcgggccatacaaatgcaaaattctcaattcatccgagagttatgcaaaacactggcggttcaagaggccggctcacgttggacatcgaaaattttgaagattttttgatggaagatgaaggaaaacgagaaagtgtggtcaaagtcatcagaggacttccttggcagtttactgtaactgcaaaaggttttccggaggtcgtcgtcaaatacttggacatttcgattcagtgcaatgcacaaaacggtgatttttgcgttttgggattaattcaaaatttttgaggggaattaggtaccaccgtatagagcccccaacgaaatttattaagtaaaataatcaaaaatttattttgctatgaagataaacaaaaggtcgccgccaaagcgggccatgacaaaatggcatcgcaaaaaaattgctaaaataaggaaaaaaattatcaattacatacacatattttacgaaattttttaaaataagtttgcgattattatttttttgttaaaatgactatctgaacgacattttgtctcgatgaacttttggagtgcacgtgccgaatgcacaaaattgttaataaatttttcaaaaatatttgcattcattaacatttctaagaatcgacctggtcatgcccatgttccgtgactgtccgtttggtctcgcaagtggttgagaaggattacacgcgcaaattctttcacatttttcatgccggatcaaatctttttcacattgacgatttcgtcacgtccaaagtaattattatagtataaccgcaagggcgtgggtgtacaaaacattccctaaaaatttttcatttttttttgaatttttttgaaattttctaagtttgaaaatttttaaaaagttttcgagggtgagatatggagcgagcccttacccccgagctacagccttttttgctcatcggcctcttactctttcactgtgatttttgtaaaatacgattttaatccattgtttgtagtttatgggaaatcctaaacttttggtgcttttaattttttttttctaaatttttcattggtaaaaaaattacgaattcttgtcaaaaaaagaagtgactatttgggtccggtcccagccatgttactcgtaaataaacaaaattaaacaggatgtcaaagacggcacggatttcaatgcgaatgacaccgttacccttgcaattgatctgattgcggaatgattccgatgggacatcagcaaaaataatgggtcaaaaaagaatggaatgtgacaatggatttatttatgtcttgattcggttcaaatataattttgttttgtttttatattttattcgttaaacgcaaattaaaggacatatgcaaagaaatttttaattttttttcgaaaattgaccttttaactgcaaaatgcatttttggaattgatgtaaatttaccgaaaaatattgaataaattattttttttcgaaaattgaccttttaactgcaaaatgtatttttggaattgatgtaaatttaccgaaaaatattgaattaattatttgcttttggaaaatttaaaatatttttattagaaaaattaatgaagcattgagcttgaaaacgcctagaatatgacattgcttaatcgatgattttttgtgctgaaaatgagcacaagtagcgccgattttgttataaaaacaatttcgaggattatagtcaattttgaaccctacgaaaagtcgatgagtaatttttcccttttattccatttttcaaaaagaaataatacttttttaaaaaccaaaattcgatttttaattattattttttgtttgtacttctaaatagttttacttttatcaaaaaacaaagatcaaatcgcattaatttaccgtatccttcaccatttcttttatgtaatatttcttattttttaccttttaataatttttttgaattttcttgtttttttcttcttctttttatttgatattttattccattttaaatgtatttataattcataataaacaaaattttaaataagataatgactaattggttgatctaccgtatcctctctctttcctttatttccctaattggttaccccaccatttgcgtccctagacatttgcgtcacatttcttaaggg

SEQ ID NO: 10222 - DNA, 4110 bp, Heterodera glycines
ctgactttcatgaaaaggaggaattatatgaaataatataatgagtgatgactgacctccttgaaattgttgatcctgtttttaatttgtgatgtgaaataaataatgcaactcaatcgcttcggcttctcgtcttttctcggagtgtgcaaccatttgaacaatgcttggcgagcacaataagctgcatttggcccatcatcatcaccaagcacgtccgggaacagatcaactgattggattgagttcaactgattgagatcggtgagaattgttggcgaagtgaggaaaagcaatttgctgagatgatcactattaggaaaggcgaagtggcgaatgtttgtcgcaaaaatgggccaaatttcacgaacaaaaacactccaaatcggagtgacattggcattttgtgaggaataaattttcaaacttaattcggtgcctttttcatcgaaaatttgatgattgaaacggagaaattcgacgactttttggtcaatgcacctgtcaaaggaatgctttttatcagttaatatcaatgctgcaagatcgaaatttggcatttttatttattaatagcaacataaatatgtcatgatttaacacggcgagtcaattttgggctccaagtacacttaagttggttttttcgtcttagtggtctgtgagttagtcaccaaatgtgggtctcaggttcaagtcctctttgtgtttgtgtataaatttcatttttttaaagcaaatatataaaaaaataataaaaacagaacgccaaaagaacaaatacaaacaataaaaggtaaacattttattttacccttgattttatgaatttttttagcttataactttttcaataatataccaaataaaaccattttatgctcattttgaagggaaaattctgaagaatatttcttaaatagtcaaaagtttaaaaaaattgtttattggcaaaaaaatgaaccatgtgttatcttatatgttagagacatggaaatagtgcgtcaaaatgagagaaaaagaaaaaactttgcccagtcgtaaaaatttttccaaagttgcgattttcttgaaattttgcctaggctagtttttcggccctctctatcgaattctcttttgttttttgaaagtttcttttctaactcgagatcgactcttccatttttacaagggaaaatccccaataaattttaagttttgcaaagttttggcgttctgattactaaataaataataaacttatttgtacttggagcccaaaattgactcgccgtgttaaatattaatatttaaaacaatttaaagtaatatgatagtacagaattttagcactctctcatttttgcgttttccctctccacaataattttagcgccaaaatagtttttacatttacttaaattttaaaattaatattgatattaaaaaaatatcaacgtcaatattgatgttttaaaaaacatatttttaaaagaaaaaaattttaatttgccattctttaaatgggagaaattggggtaatattgttttgttcctcccctttttcgaaaaaaaaatttcaaaaatttctttcctgggcttttcgagctcgctgatcacgaatccggcatacatttcggccaattccgaaacccggacccgaattctaacaaaaagtcggaattccaaattttcgaatttcgcaattcgtgatcaacaaccttgaaaagcccaggaaacttgtttttatgacatcaaaatttttgaaaaaattttttcgaaaaagggggggggggaacaaaacacagtattaccgaaattggtcaataaaattttgaacttactcaatttcaagaagttcaaagcggattttattgtgcagcggacgctgcggaattggaaattgcacaaatttggtaaagatgccaagcttctctatttttgttgttgtccccatattgtgaatcgcgattggtctccaaattttcaattcgtttttgccattgaaatgcgtgtccactaaaacatcgaaacgtggcgaaatcagtgccaattttagaccaagttgagcatggtcgaaaaaggggaaaatgtccatcaaaacatcgctgcaaatccaactgaaattgtgaaaaaaataaccttggaaataaaaaattttgcaattaacatataaaaaaggcacaaaatggttttactaattgatttattttcataatcacaccaaaaatgtgataacttaaaaaggaaatgatgaaaaatttgtaatctaatagatagatcccggacatttaggcacaaaatttttaaaatttacatgcaaaaaggtaaaaaaaaaataaaattaaaattccgataaaaaactgagcatttttattatttagtgacagatttttaccaatgccgtcgccttccaaaagatgttttcacaaatgaacacaacggttgctgctgctgctgattttctctaatggcagaagaaatgacggcggtggataattcttgttccatttaaaattaattaattttcgcctgcaaatatttaagaaaaatttttaattttaaagggctttttaaatgaaattaggtaagcacaaattttgaatagaacagagacaaaagtgtcatataattagcgcagcagaagcagcggcggtagcagttctactacaccgcggcggcgcttttcggttacaaaacttctgcatttgcgcccagaatttttaatcggcatagtacgcgccatattgactatggcaggagcaggagtaaaacttattaaaaaattaaattaataaattaatttttctgattaaataaggtttttatttattattttttaaatgaaaaaatgttttgatcgtgcgtatttagttaatcttgcgaactttttttgtcgtagtacatgttctgtgttttggttccttgtagatgtggaggaggaaacaaatatttaagtttccattgtgagttttattttttttattgggcatttaataactttaaattaaggttatgtggattcaccttatgatgtgaattggctgttgagggttgggcgacagctgttaagatattggcagggtttttctgaacaggaaaatttgttttgattttttgtatttaaatttaattttttgtttatttcttttgtccattatactgctatcttttcaataatatttataagtgatttggtatttttgaatctgtgctatggatattgcaatttttatttgatcgattctaacgtattgacgtaattgcatttaaaattatttttagttggtaaattaagtatatttgcgacattatggagcacagaccgcatgctgatgaacagaaacgtcagcgagcacgggatagtactattcaacgtttgagatggtttggagagcaattaaataattctttttttattcgttatgtttctatttttaagccgtcttcagcgtgaacaggttcacgcacgacgtgtggcaggggcttggacagcagcttgtaattatgatggtcatggtactaatcaaggagatgtgaactttgaatgtgcgcgcaatcgtcctagaggacgttcatgggggagttggcagctagaaatgggaacatttgcaacttttgttccgcccgagaattacgcttttccaccgccgatggttaatggatgccagcgggcaggggccgcaatggttcgttcccagagaacgtcggcgccgaaaagtacggctttgaagcgtagtaaaactatgtaaataaattgatattaactttattggtcatccattgtttgattgacacaccctaattttaagagttccaaaatgttgcccaaacacgttattttggaatgtctgtgtctgctaccaaattggagggaagcagaaatgagtgtcgacgcgttgtgccaagtgcgcaacgttcaggggcggggcctggcaatgcaaacaagttcgtgcaaccaattgcttttgtttgtaaagtataaataaaaaattaaaagcatataagctgattttttctgcatttatttgtgtctcttaggcgtcataaacgttatgtgagagcgcagatgcgtttggcacgcttataaggtgttgagccgtttgctaaggattgtgccggttttct

SEQ ID NO: 10223 - DNA, 2574 bp, Heterodera glycines
  misc_feature (24)..(24): n is a, c, g, or t
gatagaagggtttaaataaatttntgtaaaatcagacccggaaaaattaattgaaaattttaattttattaaaactaaaatgactcaaatgcgcttgggtaataaataaattaataattattatttgcatttattaaatgcgcgtaattatgtcgggataaattgtattaatttaatgtgtcaattgagtccaaatccagtcgcgcgttcagcctaaaggtgcgtcaaactaaggaaacggatttggactgacaaagtgttaattgataagcgtacaagtggcaaagcacgtgctactaaattactgacaaatagcaaagtatttgtccgataggtaaatggcaaaatgggaaatggtgaaacaaaagtgccgatgttggtagcacataaaaacaaaatcggatggggcgcaattagtttttttaccaaattaagcggatggggcgcaccttcactgtccaaatgtccactgtccaaatgacttcactttccaaatgtccactgtccaaatgacttcactttccaaatgtccactgtccaaatgacttcactttccaaatgtccactgtccaaatgacttcactgtccaaatgtccactgtccagatagatgtccattgtccaaaaaaaaaagaaaccaaaaagggcattcgatacaaaaacgaaatacgaaagaaaaagaaaaatttgaaaaccgaaaactaaacaaaaaaaactttcgtggacgaaaatgaaacacgaaaacgaaattaacatgggccgaaaatgaaggccaaaacgaaaacgaaatgaaagggtccgagtctaggaaccacaaacattgttgacaagcataccatctccacactaccgtaaaatacatatataaataaatactgtataattgattaattatttggccttttgatctcgtcatcccaacttatttcatattttcttaaagattctctcgaaattacacaaaagacgctgtttttcaaataaaataaataacaataatttttcgatttcggtacaacaaaatgaattgacaatttttggcagttttttcggtgactttttcaccaaaaaaaataataaattcttctttaatatgagcattttctgattttttggttaaaattataggcatttttatccaaaaaagttttttttatttgtttttaattttgttaaatataggtttaccttttttctctttatttcatttcgttcttttcaatttacaatttattttaatttctttttttttacttataattttcgtatagtacaaaattatttttatgattaaataaatttattccattctgtttgtttggttgatgatttggctttcataaatgggatagcgatggcttttcacatttactgataatccgatagaaccatttaaaatggaattcgaatgaatcataatgggaatggagagaacaaattgggacagaattcgctcattattaaaattgacgatcaactacaattttaatcatttagcttcaattttgaaaattaaaataatctttccctaaattttgccaggaattgccctgaacatggcacggtgcccgttcctgtacatcatcctcatccctcttctcctgctggtgctcatcaatttccctccaattttggcatggatattgaagcgagacgatgtcctcttagcttattctccaaatgaacttaccacagatgaaacgaaaattattggtgaaaagcaattgtgcccagccagagaatggtctttggaaaaaacttttgggcttcccattgaaccgaattctgaatttggcaaaatgttgcctggtctttctacagaattcaaccatgcacttcccggcattggaaaatctcttgaatacatattatgtacctttgacaagatgcactgtcgtcaggtgaagctagcgagtttcttagaaactgccaccaataaataggatacgatttttagacaaaagcctatttttttttcttaagctccccgcggcctgaaacgcacgaaaaatatctttttttgggctgttgttaagctacttttcaagttattagtgccgattttctaggcttttatttttagagcctaaatgcctaaaaaaattttgaaaaaacctatttttgctacctatttgtggggttttttagagcctaaagcctacccattttgacagtttttagagcctaaaaatcgtatccctacccataaaataccaaccatacacgtttattgcctggcgcttctctccccttcagtttaaaaaattcttgaaaattggaaataatttaaagaaattttgagaatttaaaaaagcttgaaaacgtttaaattaagagagaaaaatttaaaaattaatatttttggaatttcaaaatctaacatttttaaaaatttatttttcttcaagtttttgcttgcagcataacttgggcttcgttttttaagcaaatgcctaaaattccgtgcacttaatacgcacagtaagcatgaaaaacgcgttttccgcttggttggggtttctacgatgaatttgtaacgcctatttttacatatttctgggtttttgtgcctaat

SEQ ID NO: 10224 - DNA, 2097 bp, Heterodera glycines
  misc_feature (2057)..(2057): n is a, c, g, or t
agatgcatgccatgctgcatggatcattttcagtacacatgtgtcaacgattggaaggaggtcatttttaattgcaaatttcacactttaaaaaaaatcatttgtcattttttgattatttaacaattttttttgtctatttattattttattttgtgcggcacgcgcacggtttttttaaaacgatccccccccccccccccccccctcctacaaaaaattaagaaaaatttcttatggtttgaaaaatatttaaagaaattccgataactaagtttaattttttcaagtttatgaaaaactttttcgaaaaaaattttaaatgagtatttagaattttttaaagaaaaaatttttttaataaaattcaacaatttaacatttctttgtttgatttctatgaaattttatttttcatttaataatttattaatttaaattttcggatccgctgcgcaattgaaactcaaaatttttgctaggccgaatatgattaacccacaaatccgcatttaaactacggaatcccgcgcagggattacgggattttgaaatattgaataaattttacattcttattcagcttagaataatcctttgttttttataaatttcccatcaaaaggttgaggcaatgtttccgaccacaaccacaactacgaccacaacaactacaacgctggccccagttcatccgaccgctgtttgtgaacataagcaatttaaaggggtgttagtgcgcttataaattccgccaatcgtcggaaaatcaaaaataattcacaactttacttgagaaagatcacaccaacaaaaagagtcacaatacaaatatggtaatacaatttaggtgatgccattttgggccgagtctgttgacggaggagtagtgacaaaaattgaggtaattcatcatacccactcaaacggtgctaggtcgtttcctaaaaaccgccacattgggcgtttcctaaaaaccgccttctataagaatattatttttcaaaattttttaatatagcataaaaaagttatggttattaaattccacaaaatcttaagtcggaattttttttcaataacttttttaaaactcaatgaaattttttgaaattttaaaggtaaatagattaaataaagtacttgaaattctaaaaagaaaatttaatttaattgcttttgaaagaagttataaagtattgaacaggatatgctttttacgatggtcatgcgaacatttaaaaatttttaagtcaattaaaaaatacaattaagtcaaaatgaatttatatattcgattgtcctaagaattctctatttatggttaaaatttcaaaaaatttcattgagttttttaaaagttctcgacaaaaaattccgacttaagattttgtgcaatttaataaccataacttttttacaattttttaaaaaaaatttaaaattaatattcttgtagagaacaccttgtgctatcgaatgataccaagaattattaattaggttgaacttaggccaagttatgaatttatatgtcttacatttttggttttactaccacttggcggtttttaggaaacgacccagcacgatttaaaacgaccgacaaagctaatggaattgaattcattgcttaagatcacaaaaccaggaatgactaaaaagtcaaaaatgaattgatattccaataagtaaaaaaattctggaaaatcacaatcgaagtaaattaaaaaagaatatttaaaaaactatcagtcgttctctaagtttattcgagatctcctccagaaatattaaatgttaatggcggacaattaaaaatggaacaattcgcaatttggcactgcccccaacaattggtcggtcacttttcattgtgtcggccatttgttgtggcaacattctgctgtcgatctttggccatgttcagcaaatggccaaccaccaattggccaaccgccggggataacagacttttggccaccggcacttcgtcgtccggggagcgcgggagggggcgggcggtttgcagctgggcccaccgctgaagccgcagncggtaggaagtgtattcgaccttttttgaagggggggggg

SEQ ID NO: 10225 - DNA, 2325 bp, Heterodera glycines
attttgcgatgcgtcactatgccggcacaggtgggcaagtaccaaatttggcagtaatcttaaggggggggggggcttatttttcgggattaaaatagggttttattagcttaaaaatgcgcatatattgtaaatcccttaattctaaaatggttaattgcgtttattttctttataaagaaaagggcgcgtattgttggattttcgtaattttttttttgcgcacttttttcgcctacaaaaaattaattatttttgttcatattaaatttctttttaaaataaattaaaaaatgtatggattagtgttgaattcgttttaaatttttcaagaaaatctgtttgaaattgtaaattaattgatttaatacgatcgaaaataaatatttctttttaataaaagaattgttacgataattattggaaattattcaagtaaataataattatatgttgtgtttaagtccgttacaatgtgtccaactggctggaaaagaacaaagacccattgaatgacacattggtattttaaattgaatgaaataaattttaaaaaaagacttttagtaattaaaattgaataaaaattctatttttattttgcttaggtgtccaatatgaaaaatgccaaaaacaacttactgattgtggaactgtggcaaaactatcaaacgcaagaagaagcggcagtggccgccaagtcgggcggtggcggcaaaaagaagggcaaatccggctcattcatgacgggtaaattacaaaaaaaaaaaaataaataaggtggactacaggccgaccaacctaatacagtatcccaaaaagggaaaactgttacaaattatactgtgaatcacacatcaatccctactaaatacagtatccttaaaacaaaaaattcatttataaacatatccttgataaaaagccaaaataatttaagctatttcaaaattattgatttttcccagtgagattttttaataatttttttttataaatttatttttatcatttaatttatattacaatatacaccccatatccacagtatccatgctttaccgtgagtcgttgaacaagttgatgagtatgttgcacaagacgcacccacacttcatccgatgcattattccgaatgagaaaaaacaagcaggcaaatgggaaattacaaaatataatatttattatttaaattgtaattacactatgatattaaatttttgaaaaacttaggtagtttatttattactcatcagtgttaatatcaatgagcaatttaaaattgaaatatataaaaaaactaaataataaattaatggcataatcagattaataattaattaatttaaaataattaatcaaattcaattttttgtttaggaatgattgatgccgcactcgtgctcaatcagctgacttgtaacggagtgttggaaggcattcgaatttgtcgaaaagggtttcccaaccgaacacttcacaacgactttaaagtgcgttacggcattttggctgctgaagaagcgcgatcaagcacagacccaaaggtggggagataaagtattataaataatttttgatattttcaatatttaaaataaaattaaaaattacaaattgtgatgactgatttgaattatataaattttgtttaggtcgcaagcggaaacattctcaacaagttggttgacaacaaagagcttgaagtggaaatgttcagagttgggcacacaaaggcatgccaaacaatttattaatttggtttttttactctaaattatttggaatactcgaaattcacgaattaaaacgaatttcagggtttttgggggggggcatcccggtcaaggcgtcaattttctcggtttttagttccgagacttgaaaattttgttaccctcataagcagccttataaaatactgtattccctaaaatagagcccccgggggctttaattttcaacgcccctcaaaaggagggctttatttcaggagggattctaagttaggggggggggagggactgaattttaggaaagacggtatatttctttttcttttttaactttttcccgaaaaaaacattttgaaattttttaaatatttctgaattattttgggtgttcttcaaagccggcgttttggcccacattgaggagctgcgggacaagaaaatgaacgagctgatcaccggcttacaatgcgcaattcgtgggtatttgaccaaaagggatgcggcgcgcagaaagcgccaatggaattcgtatgacatcattcaacgcaatgtgaaatcatggtgagcgcggtcggttcgctgatcatga

SEQ ID NO: 10226 - DNA, 2544 bp, Heterodera glycines
  misc_feature (915)..(915): n is a, c, g, or t
tacatatgatatgatttcagtatatgatgccgacatatgataccaaatattggggaaaatatatgctcattaatgatatttaggacgtttaaatgcaaaaaagttaacaaaaaaaataataaaatgaagaactttaatttttacttccgtaaaaattttttactttaaaatattttttaggtaaagaaattaagggcaaataagagtcatatcgcagatatgatctgaattgaaataggcccctggaatgaagtatcgagtctctagggcaagtcttgagtgttataccaagcctgtgggaagtatcgagttcgtggcccagtctcgatattgtattgagtgatcgcgggaagccaagtgcctcgggggaaactttgaaaattacaccaagtctcgttggcagtctcgtgccttggggccatttctccagtatcgtattagtgattgtaggaagtatcgagtcttgggtgctaatcttgaatcctcattcctactcaaggtctatttaaaaaaaagaaaagttacatctaaaaaattgtttaaaaaacaaaagaaaatacaggtgtgtgcttcgtacatggcaatggtatttgttgtatgggaaggtgaagccgttgtgcaagggcgataaacatgaggaggagctggagaaaatggccagcgaattaaaggtgccatttcaatttttttcgattaactactaaataattgttggaatattttcttgtaattttatatttgcaataaaaaaaattgtaaaattcgaaattttaatgctttttgaaaaattttttaagaggaattttgggtacatataaaattggcccagtaaatggcacgaaatattttaataccataatgtgtccaagaaattttgacatttcgttaccgtgaattattttcgattttccgtanattgtttgccaaattatgtgtttaaaatttaaaaatatatatataaacatattttaaacattaaaaataattatttcccaatgttttaaggtcatgaaagagacattagccaagcaggaacagacacggaaagctgtcgaagcggagcatgccaaggtggcggaagagcgcaaaaagttgcaagaggacttggaacggacgcggaagggcggaagcgcaatcgaatcggaagtgatggtgagtcatcggtgttttaaaaaggcggaaaatagggaaaattaattatttcaaaaaatggcagagaattggtaaaattaattaattatttaattttacgctacgcgaatgtaagaatggaaaatacaaagaatttagaaatatggaatttccttaaatttcttaaaatattttgttgtagcaaaaaaatttttgattggtctacgaaatttcaataattttttacatattttgagaagtattaatataattttaattcaatattcataggtaattagaggcaaactttacattgacaggcaataaaattgaaacggtttattttataagtagaccaaatttaaattatttatttaattgctaattgttttttaagtcaatttgaattaaattagttttataaaaaatgtttcaaattcatttaaatgatttacaataaaataaatatattcaaaaattttgcccaataaaacatttagaatttaaacacggcaaaagtgcaattggagcgccaattggaggatgccaaagatcggctggaggaacagcgccaacgcgcggaagagacacaacgcaatttgaagagggcagaaaaagaaaaagacagtcttaacgaacagattgggtcactagagcataacttgaagaggtagagaaagagacagaaacgccaaaaattaggctcacaatcattaaaaaatattaattttacttattaattaaaaaataaatttaaaatcccgccaaagaatgagcgaaattcgggttcatacacaaaatggttttatgtttcgaattctgcgcattggacagattttttttcaatttttattaaaatttctgaaattttaaatttaagtttatattttcattaaaaacaatcgcattataaggagctcaatttttaaaatatattttttaatatttttaaaaaacaatttaaaaagaactttttcttttatgtcgttgaaaaatattttatcggcatttttagcatattaaaatatctcgaagttctcattaaaaattacagggcttaggttctgtgacactgattcaaaaaaaaaactaaatattattttgatgaaattattttttaattttaatttaatttattttttaattttaaattaatttatttttttagagttgaggaagacaaaaagaaaatggacgaccgcatcaaagaaaatcatgaggcaattgcgcagcaggacgaggccattgccgcggcaaataaggagcgcagaagggcggaggaggaaaaccgacggatgggcgaggaattacaggcaaattaatgaattaattaatttaaattaaattaataattattagggctgtgaattttatgtaaataaacatttttagtctggattctccatgctcgaa

SEQ ID NO: 10227 - DNA, 1122 bp, Heterodera glycines
  misc_feature (74)..(74): n is a, c, g, or t
ctcgcgcaaaatcaaaaattggaacgttcaattgaagaaattgaggacacattggaccgtgaacgtcgtcaacnggttggacatggagaagaacaaaaagaaattggaatcggaagtgcatctcgttgagggtaattaattaattaatgagtgtctcattaacatggacaattagagctgattaatgcacaacacttttaaaaaaattttgtggtttttatgtagtaaaatttagtttgtttatattattttattttttacattttccaattttttcaactggatcttttatgaaaaataattttaaacattttatctgcaaaattgaatttttttttttaaagttcttaaattatttagtatcaaaattttaattattactgaattttgatatgggtcaagaatttataaatggacattttagcaacgaaaaaaaaaatatttgtcgaccagtaggaaaattttcaaaaaacatattaattctatggcaaacaaatataactctttgtagagctttctaattttcaatgtccttgaaaaatgcttcgactcaaatttattttgtcaacatttaattttatattttcaatctaaaataatttatatttctgcagaacatattgctgaaatgcaaaagcaaaaaggggacacggaaatgcgacagcaacgcgttgagggcgaaatcatggatttgaatggcaaattggaggaacagaacggcattgtgggcaaactgcaacggcacctgaaggatcgccagactcgtctcgtggaattggaggaagagttggagcaggagaggaacaggcaagtgccaactgtgaattatttgtttttgttggcattttttgattaaatttaatttgaattatcttaattgttccctaaattttgattattaaatttttaaataacagaattattgtatatgaatattgagtattggaatttcgtgatcattaggcatttcatttcttgccaattcaaaattaattaaattttttaattgtcaactaataataaaaattaaatggtaaaaaatgggcaaaataagtgccaacatttgtctcaatttttcagcaggaccaagagtgacaagaacagagggaacacgcaaactca

SEQ ID NO: 10228 - DNA, 1037 bp, Heterodera glycines
  misc_feature (24)..(25): n is a, c, g, or t
ctttagtcatgtatcgcctcaatnntcaattccttttggcataaattacacagattttgtctaaagaattaccaaattttagagatttttggctaattttttaagaaaaaataggtttttggggggccggcggtgccgaaaggccgcctggcgaattttgaaatttaagctcgatttctaacagatgtttacaaaaaaaaataaaatttttacgataaatttttgtttttttaatatattaaattatcatgatttactcaagcaaaattggaactcagatttgtaacatattttcttgaggcacatttttccaaaaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaatttttttaataagatttacgaatttttgggccctgcgatgccgataggcagcgccaggcgaattttaaaattaaaaaaataaataaaaaagaaaccgtcaacctgaatcgaactcacgacagaaagtaatgtcaaggttgattcactaaccactacaccacactacacatcgatgaccaataataaaattaactttaattcataaaaaatttgtcaaaatggttaaaaaaatcaaaattgtataaattttttgccttttatccatgaatatgtcattcttaggggtgtattttcacccccgcgcccccgcgggggtgaaggtcgcgggggcgggggtcagagtcgcgggggcggggacgggggtgaggccaaaaaacctgtcccgcccccggcgggggcgggggtgacgggggcggggtccgaaccctaatctattttttctttggtactgaagtgtccataaaaaaattaaaatgcccaattttcttaaaatccctctacaggaattagattattttcaattttttttttgtatactcgtgggtttcctataaagaaaatatgattcctcatagtttttttttt

SEQ ID NO: 10229 - DNA, 1908 bp, Heterodera glycines
aaagtcaattgttgcaatgttttcgggattttcctatagaatgaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaattaaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggggaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaattgaagaataaaactgacaacttattaactgaaaattataggtgaatcacaagaaaattcaacattcgggcttaaaatccggagaaaagtcaattggtgcaatgttttcgggatttacctatagaactatagcaaaactagcgggtgcgtgaaccgtcggctatttagctgggaaaaagcgcttcgcgctttgggagcttcgctacctagataagctatgggttgtgaaaagatttggaatttttaaaaaattatcagcgatttttaggccgcttcgcggcctcagacgggcgcttcgcacccgttttttaaattcggtgatttttaggctgcttcgcggcctcagacgggcgcttcgcgcccgtttctaatttttgttgtgcttttcggccgcttcgcggccgttttttaaattgtgttgagtcggacgggcgcttcgcgcccgttattaaattttgatggactcagacgggattagaagaggtagaactgtgattagaagaggtacaaacaatgatagaagaggtacaaacaatgattagaagaggtacaaacaatgattagaagaggtacaatggtgattagaagaggtacaaaagtgattagaagaggtacaacagagattagaagaggtacaaacaatgatagaagaggtacaaacaatgattagaagaggtaaaaacaatgattagaagaggtaaaaacaatgattagaagaggtaaaaacaatgattagaagaggtacaatggtgattagaagaggtacaatggtgattagaagaggtacaaaagtgattagaagaggtacaaaagtgatagaaaaggtgtaacagtgattagaagaggtacaacagagatta

SEQ ID NO: 10230 - DNA, 1869 bp, Heterodera glycines
acaaaaaatggcaaaatttaaaataaaaaattcgttaattttgaatttactccattttcatcgtttaaaatccatactgatcatataacaatatattcaaattagcctgctacccgaacccccggggaagaaattctcggggagcggagagtgccggggaaggcagatcgaggtcagcgctggacgtaactgattttcaattacggagatccgtaattaccgcgttttctcaattaaggaaatccgtaaaccgtcttacgggaatccaaacacgccgtaatttacgtaatacgtaatctgtaattttgaaattttcatttcttaaaaaacaaaaaaaaatccaaaagaaaaactggcaaaaagctaatatgatcagaataaaggccttgcaaaattttttgaggcgtaaaagtcccatgtggtcacttaagatcagctttttacttatttttaagaagggtttctcccctaatccgggggcagaaattttcgatggcgcataaaattatttatggccgaacagacctgaatcttttctccattccatttttaaaccatcaacacgttttcacattccctttttagatttaacactaaatataaaatgggcaataaattcattccatttgctgggagggcaacaaaattatggaataaactggagaaagaacgaattaaataaattaattaaatcgtttaaaataaaatcatttattaggataataaaacctgaaaacctagaaaatttcataggttatttggtattttttatgctgtagatctcagttggactttgactaatttaaattcattttgcccttatggatgacttgttttttaaatttttggaataaacgataaaaggtttcttgaatttcaaagtttaatattaaatttgttaaacaggagggaaatgatgtgaaaggggtggggttgtgaaattttgttttcgtttcaccattcattgtttgaaattagactttttatgccgtttgaatgatttttaatttttttttacctgggctataattgtcaaatttttttgaattcgggcgccctgctgtttttgaggtatgatttaatattgctatttaattttatttagtttttcgtctataaaattttctacgaaaatcaatgccacatgaatagacaagaaaatcattaaaagctaatattatttcctttcactctccgctcttcatttattcaagacaacattttatttattcaaataaagatgatttgcggatttccgccttttttagcaattttttttggttggcagttttagaaagaagccaaatgaatgctttatgaaataatataaattagcaattaaaatgcaaaattatcgtcattaattgtattttagttaatttattctttttgtaaaaattttttttaaatgccgagaaaattcaattcgctttcagttttattaataatgaaactgatttggctaacctttttaccttatttttgttttgcggctgttgaggtgcaatacaagtgcgaactttttggtgatgatacggcattgccaaaatcagaggtattttcagaaattcatacggtcccaaatttgacaaaaagtaattaaacatttttaatgatgcatttggtttttctacgccaaaattccctgtcttccattgaaatccatgctaaattaaagaaaacagtgaagaggaatttaattttactggttccagaatataaaaaaatagatagcgaaaacaaaccggaccagtatacgggtttttacagacccgtaacccatattttttcggtcgatacgcgtttttaaggacaatgggttttaagaattttttcgcccgtaagtcccgtgtccagcacccttaccaa

SEQ ID NO: 10231 - DNA, 2575 bp, Heterodera glycines
  misc_feature (5)..(5): n is a, c, g, or t
  misc_feature (16)..(16): n is a, c, g, or t
ttttntgagctaatantttgattctaaaatttaataatatggaagttgttttacttttgacattattgaatccaaatttgttaatggattttaaattaataaaccaagggtttcgatgttctggtttatggaaatagaccctattataattattgatagaacttactgatttatatttaaatgcccaaatttttgtggccggccggacattcattctcttaaattttagtgtaaaactaattttgataaatgataaaataactaaacaaattttatcaaaattctaaaaaaaaattcctggctgtgtaggtgaattagttaagaaattatcgccaagcttggcaatgttagcaaatttcaaaaaatttcaacagatgtacaatgcgattgcaaatgatttgtatgagcgcatggccaatgatccgttgagtgcctccgtttcgcttttgtacaccttttgtccggacaaaaacaagcgcggcacagcgctggacattcttggcaaatatgtgcagaatatcattgaccatccgaccgagcaaaaatttttgaaaattcgacatgggaaccgaaccttttcagtaaggagttgaaaaccttcaaaagcaaggcaaaaaaaattttgtcatgagtttattcttaggagccataagaaatttggagactattgtcaagaaattgtatttgatttttggtccattaaaacccaatacccgaaaagctaatttctcaagaaatgaaactagaataaagcagcgtgtaatatgcttaaaagcagtaaatccgtaaagaagaagctggctgggcagttaaaacgcggaaagcggagggttggtaatatccacaaaagaaagggcggatgcctcgatagctcaatggtagagcttgcctatagattgagtggtggcgtgggttcgattaccacccgaagccgaacattttgcacatccttatcatatatatgaattctgggcgcttcaaacacaagtgtgggatgatagggtataaaatctataaaaaagggcggatgtgccatgcagtagctcaaagagctgcctacacatttagtgaagacgtgggttcgattcctagccaatattatgccccatttattattttattttgataaatttccaaggagaaagtgttgccggtgaagggatcggttgagtttttgaaagcagtcggatttgaagaagaagtgttttgggccgcatccgatggccaccagccaagcagctccaccacagtgcccggcactgagaaggaagcgtactttgtaatgcctgagccgaaaaacgaagccgatgtgcaagggttacgcgaaagattggagaaagcattgcaggaactacggaatggcaaaccaattgagctccgcttgttccgagatccgagggtaaaattatcattaacaaatggaaggtggcaatcagacaggtgtccgtggagtttcggaaccaaattttgagggtgattagagcatccccaagattcttagtgatttctttcttttttttacagaatgatcccggatgttgagataaaaatgccaaaagagcacttttcttaagaatccaggagtgctatctatgcaaccgcaaaaaaaatggttccaaaattccacggacacctgctgttggccttctaaggctggtatgctcgctagaagaaagctgcattcactaatcagggtcggggtcgttttggcgccgacgttttggcgccagcgcgagttttttgattataactttttttattgttaaccaaatttaacattcttggtatcattcgaaagcttaacgtgtttagaagctatttctaagcaattgtttcgtgattagacaattatcaaaaaagttataacctgaaataacaaaaaaaccaaaattttggaagttttttcttaataacttttttacaagctaaaattttttttttttttgtaaggctaatagagcttgtgaagggctttcgaatgataccaagattgttagatttggccaacaatgaaaaaagttataatcaaaaaactcgcgttggcgccaaaacgtgggcgccaaaacgacccagtcccgaggaagtagggggacgggacaaaatatcgcagccggaatatcgccgcacgaattatcgccgcgacaaaatatcgccaccgaaattaaatttttttttcatacatagaaatttttaagaaaaaattcttagaaattttttttataatcggcggcaatattttgtcttggcgatatttcgggcggcgatattttgggctgtacccggaagtagtgcaccccgagacattcggggggtctcaagtgatcggagaagaattttgagattcttctatactcaaacaaattaccgcacatgtaacgtactcagatcgtgaaaagcaagtgcctcgttgaacaaattgatctccactctaaatacggtgcccagctccggcttgagcttcacccgtacaaaaatgctttcaccgctctgcaaaaggccatcattggcgttaatttgggtgtacaaaattctatcttttttatcgatataattctctggtaaagctgccgctttt

SEQ ID NO: 10232 - DNA, 3141 bp, Heterodera glycines
cacatttctaaactgattttatccaaaacttttttcataattctttcagtgaatatattaaagaacaattcaaattttacaaaaaatggaaatgccaatttgtgcttttcttcgcgcccggaaaaggaccatctcattatgcggatgcacatcacatattcaagctgaacgaaaatttaggtgagagtaagagtatataggtacacagagggacatgctgggattttttaagcaaaaaaagaccaattacaacaaatatactaaaaaatctaaggctactgaatgataaattgatgaaaaaacaactataaatagttcgcaacttttataatttaactattttttaatcatttgttttgaagaaatcagcgcaaaaatttacgaacaatgaaatttttaaacctaaaatttttatcaagaaaaacaaaatgttgctgataaatttttgaaaaatttttcttagcggtgtatttctgaaactttttcagttcattttcttaggggagtatttcctcgattttattgcattttttaatggaattttttggaaaaaacgtcaagaagcatcaaaaggtcaaaatgccaaaaaaggcatttataaggcattaaaataccgaaaaaagggaaaaaaagcacaataaaatcaaagttaaaactcatttttgcattttgtccaaaattattaacataaattcactaaaaacaaaaaatacacccctaagaattgatccaatggttctcaaataatgcaaccctaacaaataagaaatgaaaaaatttctccaaaattcatctccaaaatttcggactttttttcaccgtgtcattattttggcatttttcctcataattttcgttaacttttcgagatttttcgtaacaaaaaggctaaaattgtgtaaaatatttataaaagacatcgaaattagttccttttgactaattatgaattttaaaaatctattaatcattgttcttttttgtcaattttatcattttttcacctttttagacttttattttattttatatttatttatttttattacattttgttataattagggcttagatttatatgtaagaaaaatcgcaaaatatgtacataaatatgtattaaaaaatgccaaaatatgtaagaaatatgtacaaaaatcttcaaatatgtaccaaaatatgttaaaaaaaaatgccaaaatagcatcaaacaagtacaaaaataagtataaaaaatttttatcaacgattttagggcagtaaaaatggtcatttctttttatgcgtgttacaaatcagaaatttttcgagattttccggagtaaagctcatccgattgtctgccagaatatttttgtatgctgaaaaggaacgctccacttcacacgactgaatgggcgcatatttgaacattgcaataacgtccggcggcaaacgtgtttgaacatcttcccctcgaagcaccataccaatttcctagaaaaaattgagttttaaaaactgtttgtatatatacccaaccaaaattctatcaaatcccgggttgtttcgcaaaaccgtgttaaacttttctcgaaccaatttgcccacattgcccggtaccaattgcaattcatttccaacatcgctcactaagtccaaacctagaaaatttgcatagaaaatatcgagttttcacaaactttcaatgagtgtgagattgcgtgattctaatttttcaattgctccaggtaaaatgtcaaaatgtgattttataaaggccaaatctccacgaatgcctgaacagtcaaaggcaatttgtgattggcgaatagcatcagaatcggatgggttgaagtcccgaataatcgcaccaatttggttaagattttgacagtaataatccgctgcgttgagccaagtcccccaacgtgtgatgattgggcgcggtgggagagggagatcacaacgttcgcggaatttggccaagcgggatggcgcttttgaaaaagtctttttggtacttgcaatcaatttgtcaacatttggaaagaggccacgaatttcctcgcacacacgatggagcccatggcacaaacatgtgagatgaatgagatttggatagaaaattttgaggcccttaaaaaaattggtttacatagatagcactttttataaatttttcattgttaacctgtgctgccttaaccatgtaacgtgccgcgtcagtgacaagtaacaaaaggtcgtcagctgaaattagctccctcaaattgtcgttgataaagcgagcgattgtttcatggttggttttgtccagaaatttggccgcaaccaaatgcggtttgtgcaatttcccatccaaaatgccaatgatcaaatttgcgacatatctgccacgagaatcagtcgtctcatcaaccgatgcccaaattttttggtgtttgaatttatttttaatctcagtcattttctaaattttaccatctctttgaatggaaagggggataacctgctcataacatgcaggcaaataatttttatgcaaggcatcattatacggaaccactcgcttgcaatatttttccagaaaatctgtaagaaaatttccgctaggtattcccagaaaatactaacctctaaaaccctgattttccaatttaaaaaatggaatgttcgccgaggtgagagcggtacacaaatccattgagaattcatccagttttttcgtcgtttgagtggtcaaaaattgttgttttttgcttccacatggccgcataaaaagttcaacatttgctttgtgtttagcagtttcgttgtgttgtttcagttgataaaacattttagaagggacctgaaaatgcttttcgttgtttatgttgttgtagtcgtgttgtttgtagatgaaaagtgatgctttaacctgctgttgacatgcctgacaataaatggccttcccatcagttgtgtagatcgcttttccgtcgactctgctgatccagtcgttcaaccaagctgattttgattttattttgggcattttcagttacttttatgataattttttgaaaacctggaaatatgtacgaaaaagtgcgaaatatgtaagaaaatatgtacatatgtaatatgtagaaaaaccccgaaatatgtaaaaatatgtat

SEQ ID NO: 10233 - DNA, 1350 bp, Heterodera glycines
  misc_feature (136)..(136): n is a, c, g, or t
tttgtaaacagatcagtcaaggctggaatgcccttgataaaacattaatgtctagctccttaaacacctttaagaaaatattagaattgactctgatttctgaaagcaccaatgtataaaccaattattacttttngaggcatttttttgactttgaccaattttattttcatataattttttcattattgtttattttaacctgtgatctcactcgatattttatccacttactctgcgtctattttactgtgatcactgatcagtcatcagagaagtggtccccgcccttctgatggcaattttttctttatcgataaataaataaaaaaattattaaaaatgtgatttttttaacttcgcctaatttttcagactttttttttttgcattttttcgtgctttttggatttttttttctgactttttggcgattttttatgacttttttagtcgactttttgaagatttttagtgacttaaattcccagccctacttatgtggtttagaccacataaaattttttttaaaggcatttccaggggttttcggggtcgctaagcacgaatctgaactcagattaaaatttcgaaccctaaccacgaattcgaacatttttcgaattttctttgtcaaaaaataactttttttttcgccgtcgccttcagtgaaattccaatcaattttgttaaatttcgctttttccgattagtgattggttatttcttatttcattaccatattaatgatcagcacccttctcaaatcgctgccttaaaaattttttttttttatgtggtctaaaccacatacagtcatggtcatatgtttagcataatttatttttcgaaattaatttttcacttaagcggttagaaaggcacaaatcgggtaaagatcagaagcaattatgtagcatttttaatgggctttccaataataccaaacttgaagaaaagcatccgcacttacaggttgggtattagttgaaatgaatttacccccatttttaggtggtcatatgtttagaataaaattttattttttaaaaatctcaatattttgcagtccaaaaattctgaaaaaattcctgctaaggtaactttgagtgctgatcaaaaaagtcttttacagcaacttggtccgatcgctccttcctggtgatctgaacaccccaatatacagtgaaaaacggaaaatttttcgaaaaaaattcctagggggttgggaaatttttttttggaaattttaagtgggcccattagaaagagcgtaaaattctctaccgatttgctttttgaatgatgggtctacgacttaaacccgctgaggtatgggcacattaattt

SEQ ID NO: 10234 - DNA, 6957 bp, Heterodera glycines
  misc_feature (25)..(26): n is a, c, g, or t
aactccaaaaatattctgctgatgnntatattttctttttattttatatacctaattaattttctttgtttaccattttttattttaaattttttaaatagtagtatttgttttgaaattgtggctctgtttgtaatcgaacattttcttttggcgaaacgaatatcataaaaattataaaacaaaagttaaaaaatgcatgatttatgaaaagagtgctcatttttagcacaaaaatcacctattttaagcaatgtaaatgcaccaaattttccctaaataagctgaaatgcagaaaaagtcattatcggtcattctattttatataaaagagattaaaaacggaaagaatttgaaaatttaaatatttattgaatcttaaatacaaatatgcaaggggtattacttgaaattggagattgctataattttaatttactttagagtttaaaaattttataatttcacattttagataagctttttgcataagatagattgtttaattgagttttctattttggtacttttcatctataagttcaaaaatttcgctacaatctttccatccgagatttttttaacaaatttattttcttgttggcattcaaagcatccatcaattatttttattaaatactgttgtattcaccaccttacatgtaattgcattttaagaatgagtacacatagtttttgagttttttaatatacgggaaatattaaaaaaatgggatttacattaagaattattttgctgtaattaaaagtcatttaatttataattagtcagcatgttagccattttgacacctcgttgagaagttcacggggaaaatgccgccgctttttgtctgttgtactgcttgaatttgttgttaatttaatttttcggttacgcaattccatttataaaaataattaaaaaataaaataaatcatttgtattggtggctgaaataaatcacccgtctcaaaccgacgctacattgtgaccactggtcacagtgtggcattccacctctcatccatccatccctacactctctcgcttctatctttgaatgttctctcaccttcgtttctgattctctgaagatttaaaatataaaaattaattcatctgaagaaatgtattcttttagtctttttataattcttttactttggaaatataaaaggtatttgctttttatttttttgatttatgttgaaacagagttatgattaattctttgtatttttcgggttaaaacatagtcgtcataaatataatcttccgttacttacaattagctggcaaacatatatttccttcttgaaaatcaaacattaaatgttataatattaattataattattataattataatattatttaatgcaatttattacattttgcttaagaatgtctttatactgcttttcaattttagccaattgtgttgagagaactttaaagggaattaaaatgttaataaaatttgttaatccttactgtgtaatttcctttcttataatttctccgttgtagtttttacatttatagattgtgaaatgacattgtttagagctttccatttaaatttgatatttaaattgaaattttaaacataatttttaaggatatttatatttatcaaaaataattgaacatagctcataaataattaaattcattttcattccacttgaccaagttcataaattattacctccattttgaaaaacattatatattattcagaatttttttgaaataaacaataaaacaaaaaatcatagagaattttcattaatattttatctaattcaatataaaaaagttactttagaaatattaagtttaaatttaatgatgccatagaaataacatttattaatttatttagaacaatctttttgcaaatttgataattaattatgtttgctcttaatctattgtctttatgattattttgtactctacaaatatttaaattaaataaaagattataattttaaaaaatcaaatttccgataagtttaaataagaacatactcgtcaccattggcttcaaaatttaagccaaagtatgaaaaaaagaaaatagatttttttaagatttcaggattttcttttactcgtttgggcgtcatgatgtaataatttggcaggctacaatttacaattcaaatgaaacttttaaaatctaaagttaaaaatttactaattagataaactgaaaaataaaacaaaataaatatgtcgataaaaatgtttgcgttttactttgctttttgctcatttattgctccttttccatcccttcccatccctgttctcatccattctccacacattcctccctcccctccctttatccgtcagaaattgattttgtctgctggggtcaattgggggagggaagcattctgctgcaattgggcacaaatgccattattagggatcgtatttttagtggcaaaaaaatcccaaaataattaactaaatagtgacaaaaaaatgccaaaatagtggcaaaaatagtggcgaaaaagtccgaaatagtaacgaatagtgacataattttcagcaaaaaattaagcattttaactggtagcagtgcaaatgtggtacatttctattccaatattttcttagcgaatattgagctagaaaaaaaaatttggggaagaatttttgagaaaattttccaatgcttagggggtgtatttttgaaatttttagtttggttcttaggaatgtatttttcgcttttattgcattttttgggaaattttccaaaaaaccaaaatagtgccaaaaatagtggcgaaacgccagaatagttgcaaaaaactattttagtgttcaaataattttttttagttgcaaagctccaaaatagtgattcctagtgatgaatagtggcgttaaaacgaagaatttcctagctaaaaatgtgtttttcatgcatatctcgtcgaaacaaagccgcagaaaaaaagacgttccctagccattattaattaaaattgaataattttgaaaaacattttttgccttactaaaattacttatgaaaagaatagttaaacattagatcctaaaccaaatccaaattatctaattttatttaatttaacaagaaaaaaagacccgaacccttgggttttgcgggtaaaaaggaaaaaacggggtatgacgaggtgtgaaaaccaagggaccgtcgaccgcctaccctcctgaggaggctaaccccccccccccccccgaaacccaaaaaagtaaaatattttcagtattttttttgaaattttaagcaattttcttatactttgaaaagtaccaaaaaaataattaaaagagcatcacattagtgaacttgtcatcttaaataaaataatcaaatattttataaattaatttatataatttcattatagtaaaaataccaaatctttacaaatatttaaaaggaaataaaaccatttgttaattaagtgaaaaagtatttaagttttttcaattatcatttttgttgttaatacgttatacaagcttagcagatattcgctaaaaaataaacgaacgtattccagcacagctagacattaatcaatgctaaatagatttttaaatattagtacattagtttaaaattgatattaataagttcattatctcattatattaatgtattagcccatttaaatgctaaaaaattaagccagttgagaaatgtaaatgattttttcatgaaaattaattattattaaatttaaaaatacattcaataaaaaagactccacaaagtacacatctttccaaattaaaaataatgaatttacagaaattaatcattgggattgaaccaaaatgaaatttttcaaaaaagctaaaaagaggaaccttaaggttttaaaaattatttattaatttatataataattccggatttaaatgaactttacattaaaagctgatgagaaattataaattaaaatacttttataaattacagccgggacaatagttaaaacacataaaataaagtatatgagaacaaaaaacgttgattcaagttgaatttaatgataataagcttaaatgaatattgtatttaattattatggtcgacaacaataccgagtctaatgggtatgatttaacgagcgcacatgggataattaatgtttctatcgtaattaaaataattttaaaacattctggaaatttaaatgaaacatactcaaaagaataaccttaagtgttattttaaaattaaaaattaataaataactatctaatagaattttaatgtaattatttatacccaaaaaacttgaaataagaatttataatattttttaattcagcaaattttaattctttaattattttcataactattgaaaatcaatccatcagtggtgattaaaattaattttaacatttatatgtttattagtattctcttatatagagtaaagatatattaaataacaatcaaaatggaatattaccagactttctccagtatttcagcagataagaaaatgatgaaattatatgattaagtgaattaaaaattaatgatttcaaaaaataaaaaacatgttgacttttaaattttaaaagcactctcattttattatttaatatattattaatgaaaaattacattttaaatttcttctctcttaccgatattttattatcttattcttttctattaaaataagaagcaaaacaaaaatttaaaaaactaaaaattaaatgtttgtaaactatttcaaggacaataaaagcattaaatacattttataataaattatgatacttgtaaatatctacatcaccatcccataacaccgcctcattgttggccgcggcacatgaccgatctcttaaatacagagataaactaaataagtaattattaaatttatattaataaattattttatatatttttttaaggatgaagaaatttaaataaatttatggaatataaagattaaaaaaagtaattaaattaatttaaccaaatttaatattattgttataaaaaaataagcttcacaattaaattaaaaaattggttgttcttttcacttcaaaaatcacataaaatgagaaacaataatgaatttaataataaaatgaatttatgattaaaacatcatgaaagctaaattaaacaattgcttaaattgataaataatgaaaaattatttataaattaattattatttttacatagataattctgataaagaaaaatgtatagcttattaattatgacgatcattttgcaattttttccttttcataaagttaataaattatattatcatgaaattttctggcctcccaaaaattagaagagatacagctgtgattagaagaagtacaaccactgtcgaaaagctacaataatggttaaaaagggtacaatcatggttttaaaattaaataattaaggaaatcgtttattaaaaagtaagattaaatattgaatgaattccaattttcaaatcgtatatttttgatcatatttatagctatcaaaagataaaatataaaaatattataattattagtcatattttatttaactttaaatataataattattgttttctcgaaaacattttaattataatgcaagtgctgggttgcttttattaatcacttttttttaattccaatatactcatttttagataataacttttttcaattattccaacagtcaattcttaaatttaattaattgtattttttttttaaatttaaattacagcaaatgagttgatttattatttaaaaattaaatggaataaatttcattcgctcaattaaatcgagaacttacttattcgacatgcattgtttttgaccagaaattctcgacgccaagtcttgaaaaaatataatgcaatggaaagaattttaattttctttggactaccgtttgccaaataaaaaatataatcttttattaaacataaagaggatttgtttttatttcattttattatttaaattattaattttttcttcacggtcgaattaagatgctcaatctcttggcaaatatttatcaacggatatttattaaacttcaaaatttaattctttaattgtataatagaattaatggtttcatctgtggcattgttattttaggaaaaagaaattagtttaattacgagaaacttttttgatcttttaggttcaaattgatttaacctaaaattatttttggtttttgaatattatattaaagtaaattttggttttttttatttctcaatccgaatttatattgtaaaaatcttaagaatgtctttatgaatatttattaactagttttttaaataaaatttgttttactttttgatatttgtagatttttaaattaatataattatattaacagttattttaatagtgaataattactcaatgattgtttaattctttacacttttgtacactgatttctttacacaatttatatttattccactgcggacgtgatcagcgagaatgtttaaattttaatatcctactttaaatttatcaaaataaacctattaatatatactattatattttgaatttattattaattatttaataaattaatgtgtctagtttaattttatagaaattatttaaataaacttgtattatttattgttcaatttctgatcaatgttgattattttccaggtcgtgcagttcgtttcttacaccgaaatttcacggcacatagtcacttaaaaatattaaaagtagcaagaaaattcccaggattatgagaaaagttcgttaaaagatcatttcttttaatttattattatttttttctataaacaaattcaggccattttcatgtcaagcagatattttatgtacagataaaataaaagttaatatttatgtaataaatattttttaag

SEQ ID NO: 10235 - DNA, 3248 bp, Heterodera glycines
  misc_feature (3062)..(3062): n is a, c, g, or t
  misc_feature (3120)..(3120): n is a, c, g, or t
  misc_feature (3133)..(3133): n is a, c, g, or t
  misc_feature (3172)..(3172): n is a, c, g, or t
  misc_feature (3196)..(3196): n is a, c, g, or t
  misc_feature (3212)..(3212): n is a, c, g, or t
  misc_feature (3221)..(3221): n is a, c, g, or t
taaggttcgctggcgttaaacaattttgaaaggcacaagtccaattcgaccatcaaacaggacgaaattacttacagaaaccgagtgagtggaccaacgagattttttggttacgtaaatatttattttcttttcggatttttgtcaacgaaaaacgactcaaaattttgcgtatgtgcaattggcccaactgcgccgtgagggacgagtgcaaggcgcggtttgacgaaatcgcgactcaaaacggagtcttcggtatcactcgcgcggcgtgacggtgttcgggtaccgaactacgaaagtgtgtgcctgacgatggacgcatcggtggtcgggagaaggggcaacgattggcagtgaccacggatagagtttcaaaacatttatgttttttttcatttgttatattcccattaattaaaatttatattttgataaataaatgtttataaatgggcgaagacaacaacaatattgaaaggacagacagtgatgaagtgaggtttaatttctaagagatcatttggcaacgatgaggactaacgtattttacaacaattgcataaaaacagtgggtaacagagagggcagctacgctgtggaggcacagatttaacgatccagttcgaaaggcattgtgagtgataacaatggccacatgacaggaaaaagacggattcgtcgttgtaaattggataaaggcatatagagcatgtgatgactgaaccgctgtccctcatctgaaataaatttgtttaaaagcttaatctcaattactttaacaaaccgcaacacgcattttatcctcactcgcacaacgtccatggtgaacttctgatgatttgctggcaccagccgcgaagaccaaagcatccctgaacgaactttgcataattaagcgagagagggaaagaattggtcatttaaataaccagaaaagtgcattcacctgataccattgacgacgcccttctgttccagaagctgttgcaccgccatttcatacctctgaaaggcattgtgagtggtgcccaattagtcatccgttgccacccccctccgaattcgacctgtttgtatctgacggggtctcgggcgaatacgtacacggggtaattgcggttgttgctaactacagtgaattcatactgtcctcgctcgttcaaaggtccgctgaacagcacatgaacttaacagaaattaggccgtcaattaaataattggttaatcccgcgcaaatgatctcttactgttcacgtcttcctggtgggcggcggtcagagtgattggggtggaaatgttcaggtcggggaacaaagcagccaaaacaggcggcaaagagacggacggaggaaagggaaggccgaaggccgaagtggcgttgagagggtcggcggaagcggaagcattgacaaaggcgaaagagggcaaaacggagccggagatcagagctttcgatcgtacgtcaaaatatccctcccccgcgcgaatgtatcgaatttcgtcgtcattatgcaaatgctcctcaaagaatttgctgatgcattgtccgtaattggccaatctttcggggctaatcacaatttgatctcgataattgtaaccacgtgacagcgaaagcgaagacaaagcgacgcattcattggacaaaaagaccgaaaatgaggagaaattaagtaaattaggtaaaatgggggggggggggggagggaatacgtggaaatattcgacgcccgacacggccaaatcgtccagggaaacgaaaacggaaggacttcgatggcacggctcccgcgggtcatcgaccaaatcactcataagccaacagaggaccattctctaatgacaataaaactttattatcttctgaaatcaatagatttatgtttaacaatgcgataaataaaatgtgaatatgtataaaagggacaaaacaaaaattatatgctctaaatcagtaaaagtaaacgtgatggtaagatgaaatttttttttcaaaataatttttgtctgcttgtttctcaattctatccgtgccgataaacaaagcaaattttgtttcgagcattttgacctattttggtgcataatgtgaattttgtttaaaattttttattcgagtccgggttcggggttagaattgaaaattaacaagggctcaaaacgaaataaaaattataaaaagcacacaaagtcgaaatgaaatgactgcttcaactaaaacccccactatttattggcatgggcactataggccaactccactgtgcagagaaaagcctagtactatctcgtcgtttaatttttctttataattcctatcactttggcgaactatttctttattttttaatagaataaagtatttatttcgctcaatataactttttttctatcaatacaatttttacctaatttggcatatcgatggagaaaaaaatatgaacaaaatgtaagggtttttaaaaacaaaaaaagataatctaaaaagttatggagtaattaaaatttcgcatttctttttctctcctttgacgtactattttcatgtctctaacacatgtaaaaagatggaattcgtaaattcgaatagtttttgttataagggtacaaaatcacctcaacatttagaatcaatagaaaaattattagttttcgcattttagttaaaaacagcagtttatagacttaagttataacttgataaaatgaaagtatcacaacttttttctgagatgtcaaactgctgagcattcacttagaaaaagattctccttttcaaaaatttttttcagatatcaaatttgttcggtttggttgggaattaagcgagttatggctgatcaaattaaaaaatacaaaaaaggcatgtaaattaaaaattagcgcgcaaaaattcacgacaattacgctctttggcgttatgaacaattttgtctgacactgggcttgaccaaaacacattctttaaaacggtaacatgtgattcgcgaaaaaaagggggattcgtccagtgaggtgatttcgcagaaaaggggaattttcgtccagtgagtgattcncgtccagtgagtggatttttgtcagcgacccataaataattttttttttaaaaacaanttttagttaattnaagggctaatagtttattatcccgtattaactgggtaanttttaaatttgataaaattgatanaatcagttcagatctncataaattnaaaatactttatatataaatataacaa

SEQ ID NO: 10236 - DNA, 3511 bp, Heterodera glycines
atatttattttcaaatccagaataatcgaggggacagaacctggagttcggcgatgccgacattcgatatagaaaaatttttggatgatttttctactttcgggagagattcccccacccccgggtatgggtctgattttgaatttgttttacgcaaagtttcataaacttcatgttttttccttgcatattttttgttgatattttaataattaaataatattaaatgcctcatttcgatgtatatgaagcccttttcaatgccatttaaattcattgtaacgtttttgtctaaatattttttttgtggcgacgttatgtcccggcgacgttttggggtgtaccccggtcccttagtctatataaaaaaaagctcaaatgcaaaatttatgaaaaaaaattttcatcactagggttggaaattatatgcacatgcatatttttcctaactgtgtgaggcatgaaacgtacgaaaaacatatttttagcttgtttgaagcttctagaacgtatttccatatgcatcttagtgcatatttcgcgatttatgtgcatattttggcatttcgtgcatattttatatgcatatttgagcattttttccgcaaatcctctattaaaacggccccctctattaaagcggccctttaggttctaatgaccgaaaaactttcaaatatattttttgatttaaatttatgccaaaaataagtaataaaatagaaatgcaccctttttaccaattttcttcaaaataaataaattttattttgtattttgggttttaaaatgcttattcatacgatatttagctattttcgagatttttatgcttaaatttaacaaatttgtaaaattttgccctcaatttggaaaaatttatgtgcatattttgcatttttggtttttatgcgcatattttaagattttatatgcatataattcccaaccctattcataactttgctcaaaagtaactaaattaatttttgatttcattcggcagtgttaaatattctatattagcttttgaaatttgtaggataaaaatgaaagtttagtgctatcaaacgttaagaatatttattaatatgattatttttgagcaaatttataaccaatatcattaaattttttcatataacggaggacatagagctatcgtatgatatagaaaaatgcaaaagtaaaattattcttaagagggtgtttctttccattcattattcatcaatcagcagcttggaacaaagggaaatttatcaacataaaaaacgggcaaaggtgagggggcatttgcgatgaataaacaaaaattcccttaagggttgggttgttgattaatttattttgcttaatttatcaccatatatgtatgtatgaatagatagagcctcctatcgttgcggaatgaacgtgtgtaatgaattttaaaatgatgaatccccccccccccctccttttgcctttgccttttacgcctttccataatccttctccattcagcatcaccaatccctgtgcgtgctgtgcactgtgcgggggtgtgtttggttggcgaatgttcggtcgatcattttgtaatttcttttttccacgctgtcaatgcgtgcgtttcgttggcaatgactttccctaggctcattctgcacaaaattatattctttcggcaattccaaatctttttgctttaacaattgaatattaggccatcttttacgagtttctactttattttttcaaatgtgcctttctcgattgggacaaatcatttatgggggactcgctcttgtcacgattgttctcatttgtgtgtcgatgttcacagacggtgagtgaggagcattttctgtgatggtcagagaaagatttgtttgaatgcaatttaaaaaatggaaaaacattctttgtttgggttccgtttttgtcaaaattttttcttttattgaaccattctgagaatttatttcaccaggcatttctgaatttttgggggaatttggtgcattttataaattctttttacaattttttgctgcgtttttcaaaagtggaggcgcccggtggtgccggaaggcgcccccgggaaatttttggtttattgtgtttaaaaaataaacaaataaaattttactgtattatctatgtatctcgagatcaagttttactaaattcaaatataatgttaaacaaaatacaaaaataaattatttttttaaaatgtgctgctctagttcagtttatgcttccaagcatatatgaatagaatatgacgtggtttatcataaaatagcaaaaattccttgtgttaatttgaatataccattcgaagagaaaacttaagccaaaaacgatttcgaccaaaacattggtcccattttgacattatgtccatattgacattttcccaaaaagcctctattaaaacggcctccttcagctaaattggcctttttgctcctaaagataggaagattttccgaaaaaataattttttaaggaaatttctcgagaattttgttaggtaaattataaattttcttaaaagttggtaatgtgccaaaaataagcaaaatatctcaacaaaagctttcgaatgatgcctttatcaggcgacttttctaaaaatctccaatttaaatcaaggggacttttagccccgttctttcccgataatagtcaaatcccggtcacattcttatttgttgtccctaattactaaaatattcaaaggatggcgcaaactcaattcttcctcgaacgccaccggcactgtgatggattttgttgagaatccgacggtcaatatggggctgatgttctgcaaagggccgacgatgggcgtcaacggcagcgcatcggccgacggtgcgtcggtggcgcacaacgaaaaggaattggtggatgtgtgcaaggaatggttcctggtcagctccgttgaccaattgccagcacaatttgtcccttcaccacagaataaacccgactgggagaaattcgttgtcggtgcgatggtcgtctctttggttttggcctgcctcgcgttcatttggaatttggtcactttctgcgcctgcttttgccactcccacgtgatgaaaccgttgcccgggttggccggactcaccgccatgtgtttggcagtggcactcactgttttctacatgaaaaaccagcaatacatccgtaactcccgttgtttgaatttaggcataaaacaatgctttggttttagcgatgatgaaggacaaacagttcgacaacactgaagaatttcggaagttcatccaaaaactcgacaatgtaaaaaaacgcagttttaataggcttcccccattttgagaaaattttgcttcgagggggatttttgaatagctgatcacatgtgacatccattagagttgtcaaccacttcactttacgtcactgatctgctgatttaggatggaaaccatgtcggctattcctagaaaatgggctgtggcgcggccatcgtcgctttggcgaattc

SEQ ID NO: 10237 - DNA, 2498 bp, Heterodera glycines
  misc_feature (22)..(22): n is a, c, g, or t
tcaattcaataaattgaaaatntaaagactcgagcttgacttttctttccttattacctctattatcaggcccgagattaccatgtaaatcaagaggcacgatgaaagagtgccgcatttatcacagttaagtttttatttgtcattatatatagaaaaacttgcataattttcaatggatttttaacgctgtctttgtgtggtccactatttcatcctcatcttcatcctcagcgtaatcatcaaaaaattcatccatttggtggtggtggtgtctgtccgttcccagatgatacagagacgacccgtgcccagtcgggtaaacttttcctcctccaccgcttccgaaagtgccaattttcccaacggctgatgatgaagaaccatctccggtgaaatattgatggtattggctttgaactgcgaattggtcggcttttcctttacgctgcagggaattgcgttggttagccggttttatggtgacaatcaaattgtgtgcctgaaatttaataaattttatttactacacatgaacaaaaaaaagggggtggggtcagaaatttccctttatgaaaaatgaactccaaaaattttctgaatattttttgtgctcttcgcagtgacttttaattcgataatacaccttaaattgaaaaaatctttgactaaaaatttaatgaatatcgtcagaggtttctatggcatcatgttcaattggagactggactgggcccggtttttacagggcctgggaaccgttctttttaaaaaaaaatgccaacccagtccaggccggagacctagcctaaattcttcaatttcattttaaaatataaaaattgaatcaaaacagtgatgttatttatttatttttggtaaagtctgctaattgtatgaattatgactattagctccaaaagcgtatttaacacaatcgttttttgaatttctacagaataaaccagaataaaaaaatcaatggaccatgaaaacgtacattagcaaccatcatatcagcgacttggtccaacttttttccattcaccttcaaaagattgattttagtaaggatagcaaaagacccattgcctcaatcccattgacttcaaccacttcgtcgccaacactcagtaagcccgtcgattcggccagtcccccttcgacaagccttgagatgaaaattccttcgcatttaatcggcccttggtgagtcatcctcaatgacgtcccttttgaccaataaattttaatccttcaaaacaaacaacttaccatctcttatgaaaaagcccaacttccggtcgtctccgccatatttacaaagtttcactcgccggtggcttgccggcacaacgttaacatcgataattgaagaaacctgaagtggcattggaaaaggaataccatgcaaaaaagggacttgtctaaagtcttcggggttgcttatgttgtaattccttttgttgggtcgcgcattggcggaaatgagcatcgaaaggcctttccgccgcctatctgtggcatcagtgccatacccatatttttcctcccaggattcgccttttcgctgaattaatagctgtaaatagggtcttgctgattcaagagactttcgaaaattctaaaaaataaattaaaaaaaaatccaaataaagtaaacaacgtcatcatttgtgatgggcagcaaatcgccagtataactggtgtaacaaagtgtgaacggaatttggtgtagggaatgcactgtttcaatgaaggagcgaaattctgaaaaactcatgatacgttcgccattgacagggatggaaaaacgacggaactccgaatcgaacttggatttgatctaaagaaatttccaatgcaaaattccactggaatccaagatgaaggaaacttacatgcattaatgccataaatgatggaatgaagcagcaaactaaactgttgatatgtttttacaaggaatatttggtctaaagttttgcgtaatttcatcagaaaatgtctttttctgcggtgcacccagaaatcatggcctaacacagggctcgcattggaaaaattcgccttcaaagaacgtgtagagcatttcattaaattcaaggacatttaaaaagtttcatattcagcatgagcacttttttcggcgcgccttttccaaaatggggaacagtggggtccagcgatgcggccgagaaaattttttaaatttgaagcaatttattaacacagcgtccgggaaatgagctcctgtgccagaaaagatttgcatgtgtggctcagtggtttttgtaagatagtaaagggacaaagggtggtggttcgagtccgttgtgcaacatgaatattttcatttatttttgtccaaaatattaaaaaatcacgatatttgggaattatttttgaaggtttttgccaaccaaattggataatcttggtatctttcgaaagctaggaagaatgagaagctttttctaagcaaatgctaagcgatt

SEQ ID NO: 10238 - DNA, 1319 bp, Heterodera glycines
  misc_feature (1242)..(1242): n is a, c, g, or t
caaaaataaaaaagtaaacaacaaaaataatggaaaaccacttcacgctaattagtaaacaaaaataaagttcaaataattgtcgctgttttacttaaatgaaaaaattaaagcatgtatgtgaagcgaatgaaaatataatgattctcatctgaacgaagtaataattttaataataaataaaatatcaatttgctattttcttaattaaaagtaaattaaaatcgtttgattgagtttttttaaatatataaatatttattttgatatatttcttttaattaaagttaactattttatttttctctaagtatatattttcattttaatgatagtttttggtatttttattagatttctttattgtatagtcgtcataaatttttgtttgcatattttttattgaaaagcttattttaacttatactttactttattatttatggccctctccttaaaaacaatgcgaagttgatgcaattattatgtttaagttgtattctttaggaattgcatgtattcatatattattttatacttaattcacaattatttgcaattcaatactaccaaattacttattaatttgtttttgtttagcattttttttttattaaactatatcttaatcatttgaatttcttgttcacataaatctcgggtcctttcatgtaaatttttttacaagtgcgtttcttcgatagaagtgcttgttttaaagtattaatttgactttttaaattatgtaatgtttatttgtatagtgttatgaattattctataagtaaataaatattatactaaataaattctatttattaactgattctttataagcatgactagctaatatattggtcttattatttttattatttactgatttgtacaattttcagcgatgttaatactaaattattttaatgaactttcataaaatccaaataattattttttcttcttttctcgaaaattaagaaaaattatataaaaatttttaaaataaaaagataaatatgttttgtaatatttgttttggttaatgaaaaaatataataataaaagaacatgtaaaaataatatagaaaaattaaaacattttcttacaatatagtttatttaacaaaaacttaggcttgataacgttcgtttatccttttgggccaaaaacgaaaccaaaaatcagggctctgaaaaccggattaacgaaaatccggagattttcgttccaaccatgactanaccaatctttttaacccgtttaatcggaaaaatatatttgtttatttatgaattattttattttatctctaatatca

SEQ ID NO: 10239 - DNA, 1132 bp, Heterodera glycines
ccataaaaatgaccaaaataggtttagcatcacattttagtattttaaaaattaatttttgatatatcgatttttgaaaaaaaaatccattttttagggatacattttcaaaaaaactttttaattttcataaattttttttataaattatttaaaatcctcaaaatatgtaaaaaaaaatgaaaatatatacgaaaaattgcgaaatatgtacgaaaaagtctaaaatatgtataaaaatatgtacatatgtaatatgtagaaaccccgaaatatgtaaaaatatgaaaataaaattccaaacttttgttcgcaaacacaaaaaagaaagtgtttttcctactatttagcgcatgaagaagccaggaaaaaaaatatgtatttacataaaaatggaatccctagttattaatttttactttttaaatacattcaaaaaattttttttgaaaaattggtttacttttataatttctaaattttgaaattattaaattatttttatcattttctcaaaatcaaaactgctttatcgttttattaattatgatctttatttttatcttgtagtgtaagaatattctgtttttcgaaatcaaggtcaaaattaaaatttgttattagtaattaataatgttataaaatatttttgcatactttaataagtgaaagattgttaatttttgaaaatttaatgaatacctaaatatggcgatcagcgagtattattttgcgatttagattattgatgtttataaaattaatttttaaacattcattaaatatacgtttgtatttcaattaaataaaataacataacaatttttttttgagtttacggatatctaaacataaataaaataaacttttattcaataaataaataatatatgcgagcgataataaataaattattttgtatttttcaaattattttctactaagggcatttttttgtatatactttttaaaattgtattacatttttgattgccttagtgattcttaaagtgaagctttaatttttatttttactcaatgatccaatattgatgctttcaaaaaataaaattttcatatatttatttcagctttttgaaattattttgtaattaaataataaaatagtgaa

SEQ ID NO: 10240 - DNA, 3328 bp, Heterodera glycines
  misc_feature (42)..(42): n is a, c, g, or t
tagaaatggatgtcagattcgtgatcagagacctcgaaaacnccagaaaaggcgttttacacgattttttaaatttttgtttttgtttcgcaaaatggcggggggggggagacaaagcacattattagcgacgacaactcagttcaaaaaatttcacgtaacacacttaaaattcataagagctaaaaacgaacatcatattcgtgtccagcgcacaaaattacacaagaaaatattatttttcaaaaaatttcgggggatgacaaaaagcccgaacataaatttattgaataattaaataaattaaaataataattattttaaatccaaagtatggttatgtgcacatcttctgacatcagtgggaagggactcttctacacaatttcgtttaatcgatcagtgataatgcacattctattgatcatcatatacatcgcaattgttctggttttaaaattcaaaaacggtaaaaaaataataaatatattgtaacatattctaattatcacccatgagcaaagacgaacccttcacacatttccctttttggccaatcaatgttattcatcttttccacattccccccgttcaccattttattcactatttctcttttctctaactctcacaaatccccgcaaatccccgccccttttccgttcaattgtttcccccaccaatcagtcagtcgagtcggaggagatgagagtcggacgtcggagcgatcaaagacaaattaattatttattaatcattcatttattcgcgcatttaatccgacataataaaagagccatacgaacgattggaccctttggacttcttggggatcagggcccgattcctaagattaagacccttcagtcctgggacaatccgtctcctcccatcccgctctggcatggatcctcacgtcttactgaaacaacgaacagcaaaaactttattctcgaatttattgaattaacacccaatgaaattgctttttaagcacacctcacaccgtctgggtacaataaattatttaaaataaataaaaaataggataattttataaattatattataagatattttataaattttattaaatatcattttttaacccaaatattataatttcctataatataaatacattatcgtaaaggtattgtttcttttattttgataatttatttattttgaaataaacatacaaactaaaacgattataaaaccattaatcttttaataattcatctctcgaaattagaacacatgaggtaagagagtgctacaacggcaagcattactgaggttacataccgttaaataagtaatactctttcttgcattattttaatttttttatatttgaatttacttttttaaacataattttttataattatcttaaaatttttgttggtctttggatgcatgtttatttgatcttcaaaattaaaagtctcttttatcgagcccgtttcaagatatttattttataaatattagtttttaaacagtgtcttaagtagttagtccacggtacccgtcgccgtcgaagtgtgaaatttcacacctcaacagtggccgggttttcacacctcaacgatccccggttttcaccttttttaccgcaaaaatccaaaggtattggctgttttttcgcgcattattttgggggaggggaaggaggtcgacggtccctggttttcacaccaaacggacccgggttttttttttaccgcaaaaacccaagggtatgggttttttcggcaccgccgggccccctcccctcgctcatttcctaaaagttttttggaaaaatgcgccgtaaaaaattgttaaaaatcaattctgatcccaaatgcattgaaatttatgaattgcttatttcttctccaaaattgtaaattcgataatgggaggtgaaaattatattatttaatacaatataatcgaataaattgtaaaaaaataaatgatttgaagcaatttagcaaaataccctgatttttgaccttaaaatctgattttttgcacatgatagtctgatttttgaagattttcgatcacaccgctattttagatgacttgaaccctttcagtaattttgaaactaacccacccccacccccattcaaacccatcgcaaattttggtatataccgggattttaactaattttttatcaatttattgcgaatgggaaagtctacttattttctcacaatcaggaagatttaaccttgtaaataattaattttttgctagatgttcaattttctaattttacactatattattatttagttttgccttttaattttttttatgttttgataaatgaagagaatttataattttttatttaaaatttaacggaccaaaaaatgtgcaaaaaaagagatagaaaattttaaatttatcggacgaaattggagaaaatcttcggcaagaatttgagcaaaaaatgaaaaaatgtatgaaaatacgacagaaatgccatggaattagaaaaagttataagaaaattcaccaaatgttgaagaaaagaaaaatcgaaatgaagaatttggtgagaaatttggcactttcatttcgtcgccattttcataattttgttttgatatcagaaaatccgctctctgcagctcattatattttctaagtattttggtattttatagcgtcgggagttaatctaacaaatatattttaaaatatgaagatgactttcgattttgattaaattaatttaagaaatattccctatgctatagaaacggtcttcttcttcaattttggtcattttcaacttattttgccatttttcctttttttagatttttatttgttaggattgtttaaattttttcgaaattcatattttctttctgatcgataatctttttttaatttttctttttaaattatttatatctgtctgtttgttctgccacccataaatgtaagtaaaaaatatgctcacatattcgaactattcaattgaaaataataaatttattaccaacattattccagaaacactcttcacaaatcgtgattccttgaaactaaaaaaaaatttttttaaatttaaatttctaaaattgtataaataaattctaaaataataattttaaatgaaaaacgtaaaaaactcagcgtaaatatatgcaaaaaaaatatatataaattaattatttgttgattgattttaaattgtcgaaggttttaatataaatttaataaattatagctttaattaacaacagattttaataaaagaaaaataaaaatagtttaatcgataaagagaattattaaactatagcca

SEQ ID NO: 10241 - DNA, 4157 bp, Heterodera glycines
tcatttaatgctgtttaggcggtcaaggattgaaaaaatgtaagtctgaacctaattttggacataggcgcaaatgtccaaggcgcaaatgtgaggttaccctacagagcaacccttcttctctagcacatcgcgttatttttgccactcagaaacaattccgttcttttataggtggtacattctctatatattgtatttgcaatgtctgaggcgaaaaaagcagaattggatgctgataatgaaccgaccaacgagaagacggcgctaagtgaggaattgaatgatcaggaaatacttttaattagtgagttgttaatggagtgggagcgagtgcatagccctaaaaattccggggggagaatccgaaaacttttttgctctccggtccaaaaaattttccaagattcatgaaaacctttgggttcctagggatttattagagcactattgcatgtttttacatatattttttaaaaggtacacgtgaagctctgcattgtttctactgccaaaaatcggaagttgcaacaccaacagaagttttgataagaaaagatggcacaggaattgtaagttttcgtttttgtagattttaaaaccatggaaaataataatttgacattatctttttcgggatttatcctttgtttagggggtttatagggtctgcaaaaattaaaaatgaaccactaataattatgtaaattacaaaaatcattattttacgcagcatttggcaaaccgtgcataatttaagagaatcagccggcgatagtgactatttaaagttcaggcaagaaggcggttccataatccgttgatgctcggccgggacgaacatttattcgaaattgagtttgcgctgactgcgaccattggtgaaaaaatgatattcggccagaacttcgatgggtgcaaaagtgacattgaacaggcaacaagtgtaagaaaatatttaatgttgaaattgactgattttgggcattggtaaaaaattttcctttttcagaacctcaaattaattctggaagaagatggcttgaaaaattttggaagcatgatcgacacaaccgtaattttttttttgttgtaaacagccaaaaaaacaaaattatttggcatttaattcaaaaaatttgcagaaaaaggatcgccacatagaattaattcggttgttaattgctagggatgcgatttttaggtaagaaaaatcccagaataggtacttaaataggtaaaaaaaaatctcaaaatgggtaaataaaaattttttttccaattcttagggtgcatttttgaaaatttttttggtcgattcttatgggtatattttttgattttattgcatttttgttaagaattttttgaaaatcctaaaaataggtaacaaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctattaattgcacttgtttaaggtttacaccggtccaagcataaaggaaaattttgacaaaaaattccgagaagcaatggacgaatgcgtaaagcgagtcaaagagctgttggaagcggagggcaatttggtaacaaaaccaaacaaaaaatgaatggaatattaaaattttaggagattgtcgaggcgctcgctcggcgcatttccaaaagcaaaaattggacaatgtccgaagaggaaattaaaacgtttttcgagaatccgatggcggacaagaaacagactggccgttgaatgatttaacatttgccactgccggaaaagcaccaaaatatttatttacatttctatatatttttacaaacaaaatttctgataaagatttctttattttatcaacacccctctttaaaaaagcgtaatgtaaaaagaaaaataggaggagaagaaaatggctcgtcacacaatcacaattaaagttagagatgagaaacaaaatgcttaaaaaacaattacaattatttattgtttggtcattgtctgtttttgcctccgttattcgcctttggcatcggtcggtcaatttgttaattaattaattggtcatttgctgaagggaaaaatgaataaattcttttcattttttctagatttcctttttcacctttttccctcttttcggattctccgtcccatcgctgtgctcattttcttcgaccttaaatttaaaaaattatatcacaaaatccgattaaaatccccggggttttggatattttctcatccatttttgttttacttgggctcggaattggtgcgcaatgtcacgaattttgagcacaattcgattgtacgcctcggggccgcggtatttgaacacgttgaaaagacgcgccttgacgacgagcagccaaaattcatctgaaaatgaaaaaaatgagataaatttttggaatgaaaatcgggaaaaataagtatttaaaataaatgtttcgcttttcctaagctcccatcaaaaaactgctgataaaagcataggaaatggaaaatgaaataattttggacaaattttgttacggcgaaagcaaatttaaaaaggcaatcaccgagaactggcattgtccaacagaagaattacaaaaataaaattcgcaccaaaatcctcgggaaagttcggcacgcccattgctttttggcactcgaaaaactcgcgcagttttggcatagaaaagtcggcgcgcaaaaggtcgtccgcgctgggctcggcggcgtcgccctgccgtatcatttgctgctgctgctgctggctgagaatgagcgtggcggcggagccgatcaaatccaagccggcggacgaagcgttggagggcacgtcgaagccttgttggggattgactaaattaaccgaagaaaatggaaaaattgagggggcgtggggaattcgtatgaaaaggatggaaaggaatacatggcagcaattttttaaaggtgtggattggaaactcgggtaatagtggcatggtagcacactttttcgaaaaaaaacccaattcattttaggggttttctgggtcaggaatccaattctgactgaaaatcaccaattcttcaatttctcaggccctgaaaatccctaaaattagttcattacgggaaaaaaatttcggtaacaatttgtcagacgatattgcatttttcaaaattgctaaaccattcgaatcggtgactgacgtggcgcccgaagtgtcaccgtccgtttggctctgctgctgttgaagaaaagtgttttggtaggcggccatacgccaccaattctcggccatacaaacctaaaaaacagtcgaaacctccgaaatttgaattttttctggggctcccaaaaagcacaaaaatgccaaagacctcgcattgaacgcactcgcatggcgacgcgtcgtcttcctcgtcatcacccgccgcacctccgccgctcagttcgtcgtcctccgtctccgccttctcgccgcccgagtcgctgctagccgcgcccgaattggacgacgccaccgcggacgaatgcgattggctgcccatcggaatgatgtcggccgccgcacttttagtaggctgacaaaaacatacttacaaaggagaggcgaaagaatgcacaggatcactttctaatagggaaatattgacagaatattcagctaaaaacgggtttgatcatttttagcgcatttttaaaatggcgatgagtggggttgccgctcgctgagctcgccgaccgtgctgccgcgtctgtcgtctgacccgttgaaccccgagatcgaggcgttcggcaacaagctctcggtcttctcgtgtccatggtcggccggcgatgaagaacgctagtcgtagaggccaggagaggaggagtgcggtgagtcggtagccgagatttaacaccacccgggcagaggagcagaaacagacgacccacccgatcagacgactgatcaacgacccggtgatgaatagcaagaccagggagagccgggggtttacatgtccaattaccaagctgatcgacgcagagggagaaaccttatcaattc

SEQ ID NO: 10242 - DNA, 2105 bp, Heterodera glycines
cataaagcactcctgattttccacgtaacaaagctgttgccaatagaacacaatgcgtttgtgcaataaatccaaatactcggtaaatctggatgagcatattgaattaatcaaatatattcacattaaacctgataaatgcctcgcggtgccattttgaaagtgccatcacaaacaatcgtttccgttcgtttaaaaagcgccaactgacggggcgaagaaaagagtgccatcacgtccgtacactctagcaaaaaaagttcttggaagtgatcgctttcctcgtgtgcaattcttccacgataagtcagccacagaggcttgcttatttcttgctgaagttcctgtaatgtccggattttcatcgtcctctttgattgggcatagtacaacgcctattgagatttaaacgagcatattattaaaaattaaatggacttaaaatgagttcctaccttctttgttgccactgcattaccacaagcgctgtccctgatttccgctttttcctgagtaggtaaaagtttgtaattttcttccacgatgcattcaatgcgcactttcgccgatgcaatgttttctctggacccaagtgccagttctgcttgcactttccgtcgttcctaaaattcaagtcaaatcattctctacatattatttacacctcaactccaagaacttctgtttttcgaatcggttcgcaaaagtgagggtactttgcaccatcgctggcccatgatccattttcaagcacttttctggttggtaattttctgtcgcttggtgtccgaaacacaccccttttcggaccaatttcaccatttcccaacccaggagaagtcggacatcggaaccggaaccgagggcgacatggttggacgagttgagcgcgtacaaacgagaacaaaggaagagtggcgaaagtggagggaaaagaaagggaggaaggcatgaggaggaagttgcgaatggagagggctggcaaatctgacaacatttaattcgatcactcaattctgcccaaattctgcccaaattctcatttatttttattattaattctgctttaattttaaatgctttttcgatcatttaaattattaaattctatttttcattttctctcttgttatctccgacacatatctctcgcaaattgacggcggtctcatccgccatatttaagccattcatttttttcccatcgctctcttacattattcacttaaaattgtttttaatcgacaattccgcttttttgcaattctcatcacatttttgaaattaaatttcttcattggaatttcattgaaatttgtgttttgcaaccagcaaaccggaggttttctgagcaagttttccgccacacaaaactaaactgctcgatttcaaattttggcggaaaaccggttccagcctaaattacttcaattaattttgtctcatcaaaatttcataattgctttccccttttacaagtgaaaagtatctgacattggcaaattggaaattggacgcgcagaacaaattgcaaattggacgagccgaacaaattgcaaattggacgagccgaacaaattggaaattggacgcattggcaatttggacattggacgcatcgaattcggacattggacgcatcgaattggacattggacgcatcggacaattgacgcatcgaggaccaattgagtgcactgtcttggtgcacgtctcagcgcgccggccaaccccatctaccaagacgtgctccggacacttggaacatctttccggtccttgattttccggcaaccagcacatacaaagcgttgaccgtcatcttttttgactcctgcagatgtccatttgtagcaataattcggattttcggagcaatcagttgtcataactgttttagaaccaatacgcttgctatataatttcattatggcactaaatataattgtttacgtttttttataatcaagaaattatgaattagaaaattgcaggcaaaaaacgaatcgggataataaaaacgaatcgggataataaaaacgaattgggtgaaaaacgaatcgttaccaaagcgaatccgcagaagacgaattgggggtcgatca

SEQ ID NO: 10243 - DNA, 1687 bp, Heterodera glycines
  misc_feature (44)..(44): n is a, c, g, or t
aaatggtatcttccattttctaaattgtgtcatagccaacttcngattttcttacaaatttccgcataaatttttctcccattcttttggcgaatattttcctttttgtttgtattcatttgacatttcaataaatttttgaacaattttgattttttcttcatcagtttttgatttataacttttatttttttgaagaccaaattctttgatccatttataaatatatttccgatttgtccccatttttttcgctatttttccatcaattttattccattcttttgctgaatgttttcttcctttttgctttattttctcttttattttataaaattttccaattatttctctttttttgagttcatttcgtttttcttcttctttttcttgccatttttctccaaatatttcgccaaatgacttttgttgcaattttttcttttctgatccaattttgacaattaaaaataatataattaataaaagtagcggaaataatttcatttttgtcgtctcgaaatgattttattttatttttcttcaattaaatggcaattcattttttgaggcatttaaatgatattttttctgattaaaaaactgaataaatcattattttaccaattgctaaattaatgattaaataaaattttattgttattttaaaatttaattataaaatgtttattaattcacaagaaaatccgccgtaaaaaaacatgctttttattttattcaaaattttttatatattttttttctaaataatttgtagatagatttattatatggacagtcggaaatcataacaatgatggttcgttactaagaaaaaattatttacaatagaagcaaattcagcgtatccaattgagaaaaataaacggattttatgccagttattttgacaatggttcgataaaatgtaagaattaatcagtttttatgtcgtaaataattttcttgtttgaaaatttatccaatttttcttataatcatccatttaaatcctccaaaatctctcctccaagctgtttcttccattttgaaatggtcgttctatcaattttcataattttcgcgatttctttctcactcatttttggattttgtttttttatttgccaataaattttcattttttcaattttttcttcctccgttaatcttttattgcttatgccaaattgtttcttccaattcgtcattgttctatagccaactccaattttcttgccaatttcttcataattttggtcccattcttttcttgaatattttcttttttgcttaaattcatttgtcattttaatgaatttttgaataatttgacgtttttcttcatcgcatttaattttttgaagaccaaattctttgatccatttataaattttctgtctatttgcccccaattttttcgctatttttacttcaatttttctccattctatttctgagtattttcttcctttttcctttattttctcttttattttataatatttttcaattatttctcttttattcttctcatttcgttgttttccttctttttcttcccatttttctccaaatatttcatcaaatgatttttgcggtagttttttattttctattttaatttgattgatttcaatcagaaaaataaaattggaaggtataataggcggaatttcatcttctt

SEQ ID NO: 10244 - DNA, 4163 bp, Heterodera glycines
tttgtatgtaattaattcatttaatttccatcatttgtaattaattcaatttcattataattgccgtccctcttaaaacgcattccattcccagcaaagcgattcaaagctctaatgacaatgttttattgtgtaatttcaccacatcactgaatagagcacatcccaacaaatgattcattgttcatttttttacaaagaccgaatgaataaattaataaatattgaaaatgtacaaaatttgtataaataaaatagcatacataaattatgtaatacatacagcaaaagaatgaaccggctattacctactatagtttcggagaagcttatcaaagtaattaaatgccaaagtcgtccttcgtgaacttcacaagtgccatttcccgtccattttcttgcatttttcccaacaaatccatcacttcactcacaacggattggtgcactttgtcaattggtctggcggcgtcgattcgctatgatttagttgattacatcgcctattaattattcccatttgaccgcactcactcgccaaaaggaagcgttaaaaagtgtgcccatttgcgcgtacactttgctttggaactcgctccgttccatcacttccgaaccgaatccgccgcgggcactgacattggccacgtcctaagaaatgaaaactgtgcaagaaacaaaatgataaaggaggcagacccgtaaccaaaggggctctaatgcactttatgagtccaatcaattgacaatcccgggtttttatacaataactttgttcatgttcgaacaaaccctatctttttggtatcattcgaaagcacaaagtctgaataatgtaattatacgagaaaacaagagaattctagcattccaagaaagttacaaacgaaaataatcagcaattacttaattaatcaaatcttttttggtgattgcctgaacgctgcgattttatatattttagcttcgttagactgtgtgctttcgaatgataccaaaaagataggatttgttcgaacatgaacaaagttattgtataaaaacccggaattgtcaattgattggactcataaaggtcgattggactcataaagtgcattagagccgcaattttaaccaaattttaagtatgataatcgtccaaaaataaacgcactggtcttcgttgctcagctccaatgttgacacatatttccgacgtaaaaccgaggcgccaaccatcgccaatttgcgtccatagttgaacaaaacaccgacacacatcaatccggcaccgccggtgaacaacggatttgcggtgaacgcgtcgagaaggcttccttttggggcatttgcgagtgaagcgcccgcttctgctgacggagcggacgaagaagaagggaaaatcgatgaaaaactattcatttgagcaaagtgctaaaggactaattaaaagaaaaggagcatattcatattctcaattcaaaaatagcctaattgaatgaaatagaaatgcttaaattatttaatttttttgtttaaaattaaaaaattgataattaatttggcttggctttgcaatttcattaattcgggattatctatacatttagggcagtatatgtatctattgttttgagatgaatactgaaaacaatgaaaatcacaccaaagagacttatttctcgcacaaagagcgaatgttcccggaattggatggaacggacaaacgacttatacccactgaacagtttttaatggcgtgccagggaattgcggaattcgtcggtcatttgcggcctcatttttattgaccgtttatttaaataggttttctcggcatggcttttgtgccggtgaaaaatgacattgccggaaatgtgcacaaagtaaggacaaaatttgagacggaccggaaaagtatggaagtgctccaagacttggtggacattgacttgatggaaaacggtggaaaaattggcaccgccacggaaggtcttttgtggctgaagcggtgcgttttattagtaatagaccaacaaaataatgtgattttaccaattacaaaactttccctaaaaaaatttttttttttgagaaattgtggatgatttttatccgaaaacaaatgtgcatccttttacagggggcttgaatttatgttggaattgctgaaggcgttggtccgtgactacaaaaaggcgcgaacggatgtcggcgcagcaaccaaaacggagaatttggcggacattcttaacgaggcttatgaaaagacgcttaaacggcatcacaattttatctccaagcaactttttaaagtgtgttatgcgaatgaaagtgtgtggggggataagatatgcctttttaatttgtcttaattaaaaatcaaaatgtttgtaggttgttctatatgccgctccccgccggcgcactttgttgttggctgttgcatacggccacgaaggacttgaagaaatttgtgttgaacacatcgctgagctgctcacgaacttcgaggctaatgtcagtgcactggtcgattattaccattcaaaaaagttggaaatacctcccccaaaatgaattatcttataaaatattcaaccacccattcctttccaactctgtttttgtaaataacagtattttatttacgataaagaaaacagtgttcccaagtgtaatgagttttgcatattacgggggaagggtgccaagtcccctatgacaaaaaaatcagggaaggaaagggggtaccaagtcccctttacgacaaaaacgggggtgccaagtcccctttaaaacgggggtgcaaagtcccctttaaaaagggggtaccaagtcccctttacgacaaaaacgggggtgcaaagtcccctatgacaaaattagggaaggaaagggggtaccaagtcccctttacgacaaaaacgggggtgccaagtcccctttaaaaagggggtaccaagtcccctttacgacaaaaacgggggtgccaagtcccctttaaaaagggggtaccaagtcccctttacgacaaaaacgggggtgccaagtcccctttaaaacgggggtgcaaagtcccctttaaaaagggggtaccaagtcccctttatgacaaaaacgggggtgcaaagtcccctatgacaaaattagggaaggaaagggggtaccaagtcccctttacgacaaaaaatggagggggggggggcaaagaaacaattaaacaagggaacactgagcaaaaaaaaaacaattatgattttaaaacttaatcatcctgctccatcgaattgatctcggccagcacagtcacttcccacttgtcaatgctctcttttggaaccacctgaaagaaacaaacacttttatataataactaaaatgcgaaattcgttcaaaaactttaaaaaaatcagttgaacggtacttttatggtatgaaaactctaacaaatacgcggaactgttttccctgtgtttattgtgattcatgcaccaattcgattaaataatttaaatcgaagaattattcttatttgatgatataaacttattcagcttgtaaattgattgcttgttcgtaatgtattttcggaacacttaccgtaaaaagaccgtcgctgtcctcgcccacccacgccatctccacacgttgccccgccgcgccctcgtcccgaaccgccaacaatgcatgcattgccttctttgccaactcctccttgctgagtttttctcgaccttgcatcttctcaatctcagttttcgcagcctgtgcatttttgctgaaaaaatcactattattttaaatatctattcttaaaacaaaattcaataattgaaaataacacgagaatcgagtggtgctgttttgaaagtgaaatttggcattaaagcgttagagaagaactgtctttgtcgaaattaacaaattcattgtaaaggttccgttccaaaatatgacattctcatgcgcaaggactagccgtttttaaataatctgtgatatgaaaacaaccaaaacaaaaaagattacccaattacccacgagtggtatttgagacactgtccggaaggctcaacgcaataaattgacgacccgacctaaacaaaaacggaataaaaaatataaaatgaaaggtaaacctttcgatcccattggacaaaaaacattgacactccgta

SEQ ID NO: 10245 - DNA, 1248 bp, Heterodera glycines
ctaaaaagtaagcatcaggcagaaaactttcgaaacaaataggtgtaatacatatgcatatgtaacataagtatcaaaagaaattttatcaaaccaaaaaacactgaaaacagtgaaaatatgcttactaattttgaaaataagtttgactacataatgccaaaaaccaataaaaaaatttttttttattcataaattaaagaattcctagaaataaacagctcttgtattgttacgggatgtaaatattagtaaagtttgtcaataagttcttgtttattgtgcgtccatggccccacgaaaaccgtttgcatccgttttggtcggataaaggatatccaccagaaagggctcatcgtccgccgcgtatttggtcagcggaatgtcaaatggagggaaaagagctgaaaaattgtgtatgaaaaagtgaaacacaaaatgccactccatcaaggggagaataaatgctttaaaacaaaaaatattctaagtgaaatagtacatgacagtgattgccccagcaaaaagggagtgccacgaccaccaaaatttcctggggcaatcattgtgatgtgttttttcgcatggattccgtgatatttcgttgttttctacgcccctgggttcgtaaaaatagggatgggtcaacaaattggaattaataaaataaagaaatcaaataattttgcattgaaaatttaaaaaaagagttgggttttcaatcgtggaaatggccgacaaaaaatggcacagattttctttaaaaaatggcaaatgccacaatttgagccctattctcttccgccccgattttccgtcacccattcaaaaactcccgggaaaaagttttcgtttccaatacaaaccgccgccgggggattgtcggcgaagatggtcctttgcacatatcagaacgccaagttcaaaggagcggatgaatagttgggtgccgcccttctccaacttgccccaggcagagtgggacaaattggcactggtcagcagcagccattggcactcgccagcggcgtccaacgcgacgtaacttttcacgtggggcgaagcggcggacataaaacgggcgaggggaaatcaacacaaatagagtaaatactgacaggattatgtacggaattggtcatgaaaaatactcattgtcagataagaattcaaagagaaaaataaataaaaataacgaaaggcccgaaataaaagccccccaaaaaccgaaaatgaaaaataagtcat

SEQ ID NO: 10246 - DNA, 5387 bp, Heterodera glycines
taaaaaactggctttttaaaaaattacatcgctaaatttggaactttttcgccactgttttgccatttttttgtcatcatttagttaattattttggcattttttgccactaaaaatccgggccctagtcatgaaaagagggaattgatgattatgttttgtatctttttgtttaggtaagtgtcatggattgaatttagtcagtttattttaaaagattacttcttttttttttgtttatttctttaattggattaatttaaattgtaaaatttacatttacttttttttgttgttgtataattagggctgggaacttaagtcaaatttttaattagtttttttttgtcttttttctcctttttgggatttttatgtttttttctcacttttaaggcaaaatttgaaatgcattaaagaaaatgccgaaaaataaatcgttcgatcagtgaaagggcaattgaaatccgatagaaattttcagtaattgttaaattaaaaatgccaacgattcgatgagatttccgttcccttaatgatagagaaaaaagtgtccttattcgaaaagtttaatatttcatatacaattgaaatataagcaaattaacttttttgattaagttacgtgttttgctggctaaaatgggttaataaaatttttttttgcctattttgagattttttgtgcctaaaaacgaagccctgctgataatatacaatttaatagataattgtccattccggcaccaacctttttaataatctttttcaaacaaacattttcaatataaatcaaaatcaaaataacaaataaaaatcaatatagaattaaaaaatgtattcaatatgaattgaaaaggcggataaggtgttttcatcaattttaaagaacatcagagcatgtttcttctgcagatttggctaaaatcagaattcatttaaatgaaatttatggaaaaatattttgtgagaataaaaaccaaatttattttagtggtattctcatttggacatctaaaatcctcatttgaaatgctcaaataattataaataatttatcctaattactaattactacactctcccgctttgaatgctgctgtttccccgtttccgctaacaaataagcaacacacaaaatgtcggtgctgtcgggccgcatttgaaaatgcttgtaccttccttttttcttagctcttttgcttcgcgattagacaatttctaaaaaagttatacatgaaaattgcgaaaaggtcgaaatttttaagttttttcttaataacaaattcaggcttgaaaatcttttcgctttttctaagtctaatagagcatgtgaagagctttcgaatgataccaagaatgttgaatttggatgaaaaagaaaaaagctatatttcggaaaagcatgctggggcgggtcggggtcactttggcgcagccactttggaatttttttttaaattttgaacaaacccttgtcaaaatcaaatttaatattccgatttgagtccagggttcgggattgagcaaatccgagtccatattcgtgatcactgatcagcaccctcgaaaacgcattggatagtatttttgaatcaaaatataaaagttaaatagggatcatattctatataattgctcaccactgcattagcatgctactatgaaagaaatggcatcatagttatgcacaataaaaggcaaattaaaaattttttgagatatttaaacattggcgccaaaaaagccaatttataacgtgtgccaaaatggccgcgccaaagtaggcggttccctgctggggccgaaccgtgggggccgaactgagcgagtccgaatcaattacatattattataataaacaataattgtgtcattaactaattgacaaactcacgcatcgtgcgtgagtcacgcagcattggtgaagcacaacacctaattaaatttggttaaaaaattgatgaatacggctaaattaaataaagtgattttttcctgaatttacacagacatggtcttctgctgtttgttgtccaattctttgcccttttgttcaccaaattggcattggcatgaaatgttctttagaggatgtgaactgcacaatctcaactggaaatttataaataataatcaaaaaatttaaagaaatttttcttatatttagagcacgactaaaaaggcacaaaaaatcgcgaaaaatgcattataataggcactaaaaaatttaaaaaagcattaaaaggcacgaaaaaggcaaaaaaaaaggcgtttaaattgattaaagttctatcgaaaaaccatttttgaaaatgtttttttcttagataaatattgacgatttaaaaatgattttttttaatttggatccttttgtataatgttttttcccaaactttgaaaaatgcattggtgttcggcacggcacacatgcgaactctgctcccgttcagccgttttctcgatcacatgggctagaaatgcagagggattagccaccacagtaatggtaatcagtggtgccagcattaaagccccagcacttcaatgatttaaattagagaacggcatggacctggatatagggcctggatttttcatgaacctggattttcctgggtttttaattaagaaaatccaggcccagttctaacacagaatccatgtgcattcctttttcaaaatatcgatctctatttaaaatacaacggagcatttacggcatttttttgttcttttatttcagtcaaaatttcgtgtttttcgcgaaaaaaataaaatagtctcgttgctgatcacaaatcaatctttcctgtatattttgcatgccgcactttaatgtaaaagtgaaatttaaattgattgaattttggggacgggggttcgaattagcaaaatgaatgtcagattcatagccaagtgacataaatttgtccaaaaaatttaaccaaaaaattctttgacaacattaattaatctttccgtatcaaaaactaaaaaagtgccaaacttacattgtcgataaagtcggtgacggccgagaaaagttgcccccggcgagccaatttgcaggacaatcacgaaaaagatgagagccaattgtcgagacatggttttgtgtgtattgtttgcttttttgacggttttgctaaaaaaaataatttttttttgttatcaaattggacggacaaaaaatgtacgattagtgaaagaaatttattaatgagcaaaatgaatgatcaaaaacaaaacgaatggacggacagatgaaaacggttcccagtgataaaataatttcgtttttgaattacatatttgtctcaattaattaataaaataattaaacaaatattattttaatttaataaaaacgatacggccaccgttaaagcggtaatgggttctggcattgtgccaaatgggcatgcgtaattctcaaatggcccatattagagtgcgtgataaattcttcatccaattttgccacgtattcttttacctgaagaggaaaaagctgtcatctgttttttaagctctcaaaaggctctttaaattgagcaaaaattcaaagatttctcacgtttttgtgcaaaattggcaaattcattctcggcacaaaaatacaatgctgggattgttgttgccgccaatgaaggaaaaagcaaccgaagatggcgaaccttaataattaatttttatttttaaaataaattaaaatttaaaaaatgtacacttaaaagaaaaattaattttttaattatttgactatacgaattataaaaaaataaaataattatgaatgaatggacaaaatgaatggatgggatggttaaagcaaaaatgaaaatgattcccaatgaatttatgtttaatgttttccgctgattcatttagcacaaatgctttacagaaatatttttcccataaaaatgataattaattataaattcataaattacagcgtaaacaaatattggtataaaaataatttgttaaattttcgttaattaattaaaaaataatttcacacaaaattgacttattaacctccaaaaaagtgtcattaatagggggtcggaatcgtcggcaattaatcattctcgagtttcagcatataattattttaattcttcacgttcaagagtcttgagcatttttagaataatcctgccacgattgattaattaactttattaatttggtttttaaggattattcaaataaaatttttgaataaatgagaagactttccggacaactcaattcataaattttctatggcacgagaatagcctctgggggaaactttttaagttttcggtatttttcttatgaatttttcgaaattgtggatagaaatgctaaaaagccgaaattcgttttgaagtggcaaaccaaaaatagattaaatttaggtgttaaaattgactttaatttaaaagtgagcggaaatttagttttttttcgtctttctctcgtgaaatgcaaccgcagaaaaataattatcaaaacaaaccattattgatcatacataaatattaattaattatccattttacaccaacctttttattacttttcaaaacaaaaaaaacattttcaatataaatcaaaaataaaaaaacaaacaaataaataaataataaatatcaatatgataaagaaaaagtatatatcaatatgagatttaataggcggataaagaagtagtgttcatcaattttaaagaacattcaatttgtttgtttctttggagatttgagctaaaatgagaatttaatttaaatatatttaatgaaaaagtattgtgcattataagccaaatcctaatcatttgtgagattaaaaacccaatttgttttggtaaaatcctcaaatacaatattgttaataaatagggatgccaattttatgtaaataaatatttttacctgccttctccatgctctaaatgatttttatactattttgaggatttttttaaaagtccaaaatttcggcaaatttttcattttttatacatattatgagaattttaaaaattttttagaagtttttggaatccaagggtgctggtgcatttcctaaaaaccgccacccatgcgcgtttcctaaatccgccaatgggtttaaaaacaaaaaacgggtaacacatataaattcataacttggctcaaatttatccaaattaatatttagtggtgccattcaatagctttaattgttctctatcagaatatgagtattcgaaattttttacttaagtataaaaaaagttattgttataaaatttaaaaaagtattagatccgaattttttgctcagaacttttttgaaacttaatgaaatgttctgacatttaaggtaaatagagaattcttagg

SEQ ID NO: 10247 - DNA, 693 bp, Heterodera glycines
caatcactgggactctattctcctgcgttccaatcactgggactcaatccaccagcattccagtcattgggactctgttctcctgcactgcattccaatcactgggactcaatccttcacttttcacggattcttcggcatcgcaatcaccgaggactcagttctccgacattgcaatcactgggactcaattctccagcatttcaatcacccggactccgtttttatgcattctaatcactgggactcaattctcctgcatttcaatcactgggactcaaccctcaagcatttcaatcactgggactcaacacaccagcatttcaatcaccgggactcaaccctccaggacttcaatcactgggactctattctcctgcgttccaatcactgggactcaatccaccagcattccagtcattgggactctgttctcctgcactgcattccaatcaccggactcaattctcctgcattccaatcactggggctcaatccttcacttttcacggattcttcggcatcgcaatcaccgaggactcagttctccgacattccaatcactgggactcaattctccagcatttcaatcacccggactccgtttttatgaattctaatcactgggaatcaattcccctgcattttatctttgggactcaaccctcaagaatttcaattcctgggattcaa

SEQ ID NO: 10248 - DNA, 3211 bp, Heterodera glycines
ggctcaattctacggaatgcaaatcactgggactcaaatctccggcatttcaatcattgggactcaacccaccagcattacaatcacttgtactcaaactcagcaatccatcgacttctaccgcattacatcactgggactcaattctacgacattccaatcattgagactaaaacctaggcatttaaatcattggactcaaatctccggcatttcaatcaccgggactcaaatctccggcatttcaatcactgggactcagaccaccagcattccaatcactgggactcaaatctccagcatttcaatcactggactcaactctccagcatttcatctccgggactcaatctcaccatacgaatgtaaaattgaaaaaatgcaaatgacaaattttttactgatttaaacagaaatcaaaatgaaaacgaatgtacaaactgaccttataccgttatttgtaaatccattttgtaaaattaactcctctgccaatgagaacagtaaataagcgataagtccaaccaataaaaacaacgaatgatccattcaaaatcttttttcaaactcttttcaaatttcaaaacgaattctcgaaccaaaactaagatcaaattctcgagtcaaaattaagaacgcattgagtttgccatattcaaaaacaaaagaatactcacaacaaaattaattcataattaatcaaatcaagttaatccacaacaaaggaattcatttacaaaacaatttcttttttttttacaaaagaataagactattcatttccaaatgcatatttactaaacaaaaactttttctattaaacaaatacaataataaacttctatttctttttcatcattattataaacatacaaaacttcttttcattaataaataaaaagagaaatttattttaactgtgctttttgcaaaaactgacgaaaacaaaaatgaaaaaaagcaaaaccaaacatttcattttcaaattcatttttaacgcaaaactcaaacaaaacgccacactaattcaaacaccggacacacacaacagacactcaactttattatataagactaaaatattaaataattgatttttctcatttttctttaaaaattttgaaaataagtgatttcgattaatgttgattattgcttaaatggatgaatttttaaaattttttttggttatcttatatttaaaaaaacgcccttattttactataattttttgcacttgaaaacaaataataaagttaattatttagtaaaaaaaaattgctcgttcgtcgtccattcttcgtgaaaatgctccaaataagcaccacatctgaccacgtctagtggaaaatgccagtgataacattgccggcggagttggctttgtatatggccgattgggaccactgctgccaaaaatgccatcgcttcgacacccataactagggctgctaattttatgtaaatacatatttttttcctggattctccatagcctaattagtaggaaaaacactttcttttttgtgtttgcgaacaaaaatcgggacttttatttacatatttttacatatttcggagtttttatacatattacatatgtacatatttttatacatattttggactttttcgcattttttgtacatattttgcaatttttgaagattttttaaggaaaatttttagattccccaaaaaaattgcaatttttcgtacacattttcattttttttcatattttgagaattcataaaattttttgtgaaaaaaaaaaattttgaaaatgcatccctaaaaatcgattttttttttcaaaaaatgagatatcaaaaattaatatttaatgtactaaaatgtgattctaagcctattttggtcatttttgtggcattttgtgcctgtttcactttttacgaagaatttttacccaaaaaattaccatttaaaaaattttatcgatcagtttaatcggaacccattcaggcaaaaatgttgtcgatgatgaagagctaaatttaaaagcaaataaaacattcattgtattatattatatattcacactttttaaaaagaaaaaatacaattttttaaagccatggccaaaactttggcaaatttggttaaaataattttaaatttttaaaaacatggaaaaactgacactgaataaagtccgaattgtacaaaatggtcgcatcgtccggcatcaaataagcaatccaccaagaaaaggttgaagtctgtgccgtgatcagcagtgaatcgcatgccaacacagcaaaagcaaaatcatttgcccttggcattgattttggcaaaaaaacattggcaaaaagcgaaaaataaataaaaatttatttaatttaataagcaaatatttaaatcattctttgcctggccgttgaatgataaatccgtcaaaaattgcttttcttctcccagcaaaacaacagaaacgaaaatgttgccaaatttcttcttgaatttaattgcataattaaaacagtgaatgaatgctcattaacgaacaaacccttaaatattcaaatccaaattcaattcctttctccgtaaaatcctttttcgattcccaaccgaaattgacaaagtctcccattcgaatgtgcacgcaaaatttgtgcgaatgatcatctctgaaaagaagaaaaacagaatattaaactagtaaattcaatatatttttattttattaattttacgttttttaaaatgtattaaaagtgtaattaatgaccgtacgtaataaaatattgttcattttaaaaataattaattattatttttttataccaacccaaataattcatttttgaatgccgtaactcttttacaaatgccttttccaaactgaaaaatttgacgaatttcggtcctccgactttcaaagtatttgtacgattggagacaagattcgccctgaacaattcatttttatcatgtttaatacagtaacaaaggcttacatccatttccaaatatttctgtttgattcttgaaatcgcaaatcttaaaaaaacaaaattcggaaattacttttaaaaaatggctaacgcattttgtaattttgaaaataaaattgtaaaaaataatttttacgtgttttgcttcctaaaaagcattaataaaattttttttgcctattttagtgcctattcgaggatttttgtgcctatttagcgattttttt

SEQ ID NO: 10249 - DNA, 914 bp, Heterodera glycines
atcaaaattttatggtcgtgttttttggaagcgggatttttacggggctcccgccactcttttttcaaatatattttttacgcaaaaattttttttggcgttttgtctgtgcgcacttttggtcaaattgatgatatatgctgacacaatttcaaaaaaaaaaatcttccataaaggaatggtcccggccgtgccaggtgtttgttttcgacagtgattggttgcgacagtatgtcgaagactaacagctccagtccggcggtgccggtcgcggtaattgtttggatgttatatacccaccattttgggaggaaaaaatcaacatttaaaagtcttaaagacatgttttcctgtagtttcggattctctgatcagcgagcactattctgacacccatattgatcaattttcgaaccatggaccagatttataaacaaaaagtcggaagttcaatttgtaaattcgtttaatattacgcgatgatctgctgctgatttatatatttgtccactttactattaacttttgatttgatgcaaaattcgcataaaatgaccggaccgccgttgagccgtaaacggcgtggggcggtgcccacgcgcatcgaacaattggagcgcatgttggacatgacaaaatttatcgaccaattgaaacgcctgatcgactagccgattaagtgcctgattttggtcttccagtggtttccaacgatgtattcgggaaaatttttaaagtaaattttgttttataagctccatttacaccagcaggagagcacaggccgagcggactcgccttcacgaccttacaattgaacacgaaatgaagaaaagaatcaatgaatggacaatttggaagaattttatcagccaaaacgaaacacaacctccactttttcaacaaaaaaaaaa

SEQ ID NO: 10250 - DNA, 1765 bp, Heterodera glycines
ggaggaaaaaggggatattctcatcgtcagttcaattggtgggtaaattgtcctggtgcgctgaagggcgtcgaaggattccatattagtaggatagcataaaattttgtgtacgtattttgtgagttgcagttcggcttgttgttcccatgtaagcaagaaagtggcgagaaaaaaatccaaaaacttggtgataatgcacagaaaatgactgctgaagaagtggaacaagtgtgcatttttttgtttgccaaaatgcactgtgacacaaaaaagcattagtaaacgagaaaaggtccgagtcggtggttattcttatgtaagggatcaaccgctacagtgacgaaattattaatcgtcaatacaaatggtcaaaaaaatatttttaaaataataaaattatgaattaattaatttttaggtgtttttgtttgtttttatatatgacttgttttgatggaattaagtcaaaatatgccataattttaaagatcagaacgtaagactcactcaaatatcttttagaaagtgagcaactcaaaaatcgttgtctctgtgcaaacaaaaatacctttccatccctctgctaattgccgtttttcttgtaataatatttggcaacagcgctgacgcctgatggtaaatattcatttgattacagtatgtgaaaacctgctcaatctttgcgacattccatggttacgcggatttacccacaatgaaaattagtagtcaaaagttcacgcaaacattttttttattggagtcttttttaaatgtttttgcattcagattaacactgagtattggtgaatcaagttttgtattttcgtgtaagattttgagtataaatattcattgtggtgcaaagttggagagcagtaaaagggacaagcgtttggatttgtgataataaccaattatttttccctaattatttgtttaaataccttatacataattacataaaacatatttacaatattggtgccttatattttagtaatgggtgacgtcaaagaatatattaaattgttcaacacaattgctgagccgtccggagacttcggagacgccatgcacaaaattggacgaatttcagaaaaagcggccggcctaattggactttctgccccggtggccaatttgttggcatcgattgcgcacactgaagtaaatttattcatttttctctttaattttcagcttttttctgagcttttcaagcactcatatgtacaaatttaaactttttatcttttgtcaacttaaatttgatttgcaaaatttttgatgaattacgtttagttaaatttttccttaattaaaatgaaatgtgttaaatatttttggtctattaaagatctttaatccatttcctggttgaaaatgatagtcctcagtccggctttcctggttcatgagaaactggtcctggtattaatggtagcttattaatattcaaaatatgccttttagccgcacgaagaagttttgttggcattgtccgaatttcgtcgagacattttcaaacgcctggactatctggaaatgaaaaatttccacttgatgcgcgacttcaaactttctcagtacttgacgcaatatacgtttgtaagtgggtggaatggtaacattaatcaaagtcattgggatatttttaagcaaatcgaaatgcctttggcaaatgcgattgcgacgttcaaaaaaatgttaaaaacaggtgtgcggaagaattcaacaacggtccaagactttatcagcc

SEQ ID NO: 10251 - DNA, 5380 bp, Heterodera glycines
  misc_feature (5354)..(5354): n is a, c, g, or t
gagattctaaaggatcgggaagaaattgaggagttgttctcggcgatcacgaacaatttacaagcatggtcgcagaaaaaaatggtaatttacattgcactaaagctactataattaagaaaaggagaaatgttaagttgtgcaaataaaaatgatagataagataggatttcgcttttctgtgattagatttgtttttccgtttttaaacatattttctgtcattttttagtttttgttcggttttttccgttaaaaaccgagtaaaaatcgcaaaaaatcctgcaaataacggaagataaattgtgaggttttataaaaaattgctttttcaggaaatgttttggccaatcgttgcaaagctctacgtaaatgaaacattgaagaaacaacaaatgcccattcaaatttcaaatttcaacagcactgcccaaattatcaagcaagcgcttgaccaacgtggctcgtacaggtaaatcgaattaattcatgatcgaaaagagaaccaaaaattaaattggataaaattttataggtttagtaagattattgtgaaatagatttttttgctttgcgttgtatgaaaaaacctggaaaagagataataaatataataaattgacataggtacattaggagttgctaattatttctaagattttttaatgcttttaaacaaatatttctgtgtcgatatagaagattcttgctttgtaaatggatgattttaaaatttattaacaattaacaagctatgtcgattagaattttgcttcggtaaaataagtaaaggtgcttacttataggggtaaatttccatttattgtttgcctctatattcggaaaatgataaaaaataaatttttacttttaattaaattaaaatccagttttataacatttccatcgcctaatcttcataataaaaaatttttatacaaatttagcttcttcaacaacattctgattggagaaaattggagtggtgatgaatggatattcacagattttgatggttctagaggatttaccattattaatgaatatggcatcaatgtttatgtctttcgttgcaaaagcgattatgtgcgcctgctaaaagcaaaacagtggcttttagaccatcggaaacagatagtttccgtcattgagtgggtctaattttttttaaaaaagtaataaacattgaaaaaatgaagcctgcaaatggtttagggtggctgagtctcaacaaatttgtaacaataatatttttgaactttattttacttattttcagtatttttaaaattgaacagctgagaataatataatgaattcttttttgtgttgaaatgatatttcgcccttttctcaaaatatttgtttaggaaaaatgaaaggtttttaaaaatttattaacgattaaaaatttttgaaattttccaggcggatagtatttatttcaaaaaattctccctgtaaaatttcatcattctgaaaaaaagaattaaaaatttgatttgaaattttcgcaaataaaaagtccttacccagttcctaaattttttttctctgggttttacactgtgcaatcgagaaaaacattttaagaaattcagatacttttacaacgaacgacgcaccaatctcggcattctgtacgactacattttggaaaaattccctgaaattggcggaccgaatttttaccaatcaatcgtgttccttcacaataagaaatacctggccgcctcctgtaccatcaattttggaatttccggcgaatattttcacaccctcgaaacatttgattgttggacaagcttttatcaggaccctggtcttttttcactggccgccgcatatcgcctgtttttctttttgtgaactgtgtgtaattggtagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagaaaattccttaacaaaaatgcaataaaatcaaaaaatacacccctaagaattggaaaatttttcccaaaaatttatttgttttttatgtaacaaaatttttaatttaaaatgtcaatgttttctaagagcatattaaaaatatttaaattattcgtttacaaagaaatagaaccaaaattttccccttttgtttgcttttttccactaaaaatcgttaataaaaaattttatttacctattttggtacctattttggaatttttgtacctatttaatacctattttgagatttttttttacctatttaagtacctattctgggatttttcttacctaaaaatcgcatccctattcatctggtttggtcccgctgattttctttttaaatattctttgtgcagctcatgatggtggtgttgcaaatgcataagtaattgcgtggttggtgattggggcgggtgagccttcttataatcacaagacttgcagaaggcaacgcgagcagacagtttgaaaaaatcccaatttagtgacatattataataaaacctaacaaaaaaaagtaaaaattaaaaaagtcctaaaattcattcattatttcgaaatttgtccggtattcaattttaataattttagtgtgtatttaaatttgtgactgaattattaacaaaaacataattataagtaaatatgtgaatcttttactttctctcggtttgaaaattatttttctctcattgtcacaccacatccattcttaccagtgcttaaaatttcgtgtttcgtgctaaaatacaaaacacgaacacgaaacgtcctaaaaacaggaaaatacgaaaaatacgaacacgaaacacgaaacgatcaacatccctgttgcatatgccatccatcctctcattccctttgtgtttttgccgtcatacccctcatcctatccaaagtccgtccgcattgtgccagtatataatttcactcaatttccccctcgggggctgcgagatgtctgcggtgggtcagtctgtgctgttccttgcctttagcaattctttcctaaataaccaattgcactgacccacccaaaatgctctgaggtttttgttgttgacccaaactattcccggttttgaatacgtaaatattttgttaatgcttttccttcaataactaatttgaatggcttaaagccttaaacccggggacacaacaattccttttttcaatttttttggtgctattttattatatgtagtgcctttttcgcgatttttggtttgttccttttttgcgagctctagtgattaatagggctgccaaaaatatgtacaaaaagtggtccaaatatgtacataaatatttaagaaaaatcccaaaatatgtacaaaaaaccccacatatgtaaataaaattttttttaatggtattttttgggaaagaaattccctgtaaagtatgaaatagccacaaaatgacataaaaattactttttttggtattttttggcaacattttcaaacttattttttctttataaatcttcaaaatatgtacaaaaatatttgccgaaattttggattttttttgaggatttccaaaaatttccgtaaaaaatactcaaaatatgtaaaaaaaatgaaaatatatatatgaaaaaaatccaaaatatgtacaaatatgtaagaaaatcccgaaatatgtaaatatgtagaaaaatcccgaaatatgtaaaaatatgtaaataaaagtcccggtttttgttcgcaaacacaaaaaagaaagtgtttttcctgctatttagagcaaggagaagccaggaaaaaaatatgtatttacataaaattggcagccctagtgattaaaaaccaatatttttttgaatagtttggtgtttttcgaaattgtttggcatttttcataaacaaaaattatcccagtaattagtctttgacacccacgaaattgttgtgcaaaacattcattttcattcattcattcgtccacctcacatttcttttattgatttctttttctcacaaatggagaaataataacggataaccactttgttactccaaattgcataaaaaaggattttataaaattattttatttaataggagtaaaaaacccataattagcgcgcgtaaataaatcgaaaattacacatttctgaccataatttatttattggtcgctaaaataccataaattttgattattaattttgttgttttgactttacacttatgccaataagataggcattattgataaagattggcaaaccatacatttggtctttcgttaacagtcaattggactcataaaattaatggactcatttaattaatccaggaaaacaaataaaaaagaatgacgtcatcaccggctgagcaattaagagaggcaacagacgccgcatttgactcggtggccaaagctgtggaggccaaatatcaccagcgtgaggagcagaaggtcaagcagtaccaggaagaacgggaggaatgggagcgaaggatggcggagacgagacgcaaatttgagacggaacgccacaattttgagcaaaaaatgcgcatgaaaagggaacaacagacggaggaattggcacaaatggaacaacaaatggacgaacagagacacaaacattgccgagagcgagaacaacaacagcaacgataattaaataataaattgatgccaaatttgatacttacaaaacaaatacaactaattaaataatggctaattggttgatgggaataatttttacaatattattcatctattttaataaaataaataaaactatttttttgcagtacagcacgagaaaaatttaatgttttaccaattttttcatgtgtttttcattgcaaaatttaaaaaataaataatggtttaaggaaacatttgtgaaagataaactaaattaaacgcacagaagcgaccttaattaatgatttttgattatcaaatggagacaatggagctgacaaaggaaggtcctagggtgtccgtgggatttcagaatgaaatttggtcagtggatagagcacctatgggttcttaagaaaagtgattttattttttgcggaatgagcccgagtgccgagttatgccgtgccaaagtttttgtgaataaataaaataaatatttatttgcatttcatcatagtgtcaagtggtgtagtggtagtgcgccagtcgccgttttttaaacaccaggttcggttcccctgcgtgtatgttctttttttgtttttgctttttatcaagtaaattatcaaaanagttgtttataatacaagactttatt

SEQ ID NO: 10252 - DNA, 1442 bp, Heterodera glycines
aaaataaggcaaaaaatgtaaaagtgttttataattttgacaattttaattaatttttcaatttatttaaaataatttttagcttttaatatttaatgtatttaaatatttcttttttttccaataaaaattttaattaaatttaaaaatttcaaaatgcttgataaaatttctatttgctgctttaaccataaataaaatttacaatgtttaaaacatatacggtatatgttgaacacaaaaataaaatgtacaaaaatgtgtcacaataaaaaattgtgaattttaacataaatttttaaaaaattaatcagaatgaaatgcttgagtatgtccataactaatcataaactaatgaagataaaatttgttcttttccccatgataaattttttgcataaaattgttagttcattttaaatttgaaacagcgcgccaaacatttatatttggcattctgtttcacttttttttggcttcatttgcgcggcaaatggttcaattgaggtgattgtccaatatttccacatttgcagccatcttttgcacagaatgggtgagcaaatccgcacaaatcagcagtcagacgacaatttggataaaaactgaaaggattaataaaaaaataagggcaaacaaaattgcgattttatttttctaattttattccaaaatcaaattaaagactaatgtgcagagcgaaaattttaggataattagtcctcagaaaaaatattttaaaaaattaataaaatttaaaaagctggaaattcagaatcattttgttaggcccctttttattcttttgttagttatcttaattaataattttatttatttatttattttcaaattccaattcacaatccgtaaaaattgcaggacgaattcgtcctcacataagtcaaaaaaaaattggtgagcttctgacaatttttagaagatttataatttacgaggaaaaaaaattaataaaatttaaaaagttggaaaattcaaaaaaaaaaaaacttgcgccccttttcatcaatttttcgttatcttaatttttaatttttattgttttaatttcaagaaaaattcagtttttttttaatttaaaataagaaataatttgttttttttctgcataaatataataattctcactagcatggcgcctttggatgccaaagggtacaaccagactcatctttacgatgatttggcttatcccaattcgggcattggcttgccggctttatgaatttcaggtgaattccattgacaaattgtcttaaaaataaaaattcaaaaaaaaaaattgaaaaattattttgaaaattcaccgttttcgaattgatttggaacggccacgaaatgtgtgtgggggggaaaggtgaattttttgcttgttctcgtgacaattcataaaagccgtcatcatgacttttcatcgatct

SEQ ID NO: 10253 - DNA, 1316 bp, Heterodera glycines
tatttttgaaaaaaatttctcaattcatagggatatattttctgaaaatttttcgggtcatttcttaggggtgtattttcccgattttattgcatttttaatggattttttcaaaaaaaacgccaaaaagggcacaaaacggcaaaatgccaaaaaaggcatttaaggcacgaaaatcccgaaaaaggcaaaaaaaaggcataataaaagtcaacgtagaagcctcaaacgaagtgaaaaatgtgttatgtatgcttaatatatcgaaactaattcgcagaaaaaaaggcatatgcctcaaaagtcgagctctagtaataatatttaaaataaattattttaagattttatttcaattctttcaccttatattcagtcctgaatcggctgacccatcggtgggcaacgtttttttgaccgccgttgcatagccgctgaatgagtacgatgagtttgtggttggcgttgagttggccgtttgcggttttcgtccaacaattcggtcttcgtagctcaattttttattctcatgcacatcgaaactccagcgcaattcgtgctgaaatttcagacgacgttccgccaacgatttgatgctcggcattttttgaacgggctcatcacatcttaaaaataaaatattaaatattttccagggcaattgccaattgttcttatttttacgagctttgtccttgagaatctgaatcttatgaaatggaccaaatcttaaaaaagaaatttcaaatattccaaaaccctaaaattggatgattttataacggaatctatgaaaaacttggtaaaaatttcaaagaaaactttttttggtaggtaatattgagattttaacgcccttttgtcatcattttcaaaggaaatatattacaatcaaataattaatgaaaattttaaaataatttttattataatttgcaatggtaaaacacattgataagtcaaacaggtcaatgatgctttgcccgttgaaactgttggccatttttaactgtgaaaaaaaaatgataaaaattaatttaaaaaaatgaattatttcgaaaattattttcttaccaatgtatcggtggacttatgtactgtgctgtccgtacgcataatccgttggctaattggaaagcttttgctcaaatttgtctcttctttatttctaagaatatcaaacgaaaatggatcgctaaaaaaaataaatttaattaattttcaacagtttaaattttaattacctttcaaatgggtcccaactgtacaaatgtgaggccagcttagtttggtcatcttcatctaatttaaaattt

SEQ ID NO: 10254 - DNA, 2242 bp, Heterodera glycines
  misc_feature (2199)..(2199): n is a, c, g, or t
aaaataaaaaataaaataaataaacaaacgcatcatataaagataaagcagagctgtcaaatttttttaaatcgaacaaacaccgtcaaaatggaaattttcaaatattataagtaaaatttacttattttgtttatgaatttttttgttctgcaccctttttccagcaaaattctgcgaatgagagggaaatggtgccgatgtacgggaatttcgcctactggacatttcgcctactcgacatttcgcctactcgacattttgcctgctgaactaaaaatcgaaagtttcgcctactaacacaaaataagaagtttcttactaagccaaaatcggacgttctcctactagcctaaaaccggaggtttcgcctaatggtcatttcgtctacttaaccaaaattggatttctacttatatcctaaaatggatattttgacaacggaaaatgcgtaaattcaaacactacaaagtaaaatattaaaaatctataaaattaatttccataagcatatgagtttcttcatcactctcttcatttccacagacaggtgtgaagcgccattcaaagtcggcctcgtagaggaccaaaacaaaaaaaaatttaaaaaaaatgtaaaaaaaaacattcatcctcgaatccattaaaaaaactaattaagctgtccagtaggcaaaatgtcggttggcaaaacgtccaattttacttgagtaggcgaaaattccgattttggtcatgtaatcggccgtgccgagggaaaactgtcaaatatgttatcattaatttaaatttaagagcaatgaagttggatatcaaaagcctttaagaatttaaataaatttcttccacatttattaattttctaaatcttattcatgaaattaaaaattaattagtgctgttttgattgagaatatacaaatttttccaataaaaattattcatcaactattttattccttctaattgtttttcataatttgtaaatttacttaaattttgtcaaataaataatcctttctgaatttggccaatttcttttcatgatcatataaattaccatttttattcgagaacttaaatttaaatttgagaaaaacaaagatatatttttgttataatgaaactaaattaataattcgatttaaattagtcaatataatcgaaaaaaataaaaatttggcctacttcttctcgtgatacatttatttatcattttattctcgaatttttccggttcttaacaaatattgaactataatgaatcattattttattgctttcgttcccctttaattcttttcgtttttggtgatgatttattcaatcaatttttccaacttttctcgcgcaacgcacaaaaatttctccatgaaataattcgtcccgtaaatctccaatttattttagtgaaaatagttttcacgctgaatctgccaaaaatgactaatcattttcaatttttttgtaattttaatttttatgcatttaaaatgcattaattgttatttgttttcttttaaattgatgctctaaaaaataaaaaaactatttaaaatttaaaaaatttgattaaatgatatatttttgttaaaatattattttttataaattaatagcaagaaaatgtctaatttattcgtaaattttacataaaataatattttttttaaaacaacattaacacgattttaattagagtttcaaaaatttccgtttaatctatgtttgtttgtaaaactactttttttatattgggaatttgtaatttcagttaaataatgtggcattattgcttaaatagtgcatatcttttatttttgatcaccttaaatacaatatccggttcggttttgactcggcaaaggcgacaaaatgccaaaataactgcttacaatgaacagtatgccaaaacaatggcggcactgtcggccggggcttatgccctatcgccaaatgaatgcatccggcggtaaatatgaaaatttcaactaattaagaattgttatgcatgtttcataaaaataagaaaaattttctctgaatttatttttttaaatttaattaaattgtgatttgagacaattccgaattgaaatgaatatttgaagaaatttgttattattttctttataataatcaaaattcacactttttatttaaaaaataaatataaatttttgaaaaagatcctctgtnttatttttgctttgctttctttcataatagtgatttatgcata

SEQ ID NO: 10255 - DNA, 758 bp, Heterodera glycines
tttaagaatgtgattagagaatgttcgttaatgaacaatattaattgagttgttaaattatatttttttttgtttttaaagacttttccggtgacttttactgggcattcattaggaggagcattagcagccatcgcagcagccaaatgtgtcgcacttggacttcgaatgtacgaatctaatggagtaaaaaaaattttaccaaaagaacagagatgccagttgtcctgatttcgggaattcatttttatctaattaacaaagctcacttaaattttcaaaaattccctggcaccatctgacattagatcccttaaatttgggtaaattcttatgaaaatttctgaaattggaaattcaggactaaaaaaacgtagctgtgaggataaaaattgataatttaattttaaaatataccgtatgcctcctaagggaatttgcatcaaaaattttggaattaaatttttatttcaggagcaatcaggtgacattgtacacatttggtgagcctcgtgttggtaatgccgcctttgcttcaagatttgatcaacttgtgccgaataggtgagtgggcattcagcaaaaacatttaaaattgactaaaatatttttaaaaaatgtttaaaaattaataatgcaaataaaagttcagttttcgtgtgatttttcgcaaggacattgtgccacatttgccgccctgttcaacaacggcaaagcgtaacaccggagacattggcggtattatggacgaagagaat

SEQ ID NO: 10256 - DNA, 2600 bp, Heterodera glycines
  misc_feature (354)..(354): n is a, c, g, or t
actcacgttctcgctcccactctcgctcgcgcagtcgtacgcgctctcgttcccgcagtagctcgtcccgctccgcttcatagaccgcgcgctgacgaaagtcccggatatgcgaacagacgcacggtcgggcgggcggacagactacctgtcgtatgaacgaccaaacggccggatggaatgaggaggaatgacgggatggatttgattggatgcgtcagatgttggaacggaaaaaggagtcggataatggaggaggaggaggaggcggaatgcacggacctttgtgtgggttcggtttttgttcttttttggcacctttttccattctctcccccccccccccccctcccntcccccgcctctcctctttttgttgtgtgtttgtgtgctgctgcttctggtgggcgtgtcgcgttgtttccactacctactcatttctctcgctttttctttttttattatttgtttttccgtcgtcgtttccatcatcgataaatattcatttaaaaattttcaattttttcagccctcgggggcgatgtgtgtgaggagacagacaattttgggagtggagttggtggagaggactgaactgacagacaaggagtgctcaaatcaggattcacacacacgggacgggggacaaaaattcaaactcgaggagcacactcactcactcattcgggattctcgaggaatgggacgggactaggagcaactagcgaaccatcctctttcaccgatcacgccaatcagtggatgatcgggacgggatcggacacaatcacactcagacgggacaggaatggaacggacggcaaataaggacaaattattgccttttgaatgtgtgaggcatttcaaaatgttggcccatttttagcccaactcgggccattggaggatggtggagtggactcgatgaggggacacacacaatttgtggatgggacgggggatcaattaggagccacagaacgaattgaaggacactgaggaacaaaaccgaattgaattggacatgtgcacactttggagttgcatcaagaaacggactgtgactcccttttttggaatagaacgggggcagggcacataaatttttaggtcggttcgaagtggactgcatttcgttttaaaatggcatggaatttggtggcgcttcattcgtcagggagttgaacgcgtacaaatttttggctattttatcggctagtgaaataaaaaatatatatatttaatttgataatttaaggatgatcagtcaacttttatcctttaatttatatcaataaatatgaaaattttggatggatttcatgttgaataagaatttgtcgccatctgttgctgctctgatcaaaattagtcacaatttgggcctttgttagaaaacaattaaatcacttcaatgtacaacatgagcataatgtacttttgtaaattgagaaaaacaaaatgtgcaaaaaatacaataaaaagatatgaaaatacaaataattaaataattcaaatgcctgacatttaaatgcgatttccactacttgtacataggtattgtacaagcgttttgtcccgttaattggcagtgtgtgtgaaatttcaaatttgggcttagcaatcattaattaattacactcgcactaattgagcatcatatttttgctgtgtctgggcattctttccgcttcactgagattgttgttgctgttgtgattgttgatgcgatgctgttttgtgtccgtttcattgatgatgagcgagcccacagttggggctgatcacttccccacattgagaagacgacaaccttaaatgatagaccaaattattaataattatttaaaaaaattaatgcacattttaaaacaaagttggttttctgagtattgaaaaatgggtcagtggaatgttattttgagaaataaatatcactaatgaacaatttttctcttggaggcttttgtcgatccaaataaaaattgaaaaattatgacaggagtttaaaatgggaatccattggaatttatgccaaaaaccaagcctcggggttggcaaaatttgaagagatgccgaaaagccgtaaaaatcttaaacttattggtacattttgaatttctcgtcaaatttaaattttaccggcagtgcagcaacaactgctgacacataaaagaccactgcccactcatccttggtgccattctgcacaatccacttggtcaaaacctggaaaaaatgaaacaattaaatttattaattcattcatttatttatttggacaagccttgttgccaatgctgaaaatggagaccacgaagaaggcgatgccagtgataatgccggagaatggtggggccaattggagcagtgccgtttggacgccctgaaattttccaaaatttgttttggattgtttagttgaagtcgagactctcggccatgaatacccattttttttattaaaaatttaatgcccggcaagaagaggaagctcgaaaatcatcaattttcagtatatttatttaaaaatatggtaatgatgccgatggtagcccaccgtttttgaagaaatttttttttgttttcaaaagtcatga

SEQ ID NO: 10257 - DNA, 2836 bp, Heterodera glycines
gacacaaaaaatcacggggatttcgaaaacggatccttctgcccgcggatcgcggaaaaacgccgcgaatcgctcacccgtgatgcctaagcgcgttaatcgcaattgatcaatcaattctcgttcaatgccggaaaattcccagggatgatcgcagaggtgtacaccccttttaggcaaatgatcaaatgctttcgtaataaattttttgaacggtttccaatcacgaaacaaattgtttcaggttttaaaaattgtttccgatcactatcagtgccaaccagggatgcgtcggatagatagtgctgttcgagactctcgagtcccgacgactcgagaaaaatctcggggtttttgagtctcggggtcaagtctcgggaaatttttggtctcgaacagcagcactagtgtcggaatgccaatttccgtgtgccgacttttcgggcttggaattccgggccgattgccgtaattttttgagggtgtcggcacacattccttgtgccgatcaaacaaatccaaaggattagcaaatgttgttgcaatcgatttgtgtttctcgggctctgatcagtctgatcaccttgcaaatgcgcgtgccgcgcctccgctcctcccacgcgtcgaccgccgtttggtcgtcgccggaggcgaaagaggacgcagcttcgcgtcgcgagctgatccatgaggaaaggctggaggacacccatttgctggccaacaaaaacagaatgggcagcgcggaaagaagctgaatttgggaaaaaatgtttttattaccaatttttatatccaatctgaattattatatttatttttaaatttgtaatttaaatttgtttcttttaatttaattcaaataaaataaaagtttaattagttgaagtttttcatttaaataaaattaatataatttaaattaattttttatttatttcgaaattcaaaattcaatttattctttttgtttttgttttattagttttttttatttaattgaaataaaaaaaaatttccgaaattttttctaaattaaatacttaaaataaataattttcaattattaatagacgggataatctatgcccgcccttatatactcaggataaaaaatgtttttgaaaattggtttgaatttattttttgaaattaaattgtttttttatttaatatacctaaattatttttcaattttttgtttttgcttttccattgactactcactagagaccggacgggatcgggatcccgcgggatttcttcgggatcccgcgggattaaattcgggatcccgacctcgggatccctccgaccccagttgtccggtctctactactcaccccgttttgggtgggcgccaactccaacacgtcgcgcatgtaattgggcaaaaactgcagcatgatcaccagcggatattcctgttgaagggaaattaggagccaattaattaacaccaattaggtaatttgattagcgtataaaattttgttgtaattaaatacggattttacaacaaaaagaaagccgatttatcctcaactacataaatggcttatccagaatactcagaagaaaagccggttaaaaaacggacatggcaaatcagcgaaaacacgttgacccacaacggcacggaccgtgccattttgtgccacggcacacgcctggactgagtgcgtttgccgatgtgttcacaggcgatcctggggaaaagcaaattaattagatgctaaatttttaattgaaaatgtaaaaactgccaaaaaaaaagatttaaaaattacctaaaaatgaatttgaagaaaattttttaaaatttattattttggaatatttcaaaaaaaaataattttattttatttttttattttattttgaaatattataaaataaatgctaaaaaatttaattaaaaagatgaaattgccaaaatttgattttatattgcatacataaaataattaaattttctattcaaaattttttgttcccacctgctttcaatgtacaggcgttctttgttgggcatgcagcactgtttggacggtttgtcggcaccaattggaagccaaaggaaagccgccaaagcggcgaccaaagaagacaaatggaaaatcagaggccaattctgaaaaaaatggaaatttaaaaagcagcgaaaaatcgaaaaacaaaaaaaaaaaaggaattaaaatttctgtgtaaccaattaaaatgaaaaaaaagaagaaaattaattaggcaattaaatgcaggcggaataacaaacaaaaacaacagcaaatattctttttccggataattccgaaaatttttcgggaaaatgcgctaaaaaagggaaagtattttcaaaaattcgcttatgcttaaaatttaggcaagcaattttcaactttcagccacaatcaaaaaaaaaaaaacgtaaacattttaaattaatgagtgtcctcaattaagatagggatatttaaattaaaaataataaattaccccacaaagagcgccggccaccggcaaaatgaaaagtgtgcccaattgacggccgccagtgatgcaaccgatcgctactgcgctacaaatatatttgattattttaaatataatttggtagaggtttggtccgatcggagactcaaattccatcacttttggaagtgctctgatcacgtccggccccatttgagtcatcccctgatcagagactcaatcacttttggaagtgctctgatcacgtcctggccccatttgagtcatcccctgatcagagattcaatcacttttggaagtgctcagagcacgtccggccccatttgagtcatccccgtgatca

SEQ ID NO: 10258 - DNA, 2246 bp, Heterodera glycines
cggtcgaaatgcttcagtccaggggaaagtctacaattgtgagatgtatgaccaattttattgcagttgtagcagacgactcgctttgtccttggcgcgaaaattttttgtggcggaaccgtcgatttttgctgaaaatttggccggtgctcttttccaaatccagccgatttagtggctttttgcactcgcctctgcgcgtactcgcgagagcgacgaaactcgtcgaagctcatgcctggacggcgagctatttccaatcccaccgaaatttccggattttccatagcacgaattaggtgcttgactgcaaagtcgtcgacgaaatttgagggcaaacctgggtaagcgcactcgacaatgccgtacagccgttccgcaaattcatccaaagattcgtccgatcgtcgcttcatttcattccacaattcgttgaaagcccgcatttcggtgcagtcccattcgctcaaaattccttccattccgcggcaaatttcgttgaaatttttcggccgatgtttcatcgcggcgtcaaatgcacgctgtgcttttccactcattttgctttccagtgctgaaatgcgtcgattttccggccatcctcctgttgctgacgaaatttttttgaaaaatttccgtatttcgttcggtccttccgttcctttcagctcagggaatctttccattgttaggacaaactccaacgcgccaatttgcagaccttcttgcttctgcggttgttccatccgatgcgctttgtccgatgtttcattttgatgaaattgcataatgtcgaaatgggatttacttttcccgtttttatagtcagttttgtcgacggaattgctttaccgaactgacaaaatgcgtgatttgtttcacgaattcctgaagtgaagaggggatttgcttttcccgttttcaaaaaaaaaaaaaattcgccttgttcgtctgctcctcgcgtcctttctgggttttgttcacccttttaggttttccgtcgacagtccgttgaaaactgagggatttgtctcccgttttccaatcaattcaaccgttagggctcgtcttttcgcgggttttactttacccttttacaaaatttagctgtccacaatcggctgattcgactcttctcttgctgggaatttgttttcccttttttccgatttgtccacacttgtcgagggatttacttttccctattttcaattcgaggccacgtccaattgtttttgtccactgctgattcaccggtgccaggagcgccaagtcgtaaaaaacaaatatggttgttgtcaggggggctttaataatgttgttgttgcacagcacacagcaaagacaacagcccaaagcaaaaccaaaacacagcccaatgtcgaagacaattatttatttcaaaattaaataaggcgaagacaaatcaataggaaaactgacgactgcataatctaacaaaatcacaaacaaaaatgacacaaattaaaataacaaaacgccaatatatatttaaatctcaatattatcacagtgggattaaccccgcgggatcccctcccacaaaaattaagagttacaacgaaccgctagatagggatcgcacctgttctgatttatcagaaatcttctaatttagatttatcttaaatgttcttaaaaatttcaattaaatttcaaaaaaatttccaattgcattaaaaggggctgatgggtcgacaaagatttttcgaagggctcagacggtaaagagaggtcaggaatcaaatctgtttatagtccataaatttgactattttgtttttttcaaaaccatttttttgcgcacattttccaaaaaatttttgggggacaagggggtcaggcggtgccaatatgcaccgccgaagaaattttttgaaaatttaatgcgttttgttaactttgtgatgaaaaattagttaaactttaattcaatttattaaaaatttattcaaaaaatacttggcattctgactctgaaatttcctatgtggatcccgggggatcccgcacaaaaaatcaaatttgcgggtcccctgcgggatgagaatgtacatattattacggttagttataattttagaaattgatttaattttagaaattatttaattttagaaattgatttaattaggaattgatttaatttcagaaattgatccaatcaactttcgaacatgccttattttctcaaaaccgttatctatataagaattggaaggatt

SEQ ID NO: 10259 - DNA, 1326 bp, Heterodera glycines
  misc_feature (156)..(156): n is a, c, g, or t
gagcattcattgcttgtcatgaaacttatggaacaaatttacggaaaaattggcacaaattggcattactgagaaaaagttagtgcaaatttgtcagttttaggggtatgatgacaaaatatttgatatacaaccaatcgacagtgatgtgaactntgggcttccggattggaaagaattttgcccaaaattaatggccaataaaattccaaaaaattcagtggttgtaatggacaaattaaattcagtggaaaccgtcggcatgaacaaagtaaattattttttataattttaaaaggggtatagaaaagaaaaaagaattttattccatgtaaaaaaatttacaattgaattaggttgctcatttttgataaacacaatttaagggtcaaaatattttaccaaaacttttggcgaagcaaagccgtggcactggtgtttttttgccgaaaaatgcctaacaacgcgtggcactgctttacagtatacgtcgaaggcgaaaatggaagaactttgaaaaactgtaacagtttatggtattgtgatttgtaggaaaaccttcaattacctgtgtggtgttctgttatttttctttcttttatagacaaaaaagcgacatttggggactttttattacaaaaagtcggatattcaaagatcagcaggtctcaaaatattagttagactcctaaatatctttttgtcttcaatagtacttttatcatgttgtgtaaagcattgagtttgttttttaaaaatggctaactgaacattgtgtttgtattccttttaaccgtatttacaacattaatattctcccctataattaatagtctctccccctaaaaaggtactcctactgaaggagtcacaccgtgaaaatttttgagaattcagttgagtttaacaaaaataagaaatatttttgatctgagagaggggggagggtgaaaaatagtataatattttagaaaaaatttactattcataggaattgaattctcggtgctatgtcgaagcgacaaaaatatgggtgtttgtaataattaatttaattattattttaattttattttccaagtaattaatcataacttagcttaagcttagtcaaattaataaaattaagtatttagcgacagctcgaagcatcctctactacttatgaaattttcaaaaaattagtaaaaatttacaaaaagttgtgaccaaaaaagtacgaaaaattttgactcaacaattgtgaccctagctttcttgaaattcaataaaattatttgaaatttagcagaacattacagtaatatttaggatatgtaattatat

SEQ ID NO: 10260 - DNA, 1177 bp, Heterodera glycines
ttttcgggaatttttccgattttcaggggtcaaaaaggccaatttagctgatgggaccgttctaatagaggttttttggaaaaatgccaaaatatggacataaatcgcggaatatggaaaaatggaaatagaaatccatcctagaagcttcaaaccaagctaaaaacatgtttttcgtatgtttcaggcctcccacaacccaagaaaaaatattaatttccatataattcccagccctacacataattttgtctaattaaccaattaaacatcttgatatcattctatagccctaactattctctattagctcagctaagcatagcactctgtcatttacctactttttatttcgcttctctgccgcacgtcagtaaactgatgtaaattacatgtttttttcaccctacattgcttgtttggcattttcacaatacacatagcaaaatccgggaattggcatatttattgattttttgattgccaaccttcaaatgaaatgcttttcctcaattaaatatttttcgtcattcattttatttaatttgccaaaatttcaatgaattattattttatttataaaattttcgctttaattgcccttcattttacatttgccattccaaatgttgtaaaggcagcggttcgtttttaattattattattaaactaaaacgagaataaatccttttttgagtaatttgtagacaaaaaacaaatttgattgttgaaatggaccaattaattttatttaaactacttaatttaatttaaaaaattccctttgatcagttgaaaagcgatgacaaattcgtcacttttgtaatgagtttgccacatatgccaaaataccatgacgagtggaagaaggaaattttggatgaaatttaccgtacccctgtcgctgaaaattcctacgattttgaagctcaccttggcattttgtttttgatgaaagagcattggcattgtgtcgaactcagaaaagaggatggagaaatttgcagaaaatatcgcagacaggcgcttgttttgtacgaatatttcctacgagtgtatcaccaaggtcagagaaagctccaaggcccgaggtgtaattctgctcgagatgaaattgctcgagactcgagagcaaggctataagattaaattacctaaaaatcttttcatttttatt

SEQ ID NO: 10261 - DNA, 2382 bp, Heterodera glycines
tttagcatgaatttgttttttcaaaaaaattttccaaaaactcgctaacgatttttcaaatttaaaaatatttgtttgaaaaatttcaaagtttgacgagctgctccccgtgggaacatccggcaaaaaaaatttgaaaaaaaactcagaaccgtagtgggaaaaatgtttgcccccacctagattgtgttttttgctagtcggaaatgtaaatttcgagaaaaaccaaaaattcttaatacctaaattagggaattttttctcaaataaatttcggatattttggggaataggcgcgggccgaatttcaggcactaatccccactaaaaagtgcaaaaaatatatagtaaaaacagggcctaaaatttagaagggaatgaacaacttctccgaccttgaccgcacttttggtgataaggtcgtagatgaacaggcgtccgtccgtgctgcccaccgcgatcagagtgccaaagcgttttaatttgctgaaaaaactaaaatttttcgaaaaattttgaaaattccacgcaccaacacgtcgctgccgccccgttgctgtccaggaaacactcgcgctcctccgggtaggcaagcgcaaaatttttgccaagaaaatcgccattcatcatcactttgagtgccgacgatctgagaaattaattgaaaaatatggcaaactcggcacttttggggggcatactgacatagggatttaagattttagcgactatttctttatctctgcaaatagagaaaacccgaaaaaaaattttctatccacaaattgcttagaattcgccggaaaagtttctcatcatcaaaagcttttcgatgataccaatattgtccaattcatttgattgcaataatcttcaaaaattatttacaaaaaaacacaaaatttatgcaaaactccgtaaattttttagtttttaatttcgtggggtgggggttttctagcccactggcagggatggtttcacaaatgtcaatccaatgcacaaacctgaatggtcagcaaattgtgttcccactggtagcgctccaactcacgcttcgtgaacatcaattcgcgatgccaacatctccggcataaattttttgtgcagatgaacgccggggacgaggcaaaaagccatgggcacggctgaaaaggagaaagaaaaattacattttatgaaaaaaaccgataatcgaaaccgagcatttcggttaacaaaacgtttcggttaaccgaaaacgatcaaaaaaataggtacaaaacagacaaacagaaaaaatgtattttactttttaaaggaaaattgacaatttatttaatatattatttttcttaaaagatttcattaaaaataccaaattttcaccgtccctgccttttttattttttaaagaaaattagcacggcaaaaaagcaccttttaatcgttttataaaaacctaaaatacacccctaaaaatcgaacttggtcctccgttcccgttgccgttcagccgccccatttttgtcaccgccgccgtcgtccgtcgccaatgcgcgccgcactttccgcgggattggcgtgtcgcttgaaatcactgaaaaataaataaaatgggaacttttttagggagagggtaagcctaaaacggaaatttaaaaaaaaatttggaaaatccaattcctcccaattttcttacaattttttagataatgtttaaaaaaaatctttgaaaattttaagtgttttaaaaatttcggtggagaaaacgaagaaatgaagtaaatcccaatttctgagagaaatttaaagtgattttcgaaaaattacaaaattttccaaatatttcaaaaaaaatttcgatttttatggaatttatacttttttataaaaaaattgtaaaaattgtcagtggcatttgaaagtattaaaaaattgtaccccattttttaaattttgctaaacctgggtgtgttgcctcataaattcggttcaaaagtttttgtttggtcttaaaatttcattgaatatttacaataatttgaccacaaaatacacaaaactttgccatattttatagcaaaatcgtcacttttttagttggggcggttgattttttttttaaaaaaccaaagggaagaccaaccaactttttggttttttctcctgttgcagttcgtcagcagtaccaccaccaccaccaattgcactgctcgttgtcctcggcctcggctgttgtccggcggaagaagtgcaaggctctcaaaaacaaaaattcagttgagacagcgaattttcgcaaaaaaagaccataggggttaaaatttgttcagaaaattgcttaaaatttcaaaaaatttactgaaaatttttcactttttgggtttcgggggggggggg

SEQ ID NO: 10262 - DNA, 1293 bp, Heterodera glycines
  misc_feature (44)..(44): n is a, c, g, or t
  misc_feature (50)..(50): n is a, c, g, or t
  misc_feature (75)..(75): n is a, c, g, or t
  misc_feature (157)..(157): n is a, c, g, or t
gtcgagcacagcgaatagaggcgcgttgagcgcgtcttcagcgncaatgnccgcgtgcgtaaaagcatttctgcntcagcggaggcaattttgcaacaaataaatcctggcaaaaaaatgggaaattaaatgtgtgtttttaaaccaaaatcaaccnccattttttggttttctttttttttattaaagattcgctgttcatttttgaaaatatgtaacaaatgatagtaaaaaattgtaattttctgtgaaatttttttttttttgaaatctaagggtggaaaaaaagagagaggagatacatttatttgcgtcaatgtccaaattggactcaaaatttttctgtttttttttcaatcccaaattccataaacatcggctattttttcttgaataaatgtaaaccatgtattttaacccgttataattggcgctaatgtcggataatcgctaataaagcgtggggtttttgcggatcaaattcgaaatttaaataaaatttaaaaaatggcttacgagtcggtgcaattgacggcatataagtggtggtggtggtgatgcaattggttgttgttgttgttgcagtttctggtggaccaacacgctttcgacatcgatgtcatcatcgtcttcatcctccttctcatcatcatccattggcatgtcggcaatggcttcttccatcggttggcattggctttccgtcgtccgcagcgatttttgtccgaaaaatggggtacaaccgtaaaatggcacacaaaaaagtccaaatgtttccatttttaggccgtttattacaaatttggacaaagatttgcaaaattttgaggctttttgagcgaaatgctaaaactttaatgctttttttcattaagaagtttgaaccatttgggtaataaaaaaaaaatttgagccggattaagacgcaaaaaattgctcacaaaaccaagtaaaatcgtccataatttagggccccattttttctttttttacctcattcggaactgaaaaagacgaggatgatgatgatgaagatgcaccagcaacacaattggctggctgaattgtgtcctgtttttgttgcgccgcttctccgtcacaaccgacgccattcaatgggcacaacgacggcgccgtggaaggtggcgttgtactgcttcgactcgtcgtcgtcatctgagtttgatgtccatgccgtgccggagaagtgttggaagaaccgttggcacagctttgcttattctgatcaccaccagcagcaccaccaattgttgctgttgttgcggtggcatt

SEQ ID NO: 10263 - DNA, 1635 bp, Heterodera glycines
  misc_feature (187)..(187): n is a, c, g, or t
ttctgaggtcttgactatgtcaaaagtaaaatctgatcacgtattcgtgatcagcgaccccaaataaccccctaaaagacatatttttggaagatttttgtgagaaaaatttttccactcaaaaaatcctgtccacccccctttggtcccgaatgccaaaatcacttatatttttgtatctttattntaaaagatgataaaaaggtcaaataaaatttatataatagagcaaaaaattgcggatttttgtagtattttactcttctctaatgacttttcagaaccgagatataaaattttttctgaaaaatagaaaatttccagaatttctggaataactttttttcatttgaagatataaatttcaattaaatcccataaaattctcctgatttttctctatttttagagctttaattcccttaaattgaccaaaccttcactgagcaatgaattttcaaaatttaacccaaaatcccaagggccaaaaaattgccaaaaaataaaaaatttttaaaaaattccaaaaattctgaaacttaaaatagacattatattcgtactcagcaccttattttaccccagaaaaatatttttcacccccattttcgtccgaaaaaacatttccgaaaatttctagggggcctagctcgaaaatttttgaaattttctcgacctatcctacaacattcgatagagtttcaaaagctctacaattttgctctaaggcaatttttggataagatcaactcctgacgagttatgggcccaggactcaaatgtcccgctcaggccaaaatttttttctatttccaggaaaaaatcaaaatttttccgaaaaaaataccggtcgatagagctcgaaaaactatattttggaagtggtctccgtttctctgggaaaaatcgttaaaaaatcctaaaattcaaaaaccaaaaaaacgttttttaggcctaactcgaaaatttttgaaaattttcgaaattttaaaatttggaaaaatcgagctttcaaagctctacaataagtccgctggagccccctcgctcagatcaaaccctgacgcggtattcacctgggactgaagtggacaaagttggtactgaatttctcctattttctgcagcccttcctactataggtagaggcctggaattttttttgacttttagacaacacttcaacttaggttcctaccagcggaaagtttttgaatcgggatttagaaaaaaagttatgggccgtcaaacgcacgaaaaaatgagaaatcagtccctggtactcagttggcccttggaccggaaaacctatatttttcccggatgcgcctcaaaaagttgtaagacccttccactactttcagggcgctcccggccttcggccgggagaaaatggttttagcaacgaaactccttgtcaatataacatatatagtaactagcaggtgcgtgcatgcgagggtggcgcttgggaaagcgctgcgcgcttcttgagcttcgctacctaggctgtgaagcgattcaaattgatcgaattggttggagagatttttttgaatttttaaaaaattattaggggtttttagtccacatcgaggctcaagacgggcgctttgcgcccgttttttgaatttg

SEQ ID NO: 10264 - DNA, 1499 bp, Heterodera glycines
gggcgaagctcggcttagcattcaaagccgaaggcgaagtccaatttttattcgaagtccgaagctcgaagccaaaaaaacccgaagtttttgaagccaaaatttttcaaattttattttttaattccaaaaattttttcataacaaaatttcggttaaatatcaaatttaatcaattgacagaacggctacagatcaattaatcacttttaataaaacaaatattttgaattttttgatcaaaatgtgcttagaaatttgaaagttttataaattcttaaagcatttcaatttgaaaataaaataaaacttttgggtaccggcggtttcggtaggcgccccggggaagtatttgaaattttaaccggtttcttttcaccaaaaaatgccaactttgtgtctttttgggccaaaaattaaattgaccactctatgtgaaagaacaaagtgcactaattaataaatatatatgtatatattaaatataaatttaccaaaagccaatctttttgaagccgaagtttcgcccacccctaattcgaacacgaattaattaataatatatataataaattatagactcttaacccatttattaaaaattaattattttcgtaaattaaatttaccattgcttggcccatgagtgtggtctttgaaaaaggcaattgtttttttgttgtcgttcgtttgaagagaaccgttgcatttagcagttttgtactctgtgcaacgccaagaaatgcttccgttcgcaagtggtcttgctttgaagtacatttgtcctcgcacttttaatttttcgcctttttcccgagttttaaaaaattgaatttgtactttttgcattttctaaatttgaatagacaacacgataaataaaaaaattaatttaaacgcgaatatttctaagagtatgaaatttgggtgaaattattaagggtttttttaatcaaaattgcattgtacattaattagtatttatttatgaagaattaatgccatctctaagtgggcagcgaaatgacttcgtccgtcacttcccatgcccttttcttctctgttgggtcatttctttgcttttggcaaagagaattttataaaaatgcaagccagcagaagaagagttacaaacaaaagattagtccgtcggcgagtcgtgcgtcggcgagttgacatgtaccctacccgccggcttagttgggcccgaaatgtcaagagacccatctaattctatttaaactcatcaaattttaagtctttgaacagaccgagccttgtaatgatacaaataaaacatacatatgtgtggcattgatatagaatgaatggtaataaatctagcaaaataagcaggttaattgaatttactatgatttaaattaggtgattgcaattacagacaattaaactatttttatattttaaatccttaatttggtgcccaacttccctctcacattcatttataattttgctacaatattcattaaataaat

SEQ ID NO: 10265 - DNA, 3255 bp, Heterodera glycines
cgcgaggagttggagcagcgcaggcgggcggtcgaggagcgcgaggcggctgcagacgcgcgcattgccgagttggcgaatagcaggaacttgctgcaatcggtaggtgggccaattcctccgtgagagggctttaattcgtagcaaatacaaaacccaaaaaatgtgagggagcaaaactttttttaaaattatcaaaaagggtttgctggcgctgcattaggcgccttggaatctaaacatttaatagtgttaagaaattgacaattttcgatgaggggtatggatcagggctggacgtaactgattttcagttacggccatccgtaatccgtcatgacgggggtcaaaaaaggccgtcatttggcgtaatccgtaatacgtaatccgtaattttcaaaatttttttttaatttaaaaaatttttaaatttaaaaaatccaatctaaaaattgttaagattaatttatgatcagaatatctgcttgtttttttgaggtgaaaatcccaaaatagtttttttcgcggtgtgcttttcccaaaaaactggggaatgtggggggggggggtggtcaggcggggccgaaaggcgccgccggaaaaatttttgaaaaattttatgcaatttgctataagattttgtctaaaaatgactaagattttggagctaatatttaaaaataattaggaatttttggagcgggcggtgccgataagcgccgccgaggaaaatttttttcagaattttaacgaattttgttaaaaaatagccaaatttttagcatttcctcttttcccctttgctagcctcccccccccccctttatgtatgttaatatactacaaattaccaagaataagtcagattaaatcgaaatatgggtagccttttaattagagtagagcgggaccgggaattttgggcaaaaccgggacttgccgggacctgagaagccgggaccgggaccgggacctcgatttttcttcgggaccgggaaccgggaccaaccgggaatttttaaaaattcaaaaaaattcaaaaaatttaaaaaattaaaaaaaaaatcaaattttaatttatttcaagtgaaaatattaaataattaaatttttatttagttttttatttaataaaacccaaaagttaaagctaataaattaatgaaaattttcaaatcaaattttcttcattactttcaaacaattaatcatttttggactaagtgatcgaatattattagaaattcagatttacgtttcacttaaattttttcggcgcgcttttaacagattttcaacaaagaaggctggttttgggattactaggctcaatttgtacggattttctttaaaaatgataaaatacaattaaaaaaaaattaagaatcatattttgtcgataggaaagccatgagtatatataaaaagaaatttcaaaatattttcatttctgtagagggatcgaaccaggggaaagaagaagggaaagtgaaggagactagccactaggccatttgcacagttggtcttgctactttatgaatatatttaattattatttctaaattttttcctttaactccaattttctcactaatttttgcactcagacccccattcttaccagtgcttgtttttcccggttcccggttgccctaccgggaccgggacctgagcttttcaaaatccgggaccgggaaccgggacctcggatgaccgggaattcccggcccggtcccagtcccgctctactctacttttaataatagaaaaaaaattcattttataaaaaataatcttgcaagaaatcgtcttgaaaaataatctaaaaagccagttacggatcaaaattacggaaaaatcccaaaaatccgtaacccgcaatccgtaactccaaaaaggccgtaatttccgtaatccgtaatacgtaatccgtaattacgtccagccctgattggcacacatctcgttttttgaaacggtgtgtttatgagtagggatgcaacttttagtgatttaacaatttttttgctcgatttttttgaagaaaggagctcaaaaaacgcatttctgctttggaatttttcgatttggatctcactatcggtcactagaaatcactattttggcgcttcgtaactaaaatagtgaaaattcactattttggcattttgtcactattttttcattatttcgacattttttggaaaatatccgcaagaaaaatgcaataaaaacgaaaaatgcacaagaatcgacctaaaattttttttcaaaaatatacccctaagaatcgacctaaaaattttttagaaaaatttctcaaaaattcatcaaccaaattttttttcttgataaaatttttggtttaaaatcagggcttggatcgaaaaattttcaaaatcagaacatcgggcctaaaaaatcagattttggggtcgaaaatcagaacattttgcaaaattgcttcaaatctgttatttttacatttttgtttcacttattatatttttcccctcctattatcgaatttaacaattttgagaggaaataagcatattttaaattcagtgtatttaggatcaaaaaatcagattttaagaattttttgcggcgcatttttccaaaaagcttttggtgaatgggcgaggggaggggtccggcggagccgacaggcgccgccgggaaaatattgttatttttaatgcgatttttaacagatttttgtccaaaaatgaccaaattttgccacaaattttatattttcttgtaaaatagtgacattatggcataaaatttctaaattatgaggatttaggaaatcagtacaaaataagaacaatagcccaaaatcagatcatttatgataaatcagaacagatccgagccctgtttaaaatgtcaatatttgccaagaattattagaaagtaaatttacttcagttgcaactgcaaggaaaaaaatttttttttaacttatttttggctgaaaattatgtcactatttagtcacttttttggcacttttcgtcactattttagtaactattttggaatttttcgtcactaaaagttgcatccatatttatgagatatttgaatattttaaagtggtgcaagacttatttgtcactctgtaaaagcatcgtgtgtgagaatttccccactatttataggcaattctataacaacaaataaaggggaggtgctctgatgggtaaaaatggatttggtacaagatgttgaaatgatgag

SEQ ID NO: 10266 - DNA, 2973 bp, Heterodera glycines
  misc_feature (741)..(741): n is a, c, g, or t
ttcttgtcaacaattggctgaggacaaggccattgagcgttcgtcatattccaatgttttggcagtcaatcggaaaccatttcagaagaaaagggaaggctcctcaagcagttcttcagtcaagagtgcttcttcgtatggaaatttggcacaacgcggatgctggcgttgcggagtaagccattttccgaagaaatgcaaccatctgaagacgacatgccgaaaatgcaacaagattggccacttggaacgcatgtgtgccaagcatcaggcatggttgaagaagaacgatgaccgcatcaaggatggaaaagcgacaaattttgtaagaattggctcattaatgctggaaaatgggacgcagccgaagaaattgattgaagcggcaattggagtgaacggaaaagacgtggaatttgtgatggacatggggacggaagtcacagttttgtgcaaagaatcccaccgacaaattggaagtccgaaattgggccattgcaaggaaaaggccatccttaacgacggatccacgcgccgatttttggggaaaggatttgcaaaattctcttttggagggcaaatcaagaaaggacaattttttgtgtctgagaatggatccaaaaatttatttggaaccgacatgatggaaaaatttggacttttggacggatttaagaaaaatttgaagggcgaagtccatcgaaacatttcgctgtcggagcgaaagtgatcacaattggnaggatcacaaccgatgcaaattggttacgtcattagccgaaagggatgatgtacgacgtccacttccaagatggatatacgggacggtaccatgcaacaatttggaggagtattcaccggccaagtatgaaggacctggatttgtggactccgaatcgcaaatggaagcgatcgccacgcgaactccaatggcaaacgttgaatgccgaagaagaatggacgtgtcggacagacgtgtcgagaaaaagaatggacgtgtcagatgaaaaagatcctttttaagggtgaaatgttagggatgggactcaaatggccgccccaattatttatttgtttatgtccttcacctctgtactctctctcgactttcctccccataaatagtccgccctttgacccattctttcacttgtatcttcacttcatttatttgttgcatcatccccaatcgatattccccattgcttcatttgttatttaattttgtcttcaataaatttggtaattattgtttgccctcggccggcataacaattttcaaatatgttttttggtaagttagagaaagaaaatttgaaaaaaacataaaaataaatacgccatcataatattttagtaacagatcacttatagaaggaagattgttacttgtttggcctcaaaacggtcaagtaccaagaaatttaatgagaagtttttctggccactagaaattacattcgaatgggaacattttgagcgataaacataatccgatcggtccctgttgaaaagcattacactctgctggttggaaagagcatacttattatgcatgatcccagaggaaaattacaaaattagagggaaaattccaatcgataagcattggtcagattttaatttcgaaccccccaattttaccattttaacagcactgaagaacccgacaattttggatgcaattttcaggtgtagccactgtttgacccgatctaccaaaaggacaccaagcaaatgaaggcattgattggcacattgagcgaggagaagcggcgccgcttcctgcgcacgcgttacgctcagggacgtatccaggatttgggcttgggggggggggtaccgatccgaaaagtcaattcttaggggtgtatttttgaaaattcttcgcccgattcttaggggtgtattgtatttttgaaaaactttcgccgaacgacctttttttttttttgctcataccagcgacgctgggaaaataggggtgtatttgaaacgataaattagcattttttccatcgttttcacaatggattttgaaatttagctatttttacagcttttgctccgcccctggccgccagcaaaatgtttctttgtaatttggcgttggaatttaaaattaatatgttgctttcgttatgataatttggcgttaatttaaatttggcattgctttttctctctggggcgctggttggtcttgttggggagggggggggggagtaccgcgggggtcttggggggggggggggaaccgcttctctttttctcttaccgaaggagtaattgttaggatattttattcatctccctttttgatagaaaaagcatcagagtgcctaaactagcatgtaaataaaatttggtgcgtttcagagcattttctgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttct

SEQ ID NO: 10267 - DNA, 866 bp, Heterodera glycines
cccctaatacggtactggttacgccccggagggcaccaacaaaacactgacgcctctgatgctggccgccgcagcgggaacaagcgaaatggtggagatggtgaaaattttggtaggagcataagaaaattaaattaaaaaaatatttctatcagaatttttgcagttggagagtggcgccgatccgaaccaaatgtgccttcgcaaactcatcgacgcaagaggttcccccaccatgaccagtgagtgaaaagaatcattaaaaaataaatatttgcttttttggggtcactgactcatacaaaaaatgttgttgaaaatattaaaatatgaattttcaattaaaatgccataaaataatttttttaattttcaaaaaatgttgcataattttgtatatgaagtgttactttgttcagaaaggcacgggattgtcctttaatataagtacagcagaaattagaaacggaaaagaatgccccccaatttttggtaaaaaaaattatttcaaatgacgcccttagaaatgcataaacactcatcccatattctttgccaaaatagctagctaatctacagagttaaaaaattgcattagcatcgattttcccaccatttttcaattataacggcggaaaatttaattaatataattcattaaaatgtttttatttagattcagaattattaatttattttcagttgtgacgcccctttgggttggcgcaatggatggccacttcgaagtgtgccaagcgttggtcaaacacagggccgacgtcgacttgggcgcgccgcaatttggcatcacaccactgatggccgcatgtgagaacactgctcgactggacactggttggtcgtcc

SEQ ID NO: 10268 - DNA, 1800 bp, Heterodera glycines
aatgcacctctgagaactcatctaataattttttcaaaaatactctcactttttagcacctaaaaatcctagtcctgttcaaataatgtattttcagacggcccttttttgaaattctctcattttttctttaccggcaactatgtaaattaattcaagtttgaactcaaatcagcttacgaaattgtgcattttcaattattttttataaaaatatatttttatcactgatttcaaattaaggggtcacggcaattgatattgctgcgcgaaaagggcatgtcgaaattgtcaaaattcttcgtcatgctgcactgtaagtgtgaaaatttcggaaaagaaaatatattcaaaattgttttttctttcttttgtttactattaaattattaaagtggtcaattttgtattgcaaattaattaaatttgattcgtttaaaaaattggttgatttaacgtgtttaatttccgccattccattcccactgaggggggttgaaaaatagaacccacccttgaattaaaaccccctctgtattataaccctcccccccctccaagcaaaaaattttttccaaaaagaatccaaaaattccgctgggtcgaaatacataagaaaaatagcaaaaagggccgtaaaattggtttaaacctcagaaaataaagcttttacatttaggtatttttacaaaaatccaacttacaagaaataatacaagaagttggaagctatcaccatcctttggacatatttatgcttcagccttgcgaaaccatttggaattgcctttccactcgatgtttgtcgccctcgccccgtgagctatccaagcgttgtactgttttcacgaattgtctttttgaatgggtgcaattcagtatggggcttaatgaagagcgacttgccgagacctaagatgaaaatttatactttttaactgtttactcactttttgaaatattactttgtaagttagtcgtccatccaaacataactgcagccgactattgaagcggctgattatgttggaggttagccgtttttgggaggagcacgaatagctgcagcttattgccgtctgacacgccgtgaggatgcctgtgaactgttgctagcctaatgaaatgttcaaaaataataaactgaactaccaccacgttcgcattttggtccatagaaccgtcatcgtcgagcgaacagctgcagcaggtgacttttgcgctgtacctcgttgtcctcagcagaaagagagcaaggagcatttgaatggcatggttttgagcatttccggcaatggtgcgcccagaacaggcgtttttgcattaccagcacaaaatcaccaaaaaacgacatatttttgctgggtctttgaaaaaattaagtttgaaaacctccctgaaaatttccttaaaatttcaaacaagaccgattctttgggttgcagttttagtgtttattgcattttaaaaatattgtcagtagatgacagtagatgaataaaattatataaatcaattttcaccgttattcacttaggtaataaattaagtggctaaaataaaaatcaatggcttaactctctgtcaaatgaacatgtttatgcataatttattggcaccaaaatgtatatttttctgagatgaatgaaattttttttgcataaaaaatcattatttaacgaaatgaaagtcaacatcatctttttgataatagaatttataagcatttgccctgccattttacaatttcattgccactttctaaaacgaaaaaattctttccgcaaaaatctttattca

SEQ ID NO: 10269 - DNA, 1344 bp, Heterodera glycines
tcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggcgccgaataacttcttctttattcttatgcgaatttgacttaaaaaatctgtggagttttttatctaatgaatcattataatttttccttttattgcattatatttatgaatttagcataatctcgttgaacttcaattatcccaataaatatttagctataaaaataatattttcagttaaagctgtctccgcttttgcgaatgattaatcagacaaaatatatattcaaaataaatggtagctttggtcgcacatcctttcatgccattaccggttattttatgtggcattttttgtcaattaatgactcttcctgtttttgcgaaaataattcaaacaaaaaagttaataattcttttatttaaattttgttttaatattcaaattattaaaatatgcttccatttcatattcaatgtgatatatttaattttatattaataattgtcttgtgtcgtagtatcttcaagtattttaggacgtgaatgttccgacattttcaagtttttataatgataaaaaaataaaacatagaatttcacttatttttattaataatcatatttattcattattgtttatttttttctattaaattttttgtaattattttgcgtagaaattcacatttttatctttgctttattttaaggtgtttttattttatgcagcaattttttcacttttaagaaaataattcacagataaacgctttgtatctttccttaaaaatatttattatatttttaattaggttaactagaagattttatacctttttcggtgcacgatgtgaagaaaagtgatttttattataaatccatatttgttaatattttttttctaaattatattctaataaaaagatttgtattttaaacttaaatatattatattatttgttatttattaaagaattattagtatcgcttatctaatatttttatatttgaagcatactttaattattttcaattaaattctcatactgcactgattaatattaaaaaataaaatttggtttttgtattttaattcaagctagtttttgttttaatttgatcaataatattttagattaattgataaaatattatc

SEQ ID NO: 10270 - DNA, 2417 bp, Heterodera glycines
tgtaagggttattcgacgcattccctcatttaattatttcttaattatttcccattggccattatcaattcaatcaaattttatccgttcacacgtttcttttctcgctgtaatgtttctccgcccattctcttcgcatttctccttcccccagtgatcagttagtcagttagtggtggaacagacttcaattatttattccttttctcgcttcgtgtaaatccaacaacgagtgaataaatatatcgacagtcaatgagtcgttgggattttgtggcttagtcactggtcatggctttccctattccctcccatgttccatccgggatagacggtgcggttggtctggggggcacagtgcgcatccctcactaaagtatcagtttttattgtaatcaattttaattgttttttgacatctcattgtcgacgaataatcgttttttatgattcaattatgttattttataaattggttcctatgccctaatcgaattaaaaatatgcatttgtttctttaactagtcaaattttaaataatttatcttttaatagttcaattatttgttcacctgctgatgacaaaataacattgatcgaatttagttaaaattaagtaaaaaacagtcttttgatagtatttctttctcatattcttttcattttatcatcatatttattcttcttttcgttagaggggagtggggaatttgggggaggaagggagggggatgcgcttgggccaaatttggggagaaatttgtgggtggaatttggggcgaaatttggggcggaatttttcaggggggggggtttacaacggattaaggggccttacactactttcctcaaaaattgcgaaatatgtacgaaattatataacataccaacttcaattattttataattctcgtttcgatgtattcttttcataaaatgtattatgtcattcattgttaattgttcgtttataacaaaacatttatctaattgtttttaattatttttgtttcaattataattgttgtactcttaattttatgtaaatttcgagcaatattatatgttttgatggtttatttaaattttatcacgaatagggttgtaaaataaacagggtttggcgtactgatgcatttaatacatttttttccttttctctctttctccgttctgtctcttttcctctccatttttctcgttttcactcttctcacctcactctctcgctctctttcttttctacccatctctttctctctctctccctctctccgtcactcttcctcacagcactctccctcttttttctctacatcctctctccccgttcctttgtatttctcttgattttgactccctcacattcctctttttctctcaccattattttcttctttctccctctcactatctctcattcttttcctttctctttttctccgttctgtctcttttggtaacattttccaaatcaatattttgggcataatcagaaaaataacataaatcttccagcactaattagagccctttattacttttataaattaatatgtgttttgtctaaggttatttaaacttttcttcaaaaaaagacacacattaatttatttgttattattttcatctttaaatgataatttttctttcttttttaattattttccctttagatttttaattttttcgcaaagaaaaataaataatattattttatagtttattttaagataaatattaatttactcgttattatagtaaaaccatttgtaaactgcttgaatcaacacgtgttttccagaatatgaaagatctcgtgtatcgcagtgcgttacattaattactttttatttactcgaatgtttgtaaaataattaaataatatttttgaaaattatttcaaacttttaaaataaagatagattcaaaacatattttcctttgtttttcgttaattttttattcatgcctatttttattgactttatctcttgtcgttttgcttttgcggcggccacgctcttgcagatcacgcaattggacagcaagttgctgacgcctttgcacaatttatttattaatgttaactttcgtttttattaatcgaagaaatatttatttaaatgtcagctaataatccatgccacttatgagaattttgcgttttcgcttagataacataattattatttttttatttgacgtctattttaattgtattttatgccgtattgattaattttaattttatatattcattaattattttttatttcatcatttaaattacaaattcttttttttatttttttattattgtagctgcaaattcataatattatgcaaattttcaaccatggttattcctttttcaaacaatttaatcattaaatttaatgcttttttatttttat

SEQ ID NO: 10271 - DNA, 1607 bp, Heterodera glycines
tttctttcttttttaattattttccctttagatttttacttttttcgcaaagaaaaataaataatattattttatagtttattttaagataaatattaatttactcgttattatagtaaaaccatttgtaaactgcttgaatcaacacgtgttttccagaatatgaagatctcgtgtatcgcagtgcgttacattaattactttttatttactcgaatgtttgtaaaataattaaataatatttttgaaaattatttcaaacttttaaaataaagatagattcaaaacatattttcctttgtttttcgttaattttttattcatgcctatttttattgactttatttattaatgttaactttcgtttttattaatcgaagaaatatttatttaaatgtcagctaataatccatgccacttatgagaattttgcgttttcgcttagataacataattattatttttttatttgacgtctattttaattgtattttatgccgtattgattaattttatttttatatattcattcattattttttatttcatcatttaaattacaaatttatttttttatttttttattattgtagctgcaaattcataatattatgcaaattttcaaccatgtttattcctttttcaaacaatttaaatcattaaaatttaatgctttttttatttttattgtgcctttattttaattataggtttatttaatgtcaattgtcaattgttataattttttatgtatttttatttatttttattacatagtatattgaagatagctcagaatctgaataatttctcttgagggtcatcccgagtgaatggctattctaaaattcttttcatctagtttattttttcaatcttatttattttcttattataaattatttttaatgaatttactcatttttttaatcagatttttttttccatatattataaaataaaaatattttttggtattcttccgtgaaagaaaagctatggctttgagtaacagattgggcgaataataaaacaaatatgctcctcttaacattctctaaatgaaaagcttttccattttatatatttgaaaatttaatctccagttatatattaattttcatatattttttttacgaaaatttttgaattttataaaaaatactgtaatatttaataattattatttgtcaatatttaaatttttaagatgcagcaaaaaattgtaaataaatataaagttggttaacaattaagttgattgatattttgagattcgatcgattttaaaatacgttattataaattttatttgattatttttcatctaaattgagttcttatatgtattaaggaaaaaataaaagttactgtttaattttgattttcacgtcattatttctataggtaatttttctgttaaagagaagcccggttttagtgataaccgagtgtatatttaattaatttttaaattacatttttactgacgacaataaatttgctcgttttttatttgtgttattaagactttttaaatataaaatttgaaggcttttaacataaagaattttttaatttatgtttgacattaattaatttaacga

SEQ ID NO: 10272 - DNA, 1359 bp, Heterodera glycines
  misc_feature (1267)..(1267): n is a, c, g, or t
tgtgagacgaggagaggagagcgaacatcgccaacaaccaacataaattatttcatttacatacattgatttattttttggtgctggttttataacgaaaatgcaaaaatatatgaaaaatatttacaataaacgaaaatattttattttgttatctgtatgaaaattttaatggaaatttgtggaaagaacttttttgaattcataaaaatatattttgcctagttttaaactttttctctcattttttcataaaattctattctgacttattataatttttgtaatttttattcattgccagattttatgaattcatttttttgccaaaaaattccgatcaaaatacatcatattttctaacgccctctttttcttttctttctccccccttcacgcctcactctctctctctctctcactactttctctctcacctctctctatctcctctttctctctctctctctctcttatctctgtcttattatctcactatttctttaattttctctctttctctacttgtctaatttcacccgtttctaatatcaattttccgcatcttacgcctttccaaagcaacgcgcgggcgaacgcccaccaaccaattgagagcagcagcatcatttagtcaacggatgacaaaaattcattcattcctttcatcgatttgacaattttttgggttagtaacgaaaaacatggcaaattaaataatgcaaaaatatttttaaaacatttgaatataaatttaaaattatcaaacaaaagtccaatactcaaattacttaaaaaatacttttttaagtgctgaaatgcaatgccaaacaataatggtagtaaataacattaatcaacgaagtaacctttttggttgcattttttgtattaaaacataaaaatttttcaagataaggacaaacagcaccctttttagcacgctttttccaaaaactagtacaaccgttaggtggtccgacgatacttatagtatagcggggaaaaaattgtaatttttaatgcgatttttttttaccaattttgtccaaaaatgaccaaatttaaaaatgccgtttgttattacaataatcagtaaaaaatattataaaagaagactctgcaaatttattgtaaaataaaataaaataaatcttcagaaatataaactgttatttttgactataaaataaagtaaaaaaaatggagcccattttccacgcatgtgaacaagaaaaatgaaaattacattatcataaaaaaattngtagcaactactatttttattaaattttctaaaacaaataaacttgaatatgaaaaaaattaaaataagaaagagtaatggtgaaaaaataa

SEQ ID NO: 10273 - DNA, 940 bp, Heterodera glycines
  misc_feature (772)..(772): n is a, c, g, or t
  misc_feature (904)..(905): n is a, c, g, or t
aaaaaaacatcctaattcggtttttctttctttatttttgtgtgcagacgcgagaaattaggttttaatgtacgctttttcaactcaaattagttcgctccttcttcaaaaccaccgttttggtcatttcgcttggccttctgcacggattggtcattttgccggtccttttaacgttggcacaccgtaagcgcagcagcagcggtgccaatgccgagaacgaccagcagcagcaaatcactgattgtcgagaggggaaatgggcgagaacggcgcgggacaatcggcgacggccaaactcggcaaattgcagcggaacatccgccgctgaaatatccgcgccgctccctccccgtgccgactttttcttccccaccgcttccattttcgaccaaaggcatttcgcatttgccatgacgaggacggggccaatgctcgtcagcagagaagcagccccatcgctttattcgctgaattcgattcattgttgttaaatttatatgtttttgctccaatgaatagcaaaagccacgatactttttatcggcttttttctttcattttaaagctttctgtccattcgcctcggccgtgctattgtcaaaaaaaaaattcgagaaaacagataaagtcatctgtgccggtaaaaaatttagacaaaagaatgccggaaaaaagtcaagagggaaaaataataataaaaatattcgcagttagtatttagaattaaacattaaaacatgcaaatcctaaactaaattatttttcttanaaaaagaaagaaatattcgccaattcttcaaattttcatggctcaaaaataagttgctttttttgccgtgtttaaccttttatttcgagactttagaattggtcccatgagtctaaacagcaatttcgctannaagcagcagcgaaaatcgcatcggaattaaaaaaa

SEQ ID NO: 10274 - DNA, 4473 bp, Heterodera glycines
aaaatttattaatttttttagcgcaaaatcaacaccctttgcgaaattttcgcttttttgcttatttttaacataaatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggacataaatcgcgaaatatggaaaaatatggaaaatatggatatagaaatccttcctagaagcttcaaaccaagctaaaaacatgtttttcgtgcgtttcaggcctcccacattccaggaaaaaaatatggatttccatgtaattctattccctagtcataagaaatttctatcaattctcaaaaattcgaaatatgtaatacaatgaaaatacatatgtaccaaaaaagtcaatggaccttttattttattacgccgacctttgggaaataatagtccaattaaagtataattgttcgcgaatgatgtcctagtggcaaaaattgtcaaattctcattaaattacttagtcttgttaatgtcatccaaattatccaataaaataattttcctttttcttttctaaatttattaatttcaatttttataggacttcctattagaaaatttttatggagaagcagcttccattcctgaagctcaaaaaaaattctagatttccggccgaaaaacaccaaatttaaaattgcattttatctgcaacagattttgtgcaataattgctttaattacttttagaatgtaagccatataaaattaaaaagattgacttcatagcgacaattaggcatctgaatttgtttgctgtgcattgtcggaggatccattcttaagaagaaaaaaaaatttttaaataataaaaatggataaaaaaaaataaaatatttcaagaattaatacagttttacaatttccaatgagcaacacctgactgtgaatggcttctccaactcgtgctccatttccatgtaaaagcatcgcaaatcgtaaaccctgtccaatttggagaggtattgggcatgaaaggcgaccaccaaacgcacactgaggaaaacgccccggggataatcctcctaaattctaaaattgacaaaaaaaaaataataataaaaccaaaacagctaatttgtttattgtccactttaaatgaccctttttgtgtgctttatgccgcacgtgccaaaggacagtcggatttgcgcattccgtgccgccccgcgtccaatggcactctcatcgacaaacgcggaacgacagcgcggctctttgaattgaccttcaacaaacacaacgccaacgaagggattgcgagtgtcaaaacgctgaataaagtgcgttttgactatacgtgagaagtagagaccggacaactgaggtcagcggaatcccgaccgaatcgcgatcccgaatcggagtcccgtccagatcaatatcgatcccgaggcttttttcggcatccagcgggattataaggatttgcttaaactcaattttctttcagttttgtgccaaaatttatagtggctcaatcccgcgggattggcgtgaaatggtcgggagggatcccgactcgggatccgaggaaataccgttgctaattattcccgatgaaatttgaaaaagctcaggacggattccaatgatgacatatatataagaatgcgaacattggttgtttataaagccaattatgactaatttaattatatatcgatgatttgcagaaaaataaagaaataaaatacgatgaaagtggttaacaacatgatgaaaataaatagaaacttttaaataattatttatttaatatataaattacggtgctttttaatattaataaacttgccacttcaataaaatttccaccacagtcgacgaatggttcgccgatgatgccattttcgggaattgcaaatgccaaaaaatgaatttggaatgcgagaatagcgaaaatagaaacaaagaaaatgaaaagcatttgagaggagatttataaagaaaaattgtgaatcgtttgagagatggcgccgggggaatttcagcagcaaattaattcactaattaggtgaattgatcaaaacgagtgataatgaatgacctatgacaatgcaatttcgaaatcagaatggaccctcaagaaaaatgaatttaaaaggaataaaaatcctatttctttttatttttgtccatttataaattacctaaatgatttttctaaaatagttatgcatatccttcaaatcgaatttttctgttggcctttgctccctctttggccattgtcttttgccaaattggccattcccgacaaggattctcagtaaaaacttttgcataatccaaaaagtacaatgcacggcattaccggcagcaaaatgtacgtggacggccacggctcgataaattattgaatatttttaaatatagataccatacataatcaggtttaatgagaaaggaaacattaatctcgtatgaacctttttacaaaattaatttattatttatttaatgagtggaataacattggtatagataagacgaatagcttatataagcatgggattggtaataaacaaaacaatgaataaaatggtctaatttggtcacgaattcatttaacggagggatataaccccgaggggttagtggtcagtcatggcgcaatcctcccatcacattcactcgtcgtcttcgtcgagctgttcaaatgggcattgcacttcgttttcctccgcgccgttccgtccaatcgcggcgctcaattcgtcgctcgttttctcgtcaattaaatgcatcccaattcggttgaggaacagaatggcctggcaatgggaccacgcgtttgtcgggtcggcacggccctcggcggacagttgcgattcgctgcacgacgccgaccactcgcgcagccgaatgacataatcgttgacatcggacactgaaacacaccaaatgaaacatgacgaagaagcagttgaggttggagggagggagcgacggaattcgaatgcaaaacgacccgtcaactttctacaaattcaaaaaaaaaattttttttttttttgaaaagtccaatacatttccaaattatttttgtttcgctaaaatttacaaattacgaatcgaccacttacagtaagccaactcaaattgggcgtcgaggaaggtggacacaatgccaaccaattgcgccaccaatttgcccgtccgtttgcgtctgcgagtcgcattcgcccgcgacggcgccagccaaccgttggcatcggtttcgtcgtcgtcaaaaatatgctgctgactgagcagtgcggaaaaggcggacaggcgaagggacgttgtctaaaaggacaaaaaaatttaaaaaaggagaaaaataggctattccttattttgaaatcgcaaacgaaaatttaaaaaaatgaacaaaaaagcacgcaaattcacacgactcaattctcaggttgacccatttgacgggattttatcataaattgttgcatttatatcccaaaaataatgctgtttttcagaatcactaatccatttttggaaaccctgaaaatagctaaaaaaacaaataatgaagatgtgaattggtaagtttcgtttactttaatgcacagtcaccccaaaactgacttcgtttgcctccatcagatcgaaaaggaggtacgcaacgtaacgcgttaatcgaatgaatcgctccttgagacaatcgttattatttgggcgaatttccatggaaaaaaatttttgaattcttctaaaaacatatttttgtgtttattaataaatattagattgaaacatgcctgggcctgtgtttcttggaccaaagtccaggtccaggaaaaccccaggtttccgaaaaatggcctggacctgaaaccggactaaggaaaaacccaggcctggattcgattttgtacttttgcgggtttgtcaacattttttggaatttgaattttaatatttcatatgtttggcattataattgcagatattttgacaaaaaagttcaaaaaaaattttttttttttgacaaaatgggttaaccaaatttcgttcaatttccctgggtcgcctattctcttctgaaatatttgtcatttttcgaaaaaataaacatgtaagccctggtatgcagtacatatgggctttttggtcacaaatattgaattgaataggaataggatttttaaacaaaaacaccaataaaaattgacctcaccaactgaccaaaaactactatttttcttaaaaaaaaatcgcaaaattggcattttttgataagaatctgttaacaaattacactcaaattttcaaaatttccccggcggcgcctatcggcaccaccggacccccatgttccgcaaaagt

SEQ ID NO: 10275 - DNA, 2207 bp, Heterodera glycines
tttttgtgtatttaaaacctattttgcgatttttcttattaagaaagggaatttggaagtgggtcttggcgcccagcttggcggcgcccagttgagctggcgcccagttggcgtcgcccagtcggcggcgcccagttggcgtcgcccagtcggcggcgcccagtcgacccccaccgacaaactattacccaaaagccaatacaaaaaggcacacaaacgaaacaaaaattaccaaagtgacaattgtcaaattatggtgtataatggcacaggcacaaaggatttaatatttgatatttttaaatgttaattttaaaaaataattttttctcattaagaattttaataaatttttaacatgcaaaaaagtttttcaattgtgtatttttgaattttctttgaaaatttaagctaaaaatattattttcttgattcatattaggctggaataaaaaactatggaaattcatacaaatccggtctctactcatagacaactgaaagcacataaattccaaattatttaaaaattgaagcaaaattcacataaaatattgttaaaaaagccacaaaaaccaaataaaatgtgttgtgtacattcattacatattcactcattgacaatcaaaagtttactttaattttggcgaaatgttctcagccaaacggccgaattcgactgaatttaaaaattcaataattttaaattaaaaatttgccgatgggtcaaactcaaaattaacaccgatggcccaatcaatcggaggatttaattgcacaaagtgagcccacctttcgcagcgtggaaaatttgtcgaatgcgtcgccggccatcactttttgggcgaacagccgatcattttccgtgtcggtgccctcgcgcttcagcgagtccaactcggcacggaaattggccaaacggtctcgcagcgactgattccgctcgttgtactcactcctggcaaaaaatagccaaacaaaaattaaaattattatgagaattttatatttgactaaatattcatgttttcccaacggtttttacactttgtgagaaaacgacttaaatcaatacactcactcaatgccaatgatccgttactcaaaaaggtcaaatgttttttttaattttaaaatttgccaatttttacggtaagtaaaaaatgattacaaaattttgatttaaagtgcaaaaacagtttgttactgttatagtataccacagtaacttttatgttccccacctggacatttccagctcagcgaaaatgtgctgcaattcggcggcgacggaagtgcgcgagtcggacattgtcgtggccatttcatattgacagccgccgaaatacaaaggcgccatttgctgaggcgaagtgacgacaatctgagaaaatatgaacttaacgaattttgaccgctataaaaaattataaattaaatataatttagatttatttttttttttgcaatttcacaatgataaatacccaaatttcgatttaaaaatggcactttttggccaatgcagaaaagcaggcgagtccgccgcttttattattatgatgtgaaaagtatttaccaagttgttgttgttgttgttattgggtgtggttgtcccgccgttgttcttcggcgattgtgccgtcgtcggtctgttcaatggcactgctgcggcgccgacaccattggccaatggcatttgctgctgctgcgtttgttgccgattctcgaccacttcttggtacggaggtggctgctgcatctgtgaagattccgatagaccacgtttaattgatcaaattcagtttgaggggtcattaattgtggctaatttgctttgcaatttgtgcccaaccacaaaaaacacctgttgctgctgttgttgttgctgcgcaactgttgccgtcccgggcgttgtgatgccattctgttgctgctgtttttgctgttgttggtgctgaagcgcagccattcgttgtgcggccatttcagtctcgcgcattttccgctccaacaacattttggtctcttccgcctgtttcggcatatttttcaacattggcaagcgaattgcgcctgaaatggcacaaccccacaaaccctcagctgggatagttttgcgcgttgcgcttccgcctcggcttcgctggcacgtcatgcccgctcaatgggctcctgctcggacagaatcgcccgatccgcgatca

SEQ ID NO: 10276 - DNA, 1907 bp, Heterodera glycines
aaaatcaggcgagtccgccgcttttattcttttgatgtgaaaagtatttaccaagttgttgttgttgttcttgttgttattgggtgtggttgtcccgccgttgttcttcggcgattgtgccgtcgtcggtctgttcaatggcactgctgcggcgccaacaccattggccaatggcatttgctgctgctgcgtttgttgccgattctcgaccacttcttggtacggaggtggctgctgcatctgtgaagattccgatagaccgcgtttaatcgatcaaattcagttttgaggggtcattaattgtggctaatttgctttgcaatttgtgcccaaccacaaaaaacacctgttgctgctgttgttgttgctgcgcaactgttgccgtcccgggcgttgtgatgccattctgttgctgctgctgtttttgctgttgttggtgctgaagcgcagccattcgttgtgcggccatttcagtctcgcgtattttccgctccaacaacattttggtctcttccgcctgtttcagcatatttttcaacattggcaagcgaattgcgcctgaaatggcacaaccccacaaaccctcagctgggatagttttgcgcgttgcgcttccgcctcggcttcgctggcacgacgtgcctgctcaatggcctcctgctcggaaagacgcgcccgttccgcgatcaacacttgcgtctcctcggcacttctgatcacattctgccaaattgggggggggggggggtgggagaaagcctttaaatttggctcctaaatttttaaattttaaagctcgatcacctgcatggcgctcaactgttccgacagatggttcagttctgcgcggtagcggtccctctcctgctccgcctgcgcgcgctgctcacgctcgcggtgcaaccgcacctgctcctcctgcaaaggtttaaaaaagtcatacaaaaaaaattaaaaaacccggatttaatcagggaactttttgttttatgagtttctgctatatcatttttattgcttgtacaataatcgcttatttgttagcaatagctaatcattaataaaattccaaatccaaatgaccactaaaccaatcaataaatgattagtgttttttatttgtcatttcccactgtcactttttgctgatcgactgttctctgatcagttttgtctttaccattctgcgccttcgctgctcgtctgcctgctgcttcatctgttgcacctcgagcaggtcgggctgtcgtctgcgcaggtaaaggttatgcgtgcccacacagaggtcgagaagtgactgaaacatggggagggcaaatatttaaccaagcttcttctgtgatcagctggtaattgttccaaattgatcataaattagttaaacttgaaattgaacaaaggcacaatatcccggggtattagggagtctcgaaattcagttcaattttcgtaaaaagtcgaaccaaagcccaagccgggacttttaccaggtcatgccgcctcctccccaatttataatagtttaaaaaaatgaaatattttatgaatcagtgcctgattgatggacatgtcctgtgccctgaacttgattttgcttttgtccgcagtgcaaatggtgaacattttgtttttgaacgaaatgcatttgatctctgtccatgggaagaattaaatcctccggttgattgggtaatcgatgtgaattttgagtttgattatcgcttttaatgcctataaaaattttgaacttaaatttaatcgaattcgtccatttggctgagaacacttcgccaaagttaaagtaaacttttggtgtgatctgaatgagtaaatgtataaaaacagaaaatgcaataacatagaaaaataaaccctaacataaggtcgacttttggaaaattcaaaaa

SEQ ID NO: 10277 - DNA, 292 bp, Heterodera glycines
ccccccccccccccgccccctcccatcgccacgcaatttccgctgtggtttaatttggtgggcaaaatgtgattcgaatgattaaatacaattctaaatgatgatgatgatgatcaattattattatttaatgtgttggggcgggtgaaaacggcgggagaacagcagaagaagaagaagcagcagcggaagaagaagacgaaggaggaagaggagaaggaagaggaggaagaaaggacgattctcccctgggggggggcacacattcgatggaatgtgggagttggggggg

SEQ ID NO: 10278 - DNA, 951 bp, Heterodera glycines
taacatttttccatggcgccgtcggaaaccctcccgccctctcccttgagatctcgattatcccttattcttgaactgcaaaaattgctgatctgtgaaccaattactaccattctctccccataaatcactctgatcattgaccgtctaatatcaaatttttgaatttatcaccaaacataatgccaaagtcgctgatcattgacaacaaatgccccattagagactagggatggaattccgatgcattaaaaatttcggaagtcggaattccgaccccaaaaatgtcgggactcggactccgtgccattccctggtagacacacgccttgttctcgttggtagcattcctcttctttacaatgcactctgttgttacatttcccatacacatcaacttggagcagttgttggagtcgggccgtcaacaggtcacgtcccgacggcacattgcaattggacacaaattggacagccgaacgcttcttcagcgccatacgcttttgaatctgggctttttttggaggaaaacaattagtcaattagttaattgctcctttattagtttgctgagtggctaattaaatgttgccaaaacaattttaaaattaaattttttattttgaattcggatagactgggtccgggtaccagaccggaatcaaacccgtatagccggctttttcaagacccggacccgattttttgaaaatcaaacacacgtacctgtgctggcccgtttgtttgggcttttttctccccacccccctagaaatttttaaaaattttacttacttagatatttttcaagaaaatattttagaaagttttttataagaaaattctaaaaaaagtgtttgagaaattttcagcgattttgtggaatttttttgaaaaatcttagtaattcaccataaaaatttctcaagaattattttttctttgaatttt

SEQ ID NO: 10279 - DNA, 1841 bp, Heterodera glycines
tcgctgacgcattttctgctggacaacaaatttggacactttgaccacctccgcttcggtccaaatgtattggggcaatgtttgagcagtgatcggtgccaacgcatcgtacggaatttgaatggtactgtcatttcggtaagtgatggaaatgttgaagaaatttgacggtattttgtcaaagttcacactgccaaggagcgggctctgtattatgggcggaaagaaagcaattaattaattaattggtgcaattaataaatgtgtcgtaaaaggcatagcccgcgaaggctcccggacaatccgtcattggtcaatccgtcagtggacaatccgtcagtaactaatccataaacaaatttatttttaaaacacccaatttatttaaaatcaactgacggattgtccattgctgacggattgtcctcaacatacgcattgaccaccgacggattgtccacttactgacggattgtccggaccccatcactgctttaggccaaaaattgcactaaactcgagaccaaataaacccgagaaatttgtcgactcgagactcttctctgtttgggtgtcatgatttttttagcaaatcggattgcttgaaaatttaaaaattgttgtttgtccgttttcaaaaatccataattacttcattacactaattacctcgtgggacatcataacatacagctaaacgaaggcaattaatattttatgtgcaaaaaaaaactaaaatcaattttcacctgatcagcccgacgatgtcgcggcaaatctctcaatatgtcaccagtgtgccagatcacaacagaagccgctttttcactgtgtttttattggcaataattaaagggcatttgtgcaaaaatcaaatttgcgaattttgagtcatttttaattatagagttataaaaactgtcggtgccgacagacggacaaaaccaaaattttgctattctgtttttacacagtacgagttgggtaatttagtagtgctgttcgagaacgaaaatttcccgagactcgagaccaagacttgaccccgagactcgagacccaaaaaacccgagactcgagaccaagacttggccccgagactcgagacccaaaaaacccaagactcgagaccaagacttggccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttggccccgagactcgagacccaaaaaacccgagactcgagaccaagacttgaccccgagactcgagacccaaaaaacccgagactcgagaccaagacttgaccccgagactcgagacccaaaaaacccgagactcgagaccaagacttgaccccgagactcgagaccaaaaaaacccgagactcgagacccaaaaaacccgagactcaagaccacgacttggccccgagactcgagacccaaaaaacccgagactcgagaccaagacttgaccccgagactcgagacccaaaaaacccgagactcgagaccaagacttgaccccgagactcgagaccacaaaaacccgagactcgagacccagacttgcccacaatcactcaacaccacttgaacccgagactcgagacccagacttgaccacaatactcaagaccactagaacccgagactcgagac

SEQ ID NO: 10280 - DNA, 1089 bp, Heterodera glycines
gacccaaaaaacccgggactcgagatcaagacttgccctcgagactcgagaccaaaaaaacccgagtctcgagaccaagacttgaccccgagactcgagacccaaaaaacccgagactcgagaccaagacttggccccgagactcgagacccaaaaaacccgagactcgagaccaagacttgaccccgagactcgagacccaaaaaacccgagactcgagaccaagacttgaccccgagactcgagatcaaaaaaacccgagactcgagaccaagacttgaccccgagactcgagaccaaaaaaacccgagacttttctcgagtcgaaactcgagaccgagagtctcgaacagcactataatttagtgcgagacgtggcaccactacgagttgggtttttatcccgacagacgacgcaggaaaaaaaaagattttttaaatttcttaaaaaatcagcaaaaaaaaaatttctattattttccccttttttctaaaaatgcatatttttattctgctgtctgctcacaagcttatgtcctccgtgtacacacagcggtatgaacagtttttgtccccgaattgtaagtcgacaaattcgaaaatgctcgaatgaaaaaagttgttccaggcgagaataattgggcgttcatccgccgacgcctgcaaaaatgatgaatgtttaaacataaagttgaatataatttgatgaaaattgtaatttaaattttttgaatgtacggtgtgtacagtaatccaccagggctggacgaaattcgtttcgtcctacatttttgaacacttttgagttacgttttcgtattttgttttcgtccgccaaaattttttcgttcgttttcggttttcaaaatttcatttttcgtatcgaatgtgctttttcttttcgttttcgtatacgattttttttgtttttttgtgattttcgcacagccctggacccagcaaatggtattcggatttcccgaaattgttttgttttataaacatcaattttatttccaatttgcctcacaacgggtgcctaaaacatctgcacgtggccttgtatcttaaagagggaatatattgact

SEQ ID NO: 10281 - DNA, 1046 bp, Heterodera glycines
tatttcatacctaaccgagcgattcaaacaacaacaacccctttaaataaatgtttaggcattcccggcacaacgggacaccttggcgagtccggctaccctggtcaacccggctttcccggcgagaagggcattcaaggcttgcccggccttcccgggctggagggcatgccaggatcgtctggtccgccaggtctacctggcttgccaggcccagccggaccaagcttcagagacggtaagtaaaattttaatattttcgttgaaaaataactttaaaaaaattttatatcgtaatcaaatgccaactaaaaattcaaagaatttgacagtttttgaaatcaaaataaaatattctaaaaaattcattgagaatcattagtaggtcaattatttttaaaacttttttggatcaaattttttcctacaaatttttttaaaataaattttaaaataaattcatctattattgtcattttgtaaggttttatcattgtcacccactcacaaactgctcaagtaccgcaatgtccacaagacacaacaaaactgtgggacggatattcactgctgtatttggaagggaacgaaaaggcccacaaccaagacttgggtatgataattaagaaataagcaattccctttaaatattaattaaacgaattaaggtcatgccggctcatgtttggcccgcttctccacaatgccattcctgttttgtgatttcaacgatgtttgcaagtgaacaaaagaaaattcttgaattttccaaaatttatatattatttaaattaaaaattaaaattatccagtaataattaaataaaattcctacggtaattgtttcaaattccagttacgcttcgcgcaacgacaaatcgtattggcttgccacgggagaagctgtacaaaataataaattatataaaattaatttcaattaaattgattttttacctctctttcagaatgacaatgatgccggtcaatgagcaacaaatgtaactgagaagtcgcgttgtgccgtttgtgaagcaccgtcaaat

SEQ ID NO: 10282 - DNA, 3149 bp, Heterodera glycines
taattttataatttactaaatttagctctcccggctctcgtttggaagatttccgaacaactccgttcattgagtgcaatggtgcccggggatcatggtgctagactttaaatttatcttatcattttttgaaaaattttcagccatttcttcgccaacaaattcagtttctggctgacaaccattgaggaccagcaacagtttactgtaaagctactgtatttttaaaaaattaccatttaatttattcgtaatttacggtttatccaccaaaattcctttaagatcccacaaagtcaaacactgaaggcgggcaatcaacgttctcggatttcgcgctgccaagtttgtaccaaaacaactcgataaacgccgtttcaccaaaattattattgttttttttctattaaattgtttttttaattttattaattgtcatactgccaaattcatccaatttcaaaaggcaccgaatcatatttttattgctccttcccttttttcattatatttcatttcactttttttgtgttagttttttgcaatgccttcttccatctcttcttgcctgaccttttattaaaatttgaaattaaaaaaaaagtaatttaattttatttgtttattttttcaaatacgccaacacttttgcccagactgtgtgtttatatgcacttttttcctttttttaaattttgccatttaatgatattttagtgctgccatttgcttttgtaaccaaaatgtgaatttcacaataaacattttgccaaaatttacaataaatgtcttttgttgcttgcttttttcaggctttattatagaagcgaaaagatcaacagtgaccctaaaaacctgccgtaaaaatgttaggaatttcgaattttttaatttcaaatttgggtcaagaaccctgctttacacttgttggcaactgctggaactgacctatttcctgggggttagctctaattttgattatttcatttcatgctgaagcagttatctaaatgcattcaatatttgaattcataattaattaacagcaaatttttttctggaacaaattcataaataaattctttttttattgttatttatggaaaaggcacgcgcacattcagggccatatatatttttttgttatattgatgacacaagttacaatagcttctcttattacgtaagaagaaattcttagccaacgagaaaatggggtcagggcaggtcatccacagacaactcatccacatttttctcggataaaaattcaaattaaatgatgcaaaatgccgatgaaaaataaaataaaattgataaaatctcgtttcgattggtgatgggcatggctgtgctgttttccaattatgacatgggtctatcattaaacccattggtttttgctagagatcggaccggtcggtttttttttccggttttttacggttttcggtttttgaccgaaaccgaccgaccgagaattttttgagtttttcggtttttttcggtttcggttttttccgtttttaaccgaaaccgaccgaccgaccttatttttaggggtaatccagcgcactgatttgtgagtactaatatggctttcttttggctcaatttcgagtccctgcccagattagaacatttttagaaaattaaaaaattttttttgcatttattgctaaagcattgactatttacaaactctcaaattcattatcgactcaaactatggcgggtttcatcaattttattttatttttcatcggcattttgcacccatttaattttaatttttatccgagaaaaatgtggatgagttgtctgtggatgggatgccttgtggacgacttgactgtggaaaagagcatggaaatggcagctgttgaaaaatatcctaaaaataataattttattaaaattgtttttcggagttacaagaattaattggttagatggtcagttctaaaaaggcataaattaatctaattttgtaaaaatatggctcaattatttgctattaaaacattttctttttttcatcggatatgcactcgattttcgtttgaatttttcaaagttcttgacacaacaataacagcagcagaagcattttgattggtttttggatgggcaaatgaaatttgaattcgaattgaccacaatttaatgacccaaccgaactcactcttcaagatatcacgatattctttgctaaaaaacctttatttattaaaaaaaagattttattattaattctaaatttgcctgcaaatatataggattggtgcattgatcgcccctgcaattgtgaccatttgtaccactaatcgtgtgatcagaaattgagatgacggatcacttgtgatcagtccgcgccccacaatgttaaccaccagacaactggtgaaccaaaggcaaaagatcactgccatgatcacagccaatgatttgaaaatgcgacgagtgatttcaatttgggactgtgaagaattgttgctgttgttctgatcacttctgatcactgagaaatgaaaagctattgttttaataatcaattgtaaaatagtcatttaaatttatgtattttaattatgtaattaaatttaccctttagcataatagccatgataatataaattacagttgtagccaaagtaaaaataaccacgataagagtagcgagcaaatacacttcaccttgcaccatatcaccaggctcacaatagaccatactatttaaatataaaaaatattattttcaattagttaattaattaattagttacatttcgggatgttgtagatcaaaagtaaacgacaaataaacaatataaaaagcgattgacatggaaaaaacattggctataatcacatattttccggaaaatcttgagatgttacgaaaacttaaagaaggttagattaatttcaagaataaaaatttataaaattacaaaacggggaatgccaatgccacaaaacgatcaatgcttatccaaaacagatttagtgcagaatttaaagatgaaagtggtgcaaagaattgtgcataaacacaagtcaacagaggaatccgtttgcgaagaaaaatgaggactaaaataaataaaaaattgaaaaaataataaaatattttattttttatttat

SEQ ID NO: 10283 - DNA, 1584 bp, Heterodera glycines
  misc_feature (13)..(13): n is a, c, g, or t
  misc_feature (38)..(38): n is a, c, g, or t
  misc_feature (1465)..(1465): n is a, c, g, or t
  misc_feature (1502)..(1502): n is a, c, g, or t
aatcagttcatanaatgccaattgatgtgtcatgaatntaagaggacgcggatgcccaaaaaacaaccattctttttctgcctttattattttaataattataggctgactgagaataaattttcccagtctcgagactcaagcctgagaattgatcacgagagtggagaatgagacgccatgaaccgggaacgagaagcaatcccgaatctcgacaaatttataattaggagctaattaggaacgtctctcgtctaatgctttggtgccttttttcatgcaacaaatgcgcaccttagcaaataaacaatgctttcgcctttatttggtaattcccttgtaaaaagtgcgcgaaggaacagcggcgcacggttttcgggttcgaattcgcccatgaaaaacacgaaatgtttgctcggatcaggccaattaatttcccatttttttctctgaaataacaaatttagattgtaattaatttaaatgtttttcactaaataaatttaatttttaaagaaattcccttaaattagtgttgttgaattttgctcacccttttcagtccgcctaatttgtctgtggacgtgacggttacggtaagtttttctacggtgtcactgcgttccaatggcaattcgacggtgaaagagccgtcctcccctctcgtcaccgtttccttcgcctttggaatgccgtcgtcatagtcaatttgcacttcgaattgatttgtcgcgccaattaccgccccgtcgaaattgaattttgtaattattttttcaattttcttcttctttttgccatatgtaaatgacggaagtgaaaggactgcttggagcagtaacagaaccaaaagaagatgaaccgaagacattttcaaacgaaaaatttattctaaaaagaatcgaaaagcaataaacaatttgatatatattgtgggatgttttgctgacaaatgagcaaataaagaaaacgctatttgcttgttgttttagctttctctgtatgttacacataaaaagcaaattaaacataattattcttttgtcgggcaattttcagaaaataaaactaaaatagggtgctgtgtcgaagcattcgccgaatcggtggccaatgtccgcgtgctgtcctggattttgttgggcacgttgcatgcccgtggcaatggcactgtcaacgcaatttgcagctccgtttcgggcccaaaccaatgtttgcccgtgccgatcgcttgttcgggtcagatggccgattacatccattttgtgttggccgggttcgcagatcagtcgaaagtccgccggaacttttgttcgctattggtcaatgttttgcttttctcagcaatccgtcgttcatatgtccgcccttttccatgcgtttcatttatgccaactttggacaatttactgtgaacagaccgccgccacttgtcgctcggaagagacccttcaaaggacgatgncacaaattttggacttttgggcacgcgtcaccccggncattcttcagctgctgtcccactccaaagtggtcagttttctgcttctaattaccttctgatcatctttttaatccgctcat

SEQ ID NO: 10284 - DNA, 3508 bp, Heterodera glycines
  misc_feature (3447)..(3447): n is a, c, g, or t
  misc_feature (3469)..(3469): n is a, c, g, or t
taatttttcatttttctgaaaatttaatgggtttcattaagctacaaaaagttattgcagaaataaattagaaatgagaaaaagcgattttttgacagttcaattcgggctcaccaaaggtgagggcttttaacacaattaattgttgaggggaaatgggcgaaatttcaaaatggaggtcttaaggctttttgaaggtttttcagacgtcgccgatttgtccatgcgccgattgtccaccattggatttatatggttgtctcaattattatttttggatactttgtaaaatttgtaaaatgagcaaatgtttaaaaaacgagagaggtaaaaataaaatgaaaaagacacgcatttaataaaaagccatcatgagaattaataggcgtatctattgattaattaattgagggaaaaaaatattttagatttttattgtaataatttaaattttttatactttaaatgtaattttatctcactttttactgttttattccaacggaccatcactgggcgaaacttcggcttcgagtgttaagccgagcttcgccagaaagaaaacgaccgaagaatttttattattaggtttgtattttatggaaatgcataaatttcctatttcccctggactatgtgaggtttgaaacacacgaaaaacatgtttagcttgtttttaaggtttagcatggatttgctatatccgcattttccaaatttaaaattcttcgcagttacattaaagacaaccttaagcccaaaagtgaaaaatttcgccttttaggtcgtttattttattaattgattatgtgttttccaacatatttagccattttcgaaagttttaacttccattttttaatatgaagaggttttggaaaatttgcctacaatttggtaaatttatttccatttttttgcaattttgcgtccttatttcggaagttttagcaattttatggatatttttcgcgattttattgcaccattcgctttctctgatcgagagaatccaatataacaaatcaaagttgggaatattcttcaattattatttccaataatcctttcactgctctaatgaatatttaaaataattacattaagtcaaatgcccaaagacaatgcaacggtttatttgaatttgatatttttcatcggcgaagaacatgaaaaacaaaggaaaaagtttttggtggaaccaaaaggttcaaatgggttcatctgctgctctgtcacagccgttaattgctttgttttatgcctaaggaacatttttctgctggtgaaaagcgacggacgcggtctcacccaaacgcaaagggttaatagcgcaattagtggggagaggggggggggggggtataaaagaggctaatgacactcactcgcgaacccaaactaaattaggcgttaattagcttttggttatgattatatacattcctatatatatgataacaacttgctaataaaaaataaaaatatttaattttaaaacatgggataatcagtgatcgcaaatgctcttaactcatttgaaaactcattaatttatagctgcgtaataattattcaaaattaactgccttggtaattttagcctcatgagcattgagttggaagggcgcaacagcgcttaccgtttcgtcgcttatgcggccgtttgcttctccgtggtggaggcgatcaatgagtgcgttacactgcccatggagtacaactacggacaccacgtgcggcgtaccatgcaggaagagattaattattgtaaggtgattcttagattttattcttttgtatgtgcggccaaatgccattggttggtcaaaattcccaacggagggacgaatagacatcatttgtatgattcgttaaatggccaaatgctggcgattcaaaagtggcatggtttggtattgaccaaatggataatagagaatggccaaatgttagccatttcgagttggggatgacaagcgggatgagtctcgttttcacttatctctttaacattgaaaattttgaagagctcggcccgtgacatttggatggaggtcaaccaaatccgcaacattccgtcagcgtttaacggcaatcggaccgcgcgtgcgtctggttatgctagcggaggcggcggaggcggtggcggatacgcttccagcggaggaagcgggggtggaggcggtggcggatacgcttccagcggaggaagcgggggtggagctggtggatatgcatcagcgacgagtggcaccagcggaggcggcggcggaggctgtcaaccgtgctgtaaccctggcccgccaggcccacctggcacgtctggacgaccgggacgccccggaaagcctggctcaaacggcatgccaggaggcccaggcaagccgccgtcccagccttgcgagtccgtcacgccggttcgttatgcgcgctttgattgcgtagcaaatgttattatgctttttcccatttagcctccttgtaagccttgcccaggtggacctcctgggccgccaggaccacccggacctcccggcgacggtggaggacccggacagcccggccagcctggcagtgactcgggtgcaggttctcctggcccaaagggcccgcctggcccacctggtcagcctggacagcccggctctcctggagagcccggccaacctgcgcagtcacagcccatcattcctggcccgccaggaccaccgggtaaccaaactatattttttgaatcatttattctaaatgctcttttaggtgattctggaccccctggacctcctggtcctcccggaaaccctggcactgatggaggcgctggtcagcctggccccaagggaccgcccggaccaccgggaccgcctggcaacgacggccaaccgggctcgcccggccagccgggacaaccgggcggacagggcgagaagggcatttgccccaaatactgtgccaacgatggcggcgtgttctttgaagacggcacacgacgagcataaaaagacgaaattcataaatgttaaatgaaaaaatgaagagaaaaatatgaaattggaaataaatgaattgaaaggacaacaattatttaaataaatgttaatattaatagtgttgtgtctcattcattgtcagaagaatattggggaagaatgccctgaaaagtaagctaattttttctttttaagctttttcatgtaaactgctgacagctttttggcagtaaactttttttagctgagacaagacaaagaagcttgatatcgttcaaaataattcatcccattcagttgccaataaaacagaaaaatttatggctattttctaaaagaaactcttagtgatcgaataatatcgaaaattaaaaattttggttgtttttgggtaatgttatggatacaaaattaactaatgtttattccctattaatatatacaaccttactanaattgcaaaaccatattatagngccagggttttcgatatctgaggatttttcctcattttg

SEQ ID NO: 10285 - DNA, 920 bp, Heterodera glycines
  misc_feature (854)..(854): n is a, c, g, or t
tgattttgctcgcaattttatgatgttttaaaaaatgaggatttttcattccaaatgaggatttttttgagatattttagtggcagatgaggattttttatggctgaaatgaggattttcaaaattttgagatcgaaaccctgttataggcactatcatgcatggataaaattgtgaggtggcacaataggtaccacaaaatttccttgcaattttcaaggaaatttaatagaaaaaaccaatttaactttttgtcgctgtctaatgagttcaaaatgtcccttatgaaaatataaagatattaatgaacaaacattttctataatttggctagaaacgcgtcgtcacaataaaaaatatatattcaataaccagggaacggatttatatgtttttttgcgcatatgccatcgcatgaaaagctcaaaaatagcatttttacctgttttcctttcaattagagcgagtttttagcatgtataaaaacatattttgagcttttggcgaataaaaacatatttttatggtttgacagtttttagcacatattttggcgattttttaaaatattttgaatttttttttaagaaaattccttttttggcacccaaattcttggtaaaattaaagttttcaaaattttttattttttttattttttgacctttttcatgatttttttatttttatggcaaaatttaacttttaaagaaaaaaatccgaaaataagcattttgctagtgaaatggatgaaaatgagacttttatgcaaaattcatgtatttattaagcagtttttttcagtttttggcaaatattttggcttttttgggggtttttagcacatattttgngggttttttttggcacatatatatgtacatatttggcgttttttagcacatataaatcgttccctg

SEQ ID NO: 10286 - DNA, 1505 bp, Heterodera glycines
attgaaactccgtgagtttttaaagaaaccggaatatcccccccccgcccttttaaaatattaatagaaaaattcgtattttaatgagaatttcttgttgagatatgttaattaattattattaagaacacaactattgtgttttttttatttgaaggtaaaaaacacattttgaggtaagtatttttttatgtgactattttagataaaagccaaaaaaagcccaaaaaaaaaaaaaaatttagcaacaaataaaatcatttaaatgtttgtaatatgagagaatgcaaattgagtcccctcctaatttggggctcaccagactgaaatgggccaatcccgcttgtacttcccggttcaggtcagatcagcaccaaattgttcagtcggctcactctttggctgctccgttatggtcgttgggctttggtcggctttatggaggtccaaaatccgattgagaaatttgctaaatgggaaaaaaataaattaaggacaattgaacagagaaattttaataattttctaaaaaatatttgaattgtatgttaatttaaattagaaaaaagaatttatttttataattttgataattcatttttttaattattttaagcgtttcaccctgcgtaaaacaattccatacagcgaatgtacgcgtcctgaacattgctaacatctacaaaatagaaaaaaaataataattttaatgaaaattaaaatcattttttaatttcatgcaaaataaacgaattttgaagaaaaattcgcttgaaagcaatatttaaataaatataaagttgacaactcattaaatttaaattgatttcaaccggcaagagaatgtgtcgcaacagcttggatgggataatcgcgttgatttgtacatattttttgcagccctacaactcagtattgagttacatcattttttaaattcaaaaacttgtccaaaaaaaaaaatttaaagacggttattaagaaaaattttcatttcttaggaggtttattttcagaaattttttggtcgattcttaggggtgtatttttaaaattcccaaaaaatcgcttcttagaggtgttttttcgtttttattgcatttttgttaataatttggcaaaacgccaaaataggcaaaaataggctctttcaaaaatttttaggctttttaggcgctaaaaataaaagcctagaaaataggcactaataactcgaaaagtaccttaacaacaaccaaaaaaacttgattttcgtgcgtttcaaaaatagtttttttgtcgaaaattgaattttcaaatatgtcgaccgacgaaaagtgtaaatttggttcgtaccgccgttttcgtacggggaacattttcgtacgagttcttgtacaagcgtcagattcaaatagaaaaacttaagaactaataaagccaaaatttatcattttttgtttcccattcataaaattttgtagaaaattcataactttataataataacaaaatccgggacaaac

SEQ ID NO: 10287 - DNA, 1246 bp, Heterodera glycines
tacaaaaagtggtccaaatatgtacataaatatgtaagaaaattcccaaaatatgtacaaaaaaccccaaatatgtaaataaaattttttttaatggtattttttgggaaagaaaatccccgtaaagtatgaaatagccacaaaatgacacaaaaattactttttttggtatttttaggcaacattttcaaacttattttttctttataaatcttcaaaatatgtaaaaaaatgaaaatatgtacaaaaatatttaccgaaattttggatttttttttgaggatttccaaaattttccgtaaaaaatactcaaaatatgtaaaaaaaaaatggaaatatatatgaaaaaaatccaaaatatgtacaaatatgtaagaaaatcccgaaatatataaaaatatgtaaataaaagtcccaacttttgttcgcaaacacaaaaaagaaagtgtttttcctgctatttagagcaaggagaagccaggaaaaaaatatgtatttacataaaattggcagccctaataatgacattagaatcgaaaaattttaatgcagaaatgcgttttttgagctcctttcttcaaaacaattgagcaaaaaaaaaagttttttttcactaaaagttgcttccctattgattagataagaggaatgcatagttgacgaaaaaatttttgggtgaaaagagaggagcatttgttattacttttttatgatttttaggagcctaattctttctttgtaatttaaagaaaatgaaatttaatctttataaattaactagcaaaagaaaataacaaataaacttaattttttggtattaaattataaaatatatccatatttatttgtaaagaaatttatgaataaatttttaaaaaattaaagatataattttatccatcaatcaaatcccaggaattatttgcatacagatttttagaattaacgaaaaacaatatgaataattttgatttttttgaatttcctacagtatcatttcctttggtatttttaaagtaaatcaaaaacgtgcggctgcttttgcttcttgtctttattattgccgccccacaatgagctaaacgttttcgccaattttcatttttcgtgtaatttttctcaaagaacattacaaattcgcctgtctcaagttgaccatgttttttgtcttattttgacgtactatttctttatctgagaaaacccgaatttacgtgatgtctaatttttttctatttgttaaatt

SEQ ID NO: 10288 - DNA, 1197 bp, Heterodera glycines
tttaacagaatttgtccacaaaaatggccaaattttgcaattttaagcaaaaattttaagaaaataaaggatttagcggtgccgataggcgccttcgggggaaaaattgaggattttgaccatatttttagcagattttcattaaaaaaattcttaattttgtggttttttgtaaaaaaattattctattttcgttttgatgctctattacaaacccaaattttaaataattgtaaaacattgtgccaattaataaaatttaaaaatctgacaaattttcaccagtgtggcgaagtgacaaaaataccagtgtgggcgaagtgacaaaaatatcagtgagagactttcagaggggtggggtcatttcagtacggaagagttgttctaatgatcaattaattatttaaacttttaatctattaattagatgtgttagcataattataattatatttggctctatttcagtttacaggaccacaaaaaaagacacgacatgttatattttggtaaatttcatgcaacataactttttatagaagcacccaaattaaacattcttggtaagttttgattagagatcggaccggtcggttttttttcggtatttttcgattttcggtttcggtttttaaccgaaaaaaaccgaccgagaaattttgagtttttcggtttttttcggtttcggtttttttcggttttttaaccgaaaccgttcgaccgaaataattaaaaaaccgaaacaatcgaccgacttttttgacaaatcagttggccatttttttaacaaaattcattaaaaattcttaaaaattttcctctggcggcgcctatcggcaccggccgaccccccaaaaagctatcttttcttaaagaattagccaaaatctcaaattttggtatttttagacaaaatctgctaacaaatagcattaaaattacaaaaaatttcccggcggctcttatcagcacaaccggccctaaagttatggattgagctcacaattaaggcaccaaaaaggcgcaaaatggcactgaaaaaaggcacaaaaatcccgaaaaaggcatgaaaaaagcatttaaattttttattaatgatttttagggagcaaaatacgtaagtagtataagaccccgttttggtggccatctgagcgccgggacatttcagtcccagcgctctggccggccatttga

SEQ ID NO: 10289 - DNA, 1829 bp, Heterodera glycines
  misc_feature (176)..(176): n is a, c, g, or t
aatcctacaatccctttcaaaatttaaactttcacacattattctcacacaggcacagattagaacccgcaagaggcagcgtagcctaaggcactaaccattaggccgcatgtgaacagaaatggcttgtttaattttgattatttattgtaaaaagaaaaaattacaatttcttntaattagcaaaattacacgaatatattatcacattcattttttcttttttcgggccaatcgttcagactaaacacttttctttttaactttttattttaaagcaatacccgtcgcactgttttccaagtattcggcttcacacattccggctgatcaaccggttggtcatgaagagaccgaatttttcaacgcaaaaatgataattaagcacgaaataataagcatgagaatgacaaaataagcacaaaaaattgaaaaaaagcacaaaatttggtgattttttggctaacaatttttattagttaacagtaaattctcatttttcttttagcactgacaattcattcgtaacaaaagtttaaaattaaaaatattgtaaaaaaagattttgatgatgaattttgagaaaattttccatttcttagggtcgtatttttcgttttattgcttgtagtcggtgttttagtcaaaattttacaaaaaatgtcaattaaacgcaaaaacaagcactaaaatgctaaataaaattcggtctctagttatcagcaaactcaaacaggaccgttttaaagttgatcaaaacggtccttaatgacaaattatcagaacactcttttcagtctgatcagcgttgcagcgcgatttaatgggaacatggacctgcggcgccgacaggcgccacagggaaaaattgggaattttcttaaaactttgggtttttgttggcttttttcacaaaaatggccatttttgagggtgttcacaaaaatcaacaaaatgaatttctttattcaaatcctacaattttgaaataaataatctcatgtttttttgcagagaaatatttttgccaccgttgcgacaaagtatttgttcatacttcctcgtaccgagtaatttttaattatttagcattaatccttatatgtaatttaaccaaaatttaagcgccattactactcggtccatttttcgggattgccgtacaagtgcagtttttgcagcagccaataaaatattttatataataatattaccatcagcaacaaatatgaaaattaatatttgcaattattttgctaaacttcttctttaagaaacaagaaattgaaagaatgttgaagtaataaaccggtagaaagaataaaaaaactgttaaagtaatggcaatacacttatgaattgtgatcccatgtattgcttttttttgctgctgtgttgatttattttcaatgattttgggcacagtgaaaaacagttccgtgtgcgcctaatattcaacggttatttaaattttgaattttaaaccatctgacgaacgacgagcgttcacaagctgatggataaagtgcatcaaattgcaagacaaaaacattgaattacaactacaaaacaacaatgcattacgggaacacatcgagatacagcagaatactgaatcatttgtgaaagaaaagagagatttggaggaagaaatattaaggatgcacggatcagaaaacagggaccaaggaagtatttgcgctttgtgctatgtcaaacaggtcacaataataataaatattaaaaacaaaagaataattttggctactttagcgcaattatgtttatatttccttgtggtcactttgcgctttgtacccgatgcgctg

SEQ ID NO: 10290 - DNA, 731 bp, Heterodera glycines
actaagtctgagacaatttttattaattttcggaatctttcgttcgaattcgggtccggggttagtgtcgaagtttggtgcgacattttgtcctgctcccagcggcggacggaacagctcaccgaacgcgctgcggacaagcgacggcgtgaagcagtcctcctcgtccttgtcctggtcgctgtttgggtggtgcccggcgtgacgatgtccacagtcatttcggccaaattgtagacggattggtatacagaagacagaagcagggatacggagctaaaatgtaatgcagaattgatatatggtaaatacaaattattgtgccaaaaagtcgggaatagttcgacaacaaattttcggcatttttacatgaggtgaaatttcgaatttcgcatttttcatctcaaaggcatttttccagtgagtccctctattagaacgggccaccaccagataaattggcctttttgatcacaaaaaaccgaaaaaatttccgaaaaattattgtttagtaaaattctctcgagaatattgaagaaattttaattttctcgagattattaactaaattttaaattttcaagaaatccaaatccgatgtgacgacaaaaaatgaaaaaaattggaaatgatgatggtcatcggctgacgcaaggcggaaaaaaaaaattacgaaagtgaattgtaagtgtgggaattggccgaaaatttcgttccttttatactgccaa

SEQ ID NO: 10291 - DNA, 2056 bp, Heterodera glycines
  misc_feature (198)..(198): n is a, c, g, or t
ttttttatgcacaaaaaatcgcgaaataggcacctaaaaaggcataaaaaaatcgcaaaataggcaaataaaattttttattaacgttttagggtaacaaaacacgtaaaaacttaaatatttcaattgtaaatgaaattattaaatattttcaagtttttttcgaatatgaacaaatttttaaaccaaaaaattttnaataagaaaaaatatttaattttgggatcaatttttttgaaaatttttttcaattcttaagggtgtattttctgaaattttttttgggtcatttcttaggggtgttttcgtctttattgcatttttgttaaagattttttcgaaaatccttaaataggcactttggcacaaaaaccccgaaataggcaaaaataggcattataaaagtcatcgtagacaccccaaaccaagcggaaaacgcgtttttcgtgcttatctgtgcgtatcaagtgcgcaaaaattttaggcatttgcctaaaaaagaagccctacttattaacatataaataaaattttgtacgtttcagaggcactttcttaaaaaatatttataaattaattttgcaaaaactaaataacgaaaactcagaattttgaaaattttttaaaaaccactaagcgttgaaatttgtcaggttaagttagtactgtaccggggagtatgcctgcaaaatctggtgaaattttattaatcatagaaagagttattcaaaattaattaattaatttttaaaaatttgatcatcctccacaactgatttgtaattgatcagaagctcaccaaattttgcagggataaatgaccaaatttgtgattttgagccaatttgtttacgtaattttttaaatccaattttaatttaaataaaaaaaaagaagcaaagatggcaaatattttaatgagagagagagagagagagagaattaatttaatttagcatttaatgagacaaaacaacaaaagaaaatccatggaaattaaattcaaaaatgcattaaatgtgtatagaatgtacgggacgaagtgctgtgatgaaaatgagagagagatataaggcgacaaaaggtcaaaatgagaagcaacaaaacatttaaatagtgtcaatgaaaaagaaaaatggccaaaaacaaaatgtgccgttcgctatgatgatgatgagatgtcctagtaatcgtaggccttgccaacgctcttcttcaggatcaccttgcccacgtgttgcaacagcagcgacaccaactcgtcactgcgctcgctccacaacagtgccacctgttggaatatggaaaaaatttaataaataattttaaaaaatcgccggaaaattttttccaattttttttttgtgtttaaattggaagctccactaaaattctgggagcaaaaattcctcatcctcctatttttcctagtgaaattgaaatccaaaattaataataaatgctcgccggacgcaagccaccccaaccgaaaaacgcacatcctgcttggacactttgatggccttgatgttcggacaattgacggtgatgaatgcgagcaggtcggcagcggacggaaacgccttacgataatcgccattcgtactcagtcgggccaacgttttgtcaaactcaatgtgctacaaaaacgggcaaaagtgttcattaatgggcgcaaaaaaaccgaaagtgaaaattcgttaaaatttttaaaaattaaaaaaataaggcatcccccactcaatttgcatttcgatttatttgtctccaatgtaagcctactggcaacacttaaaagctcgtgccaaatttcaaggcatttgttcgtttaaaaaaaaatgagttttgggactggatattattaatattgtagcccggtgctgaactgtgcggtttacggaaaaatcgcattccctaaatgactaagggattatgctttgatttcattagttgggtagaacccacattgacattctgcaacatgcccatgacgacactgaactgtccaacgtatttgttgcgctcatcctcggaaaactgtggggagggggggggg

SEQ ID NO: 10292 - DNA, 727 bp, Heterodera glycines
tcggaaaaattcaccaaaaaatggccaatttttggtgaattttgagccaatttttaaagaaaaattgcgggttttggggtccggcggtgccgataggcgccgccggggaaaatttttggggtttttaatgaatttgttaagaaaatttccaaaatttgcgacccccaactcgccgcgaaccccctcccccacctaaaaattgtatggtcacaaccgatcatcataacaacaacacacctttttgctcttggccgccaatttgctgctggtggtgctgcccgcgctaaacaaaacattgtcaactgtgaatgtcgtttggccatttttctgttttgtgtcccatatattccggcttttatgggtgttttttaacatggaaaattcaattgtttttttaaaattttaatacagcaacattattatttttttgtctataagtgcgaccccattggacaccaccgtatgctaacattctacaacattatttgtacagcaggaagtacggacaattgctggtagaactgctccgtctcctcgtcctgcaactcctccggcgaggttgtgtcatggtggtgggcgccgtcgtccaactccccgtcgttgtcctcctcgccctcctttttctgggtcatcatcatcatcggtccctcctcctcctcctcttcgtcatattcctcctcctcttgatctaatgccattttgtcattgatgcccttccccttttgcc

SEQ ID NO: 10293 - DNA, 1211 bp, Heterodera glycines
cgcgaatattcaaaagtttccttattaatttaattttctcctcagaaatatatttattgttaaacaagttttcgatgactggagaaaatcccataaataaaattaacaaaaacgtatactgtatataaatagaaactagcgggtgcgtgaaccgtcggctatttcgctggcaaaaagcgcttcgcgctttgggagcttcgctacctaggcctgatcatgacttatagggtgagaaggttcaaagaggtacaacagtgattaaaaaggtacaaatgtgattagaagaggtacaacaaatgttagaagaggtacaacaaatgttagaagaggtacaacagtgattaaaagagctacaacaaatgttagaagaggtacaacggtgattaaaaaggtacaaatgtgattagaagaagtacaaaagtgattagaagaggtacatcagtgattagaagaggtacaactgtgattagaagaggtacatcagtgattagaagaggtacatcagtgattagaagaggtacaactgtgattaagaggtacatcagtgattagaagaggtacaacagtgattaaaaaggtacaaaagtgattaaaagaggtacaacggtgattaaaagaggtacaaaagtgattagaagaggtacaacaaatgttagaagaggtacaacagtgattaaaagagctacaacaaatgttagaagaggtacaacggtgattaaaaaggtacaaatgtgattagaagaagtacaaaagtgattagaagaggtacatcagtgattagaagaggtacaactgtgattagaagaggtacatcagtgattagaagaggtacatcggtgattagaagaggtacaactgtgattagaagaggtacatcagtgattagaagaggtacaactgtgattagaagaggtacaactgtgattagaagaggtacaactgtgattagaagaggtacatcagtgattagaagaggtacaactgtgattagaagaggtacatcagtgattagaagaggtacaactgtgattagaagaggtacatcagtgattaggagaggtacaactgtgattagaagaggtacaactgtgattagaagaggtacatcagtgattagaagaggtacaactgagagtagaagaggtacatcagtgattagaagaggtacatctagagtagaagaggtacaactgtgattagaagaggtacaa

SEQ ID NO: 10294 - DNA, 3034 bp, Heterodera glycines
ttttaatgctcatttaattcttctccaaatcgtttcttccattttgaaaaggtcgattgattaattttcagtatttttgcaattttctcgtcactcatttttggattttctccttttatttgccaatattttttcatttttttcattttttctttctccgatattctttttccactcaatccaaattgtttcttccattgtccaattactctatgacttactccaattttcttcccaatttcggcataatttttcttccattcttttgtcgaatattttcttcctttttctttatattcatttttcattgcaataaatttttgcacaatttcaattttttgttcatccgtttttgatttataacatttgtttttttggagaccaaattctttgatccattggtaaattttgtctcgatttgttcccaatttttttccgattttttcttcaagtttattccattcattttttgaatattttcttcccttttgtaagattttctcttttattttattgaatttcgtaacagtttcccgctttttctgatcattttcattttgatcatttcgtttttcttctttttcttcccatttttctccaaatattttgtcaaatgttttttgttccgcttttttcttttccgctccaatttcaattttaacaattaaaaatacaattgaaaagattaatagacataatttcattgctgaattgatataaataattatataaatatttctaaaaaattatttttaatatttttttcatataatttctacattttaatgtaaaatattgacatatttaatatattcattaaattataaaaattgataatttctctctctacttattggtcgcaataataaaataataatatgataaaacattttcgcgattaattaaaattccaatcctactgatcataaaaactcagatatttttatttaattttttttaaagttttcccttaagcacattgccaaaagtatctggaaagccgtgtttaaaacggatacccgtgaactttggcatttatccaaatcatttgatggcgccgggaagatcaattttaagcctccaaaaaaaataatgatttggatttctgtggtaattttaatcattttcattgttgttcctattcatttggccagtgctaccaatgaaatagctgagcagcatataaaaatacacctggttcattagaccactccttgatgttggtctgaaaacccgaaaatggaaaaatcgtgaaacgcggcacatttacttaaatccgccggcttaattgcacccttttttaagaaacggttcagctccctgtcgaccagtgtgtcatggagtatttgtttttatattctaaatatgtataaaaatcaaatcatttatttttcatatagaaaaaagtaacaatggaacgtaagttatcacttttttgatcctcatttaattcttctcttaattgcttggattttctcctttaatttgcaatgaatttgtttcattattctctgactcatgccaaattgtttcttccatttttgaattgttccataacctattccaattccattttgatcatttcttttttcttcccatttttccccaaatatttggtcaaatcttttttgctgaaatttttcttttctgattaaacttttttatttagcaattaaaaatacaattgaaaagaataataggcacaatttcattgttgacatttatttgcaaaaatttcggttttacagaaaataaaggaataataattaatatttcttaaaaatgaattttatattttcgcttataaattctttattttaattaaattattgacatgtttattactgttaaggatcgaacaatttgaatgtttttaatattgacacgattccctgtgtcataattggaaatgtttatttaaatggacccgttcagtcattcgggtcacttgccgttctctccttcatttccatttattgattgtctttcctccgtcatttatttatttgttatttatcattttatttttctgtttgtctttgcttttaataaattgtgtaagcaagagacataacaattacattcagaaaacatacgtattatacaattttgctctataaacgctttcactttttctatacaaatttctcctggtgcactatagtcaaattacaaaaaatttatttatttttttacacagtaatgaatacaattagaaaaatatgttatggtcaatactgaaaaaatacataaaataaaataaaaaagggatgaactaccactctggacttattttatgaaaaaaattctttcacaagatttttaaatttagctaaacttccgatttccatagctgttttgggtaagcaattccacgcattgattgtacgaataaaaaagttattctgagatttattactgcatcttttgttttgaagcctaaatgtttttcgttgcgattttgatgaaaattcgaatttaggctttaatttaattaaattttaacatagttataatttaaaaattgataaaaaaaatttgaaaaccagatttttgaattttgcactttttaggaatcgacaaaccaggcaaaatgacaccaaaaacttattgattgactaattagacggaaagacacagtttgacaaatctaaactactaaaaacggtcattacctttgggacactctagtatttatatatatgtaccttaaagcccggaattttgaacaaaaaaatttggaaccgaatccaatgctgcaattttcgcgtcactcattttttggttttctcctttcatttgccaatatttttcaattttttctttctccgttaatttttcatatataccaaaaattgcttcttccatttttcaattactctacgattaactccaattttcttcccaatttcttcataaatttggtgccattcttttgttgaatattttctctctttttgcttgattttctctttaatttggttgaatttttcaacaatttctctctttttctgatcattttcattttgtcatt

SEQ ID NO: 10295 - DNA, 1287 bp, Heterodera glycines
agaggggcgaatttgtagaatggaattaagctggggggaacattacaatcaacatttttctggaaagaatttggcaaaatttggcaatttgatcaaatgagggattttttgagacaatataagagattttttggcggattatttctgctttctcgccggcttgatgcatcacttgggtcgaaagagttgaccacctaaatgcgtaatcctaaaaaagcctaatgtttcacataattttttcactgcatcgaaattctgccaataaaacgatacggcttgaagccaggtcccccatctcgttaaaacggcctttgaaggcattgcgaaatcctgaaacattcggtggtaaatgttcgtacgttgaggtgctttgacaaaaacggccttcgtcttcgcgattaatttgtcggcctttttgaattcatctcgcactttctctgcaacacggcataacgcatgatttttacgggattcccattcgggactcccgtcccggaaaattttgaactcccgctcccggaattctgtgtggcaggatttggcatacattcgatcaaattttgggcgcttgagtcaggcaatcacaaagttggaaactcaaggccttaccattcaagagtcgttataaatttttacatatttttcacttattatgtgcatattttgccatttttggtgcatattttatgcggatattttacgactttatgggcattataacagattttcaataaaaaattattaattttacaaaaaaaactcaattcttaccagtgcatttttactcccgttttttgggtaaaatttccgggagcgggagcgggagttcaaaattttccgggacgggagtcccgaacggaatccctaaaaatcccgccgggcaaaaaagtgcgggagtcgggagcgggactcccgtaaactcccgcgggagtcccgattcgccggtctctactgtggattgtgtacgaataaatggtgaatcagtggtggtgagttggtcggcaggtggcccatttgagcgctgccaaatgggtgtcaatgccaatttgtaagccaacgccatcacaaatatgggaattgaatgattagcagaaagtgacgatggccccgtagaaatgagtgagtggggttgaaaaggccatgcggcacctgagcgccgccaatgactgccaatttataatgtcacaggtcgaaatttgggggattgaatagttgcaaagctgcgctaaatgagtgccactctagaagaactaaaggccaacatagacagaaaggattgagggactg

SEQ ID NO: 10296 - DNA, 1006 bp, Heterodera glycines
ctgcacacgaaatttcggctgtcattgcccctattttagtatttgcaaacgtttgactcgatgtatttattttttaaaattaaataataatttataatttcattttataaataaaattacttattttttgcttctcttccgccatcactgaacataaagcaccgaaaaagggattttctttgctaaaaaatttagatttaaaaatgaaaattttaagcaaaatcccaatttgtctttacataattggcatcagttcggtgccgtaatgcgctgcaccggcgtcatttgaacacaataaacgcaaatggttaaaaagctgatcaaagtttgtgcaaaatttgctgctactgatcatcgtggataaaaatgcttaaattatattataatttgttactttcaatttaatttaaattaaattaatttaagttaataattttaaaacaagcgaaaagttcacaaggaatgaatgaattatcatttgcttcacattgaatatttttaaatgcatctgtgagataatttcaaatttttgtgtttatcagctatcagatgaaaactgaagaaagcaacaaaataaatttttttataaattaaaaaaataaccgaaacattcattggacaaattggccaaataaatgactgataaacgaacagcgaaatttcaaataaccttttttaaatgaatttttcttcaataaatttcaaaaaatttaatggaaaactttcggatgattttataaagaaaataaataaaaaccaaattttctttaaaaaaaaaattcaacaagtgcaggaggcgcagcgtgccaccctcgcgttgcacggcagccaaataatgcgtggcgctagcggccggcagcgctcggtgatcggatatttgaaattgtgggacaaataagaaactgataaccagggaacggattttaggtgctaaaaaccgcgaaataggtacctaaatagttgctaaaaaactgccaaaaaatggaaaaacatgtcaagaaatgcg

SEQ ID NO: 10297 - DNA, 3214 bp, Heterodera glycines
  misc_feature (2708)..(2708): n is a, c, g, or t
attatatatatatatatatatatatatatatatatatatatatatattatatatataagatgattctctcacaattaatcaaattgaatttataattattccagaaaaatatcgtcgccacctcatttaagagtacttttgatgtaaataatattaatcctgctgcttttcagtttcgaatccaccaacaatgtgcttggatttgaattatttgaaaaaatagaataatgcataaggaaagcacactttcataagcccaaattgttaataattcaaaaataataataaatctcgttgaatttcgagaaatccatatggtccattattaatatttttatattatttttaatattctgaaaatttccgcctacaaatttcacgccgcgtttctaattcagtgcttttttctgttaaagcaaatagcaaaaaatttccatctgatcaaacaaaccaagcagaggattttacctgctgaacgtaatcaatcattcgctaatggaaaatttaaaaaattccacagagtgtataaacctaacagtttcaaaaactttcaatttctgggagaatctgtatcttttcatatatgttatgttggccttctgttcgggcattctttttttttcttttttgaaaattttataaataattagggctggcaaaaatatgtacaaaaattggtcataaatatgtaaaaaatatgtacctaatatgtaaataaaatgttttttaatggttattttcctggaaaaaattcttcttaaagggtgaaataggcacaaaatgacataaaaatacactaaataggcttataatcacatttttgtatatttaaaaattaatttttggtatcttttttttttgaaaaaaaccaatttttaataaaataatattccatggcttaacatttcgatttatgcttggattggatgaagcaatgcttccaatgcttctttctccccattttccattccccaccgattccttccccccttcccccatcatttgacattttgcacattcattgttggaatattttgtcagaaggaagggctagcagcaagcagttgaatgaatgaataatgttgcttgcctttatgaattcaaaaaatatttatattaaatttagtttttacttgaaatttattttttatttcctcttgaatttgcccttattttgtcactcaaataaaattttcaacggggatttgttttatttgttaagaaatttaacccaaaaatattcactttattttttctattggaagtaatgacaaaaataagacaaaattgaataaaacttcacaatttgagagaaaaaatgagcaaagaaaaaagaaatgacacttaaaaaacaaaacccaagaaagcagcgctctcaactctcaagttgaaaattccatgcgttcaaatatttaattaattatcgaaaatttaataaaattcagggaatgcccaacattattttgtcccatttcccatgggaaaaattcaaatatatttttgttgctttattgtccataatatttctttttattatttacaaaaactacgatttttcatatgacaattcggcattattcaggtgacttaattgaaattattaaaaatatttttttttaaaattataaatacacattaattaataaattaggtatatttatttagctttagctatccggagcagaacattgacgcattatcatcagaatcagaagaatgctttggagaaaaggtatttaataattaaataaaatatttttcaataaataatttaaattttattagatggtttataatttgaaaatgaacgactcgcgaataattcgtggcaaaaagtttaattgctcattaacatggcttttggagcgctacaaactttcagacaaatacgcaattaaagagaaaattgaagtctgttttttaatttatttttattatatttttattaattttaatcatttttatgtcaaataccatggccatcccaaatttgtgtttgtgacagccgccaatgacttttattatccttctcttcggacagtaattgcaaatgtaaaagaaacatttggatgcaaacaaaaaataatagcttatgatttgggaacgattactaaaaacaaagaatgggtaaaaatgtttattttattaaaattaaatcgtaaattatttattttaaaattaaatattggtgcttttcagttttgctcttacatctcaaaatttaagaaagcaaacaaaagggcgcgcggaaagccatttttaagcgcacaccgttattttgaggcattgaggaaagaaattttcacgatataaaaagccaattttcatctttgtaattcattttgggtttttggaattaagatttgaaaagattgcatttttagtccaaaaataaggtaaatatgaaaatgagaaggaaaatgtgtaattaattacacagctgattattttgcataaaatgggaaaaattttgcttttcccgcgcccttttgttgttttttttcattttgagatgtaggaacaaaacagaaattacctataatttaaccaccttccatctttatgcagatgaatgaattggattcggtgtgcaatttcgaatggcgaattttcgatttcggtcaaatggtggaaggacgggttcgccaccccaaaagttacgcgtggaaaatttttgtgtgggcggtaaattttttaaatttaaactnagagtagagcgggaccgggaattttgggcttaaccgggaccgggaccttttcgggttgaaaaaccgggaatttttggctgggaaaaccgggaaaaaacccgggactggtcccggtcccggtcaaaaccgggaccatggtactcagttggactcagttgtccgtgttttggtcccggtcccgctctactctaatttaaactattaattaaatgtgtaattcaaatgattaagcatgttttattggagtatgacactgtcgtttggattgacacttcagtggttttccataaaaatgatttcaaacgattttttgaaccgatgcaaaacggcaaaattggcactgtgcaaatcccaagctgtgagtgataagaatggagcacagcattaattaaaccgtagtggggacatttgcggaccaacatttattgattgcctactttaaagaaaattgaaagaaattaacaaaataagtacagcgcgaccgataattttcagtttaaccggta

SEQ ID NO: 10298 - DNA, 1413 bp, Heterodera glycines
  misc_feature (1261)..(1261): n is a, c, g, or t
ttgagggaatttttaaatttatactctatcccagaaaaatggctatctctttttatgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaactctactctaatttaaactattaattaaatgtgtaattcaaatgattaagcatgttttattggagtatgacactgtcgtttggattgacacttcagtggttttccataaaaatgatttcaaacgattttttgaaccgatgcaaaacggcaaaattggcactgtgcaaatcccaagctgtgagtgaaaagaatggagcacagcattaattaaaccgtagtggggacatttgcggaccaacatttattgattgcctactttaaaaaaaattgaaaaaaattaacaaaataagtagagcggtaccgataattttcagtttaaccggtaccggtaaagatatagtgaaaatttaacgccaaatttttaccctattaacacacctaattaattttttctaatagctatattatggggttgggtcaagaaaattatcacattttacaccaaaattacttccataatcttttttcattttaattattcgaaatttttatttaaatgtatctatctttttcatttttttatttaataattcatcctgtaaattcggttcgcaaatgttgattacccaataaacgtttaattgtgaaaataaaaagcaaatttaatcaaaattttattattttatttctttagttgcattgcatgggatgaacgtttcgactcacccgggtaaaaacattttataattcaaatgaagcaaaaaaaattaacttttttaaaatttttaattgatacgacatttggttttgaaaaaaaaaattcttcattaatcttagaaaattctgaaagcgaatatattacagaattacaaaaaactcaaaaaaatatctgcaagacacataanaattccccggcactttaattcgcatttttccaggaatgtacgaatttttgcccatgtacaccaattttgagcctaacagaacatacacattgactgggatatattgacaaagcacaaaaattgaccccgcacagttcgaaacaactttgtga

SEQ ID NO: 10299 - DNA, 3754 bp, Heterodera glycines
aatggacaaaatgttgaccagaatgtttcgctctgtcggcaccggcgcatcatttgaccaatcattgctcaccgccgccaccctccgcgggaggaggcggtaactgcttgaactcgttgctgttgttgcagcgacagcaattgttggccgtgcagttgcagcaggaggacaaattgaccacaatggacaccggcggaactgtggcgctgacaaagtgccgatttgacgacgagtgcaccgtggtcatctgtgccgttttggtcgttatttttacaatggcatattttaaccccttgaatggacattgagtgttcatgtcatttttttggcttgaaagtttacagattttgacccctcaaattcagatttccggcgatcctaatagaggcaccaccgcttgtggaaaattagggtggaatccgtaaaaagcactgccaatttccaaaaattgcgctttcaatttttccaattgttctaaccaagtcaacaaaacacgggcaaatttgtgtgcgtttctctttatttgttagtggaccagccctgtgccattacggcaatattttcccgttccctcccaccgaatgtccgtcaattgatgatgagccgccaccgccgtaggcatcgtcaaaggtgtcgcacgttcgggcggacagtgtctgttaattttaaatgaaggctaatagagaacagttggagctaaagaaatctcgattttttcggtctcgagcctcggttcaagctgcgttctcgagtttttggtttcaaatagcacactaatccccggattatcatgattacatcggcctcgcctcctctgccgccgctgctggcggtggtcagtgtggtggatgcgttgtcctcagatgtttttaaaacttgaccttaacctaaaaatccttaaatttgatcatttttttgacaaaattcgcttctctcccgtccctcgcactctaatgaatgttactgatcacttggcttctcttgaacttattctttccaatcattttggcaataatcactaattatgccattaatcctgctctagctgtataggaaaatgtgggacttggacgagcggggattaatcaaactgcggggacgggagcttctttaaaaatgccgatttttgcggaggctccgtccccattattcgggggcgagtgtggggaccgtcgcaaaatcccgcggggtctctgcccacgtccgggctctaataataattaactaaatttaagcagtttaagcaacaatcagtcgtcactgattgtctctctcaatgtttagtttctcgacattcgtctcccatcctccgctgctgctgcttctgatcagcaaagacagcccattttcgggctatcaccagtgtgtgccagcgagaagcacaatttttgcaattgtaaaggtggtaattctgatcaaaaaatgccgaacaaatcacttacaaatcgctgtttttgggtcccaactcggcactgtcccatggcgcacgtcaaaaaacggccgaatgcgaactgtccgtctcgccacagaatggtatgtttcagcaacagttgaggagatcagagcagaaagcaaattcaagaacagatcagggaaattcccaaattcccaaggacattgttgacaaaatgacaaatttcatgtcaatttcaacagcaatcttgtgctatttaagggcaatcccattaatttggggttcgattgtttttcgctttcaagggctaatttttgtttcaaaattttactaaaaatattcagaaatttctatttttattttttaagtcttaaaattttagcttgcaaaacaaattaaattctattggtaacagaaaaaaagaaattttatagttttgaattaatatcctttgcctgttcctactgatcactcactcactgatcagtgaagaaattgcaaataaatttgttttcccagcttttcatctgtcgcgtgtcgccgatcgtctcgcctttttcattgtgcccaattttggcctgtgtttaatctcactgataataagggttgcacaaattacagatgtgccgctaaaagtagccttagtgcatgttattggaacatccctcctacttcctccgatctagtttggcaacattgagttcatgcttctaggtattgcaatacccacagcatttagaatttgccaagaaaggctatattagtgtaaacggataaaaatatctacaaaggttgtcaccaatccaaattgcaaaacagcgatttccacaggggcttcagctatgctatgcttcgtttgctaggttggcatttctctaatcctgtgtttaatctcactgataataagggttgcacaaattacagatgtgccgctaaaagtagccttagtaacagcataagcatgttattggaacatccctcctaccattatttcatatttctctcatatggcagaaagctacatattctagcgatcagacctttcagttgatcgggtgttttacgaaagaattttgtggtactgtagtggtgctaatatatttctatacttttgtaaattgtctatttcatcataaacaaaattggaaatattttcgaaacaaaaacatggtacagaaaggaaggttgactttctgcacacgtagatgggctgaattttggcatcgaatgcgtctacaatgcatcagtatttctatttgttacaatgacatattagaaaatgtagaaatcaactattttcagaagattgcgaggcttcctccgatctagtttggcaacattgagttcatgcttctaggtattgcaatacccacagcatttagaatttgccaagaaaggctatattagtgtaaacggataaaaatatctacaaaggttgtcaccaatccaaattgcaaaacagcgatttccacaggggcttcagctatgctatgcttcgtttgctaggttggcatttctctaatcctgtgtttaatctcactgataataagggttgcacaaattacagatgtgccgctaaaagtagccttagtaacagcataagcatgttattggaacatccctcctaccattatttcatatttctctcatatggcagaaagctacatattctagcgatcagacttttcagttgatcgggtgttttacgaaagaattttgtggtactgtagtggtgctaatatatttctatacttttgtaaattgtctatttcatcataaacaaaattggaaatattttcgaaacaaaaacatggtacagaaaggaaggttgactttctgcacacgtagatgggctgaattttggcatcgaatgcgtctacaatgcatcagtatttctatttgttacgatgacatactagaaaatgtagaaatcaactattttcagaagattgcgaggcttcctccgatctagtttggcaacattgagttcatgcttctaggtattgcaatacccacagcatttagaatttgccaagaaaggctatattagtgtaaacggataaaaatatctacaaaggttgtcaccaatccaaattgcaaaacagcgatttccacaggggcttcagctatgctatgcttcgtttgctaggttggcatttctctaatcctgtgtttaatctcactgataataagggttgcacaaattacagatgtgccgctaaaagtagccttagtaacagcataagcatgttattggaacatccctcctaccattatttcatatttctctcatatggcagaaaggtacatattctagcgatcagacttttcagttgatcg

SEQ ID NO: 10300 - DNA, 1218 bp, Heterodera glycines
ttctgtcatttcctctacgtttgtctctccttttccattacttgcatgctgcgagtgcttcgtcgcgctcggccaacaattcctgcgcgggaaaagggcactttgggaagaaaaagaattgacataataaatttggcaccaatgaactaacctctccctctacgaaatgaaaatttataaatccttcaagaaaagatgtgtaagttctcttgaaagtttgcacaattttcataaaaatatcattaaattttccaaaaatctccctagcggtgacctatcggcacagtcggggacctgcattttaccatattttgtaaaatttgaccacaaaatgccgaaaattttttatttttggtgcaaaacggctccaaatcctgttccctttacgacttccttcaatcccaccttcttagtgatgtcaatcttctgtttggcaaagtcgtcgaggtcgagaccctgcacaattttccactctttctgtgcatcgatggtgacggggaaggaaaacaccaatccctcggggatgccgtaagagccgtccgatggcacagccatggacacccaacgaccgtcggacggagtgccgaaaaaccaatcgcgcatgtggtcactgtcagaaagacggtttaaaaaatcagagagaaatgcagaagggcatttcctccataatcagtccacatcatttcgcttaccacgcggcttttgatgcggacattgcgctggacaatttgcgcttttcgatgatcacagcgccacgcttttgtacggtcttttggggagaaaatggattgaaaatgatttaaaaatcaaaaaccttgatgaattggtcctgaatccacgcggtgtctttgaccgcatcataggccaaagtttcggaaccacctgtaattttgattaggtatttgattgttgttgcttttttgctgtttagattgattgctaaaacctttggcaattttggcatgtcgaatatccgggaactgagtgctcgagtgattgccccaaatgatcacatttttcaccatcccaacggtggttccatctgcgcacttttgtgccacttgtgccatggcacgggttgtggtcaagacgagtcatggcacttagaattgaaaggaaattacaaacaaaccatgaaaggtttacctaaaattcttagccggaattttgctggccgcgtatttggcgcaattaattgcgtttgtgttggccggattt

SEQ ID NO: 10301 - DNA, 2234 bp, Heterodera glycines
gatgcggacattgcgctggacaatttgctcttttcgatgatcacagcgccacgtttttgtacggtctttcgggaagaaaatgggttgaaaatggtttaaaaattaaaaaccttgatgaattggtcctgaatccacgcggtgtctttgaccgcatcataggccaaagtctcggaaccacctgtaattttgattaggtatttgattgttgttgcttttttgctgtttagattgattgctaaaacctttggcaattttggcatgtcgaatatccgggaactgagtgctcgagtgattgccccaaatgatcacatttttcaccatcccaacggtggttccatctgcgcacttttgtgccacttgtgccatggcacggttgtggtcaagacgagtcatggcacttagaattgaaaggaaattacaaacaaaccatgaaaggtttacctaaaattcttagccggaattttgctggccgcgtatttggcgcaaattaatgcgtttgtgttggccggatttcccaccacgagcacctaaaagtttatttttaggatgaaaaatcatcggtagccaacaaatgcacactttgactgttggcttggaaaatttggccaaagcttcgccctgcgatttgaaaattcggacattggccgcgagaaggtcctttcgctccatcccttctttgcggggcatcgctccgaccagaaaagcgtagtcaatgtctttgaaggccgcctcttccgtggtcactgcctcgacgccttaaaaaaaggaaaaaatgagtcggaagaaatgggaaaagggacacccattcacaaaagcagaaagaaatgaatgaatgattagcccacgtacgtaccgaagaggttgggaagcgcacagtcaaccaattcgtaatggacgccggtgagcacttcagtaagcggagggatgtcgagaaggacgaggacaatgggcgaaaatgggaaaacaattacagccgaagataccaaaagcaacacacctgatctttgccaaaaacatcccctttggcgatttgcagaacctaaaggtcaaaaaaccgttggatagatggatttgtgagacctaattcccaataaaattttgcggttttcatttcatattaattaataattataaaattttattggaaggactcacaaaactatttacaaggataaaacaaaatatgtagatagcagttacaaaatgcaaaactgaccagagaatagccaatttgtccagccgcaccagtgaccaatacgcgaatgggttgtgaggtcattttgtagaaagtaagtgtaccttttcctaaaaatccttaatttatttaacaatataaaactaataatcgtgcaaataatatgtattattaattcttatggttgttttgttcatttcttagggttgggaggaaagggaaatgaaagaaggaaaaagtcagcagaacacaacagcaaaaggacgataagaaagtgtaatgatcaattagataattaggaaagggcagcaaaaaggctaaggagttggcaatgaggggcgggggagggaaaggtcaaatcaacgtcaaaacaggcaatcaatcaatcaaaaataaataaataaatgattaaagattagaaaatcagaaaaaatggaatcagaatcaaagagagcaagaagaggcttaaaggtacaggaatttttttcaaaaatcaaatggcgccatatgatatgctagatcaaatgttataaatagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttatatttttattgcaatttttctcaaaaatgccaaaatattacagaatatgtgccaaactccaaaatatgtgctaacatat

SEQ ID NO: 10302 - DNA, 1081 bp, Heterodera glycines
tgaaaacaaaaagatggggtagaataattaaattcatagcttgtctcaaagtcaacctaattaatatttcgtggtatcattcaatagctataattgttgtctctcagaatataattttcataacttcataacttaagtatataagaagagataaagcattgaacaggctatgtttgatgcaatggtaatgcatatataataataaacatttaaaattttaaagtctttaaaatgaaatttaaccaaaattaattcatatttcgattgccctaagaattatctatttatatttaaaattttagaacatttcattgagtgtcagaaaagtaatgaacaaaaaatgcagacataagaactattgccattttgtgtccataactggcctcatactcaaagctgtatatagtagaggcacaagcatcatcaagtggtcattctttatagaaacgaacataaaatgaattttgaattttcaactttttgttagaattcgggtccgggattcgaaatggtcaaaatgaatgttggattcaggttcaccgaccctgaaaacccaccataatcatgttttcacgactttttagaacaaaaagaaattttttccaaaaagggggcccaccatctaaagtattaccatttattcaaatttaggcgaagacaaaattaaataaagaagataaatgggggtagaataacgatagggaaaaagtggacagaaacaaatgagggaatgaacggatggtcaaagggatgggggtatttatggacgggcaacagagagagagaagtgggaggacagagatagaaaggaaaatataataagcgggacaaatcagtacccttcccaacatctcccccttaaaagaattttaatttttcaaaaaattttcgagtttaggggcatgttttccacaaatagcctgaattttcgactttttggggatttcgactttaggtcgaatacgtttccggggttcgaaattggtctaaatagatgttataatcgtgttcagcgcccctgaaaaccatataaatgactttctaagcaacctaagatgattaaaaaaaaatttaaatttgt

SEQ ID NO: 10303 - DNA, 2541 bp, Heterodera glycines
tagaacctattccattttttagtgcttattttatggattttttagagccaaaataaatataagccctatatttacctgtcgatttatttttaaatccttcaaaaattgtttgtcttctcccaacaagacgacagaaatgtttttaaatgatcccttaattttaaataaaaatattgaaaacgtaaattgatttaattaccattaatacttaaatgatttaattaccatcaaatatttaaatccgaattcaatgccctgctcagtgaagtctttattggaaccccaagcagaattagcaaaatcacctcttcgagtatacacacaatatttatgtgattgatcatgactaaaaatttttaattaaaatttgtttaaaataccaacccaaacaattcttttttgtattcgtcaacagttttacagagtttttgtccaatccgaaaaatttgacggatttccgttcgtcgagtttcaaaatatttaaacgattggaatgcagcccccttcaaatctaataataaataaataaattatttaaaaatgttacatcgattttcaagtatttttctttgatccttggaatggcataccttaaaacaaaatttactgttttttaatgtattcaggaaattgccaacttttgtgggttgtcataagaaaaaggtggagaaaatgccctcaagtaaaaggtttcgttttgcttttcagtcgaattctaaacgcattaaatttttaatttatttgaaatttaatttaaattaattttgaatttacaatgtattttatttggctggcatagaccgggaaaagcttttcaatctcatcatttccttccgactcatgaattgcctttgttttctcgcagttttgattctctttgaaaattggctttcgtccgaatggcttcccaatgccatacattgaggcaaaacgaaactaaagcataaaataaaatggattaaaaatatttaaatcttttaaatttgtaataaaaaatattaccaattgattgccaagtccgccacaatttccttcatatgccaagaacaaatatttggaatgcttcgggaaaagcctgtggcaaattttctacaactttttgtgcacgtacgaaaacggcctggcctcccaaaattcacgaccccccccccctcatcaagatggtcatttatactgaaatggacaggtgccggatggggaggctgtgccgttgcgctggtggacaaaaacaaaagcgctcggttggaagcgaacggactgaatgtgctgttttggagcgaaccgtgcgaaggcatcgaagtttttccattcagtggatgaggcgaaaatgaaattcaattgaacaaacgaaaaccgacggctgacaaatgagtgaaagaattaggacagaaaatgaaccaatttcaatcctccccctaaacatacctaattaaaattctaaaacaaggataaacaacaaaaatctttatggatcaaaatagtaaaacatctcaatcggattatttgtttatagagaaagaaaaataaaatcatttacctaattgtaacaaatcagtacaatttccatcacatgacttccatctcaattgacgcgtcttcttcatccgtcatttgttcgttttggccagcaacgcctccgccttcgctaccatttcctcgtacgcattcttcgccttcaccaatttctgcgcgacaactgcgccctccttcagatcgtcgatgtttttactgacactcttctaaaaggggaataattttagaaagatagcaaaatttaaatattaaaatagtgtcaatggcatggctttttgggggatcgtttgtcttttggtcgaaatgaaacccccataatttgtaagaatgtttttatgaccaaatttttaggttttatcaaaaatggagggtgggacagcgctacaattacccgtgttttgcccatttccaaaatggtcttaaagccgtacaacgaatgtgccgaattcaatttgccaaattggcaatcattaagaattggtgtcccgacgaaaaaaaatattaaaaatttgtcgggtattttttctaggcttaaaaaaatgtgctgatcacgaatctgagttcagattttgaaaatcattgatttttatctaagattttttgtcaactacttcattttttccaaaattttaagaaaattagtcggacataaaactgatacacatatgttgtagagcctaaagggagcttttgaatgagctattaaatatatggagaagtcaagttttcaattttacgatttttgaaatttaattattaatcccaaggggtcgtatgagacgggggtctggagttcgagtccgctgggctgcggtttatttgtacaaaatgaaggttcatgcataatcagagcttagaatcgagatcagagtatttttttaacccaaatcattgctaaactttaaaaaaataatttaaaaaatcgaaaaaatccagttgttgacaaaaaatcttagataaaatcaaaggatttcaaaatcagaattcagattcgtgatcagtgcattt

SEQ ID NO: 10304 - DNA, 1680 bp, Heterodera glycines
aaattcattttaaataatgattttttaatttgtataaattaaaaaacttctattcttacctttcatgttcttcatccgttagattttctttacaaactttgctctccgagtgcgaaaaactaaaaaaaaaacttattgaaataattatttaaagttctaatttacttataaaaaatcataataacatcactattgttccaagcacaaattttgtcaaaaaatcataaaattgctaataaatttcattataatgttgcgactcgctacaaaacgtagactttttttaaatatgcaaaaatagattttttaatttataaacattttgaatagcttatctttgccttttccattcttcgtccgttaaatttgccttgcaaacttttctctccgaattggaaaagctaaaaaacaaatccatttaattattaattaattgtaaaaaatgtaaccacacctgaacataggtgaattgtcctcattgcctttggcgataatgtaaaataatattaaaaaaagtgaagcaacaaaaatgtgtttgattttttcccatggaatttgggacgaaaaaatattggacattaaaatttaatatctatggaaaatactgttaattagacatgccaaaatatacagaggattttaaaaaaataaaaaatttaatgaatctcttatgttctttatttgggttggtctcgataactctcgacatatgtttttccccgactcgggtcggggagcatttttactttattttaataaatattacaattcataagcaataaccaagctaatgcaattttatttttagttattatttgcatatttggtgcaggagttgtcggccatatgatgaaaattttccctttttgtttgttacattttagggtgcttttccgttatgcacccaccgctgactgagtctcgcgtcacataaaatctacacgtgtcccatgcgtttagtggtccgtttatgtcagggatgttaataacccaatcagttagcattttaaggcgctatcggcctgcggtccgctagtgtacaaaagcactaatgaccggtccgttaatgtcccgtcagtccactaactttccagactgataataccggtccattaaagtgccataatgaatattaatgagacgcctaaaagttcatgggacgcgtattctgcacgtgaacaaaaactaccaccgagatattatttacttaatgcaaatttccgttcgcgaattcgtacttagttaattattacatcggcgtcattctggaattttttatttattcagcatgctcttgtcaaagccaactggggagagggaatgaatgaaatgaatttgtggtttaatgaggtgaacaatttgacaaattcaaacaaaattgattagcaattacgtatttggatggggaggctgtccaattaatagaacttttaaaaagcttaatttgactgaaaagagtcacaaatgctttaaacggatgctcaatccaagctcaactccacttcccaaagaacacaaattttcatattttatagaattctttgctgacaaacaaagccagtaaagcccacaataatttgaaatgtcatttattctcctcaatgagcggccggccccgcaaacatttctttctccgttggcttttcccaagacaaaacaaaggccaaatgggcgagtcat

SEQ ID NO: 10305 - DNA, 1346 bp, Heterodera glycines
  misc_feature (1245)..(1245): n is a, c, g, or t
  misc_feature (1316)..(1316): n is a, c, g, or t
ccagaaaatttttagaaaattttgtgcaatttgttaatagattttgtatgaaaatagccaattttataaattaaaataaaagcaatttttttagttttacatacttctttgtaagaaaactatatttgaatttctaagattttcgcccttcaaaaaagaaaaaaacatcttagaattaaggaaaaatggcatctgaataaaagttaaataaattttaaatttgtccgtaggcaataccttttttgaaaaataataatgcggtaaaaaaacaaattgaaagtacgctataaactgtggccgtaagcgtaaatcatggtcaaaataacaaatattttttcctgttcagaattttataaaaagttcatatgaacattgaagaaataagcattgagtacttttcgccttttttttagtcttggaatgaataatatgcattaaaataaaagtcgctaattgcaaataaagttgatgcctattttccagagattattaaattatgatgtccaatattctttcgtccaaaatcccatgggagaaaatcaaatatttttttgctgctttgatatttatattaatattttacattatcaacaaaaacgaagaattttcatatgccggttcagctttattcaggttttttttgttttggaaccgctttaattaggctgccatcggctgggctaaaatttcaaagtgtataatatgtacgggagaaaaattgtgaaggggacagcaagggtcaggttgaaaatacaattcatgagaattcataaatataattttaaaaaaagcataaattatttctttttatccaactatattctttgaaaaaatgcttcaaattttcaaagcaaaaagatatgaaaaaagcacggcaattttgaaaaagtacaaatggcacccctgcttatatcaattaattaataatgtatgtctaaatgtttttttgaattttagactttcgcattcggagtcttgcaaagcaaatttaacggacgaagaatatgaaaggtgaaaataaatacgatgcatttgttcaaagatgaccaccattctaattaaataaattcaccacaggcttttcccgaagcattcaaaatatttgttcttggcatatgaaggaaattgtggcggacttggcaatcaattggtaatattttttattacaaatttaaaagatttaaatatttttaatccattttattttatgctttagtttcgttttgcttcaatgtatggcattgngaagccattcggacgaaagccaattttcaaagagaatcaaaactgcgagaaaacaaggcaattcatgagtncgaaggaaatcatgagatttgaaagctttt

SEQ ID NO: 10306 - DNA, 5322 bp, Heterodera glycines
  misc_feature (5242)..(5242): n is a, c, g, or t
  misc_feature (5311)..(5311): n is a, c, g, or t
cctttttggtggcggacaacgaccagtggttcagctacgacgacgtggagagcatcagaaacaaagtgaatgaaagcccatttcgaatttcaatttgaaatgcttttgcctcattcagctcagttggattcgccaaaactctttcggcggcgctttcgtgtggactttggactttgacgatttcaacggacaatgccccggcagccaactcggtaccgtacctttatttgcaacaataatgcagaatatttgattcaaaattgaatttaaattatgttttgtccaggccgttacccgctgatccgcacaattgcccaagaattgggcggcatccaactctcacagacacccgtctcggcactttcgaatgtagaatttaatttaattaaaaataaatattatatatatttttgttgacagtcgccttcgccgtctacgggcgcagctttgccggctgtcacaatgtaatcacgcgaacagtgcaaatcaagcaaaattgaaaaaaaacacaacgacaaaactttgttattttattgggttttaattcgtttattaaataactaaaaactcaccatacaaaacaataacccattcatacctcttagtgcaactccatccaacgcccgttcagaatctctgacttcaccagaaagcaccccagacgaactccctctcaccgaggagaccatactcgccatcgacttacaaacaaaccgacaattgctacagaaaatcatcgaccgagacaatggcctgctacgagaatgttttgaccacattaagctgctaggcgacccgtttctgaagcaggcggaggaggacctcctggccgcactcccgaccttcgacgacgagcaagccgacccaaatgtcgaagaatggccagtcatcactcttctctctaaagcccagctcatcctcgacggcctccaagtctacatcgaggctcgattcgacacgacggacgccatctcttctcgcagcagcagtcgtgtttctgatcacggggccgacgacgaaaaccggatccaccgccaacggcaatccaccgacccaccgactcaggcacagccagcgaatgcacatcagccttccaattcggctagagccgatcaaaacctattcaaccagcgaaccccggcattcccgcttaatctcacatttccccgagcatcgaatcgccccacccatcgatcggaacctcaccatggccacttccgacagtcgaccagtgacgacgacgcacttcgggtcagccgaatcgaaatcccgaggttcagcggatcggcagaagaatgggtcacattttgggccgcctttgactttgccgtccactcacgccaataccccgccttccaaaagcacctcctcctcctacagtacctcgagaagggatcgccaccacgacggatggtcgaaggttacccaccgtcagacgccaattacagcacagtcgtgagcattctccgagatcgctacggcgacgtcggcaatcgacgagaccaactcaatgcccagcttctccatctcaaacccgcccggaacaacctcaaggagttgcgccagctacagcaggagatcgagcagatctgcactcaactctgcagtctcgagcccgagggggaactttcgccaattgccaatagctcactcgtcacaaacctcatcaaaagcaaactcccacccccggtactgcttgaactgatccgaatggagcgcgagagctacacctcttggacggctcgaaattggcgtgagggatttgcgacaatcgtcaccgacaaagagcaggtggacttgtgcgtccgcacattccaggacatggacatccagccccgcgaacgtcctcccgaacgggctccccctcgtccgggtggtcgttcttctcggccaacaccaccaccagcgccggagcgacgttatttggagaacactcgggcctttcctgctctcgcccaacccgtctctgccaatggcatcagttgctccctttgtgagcaggagggacaccgtccgagtgcgtgccagcgatacaccaccgtcattcaacgccggcgacgacttgaggaacaggggcgctgcctgcgttgcctccgtcaagaccacgtcactcgcgattgctctcgtcaagatcgatgttcgaaatgtcaggcgaacgaccatcacttcctcctctgcccgtcaatcgaccctccggggcgaaccaaccttcgacgagagaatcaagagcggaatggaaatgcgtcccgcaacgtcagtcgtgccacgggagccaacgccgaaccggtccgaccgagaacgactcccaccacaaccgcactgctcgtgtgcgacgagggcgaaaacattcccgaggcgttatgcgccgccgcctttgaccccctccccgtcgacagcggcagttttcccgtccccaaatcgacgagagtagctcatttgatgactcagacccttaaggcgtcatgccaagggggcccacccgacggaattcctgcttttgtcttccacgaccctggcagccagtccggctacataagccgggcaatgacagagaagctccgtccccctcgactctcagagcacctcctccgaattcacaccttcggagactcccgccctaagaccgtccgatcagcaaaattcgccattcaactgcagcgcctggacggaggctgggagaccctcgagctcaacgtaatcgacgagatcacgaccaaaatcaaggccctccaatgggacaccaccgatggacccctccccccgaatgccgtcctcaaggtcgtcgaaaaagcgccggacattttgatcggcatccgggaattttggcaattcttcattggccgttcaacgcttcactccgggcttcacctcatccaaacaattttcggcccaatggttggtggtgaagcggagtttcccgagaccccacggcacaccccgacaattgccatgctgacgtctcaccccagtaacgtcgagtcattcccctcgtcccgcacggtcaatgacttttggagtctcgaggcgattggaatcaccgacgaccccaatcagaacgacgaccaagttgccatgcagcaatttagcaataccgtccgccaattgccgtctggccgttactccgttcgcctcacttggcgggaacctcggcctcccctcccctcgaattgggccatcgcatatcgccggctcctctcaacgaccaagcgtctgcaatgctctcctgagcttctcgaccgttactccgccgaactgacacggcaaatggacgccgacattattgagctgaccgggcgagacaacgacgagcattttttgcctcaccacgccgtcatcaatccaaagaaactgcggatcgtcattgacgccagtgctcatgccaagggcaccccaagcctcaacgactgtcttcaccgcgggccagtgttgctccccgacctttgcgggattctcctccgcttccgttcagcgacaattcctgtgttggccgacgttcagggcgcctttcatgccatcgaagtcgaacccgaggacaggcgcttctgcaaaatgctttggctaaaaaatcctgcccgtcccgtctcaggcgacaatctcttgatctaccgctacaaacggctagttttcggcgcgacgtgctccccctttatccttgccgctgttctcctccaacacttcgacaagcacgagcacccattcgcccaagcgttggccgcgaatatgtacgtcgacaatctcctcatcgagtgtgagacggaagaggaggccatcgacaagtcgtccatcgccaaacaaatcctcaaagacgccgacatgaacctccgggagttcctcagccactccccaaacgtcatgggacgaatccccgaggacgaccgactcgacaaaacgccggccaaagttctgggactgacctgggacacccccagcgactgcatcaccttcagtctcccaaaagacacagacatcactgctacacggcgttcagtcttgagcatcatcgccagcactttcgaccctcttggactagtcgggccatgtcttctgcccgccaaacggctcttccaacgcctgtggggagaaggaaccgcctgggacacacccctccccgagaccgaggcggaaacttggaatcaaaccctgtccctatggcaaaaccaaacgattgtggtcccgcggcattccattctcggcgagcaaagccgcctgcaactccacgtgttttgcgacgcgtcggaacacacattcgccgccgccgtctacattcgaagcgagactgccgatggctctgaagcgaacctaatcttcgccaaaaaccgcctccggccacgaaccgcgaaccagcgcttcaccatccctcgactcgaactcctcgccattctcgtcggaattcgcgccatgcgcttcgccgagaaagagctccgacgtccgatcgacgagcggcacttatggtccgactcccaaattgccctctcatgggtgaagtccgacgaacccaaggcccaatttgaacagcgaagactcgtcgagatccgacaagggccgcccaccacttttcatttcatcagaaccgaccaaaatcccgccgacgtagccacgagaggctgcacaccggcggagctccgaactcgccacatttggtggaaagggcctgagtggctcacgagtccggaaacggaatggcccgacgagttaacgttcgcaacgccagccgactccccttccgccgatcccccgtttgaaaaatcggagaccaagaccctcatggccaaacaaagtccgctgccccctcccctcattgatccggctcgtttcggtactatgctgacccttctcggaacgaccattctcgtcctccaattcatcgggcgtcgtcgaccaaaatggctcaaaatcggcacctcgtcaatcccacggagtggccctccgacgggcgattcgttcagagcagccaggactttcctcatccgacaagaccaacgaagctcgctcgacggatacgacaaacaccccactgttttcaatgaggatggccttttgtgcctcaaaacccggctcttgcacgcgaacggtccgcccactctcgcctctcccgttcttctcgaccgccactcatctctgactcggctaattgtccaagaaatccacgccgacctcagacacgccggcgttgactggactctgactgagttccttggccgttattggatgcctcaagcacgacgaaccattcgtgtatccntccgaggttgcccgtcctgccggcgatcacagcacccccttttgcgagggccacatgccccctctgccntctatgcgcgt

SEQ ID NO: 10307 - DNA, 3788 bp, Heterodera glycines
  misc_feature (61)..(61): n is a, c, g, or t
tcgcgggagggctctctgtggggctcgccgttcactgtgaccatcacaacgctggatgtgncacagttaccgcaacgacaacaggtgcgtggcagtggaaaaaggacaccgtattcagtacaacatatcgtaaaagagagtgctcttctgagaatcaacaacagcgatgatgcatattgtcttttttacgctttggaggcaagcagaaaataccacagcaaagagatgcccagaagaaatttctgctattatattaactgtcagaacgggcgacgactggaagacgtgttcggactgatgagcggtgcaaacattcgcaccgatttgagagaatatgacgcggttgtctatgtgccgattgtcgtggactattggaatcggaaatacgccaccgcaaatcagcgatttaaggtgttcatctttggcgctacaggcacctatcggccaaaatttcaatatgggccggacaacttcaacattgaaatcccgctctaccatcacaacgaccatttcgacggaattcgatgtggggtgggcaaagcggtgtttgggcgtgactactactgtttttcgtgcgaatgcccatatgataacgccaatgatcacacgctacaatgtaaagcaaagtgcataaactgcggtcgcataggagtggggcgaccgtgccgagcggatgacaacaattattacagagaatgtacagcatgcggcaaggatttcatgagccaagactgcttcaatcaccatttgtcgagcaatgtgtgccgacaattcaacaaatgcaaacagtgcggaattgtgtggaatatcagacaaaaccgacgaaaaggacgcagcggacacgtttgcggtgagaaattctgctacacctgtaaatgctaccataagccggagcggggctgcttcatacagcagttgaagacgcgccgccccacaaagtacagactgatcgcctttgactgtgaaacaacacagaatacacgaattgagggcagcggcgaccgccgacttcattccgtcaacttcatctcatgccacgtcgcctgcaccaagtgcataactgaaaattcgtggcgaaattctctacaagcgccatgtggcatttgcggtcggcagcgcaccgtcacattctcccaccgcgcctatgaacgcacacaaaccgatgcccaattcatcactccttgtccaatggcggcctttgctcaatggctgctcagcgaattcgatccgcgctatcccacaatgctcttcgcccatttcggtggtcgctttgacaacattatgctgtttcggcagttcttcctcaacgggttttgcccgcaaatgatccgtcgtggcaacaaattatacgaaatgaaaattgcgaggggtgaaaaaaacccggaaatcatcgtaagagacagctggaaccttatgccggtgccgctcggcgctctgcccggagcgtttggactcaatgtgcaggataaggagttcttccctcatttggcgaatgttgaggcgaattatgggcacattctgcagtcgctaccgccaaaagctgactacttatacggtggaatgacgcccgaccgacagcgcagatttgaccagtggtacgcggaacaccaccatcaacagttcgacctgtgtgaacagctcgcggcctactgcaccaacgacacgcacatactaattgaggcgttggttgcttttcgaacggagttcttggcgatcagcgatccactggagcgacatggatgcttggatgacgaggacgacgacgaggaggaggaggaagaagacaacgacaatgcattcgaagtgattggcggtggcattgacataacgtgggagccgatgaccatcgccagtgcctcaatgaggcactttcgactcaatcacctcaagcgagatcagctcgcgattgtgcccgagtgcggctacgacactacaaacacgcaaagccttgtagcgctcaaattcatggattggtacgccaaaaagaacggggtgagcattcagacggcacactcgcccggcggagagaaaaaaattggccagtacactgtggacggatacatcgcggcgaccgacaccgtgattgaggtcaacggctgccactggcacgctcacgaccacccgcgtcaccgttttcagccccaaacagtgatggcgaatgggaaaacggcgcagcggatacgggaggacgatgcgagacggatggccttcatcacatcccaggtgcaacaagtgctcgtattttgggagtgtgaaatcaacgcggagaagcgcgacaacgacgaaatgaagcgcacctttgcgcagtacaaggacagcggccctatccgtttgaaggactgctaccatggaggacgtgtgggtccacaacgactacactacgaggtgccggaggggtggaggatgaaatattacgacgttcgttcgctctacccccacacgaatgctgtgacagcataccccgtgggtcacccaacacgagtgaacatcattggtgaggcagagcaggcggttgactggcgacgcgccgaccaagtgccggtccgaggcattctcaaagtgttcgttgtgccgccccatcacattgatgtgcctgttctgcccgtgaaatttgatcagcggcttcttttcccgctgtgccgtacgtgcgctctgcaacacccgcatggagcggtcaatgaggactacgaatgcacgcatcgcgaagatgatgagcgggggtgggtgtccactgtgacgtcaatcgagttggaggaggcgcttcgcaacgggtatcggtgtacggcctattatcgctccgttgagtgggacgacacgcagtggagcgaccgcgtttttcgaggctacgttgcagaattcatggccatgaaaacgcatgccagcggcttcccggacgaaattggccaaaccgaggaagatcagcagcaattcatagaggaatgtgaggaaaaattcggaatccgaatcgagcgggaaaagatggtgcacaacaaggccaagcggaccatcgcaaaactgtgcaacaactccctgtgggggcgcttctctttacgcaatgggttgtccaaaacgattgtgaccgactcgcccgcggaactgcgcgctctgcttgacaacccagcggtggaggtcagctccattgaccaactcaccgacgaatgcgttctggtcacctatgcggccggaaacgaatgggtggaggaacacgagtgctcaaacattgtgctctctctttggacaacatcggtggcgcgcctacacttgttgcggctaatgcagaaggttgttcgcgcaccaaactctgtgctcatctacaccgacacggacagtgtgtgtttcgcccatcgtgaggcggacgggtgccctctggagacgggaccccacctaggcgacctttcggatgaatggccggaccacgaactcgtggaatttgtttctggtgggtgcaaacagtacgccctgcggatgcggcaccgccaaagcggggaggagaaaacggtgctcaaagtacggggcataacactgagcgccgatgcctgtcagcttctccactttaacacgttcaaaaggagtgtcctacgctattcaatgtgccattcaaatgatggtgatgatgatgatgatgacatttgttcaattttgattgagtaccccaatttcctgaggcccaacattaaggacgggacggttatttctgtccggctatcgaaacgttaccgccctattgtaactaagggggttgtcgggatgaatgcaattgtacatgattttggttttataaagacata

SEQ ID NO: 10308 - DNA, 3425 bp, Heterodera glycines
  misc_feature (3417)..(3417): n is a, c, g, or t
cttcctcatcatccacaattgctctttccgattgctctcgctctttcatttaggctttttttttgctaatccaagtctctgtctctctcctttccttctctcccactctttttgtttgttcccttcgctctctctctttctctctctctcttcgctctctcttcgctctctctctttctctctctctcttcgctctctctctattcctcttcctcttccccttttcctcctttccttctctctctctctctctctctttctctctctcttcgctctctctctttctctctctctcttcgctctctctctattcctcttcctcttccccttttcctcctttccttctctctctctctctctttctctctctctcttcgctctctctctttctctctctctcttcgctctctctctattcctcttccccttttcctcctttccttctctctctctctctctctctctctaaatatctctttcttctttttctctctcttttcctctccatttctttcgctctcttttctttttattttatttaacacgtgaataaaatgtgaagccatttcaaagcaaaagctatgtgtattccttcagagtgagaaatcaaataaatttgtcttttcattttccataatttttatttttttttattttgcttttgctgaattccaattcattttctttttcctcttcccccccccctctttttttctttccttccccttcccttttttctccaactttttcggggttttcttccaatttttcttcgtcatcgtttctcttttctctgccattttcttccttcgctcttttcccatttgttttttcacttttaccttttacctttgcccattctgtccccccaatgggaaatttcccaatcggaaacatttatttgtttctctgttcgtcaatctctgacaaatccaatcgccccctcctttttgtctcagctcgtcctttgctttaccccccccccccattttgtccctctctttttgtttgccctttaaatactccttttcatagtgctttttgacattcatatttttgcataaattttggcttaatcgcctgattctttttttatttttgccttttcttttattttttgcacttcatacaattgaaaatggctggcaaattcatcggcggaagaatgccttttcgtcaatcacttttggctccttcctttctcagtaagacttcctcttccgctgatggctctcatttatccgttcgctttctttcagcagtttctcccctttggccttttcccttccgtcccaattccgcttcttcccatgcgcgtgtcttcgattccgaattcccttcttctcattctccgaaattgcgctgtgttttgtcggctaataataagacaaattcgcgggcccggcgttaccaccacccgcggcctcagctggtcatcttcgacaaggacggcactctgatctgttttcattctctgtgggtcccgtgggtgcgaagctttgccgaaaagtgagacccgggcaaagtgaacggcacgacaaaacgaaccttttttcagagttgaggaggcgggcatcgatggcattgccccgaaggtgttccatgctctcggcttttgtccggttctcaaaaaggtcgtcttccttctcattgttagccacactcataaattttcgcctaattaggtaaagcgtggtcttctcgctgagggaacgatgcgccaaattcgggaccgagttgtccacctattggttcaaaacggtctcgaaaggcgcgagtcactgaacgtcgtggaaaaggccatccacggaacttcggaaggtccattcgcagaaagaacggtgcgtcaattgcacgacttggaaggactgtttgcaaggctgaaggagcttggcatcaaagtgatttggcaacattcgcaccgaatgtgactgtttgttcacccacagattgccatttgcacagcggacagtcgggcgggaacgacgcgagttttgaagactctaaaagtcgaacaattcgtggatttgatcgtttgtggtgacgacaaaggatcagtgccgaaaccccagccggacaatgctctgttcatctgccgtcaattgggagtggaccctaaggtcgaatgccctttgatggcttatcgttaatgttgcttctcctcttcagaatgccatggtaatcggcgacactcctgccgatttgggaatgggacggtctgccaaactcggctcaatcgttggtgttctgtcggggattggagaacacaaagaactgaacgaagctgaccatttggtgagccataacacatcctttcgtctgattctttcgctgtttaggttgaacatgttgaagaacttcttcctctgattggctgagatttccacgttgtcgtgggactgcgcataacccaaagacggattgaatcaatcctttgttctgtcaatacgtcgtgcttttccctcccctcctattaatttgccattgtatttatatatatatatattttaattttttgatatagatttcattaaattattaaatcaatttttaaaattaatttggcatttgtattatatatgtatatatttttattttattgtaggtcaaccaaaccttgaggatgacaatttggacaacttttggagcatccattccccgtcaaccgatgaacaattgtacgacatgccgtcgccggaaaaacgcaatttttacacccatttttggcgcagcattgcccaacgcatgccgagctatcgcggcggaaacggccgcatctcgtcactggccgaggcatttttgggcgtggatttaagcatggaaaattgagaatcatccgacgaataattaagcgctaactttatggaatttaatcccaaagaatttgactcgagaaaagcccaaaaaaatttataaattaaataaagaagttatttttttttaatttactatttatttgaaaaaaaatccaattactcagcgctccgcaaaaattgacgtggacaaacgcacaccatggattgacagaatggatgccatcagaaccggttgagaaaatgtaagatggaaattggatgaaaattaaaaaaaacaattcgatcattgatcatttaatctgtccggcgactgactgtccattatgattaatttcatgtttcttataaaccaaacttagcatcttataaattttttttcaaaaataacataaattggcatcgtttggttgccggcccctaatttagttgttcaatatttattattttttaatttaataactgaggttagaacgccacgccgaaacaaaaatttttgcgcttttcagggaatttcccgaattcgataaattctatttccgctaatgaaatatgtaatcagaaatattaaagaatgaaatttataataattacttgagaaaantgggttat

SEQ ID NO: 10309 - DNA, 2443 bp, Heterodera glycines
tagggatgccaattttatgtaaatacatatttttttcctggcttctccttgctctaaatagcaggaaaaacactttcttttttgtgtttgcgaacaaaaaccgggacttttatttgcatatttttacatatttcgggattttcttacatatttgtacatattttggatttttttcatatatattttcatttttttacatattttgaagatttataaagaaaaaataagtttgaaaatgttgcctaaaaataccaaaaaaagtaatttttatgtcattttgtggctatttcatactttacggggattttctttcccaaaaaataccattaaaaaatttttatttacatattttgggtttttttgtacatattttgggatttttcttacatatttatgtacatatttggaccactttttgtacatattttttgcagccctattaatcagtatttattttaaaaattaatcatgcatggatcagcaaatttaaattttcccaaaaaaaaaaaaagcttttttcgaaagtcagcctataaaattgtcatgaattttttcatttttattgttttttctaatacttttttttgcttttaaatttaattattattctacaattagtagagatcgacattttgaaaaaagcctgtacctgtacctgtatttccaaattggcctgtacctgtatttcctgtacaaaagtacaggaaaatacaggtacaggaaaaatacaggcttctcgaggcctggatccaggcctgtacctgtatttttttatttttttgataaaaaccttttttattaaaaaattaacacaaaaatactaaattatttattatatattaaacaataaatattgtaatatatttaaacttttttcgtatatattttcatttttttaaatattttgagaatttatgaaaatgtaccaataaaaaataccaaaattaatttttaaaatactaaaagatgattaccgtaaatccgctatttgaaggcacaggccttctattgttcaacccctccaaaaaggggcctttaattggaggggggccttcaaatagcggatgtacggtataagcctaattaggttacattttgtgcctatcttaccctctacgaaaaattttttttccaaaaaacaacaatttaaatattttatttacatacatatttgtacataattttgacatcccttataatgactttttttggttttttaaaggcgcgctttttaaaaaacaattttttgggtaactaggggagggggcggtggtccggcggtgcaggtaggcgccgccgggaaaaaatttgtaattttaaatgcaatttgttaacaagattttgtccaaaaaagacaaaattttgcgattttccaccaatttttttataaggattttagaagccatcggataatttgtagattttacaaaaaagaattttgaacaaaaagtttttgctcataagaaaatacaattttatttaaaacatgcgccaaattgaaatttgaagggcattcgaatgataccaagatcgttagatttggttgaaaataaaaaaagttacagcccaatgggctggcgccaaaacgaccaagtcctctttgaaccagaacatttcgccaaaatattaataaatttttcaaatttgacacatttcactgataaaaatgatattttttttgaatttttccatcctttttaagacatttcgccaaaaataatgattaaaattaatacaggaaatacaggttttttaggcctgtaaatttaatttgaaatttatgctaatcatataaaagcattttgtcatagacgcagaagtatccgtatgtttctattctctcttctatgtctttaaatatcttcccataactctctcttattaattagttttctctaatctccttaattaaaaatgatttgtatgaccggtactggatttcagcactctcttaataacgcatatgcaaattttttttgttacgacccagcaccttttgaatatttcaatcaatccaggaaggaatcacacattatttgattagctcctaattaaaattcaaacaaataattaaccacaaattaatattcaaatttttctttctaaaaattatccttaccaagttgcagcttctgctgttgttgctgctgtgttcgtccacgaattgccggtgatgctggttgatgtgcagcaacaccagccttcttcatgctccacattttttctcgttccaacatacgatttcttcggtccacttttgccttttcggtcgcttctttgatcattttttccctttccattcgtaccaatttttgccgaggtccttgaatttgcttgtgcagttttaagaattcgtccatttccaagtccatggtgcccttggatttttgtcggatcaacatttggctttgttttacattggccaaaattgggtcctcaaagt

SEQ ID NO: 10310 - DNA, 5227 bp, Heterodera glycines
aaaaatccaggtccaggcctggatccagggctcgaggagcctggatttttcctggacccggattttcctggatttttgtctaggaaatccaggtccaacatggaatcgaggtccaggtccaggcttttttcaaaataccgagctctactagttagtcatgtacatttagcagaggggggctctttttgctttatattttttggtttctaattaaaatttttgaaaaaatatttctcccatcaggtccgtgccgaggacggttcggcgctggccgagtattggtcttgtccgttcgcggaatgctccgccaaatcggcacacaatgtgaacacagtgtttgcggagattgtgcgcgagattaattatgtgcaaagtgccaaggcgaagcagaggcacggctgttgttcagtgatctgattgatttgtcatcatttgcacccgccccaaaaaacacttggccagaaacacaaattaataataaaatattttattgtaaaaataaactttatttgtccaaaatggtccaaaaaattatggaaaggggaaaatattttattcctacccgatccttgggcagataaaagtagggaatcggggaggaaaatccacgacaaaatttattgggggttaaagaaatttatagtgtcggggagcaacacccactcacgttggggagtaaatttccataaaaagtcgaaaaattatcaatttcccgaggaggaagccctagttatagctataaattttgaaatttatttttattgtgcacagtaaattcgtaaggttataaatatcatcggtcgtaataaaaagaaaatgcccctttttggcccaaaatggaaaagcattgattgacaaattttgcgaacaaaaaaaaataataaatttatttttcgctttttatgccataaaattgattcgtttgttggcataaaatggatttgctaataatgaatgaatgctgccgcataagtaaagcagcataagatttaaatttatcttttagaaaaattccaaatattcaaacttttcataattttaacttacaataaataatggtttccattcgtcctttgtttcctgtgaaattcgtcttttttcaaagatatcatttgaaattggaatttggcccattaaaaatatatattttatgggaaatttaaaattatgcattctattaatgcattctattaatgcatttttttgcatttatttctcttattttttaaattattggcatcattttggtgaaatctcataaaaatagcaacaaaaaattcaaaattttcctgtcggtgccttttgcctccgaaaataagaaaatattcgaaaaatttgttggcagaaatataaatctaacctttattattctagtaattaataaatgtttggatgtgccttttgaattcaaaatttaaaatcaatctcggacaatggcatcaatggcctaagaatataaaaaatccagtgaatgaatggtattttttttaaatttaaggaaatgcgcaaatcgatccaattgcccattctaatcagtatgatcagtgtgtttgattttgtgattggaatggacgaattgaagcagccattgctgaaaaaagatgccactgatcagcagtcccaattcgaactgttcgtcgaagatggcacaacggaggaggaggacatggaaaaagcaatgaaaactggtaaaacattcttttggcgcgaaatggtgacaaattggcattgtaaaaatgggaaattgaaaaagcccgaagaaattggattcaaaaaatcttataaagaattgattgaattttgtgaacattggaaaatgatgacaaccgcagcgaatgcatttgtgaaaagttgggagaggtgcagaaatggacagaaaaatagacaaaaaattgacacatcaagttcaaggagttcgcggaaaaccagtaaattcggtgagagtgttaaggaatgaattaattttttaaaattaaaaaaaaattgtatttcaaagaaaatccattggaatgcctttgtctgaagccacattttcgtgtcggcgatcgcgaactccaaatgagctcagcaatgggagcaattaaagcagtttatcgtgacttgttcaaatggggcgatgggaaaagcatggaaattgaggtaaaataaatgtcaaaaaaattaaaaaatgtattttaaaaatttagtttaaattagcgaatgagaatccatggaaagtgatccaatttttagttgataattcaaatattgaagaaattaaagcatcattaacggaattggagaaatcaaccgctgttggcacgaaaaaatttgatgcttttatggcaaaaaattttccaaaaattaatttaaatgtcagatcgcgagacattttttcaagcaagttttttttcaataattttgcttcatattgattccataatttaaaaaaatatattcaatttaagttccctcgagagtctcggtctcgagtcgagaaaagtctgggagtttttgggtgtcacgctcggtctcaagtctcggtttaaaaaaatattcaatttaagttccctcgagagtctcggtctcgagtcgagaaaagtctgggagtttttgggtgtcacgctcggtctcaagtctcggtttaaaaaaatattcaatttaagtacccccgagagtcttggtctcggttcgataaatacttgggagtttttgggtgttatgcttggtaccaagtctagggttcagctctaggtttcgtctcgagactcgtgaaattttaattctcgagtattacttttgttttatgttgacctgctcgggtcaataatctcggaggaaaatatcagtgggtaggaggattgtgccaaactatagagtttttttttatgaaacggtttcaacataaattgaaaaatattttcatttcaaaatatttcttaggcgtaatttgtgctgcccattaatgacgaaaacagtgtgaaaagtgatgaagaagaacaaaaatgtgatcaatttgttgaatcatgtttcaaattaattgatcaattggctaattccgatatattgacaagaaaagaattgcaaaaagatgcttttaaaacgtacattgaactgtgggagatcagcaaagagcttgggctgggcaagtttacaccattgattcatttcataattagtagaaggaaaattaattgcatataaaaaaattggaaatcggtaaaaactgaattaaattcaattttaaatcgagaaattttgttacatatttgtcaccctgtatttgaaggaaaatgttttttaattcgataacatatataccaaacagaaattgttgaaaatattagggctatataattgttcaggggtggagcgcgcacagaaaaatcccgcggccgcgcaccgcgcatttaaattgccgcggccgcgaaccgcggatcgcgcaaaaaaaaaaccgcgtccgcgcaccgcggatcgcacatcaaattgccgcggatcgcgcatttataaaaacatagttcaaaaatttcaatttaatcaataatcaaaatggtaaaggatgagattatgatgaagaaaaataagcttttctagattttcatgcgataggttttttcgaagatcattaagaataaatcctgcgctgctgaaaaggcgttccgactcaacacttcccggtggcgcacttgagaattgtcagatttctcaattttttccttctttttacgtaaagcttcatccctttgcttgtaatgttcaggatgcttagattttaaatggcgttccaaatcagatgttcgttttctaggccctctgtcaactttataattgcatgccttgcatttggcataagaagaattgtcaattttgtcaaactaaaaccaaatagagtctttttcatgagtcatttggttttaaattacagaagaaaattgtctagaaaagttaatgaatatttctcatttttggaggaattagtgagaatccaatttctaaatctcttgctttttacataaacaaaaatttacttttaaataaatttagttataaaacaatcgctttaaaaaaatttatttttaaaaattttagtcaaaaattaccgcggagtcccaaattccgcgcatcgcgcaaaaaaaaaaccgcggccgcgaccgcggatcgcgcaaaaaaaaacgccgcgaatcgcggatcgcacatcgcggcgcgcccccatccctggtacaaattaaaaattttgtgaaaaactgacgatttttgtaaaaagaaaaaagagaaaacaaaacctaagtgatgtaaaataatttaaaaaattttaaaaaccttttcacagatattacaaaaatatgcgaagctgacagagaatttgccgaaaattacgccaacgcttcaatgttttatcagccttagtatttgtttaaaacgagagtcgtcagaaccaaggacattctgatggcacggatcgatggccatctgttgccataccgtaccattgagaaaatggtaggcaattggcacaaccaattcaaagagttgcttgaagaggaatggcacaatgccaatgccgaagagaatgccaatgccaataatgacgaggaacaggaaaagttggagcagcagttgcccaacccatgtgaggaggcaaagctcagagtgaagaagttgtgactggttgatgaattgctataatgaaaaacttcggcaaatttttaaattcgggctgccatcgaaaattttcaaaaacatggactgacttattaaagaaagattttgggagcagaaaaagggataatttttaaaagcaattcaaaaccaatttagcagacctaagcttaatttgtgtggattttagggaaagaaatacgcatcttttggtggcggcggagttgaagctgccgcgaaaatttaaaatttttgtgaaaattattaaaatgattttggctctaatgaaaatttttggttttttttgatgattaaggatgataggttcaaattaattattaaagttaatcaggaatcactttaaatgcgtaggataaaaagcgatttaaaactttttcatgacgtaattttggacaatattaacattaagaaaaatgaatcatacacattgcctcgtcctaatttaagaaatgataatgctattaaatcaatttttgctaaaccaatgttcgatacaactcatttttttgtgcgaatgtctcgcctctataggcttctccctttttgaacttgaaactacgttaatgtc

SEQ ID NO: 10311 - DNA, 981 bp, Heterodera glycines
taattggcagcgtcacgctttttgcatataaattatgtataaaaggacgaagcttagaaataatgggaaatggcagcccttgttttattggaaatgtacattattttgtttagtttaccatatacatattatttttaatttgtttgtttgttctgcattaaattttttggaaattttacttttcttttttgtgctttgtctcttttttgcattatttttcaatcagtgatctgatcagtgatcactgtggtgcaacaattaactctttttttaatctgcatcggaagttatacagttatgaatctcttctccatgttcgtccattcattcgtctattgtagccttatcgttagggctcgaaattatatagattaacatattttttctgtgcatatgctataaagaaaggggttcaaaaatagcatttctacgtaaaattttttgatttggtgaaggtttttagtccatataaatccatattttgggggtcttagggaataaatccatatttcggccattttttggaaattttcaaagaaaaatgcaaaaaaagtgaaaaatacacccttaaaaatcgactttttaaaatttttaaaaaatacaccctccaaaaagagaatttttcgaaactggcaaattttcatatattttgtttcgcttccgaaaattttcgctcgcaacaggatgggattattatccaaaacttttagatgtctttggtttgcattatgaagctaaaatttgataaaaagttggcactttttaaggtaaatccattttggcagtttttgtgtgtttttaagtctacctatttaagcaaatattaaattgaaacacattttttgtattttagggtttaaaatttaatttttgtcagtttttagtccattttttggtccatatttggccgatttttgagctttttagtccatatttcgggtattttttgtccatgttttatgtccatttttgacgtttttt

SEQ ID NO: 10312 - DNA, 2383 bp, Heterodera glycines
  misc_feature (15)..(15): n is a, c, g, or t
  misc_feature (27)..(27): n is a, c, g, or t
ttttaaataaaatanaagcaaaaatanatattagcgcgagcagtttttaatgggccaaatacaaaggaattattgtaaagttttactatcatagatggttttaaacaaacaattaagcgtaaaatgttttttatgtatgcagattttctcacttctctaaaaacaaagctttaattaaaagcaatttccttttgtgttctttatgtttgttataatattttatgtagcaaataattaatgcaattaagcgcaaaaatatttattcgattattaactttttttaaaatgcatatttgtttttccatttcaaaatctttgacagaaagcataaaaaccaaaaaaaaagaagattaattaaattcatttaattgatatttgtaagaactacgacttaattttggtgtaaaatttaactaagagtcaaaaaggggcttatttttgcctttcagtttggaaaagtttatcttcggcatttcgtccatcagtcggcttgccaatccgccgtcccaactcggcacttttctcatccctttgcttacaccgtccaattcactactttttccgtgctttgtcgggccctgatggaaagaactgagttggccgcttgattgtcctatcaatgagtcgtaacttgcacttttgccgattggcctttgccgaattggcgaaatttgctgttttgactttgagaaatttggcaaagcgtacgaaaatgccgacgatgggaaggcggaaggtgccaactgatgcttagcagctgcaagagaagcagcagtgccgactgtaaaatgccattgtccctttttgaattttaaaaatggcacttttccccactaactttttggcattttgtctccctccaccgtttctccattatttttcgacattttactcagttgcgacttgccaatgttctttttgtgcatattcactggtgccgcttcgctgctgctgaacctcggctttctcaactcgtgccgcctcagtaacattttggtcacttggtgcgctgtcaattctgagctttgttcggccgattactttccgttttgacggtaaataccgtaatcattgtgactgtttcgagcattcggcgcgtttgggaacatcgcccgtccgtttagcgtttgttcgttggcattttttgtggccaaattagtgacggatgagcagagcaaaaaggcaaagtttaggaagaaaaaatgtgcgaagttaaaagccattttataaatcataaatttttatgaatcgtaaaagtaaaatatattttttcgattatgctaaatgacaaaatcatatgctaataaagcatcgattgccaaacgatggcattggcattggcatcatgggaaggccatttccaagcaaagtgccttattgacggaagctattcattttttagaaacacatgtaaaatgatgaattaataatgaaatgttggtgattttaatatcaaatggcattggaatgatgtcattgaattagccaaaatttaaaaaatattattcacacaaatttatgcgtagaaaatgaacagaaaaaacgctaatttagaataaataggcaactaaaaaggaaagtgtgtttgattccgaaagtcaattaaattcccaaacaaaaatgccgtctttcgttctttggtcggcacaattcactgattcatcgtccgccggttggagtgccggtgttttcccatccgtttctgttgacaacatcggcgagccaattggcatcattccactgactctttgcccaatcactaaaataaaggacaattaaattcaaaagaaatattttaatttttaaactttttaaaaataataactcaaattaataataattatttaatttaaaatgtattttgcatttttgaatatgccatttttattaaatttatgctcttacagtgtcgagtcaatgggatggtcccatcctccgacgtatccgccggcgtgccccaaaacgtccctctttcgccgttctccgctcggcttctgccccggatttggcttactttcgccagagggcgcttttcccttttcattagccgccgattgtttgccattcaataaaagctgaatgaattttgaattgtttaattttacaattaaaaatcataaccaaaagtcccattggccccgcggcgtttggaggggcggcgccttttgcctccgtcggtccgtccattttaatgccaattataagcacggccaaaacggaggaggccaaaaagagagcagacaaattggaagagctgaacatttcttctaatggacaattggcggtaattaattgttttttttaattaaataattccaatggtttttttggtgccattctttgactatttatacgcattttggcaccacaaacattgcacttt

SEQ ID NO: 10313 - DNA, 2841 bp, Heterodera glycines
  misc_feature (2830)..(2830): n is a, c, g, or t
gaaagaaggcatttttgttggggaatttaattgactttcgggatcaaacacacttccttttttagttcctatttatttctaaattagcgttttttctgttcattttctacgcataaatttgtgtgaataatattttttaaattttggctaattcaatgacttggcaatcgatgctttattagcatatgattttgtcatttagcataatcgaaaaaatatattttacttttacgattcataaaaatttatgatttataaaatggcttttaacttcgcacattttttcttcctaaactttgcctttttgctctgctcatccgtcactaatttggccacaaaaaatgccaacgaacaaacgccaaacggacgggcgatgttcccaaacgcgccgaatgctcgaaacattcacaatgattacggtatttaccgtcaaaacggaaagtaatcggccgaacaaagctcagaattgacagcgcaccaagtgaccaaaatgttactgaggcggcacgagttgagaaagccgaggttcagcagcagcgaagcggcaccagtgaatatgcacaaaaagaacattggcaagtcgcaactgagtaaaatgtcgaaaaataatggagaaacggtggagggagacaaaatgccaaaaagttagtggggaaaagtgccatttttaaaattcaaaaagggactatggcattttacagtcggcactgctgcttcttttgcagttttcttcctaaactttgcctttttgctctgctcatccgtcactaatttggccacaaaaaatgccaacgaacaaacgccaaacggacggacgatgttcccaaacgcgccgaatgctcgaaacagtcacaatgattacggtaattacggtatttacagtatttaccgtcaaacggaaagtgattggccgaacaatgctcatttaaacatcccgatttttttaaattgttcgtatttttggtagcaatagaaatgggcgggatgtaaaaatgggaccgagatcttgtctcgatttaaaaaaatatgaagattcataggtcgacggttccgttaggcaacgccggagaaaaaaaccggaaaatgaaatttttaattaattttgcaccaaaatgtaaagtttaatttaatttaatttaattttatcgagcaaaccaaaggcacattagtgctcttatatggtgccaaaaacaaacaaataaaaatgatcaaataaaaaatacaaaatgaataccgtaataaaaatgaataaaaataaatcaaatgttaaaaattcacaggtgattaaaatatagtgtatatgtggcacagaaatttcctactcagaactaattgcttttagtaaacccctgaattcctttgccttattaatttgcaccgctaaaactggaaggttattccagtttcttactatcctatgaaaaaaattattttgtgttttggccgtgtggcgctttactcgtaaaagtaaaggcctcctgggcctttctgagaaaaagaaattttgttcagcctctaggctggtgaaccctttaataattttaaaagctgttgtcaaatcattaatttttcttctttcttctaatttatgtaaacccgcgattttaagtctttccacatattttttgtacacaagtccacattttcgaaaaacttttattgtgaaaaatttttgtacccgctcaattttgtctatatctttttttaaattagggttccaaacttcggtagcgtattctaattgaggtcgtacaaaagttttataagctgctgttagagtctttatttccctgcttttcaacactctcaaaatctgaaagcttctaagatatgcgtttcgtataattttgcttatgtgttctgaaaaattaagtttcgagtcaattataatgcccaagtcacgaacattatccgactcagaaatcttttttgagttaataaaatattcttttttcatattatttttccctaaatataaaacaaaacatttttcagttgaaatttctaacccatttatttttgaccatttttccaaagcctcaattgctttatccaactgatttgaatggtcatcgttttcatgtgtataatataatttaacatcatcggcatacatttttatatcaaccgatgccgcttcatttgtaataaaggacggcagatcatttataaaaattaaaaagagtaatggccctaagacacttccctggggcactcctgaaaatattctgaaactttctgacaattcttcgccaattttaaccttaaaactccgattttttaaaaagttagttaaaaaattatgaatttttccttcaattccaatctttttgattttttgaagtaataaatcaattggaacagaatcaaacgccttgacaaaatcaatatagattatgtcaatttgttgattcttttgtatagaattatatatatcgtccatcatttttaatatttgggttgtagtcgatctattttttaaaaacccaaattgttctttatcaaagaatcttgtactgttcagaaattctaaaattttgctactcaaaattcgttcaaaaactctacagacagtgctggttaatgaaaccggcctgtaatttaatggatcagttttttcgccttttttgaaaattggtaccaccaatgatgttcgccatatttccggaatttgaccgtaatccaaaattagcctaaatatatctgctaatatttttgtaattggttctgcacaattttttaataaaatgtaaggaacattatccggtgaagtggaattacgccggggaagtcttctaaagatattccaaattattcccgcccattcaanttaaatgtcag

SEQ ID NO: 10314 - DNA, 2895 bp, Heterodera glycines
ggagaaccgagaggaaggcaaaaagagtgcaaaccgcgttggaatgaggtgcagcccgacgactcaatcgtcccttccaactggagccctgtaattatttctacaaaaaaaaagaatatttatattaaaattaataaatgcatcaatgcttcgtctgaacaattaatataagcaacacatcggataatcatggagcaagcattttggtatatttaaaaccgatttttaaaacaaaattttcaaaaaatgttagaatttctgattagcggttcgaaatgcgtcaaatcgagttcgtatccatccatgatcgcggccccgaaaacccctggaaacacttggtcattcgacgcattggcactgtcgtcagatgaaaatccgggcaaaatgcttaactgaaaccaataatatgaagggatggacattcgttgagcattgacggggccaattggcgcattcgacggaaagttgcggccgtcaaaatccaacacaatagtcgtgtccttgaacattggccaaatgttgagcacaatgaattccgaaattcgcacattttcagtgcgaatgaacaatgttgttgaacatgaggcgaagaaacggtaaaaacggcggacaaaagtgagcacattttggtcgaagtagctgaagatcagttaaatgtaatgcttaaaatcatctataaatttaatttttcactagataacaatgcttccgaatccgatgactttgttcggcaacggattttgtgggatcggcagcgattcccaattggaataattgacaattttcatttcttttgccccatttagaatttttattttgcccaatgtccatttgcgcgttttgaaatgttcgtcaacgaaatagtcaaatcggtggcttatcatcgcaatcagggatggacgaaatttcgtttcgttttcgtttcgtcctacattttcggcacttttttagtttcgttttcgttttcgtctaccaaagttttttcgtttcgttttcggttttcaaaattttgtttttcgtttcgtgtttcgttttcggtttttaaattttggattttcgtttcgtgtttcgttttcgtcagagcaaaattggacgaaaaagacgaaaatatttacacccttaagaatgacttttttggtaagaaaaaataagatatttcttgaagtattgtattaaatctgccaggaaattgtatgtaaagtttgaaatgttgataattttttctagagagcggcgacattcggcaaaaatacggatcaggatcagaactacggactaggcatccatacggactacagacttacggactaaaaacccttactccgtatagtacgtatgctggaaaaatacggacccgtatacggatcagggttttttgaaaagttttttaatcaataaaaaccatatttttttactaaaatactaatatagattcgttctaaattttactacgaattcaaatgaaatttacaaattggaaattaaatagaatttcataaaaaattgatcgctctttgtgtccggacgaaaggaagtgcgatatctttatttctcatttttctgcaattaattcgatctttgctgccccgcccctcttaatgtattcctcgcccattcacttcattcattcatatctctaataatgcaacaataaaaatttatatatttttgcctctgcaaaatatttgggaaaattcttgaataagaattttaaggcttttgaataacatcaaattctaggcccatgatttcagttgaaaacccttggggagagggaaattgctgctgacgttgtgccaacaccatcagggaagtcccatccctgaaaccctgatcaatcagcccatccgaatgatcagtccttaaaaatctaaggggaaaacatcattgatcaccattccatcggctgatcagtccctaatataaatgggacaaaatttctttaaggtatttcaatttcggctgtttagccactaatcatttcattttgggttttaatcattcatcatggctgttgagccctttcctcccaatttgcttccttttcgttactgcacacaaatacattgtcagttctgacaaccacatttttcatttattcgaaagcgtcattgtatgaagggcccgttttcgaaattaaactattgaaactgaggaaatgaaaaagcacacactctcgcttattaattataaagaatttttcatatggattttaaagtatcaaggataacttaaaataaaacaaacaaattattttcctcgtttaaaaattaaaaaaaaaataaaacttaaatatataaatttaatctcatttaaatgggttatcattcgtataagcgggtaatcacaaaataaagaattaacaaattcacaaatataaatacttaaaaagaaaacaaaaaaactcacgttaaactctgcgccaataacaatttgaatgttttaaactctaaataccaccaagtcaaagaacacagcgttcaacagcgcgagtaaagtcacccttcttaaaatattatttaccataaaaaagaaaagtaaagaaaatataaatttatattaatattccgatgataaaaaacatttttataatttgaattaattaattatatgaaacacgtaataaaatacaataattaaattcattgttttagtcaatttgcaaaaagtaaactaaataatttaagtaaaatttgatgaatgataaaaaaataataatttaagcgaaatgtataaatatcgatcaccattagaattttaaaaaatggaaaaaagtctaaaggtatatattaaataaatttaaataacaataaacttttttatcgaatatttataaaaacacgtgagaaatggtactcatggacttcataatctaagaatatggctaaaaacatg

SEQ ID NO: 10315 - DNA, 2319 bp, Heterodera glycines
  misc_feature (2270)..(2270): n is a, c, g, or t
aacaatttcggagccgttgaacgagctacgccgatcagagaccaaatggcattggggacaacaacagcaaaaatcattcgaacagatcaaaattatgctgtcgtcgaacgagctgttgcccattttgatcccaaaaagccactttatctggcaacagacgcatctgactatggagttggagcgatccttttccacaaagatggaaacacaggaaagtttggcgtgatcgcatacgcctcaagaacattgagcccagccgaaagaaattatgcgcagatcgaaaaagaaggacgcgcagtaatcttcggcgtggagaaattcaaccagtacttgtacggtagaaaattcattctacagacggatcacgagcctttaaaaaggatttttggaccaaaaggtgaattgcccgtggttacggcacgacgacttcatcgttggagtttgaagctcatgaattatgagttcgaaatcgaatattgttcgacaaaaaatttcggttacgccgatggattgtcgcggttgcctagtccagaaattgatcaggtctgtaaggaaagtctcgagctgaacaaaatctagcaggagagccaaaacgctttgccgatcactgcgaaggacattgcgaaagaaattggcaatgatccggtcttcgcaaaagtaaaaggttttgtgctcaatggatggccaacaaggatagaagacgagaaaatcgcccattttttctggtaaaagacgaattggagctgaataacggatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagaattgtgtctgacaacgggccgcaattcgcgtcaaaggagtttgaagaattctgctccaaacgcggaattgaacgaacgctgacggcaccataccacccgcagagtaatggggaagccgagcgttttgtccaaacattcaagaaaggaatgttgttggttaaaaaagaaaccaactgggacaatgaattggccatgaaccaattcttactcaaataccgagtaactcctcattctgcaacaggacgatctcctgcaaaaatgatgttcggcagaaagctgcgaacactgctcgacctcgtgcgcccgtccgaatcgaccaaaattgaaggaggagaagagaaggcaaaagaaaatgctgaaaagcatggccaaaaatatttggctcgcgccaaaaagaactttgatcgacggacgtggaaacgatcgtttaaaactggacaaagaatctttgccaggaattacagagacggttcgaagtggatggcaggccaaatcatgagccaaataagcccatcactgtttcttgtccgaacagcccgtgtggtctggaagcggcacttagatcagctgaaatcggacgagacgaagcctgatctggagagcaacaccgacgtggactcaacatcgtccataggtgatcagacggaggatgaaaaggacggaggacagcagacggacgtggaagaagagccgaacgatccgccaaatttgcacgatccgccattgagaagatcggtgcgcgaacgaaggccacgacagatcttcgaccccagcgcgtgatcgctgacttcagctggtggggaggagatgttgtgttcgttaattatttgaattaacgccaaaagatgctcgtttatcgatcatccttttgacccttcgtgttgtccatttaaaccccccttttcccccattccgtgcatttctccctcattcatttgttgtttccatttaattgtgacccgctccctcccttcgctatttattatatttatttgtgtggaataaatcaatattattccattgactgttgaacggacacaacacctttcgtctttgcgctcaaaatttccaactttttctcttgtctccaatcgcctgtgcacaattcaagagtggtgaaaaaatcgttgattttgtcccttccttcagtgccaaaaagagtaggaatttctctaaggacatttgcgtactgatttgaaagtgtgactttgtgaagttcaaggataatatcaggaattccctcggtgtatggcatcactcttgccatgttttgttgaaaattttggccctgcacttgttggtgaaccanaattttggtattgtccatccattttgtctcatatttggttcgggaattg

SEQ ID NO: 10316 - DNA, 1947 bp, Heterodera glycines
  misc_feature (53)..(53): n is a, c, g, or t
acattcggccgcttcgcggcctcaggacgggcgcttcgcgccccgttgtaatntttgttgagaacattcggccgcttcgcggcatcaggacgggcggttcgcgcccgttttttaatttttttggagatattcggccgcttcgcggcctcaggacgggcgctcccacccctaagaatccccaataacactgggattctgaggtcttaaccatgtctaaagtaaaatctgattacatattcgtgatcagcggcccaaataacccctaaaatcatatttttggaagatttttggtgaaaaaaattttccactcaaaaatcatggtcacacccctgtggtcccaaattccaaaatcacttttatttctataacttttttcaaaaaagtgataaaaagctaaaataaaatttataaaatagagcaaaaaattgcggattttttgagtatattatttttataaaatactttttcataaccgagttcttaatttttttctgaaaaatcgaatttttccagaaattctggaataacttttttattttggaagatagaaattccaaatgaatctcataaaattctcctaattttttgctatttttcaaactacattccactaaatttgatcaaaaacgaagagagttatgaattttcgaaatttgactggattttccggggctcaaatttagacgatttttcaaaaatttgtaaccaccttccaaaaagtctgaaaccaaaaataaagtatatattcgtcttcagcaccataaattaggccataaaaatgcattttggctaatttaggagcaaaaaaatttttcatgaaatgcaaaaccatggggtcccccctttggttttgagtttcaaaatcacaattaattttataactttttttaaatttaagataaaaacatgagataaagcacattagattgggcttaaagttctctacaaaaaagctcttagacgattttttgataaaatcaactcctgacgagttattgcgccagaactgaaattgaggcctagcaaccaaaaattttctatttccaaaaaaaattttaaaaatttttctgaaattgacaccaatcgatagagcatgaaaaacggttgcttgaaagtggtctccgttttccccggaaaaatctgtaaaaaatcataaaattcaaaaacctcaaaagtgacgagggggcctagctcgaaaatttctgaaaatttcagaaatacaaaaacatggttggatagagctcgtcgagctgtacaaaaaagccgcttacaccgacctcctccctcaaaaccccgacgagttattccgccggcgctgaaatggccaaaaaagtaagcaatttttccacgactgtacacggaatacagtaggccgtagagaaaaatgattggaagcgaagttgtagggcacacttcaacttaaaatcctcccagcaagcattttttgatcaaagcaaaagaaaaaaatttcgtaacagtgagactgaaacgaaaagccgtttcagcgccgccggcgctcagttggccaccggaccggaatgcccatagttttcctggatgcgccgtcaaaagttgcccccaaggtcaaaatctcgaacccctcccgccagcggttcccgagatttttgttttagcaatgaaactcgatgttgctttagttatatataaatgacgggggcggcgtaggccgttgggttttggatgaagagaaaatggacatgctcatttgttattttaaacagacaaacattaattgcattagtgtgaagttttaaagcgctatcgcgctatgggacgcggcttcgccgcgtcgctagaaagtgatgtaatttagcaattcatcgcagcctcaggacgggcgctcgcgcccgtttttttaattttttgagggtaattctgccgcttcgcggtctcaggaagggaaattcgcgcccgttttttattttt

SEQ ID NO: 10317 - DNA, 1248 bp, Heterodera glycines
aattttaagctatcgattatttatacataaatacaaaatttgaatctatttctttgtaattgattattaacttaattgattcaattttatgtggctctgctgtgcaatgaattggcgtgccaattagcaacgctaattagttgaattgttggcgtttgaaataattgaccactagcgctgatggtattgttgccagcagaagataaattgccgagtccaacaagagaggaaaatttcttcaattcaactagcaaatgcctcgcgatactgtgaactaaaaaaagacatcaagacggtcgcttcgcgcccgtttttaatgttattaagaacattcggccgcttcgcggctcagacgggcgcttcgcgcccgttttttaaatttagttggggccagacgggcgcttcacgcccgtttttcaaattttgttgggcttgggcgggcgcttcgcgaccgttttttaaatttgtttgggccagacgggcgcttcgcgcccgttttttaaatttgtttgggccagacgggcgcttcgcgcccgttttttaaattttgttggggacagacgggcgcttcacgcccgtttttcaaattttgttgggctaggacggactcttcgcgaccgttttttaaatttgtttgagccagacgggcgcttcgcgcccgtttttcaaattttgttgggctcggacggacgcttcgcgatcgttttttaaatttgtttgggccagacgggcgcttcgcgcccgttttttaggggtacaacagtgattagaagaggtgcaacagtgattcattaaattaaaatgaaaatattttttaacaaatttaattaaaaaaatacatgaaattctatcaattaaaaaataattaatttaaacttataaaatttatttatcaaaaaaaattaaatataattttttatttattaactcaacaaaatattttaaattaattaaaatcattgaaaataacgtaaaaagtcatagaaaaataatttacaccgtccggatccgaacctgccccctcccccctcaaaatgatgcctcagaatccccaatcacacagggattctgaggtcttgacgatgtcaaaagtaaaatctgatcacgtattcgtgatcagcgtcataaaatagccctaatgacatgtttttggaagatttttgtcaaaaaaattttttcactcaaaaatcctggtcacacccctgtggtcccaaattccaaaatcacttttatttctataactttttt

SEQ ID NO: 10318 - DNA, 5031 bp, Heterodera glycines
ataatggtacggtaatagcggtattgccaatttttttggaggaattgccctaacttttaacagtcctataaaatatttatatttttacatacggttatgaataccatcataagggatgtcttcgggacattgccacagaacgtcttgagattttggtattattatttttggtgtcttaaccgggtacggtgtgaaataattaacctagaattaaaatttggaagagattttaagttatattaccgatggatataatgagactatgtcggctatatttatttcactgttttcagaaatctttgaatataaacaaaacgcttgcgttcgcccacccgcaaaagcatcccgggggtcgattggtcctaaatatttgctaaattgctttttgttttgattaccccacccttatcgggaatagaatcgaaatatttcttcatttctatgtcataattttcattatcacgtggattgagctttcgtaggacctcacattcctaagaaatattaatcaaaaaatcgttaatttgtactgacccatatttcctccacccgtattccaaaattattgcatatttttctaagtttaaacattcggttttttgtccttacaaaattttcttccatagttttaccattgggcccaatttgaaaaggtttgaaacattttttacatccttaatatacatatttaccaaaaattttgatataacaaaccgtgaaaagcacatccctaaaattatcattcttttccataaaatatatttattaacctggaattcgattatggttttgaatttcccacaaataaaatcaactttgaactcttaattttaaaattattttgtgattttaattactaagacctcctatattaatctcccccccgttagctgcgtgtctccctttaacacaatgtttatgcatataatattcaaagtattttattgcaatcatgctttgggtgttatgtttttcaaaccctccctcagggaccatagctaggtgtttttcctttaaaaatttagccctgtaaatttttatcgccgctcctgcgattgtcgtactgtccttaatatggcataaatgataactgaaaatgtaaattaccttaaaaacatcataaccgttaggggtttccgagtcttttgttatttcaataaaaatttttcgcatactcagtatcgattttaataaaatttcagtatcctgtccgcaataaatttgtaattgttcctctaaattaaattttttcaaaagttcgcttattttatagtacctaacaaaaaggggatttttttgtttttttggtaccattctttgaatctttcaaattcgtcatctttcatgctttcagggcaataatcttccataggtggaagggtcgggagtaattttcctaaaataaattatagaagaattataattaaaaaatttaccataatttctttctgaattgtatttatgaggaaaaaacaatttaggtgtacagtctaaaccgaacgtttttggaaggtgtgacaatttattttgagccattagccaaaaatctctaaaatagatttgcccaatttttatttggtaaattttcaagtctgaaattattaattctggtgtgtgtcccaactccgttaaaccccttaatataaaatgggtatcgtatcgacctttaaaaatctttttatattagatacattaaaatatattaccggcaaaatgagcataacagtaggtctcatagtttttaagtgatagaacccatttcaaaaattcaaaaactggatttactctgtttacagtacaccaagtgtggtgccgaattccacctggcccacaaatgtcacaattttctattttgccttcacaatcgctacatgtaaacctggctgacaaaaaaacaactttatgttcatagaattctgttttttggttatcaaccagattatcagcctgtaaatattctatatcaaaaaattataatattttatatatcataccgaacactcaatatcgtaggatataattctatattttggtaaactttttggtattataatttttttaatgtaacaacattccgttttggggtgtcttattttacaaactctgcagaattttgatcctaaaaatcgaaataacaaattattagattgtgtgttaataccgcatatatgcatatcccttatgcaataatcgttatcacattgtatacaccgtctatagtatttgcaggccaatttaaaatgattttgatagcaaaaatcattgaaaaaatatctattgcatattaagcattcttttggctgtattttttcgtttttacatggaaattttgtacctgaattttttgtaaattttattttcctttttttttcattaccccatccgccacatcgttgacattttattacacaattaacagaatgtttaattttttcacgaaatgtctgctcgcaatatatacaataatagtgtttaatattaaaaaattgtttaacgctttttaaacctaaaattttttaaaaacgattttttatattaatttaccgtcccagtgcccattttcgagaaaaatacaaattatatatttttttggtccttgtcctttaaatatgggttttaaaccattttcctaaaatacttgattgttatttctcaaattttcttttttacctttgaaaatgctgcgactaaaaaatttccgggaaattctcgatcaaaaaaatcttgaacaattgaaagatcttctaccccataggacgttttgtttggatcaatttttgtgttttgaattaattcatcgacgtaatttttttgccttttctggttattatagatttttcggaattgtgcatatgatatccgaaattgctcttctgccccaattatttgataaaatttactcaatattatactataaaaaagacaataattatctgtattttggacagataatctcccgttctcttttggcgggaaaaaattaaacacatttaaattataacctaaaaaaattttttttaatctatgattttttatttaccggatcccgtgggggctgagtaggttgtgattattattgtaatttcctcgtttaacaggtcgatttcggcaaaactttgttgtatgtggtaaaaagactcgaggacgacgtctggattattttgcaccatatctctgggtggtattattaatgggtcattcaaagcttcacaataaaggtcatacgatattttttcaattttaaaatttttttcatttttttctatagcttttttggttaggtattgaattatttttttgaaatttttttttgagttttcttcagtatttttgaatatgaacctagtcgtgttttctctcagaccgaattttttattttctcttattgtgttggatatttcggtgtaaaaatttgattctgggatatccttacgttttgcaaaataattttttttattcctcacttgccttttttcttttgggatttttaaaaaggctttgttttccatcgtatcttgaatttacaaaaaattaaatgatcatataacaaagtaatattggatcaaaaacaaaattaatcagagaatagactacttatttttataactttatatacataaccggggatgttattacgaaagtctgaaatggcgggctgagcttaaaagagggtgaaaaatgatgacaaaaaggcgacacgtaattaggtgggaataggattgtcgaagggggtctgttgtgtcggcgcccaaaacgtctccaggaaaaatgcgtttacagctcaatggtgacaaaatgcagccaaaaagtaattaaatagcatcctacccataaatccaccattttggtggaatatttgcacatgagttttttaatgttccctaccccaaaccaccgccccgtccattatcgctaatcttacctaaactttattttatatgccaaaaatatttaacagtaaaagatcaattttccgaagagatctgtgattttcccaaaaaaaaatcctcaaaatcatgctccaacacccggcggcggcggctgtggtgggtcgtggtcccagttctgaaatctgtgcgccgcaggttcatcttcctctgggacgacctcgagaagttgacgacgacgcctcaggcgcgggtccctcagtgccactaaaaatgaaaaaaatgagtgttttttaaacattttttcgcaccgccaggggttggcggacgcacaggccaacgaccgttacgctgctgcgggtgggcgcgatgcgcttcaaaaacacctctcaatggcctgtagttcacttcacccatgagtgggcgcggtgctccctgtggcgccatcggtggcattccgaccgcaaaatgctggtgctcccccggcgccattcccacaacaagtggtgggggtgcggctgggggcatcccaacggcaaaatgctgtggcgctccaggaccaattccggcgacaaaatgctggggcgcaaccggcgccatgccaaccgcaaaaagcgggggcgcgcccgccccccatgccggccacaaaatgcggaggagctccaggcccaattctggcgacaaaatgcgggggcactccagggcccatgccagccccaaaaggaggttgtactccagggcccatgccggcgacgaaaggtgggggcactccagggcctatgccggcgacgaaaggtgggggcactccagggcccatgccggccacaaaaggtgggggcgctcccggccttatgtatttagcccaataatagtcgaaaatcttagccaaaattctgaactctccaaatttaattaagcccgttaataatttaaaacatttttaaacgattacccggcatcgggtggtcggcgtgcaccaattcctcatccggcggctcaattttgacatcgggtgattcagcaactacgttttggccgataaaatcacggcgccaggcactaaaaataaataaataaattgaaaattgttggatttcttacttaaaagcctctaaaatttcggggtcatagggtacagcccctt

SEQ ID NO: 10319 - DNA, 312 bp, Heterodera glycines
gggggtataggttcgcgaatgaccgttgaaaaataaacgatatagaaaacgcccttgaaaagtgccagtgaagtgagcttggggaaggggggtgacaaaaatcgttttgccaccaaaaattatggaatagactttgcagaaaatgtttgggttagaaaaagtttttaaaatttgacattaagtgaaaaacatttgcattaattttctcggtttaaatagcaggcgaaaatggggcgtgacttatggtgtcaagcacaattgtcatgcgacacgcctatttcgaaatgttagtcatgtgaccgatattcgcaa

SEQ ID NO: 10320 - DNA, 5476 bp, Heterodera glycines
  misc_feature (48)..(49): n is a, c, g, or t
  misc_feature (60)..(60): n is a, c, g, or t
  misc_feature (155)..(155): n is a, c, g, or t
tttagattagaagcttttttaaaaaaactcaatgtgtaaaataatttnntagaagagacngctgacgaaaaaaacattatgcatgatggaaaaagtgggcgccgcaactggacaatgtacgatacggtaaatgatcaaattaataattaatattntaatttttaattatttcttaattggtccagcattctctctacggctggtcagaaatggtcgccacacaaaaagcgttgcgcgtctcaactggcaaacgcggctcactcacttctcgttcaacatttccagtatgcactggaaaataattaaacacattaatataggatatattttgcagatatgtctttttgctaatttcttatttgtaaaacgcacgaaaaacaatttttttaaatttcaaatgctagcttttttgttcttgcattttgaaattttggtcactaatgcccggtctggattttctgaaagtttcttaatataacgtataaaatgaaaatacccctaaaaattttgcaaaaatacttttttaaatgtgaccttgaaaaaaatatatatttttttaaacacacccgttaaaaactggaaatttttcacaaaaattcacctcctaaattttttctctcaatttagaattttatgaaattgatttaatttcttccgtagttttttttatcatcattgccattttcagaaaatatttgaattaacaaacagcaaatattttaatttctaagttcaaagctagcgcaaattttaacaaagatttttggaaatatattacaaatttctatattataaatatgcttttaaattaacaataaagataaattaattcctcaattttcagtcatctggccattacggtggccattggcttggtgacaaccaatcccgatggcctgatctccggctgtcaataatcggggtcatggagttcaacatgtttggcatcccacaagttggcgccgatgtttgcgggttcatcggagactcaaatgaagtgagaaaaataggataaagcttatgttatatatattttttaatgattttaattaaacaaatttttattaaggaactttgtcttcgatggcaacagcttggagctttccattcttattaccggtcaaaataattaaatttaacaataataataatttaaataatctattttattgttcccattttagcaatcacaatgatgttaattcaaaagttagccaagatccggcacagtggaaatccgtggcaacagcaacacgcggttatttgaaaatggggttgctccccgtccttcagggagagaaaattcggggatcggggcggacattccccgtcaaaaaatgccgggtatggcttgagaaatttcaaaaataccggagagcaacgctttttcgggaaggaaattttcataaaaaaatacgaattttatcgacgacattcgcaatcctccgaatcgggtcggggagcattcctaatttggggaaataatgtttaacatttaattcttttaataattgtttagttgcgaacttattccgatatcgtcatcttccttatttgtataggtaaaaaaagaaaaatatatataaaaatattttataaaatatttttaaaataaatactaaaaaggtaaaatctaagaatagaactaacttaaaaatattaataaagtttctcatcatatatttgccattttgaatgtaatttataatttgtcaatattctttatacagtctccatttccgcgcttcactgtacggtggtacggtaattcgaccactgttctttgaattcccatcggacaccaacacacacactttgaatttccaattcatgtggggcccagcaatggtcattgtgcctgtcgtgaatccggtgggatttatttttatttttattaattaaatttttttattcgagttggcatcgcctgtcaatagtaaaattaaaaggcccaaatttgaacccattttacataatgcattttatttaaagcttttttgcaatttaaatgcgataaaattaaaagaaaaatgataaatgaatgaaaaaatgagtcaaaagatgaacttattcaatatttagcttatgcaatcactaaaaaaatcaaaattattaaaaaatatatttcattttctgccaatattctaaaatgatttatttttatttcaagtaaattattattttttattatcacagtacatgaaaaatttgtattcaatttttttttgaatttaattagaaatttatattcttctggtttccaaataaattcgtatttatttgtaaaaaaatattttttttaaattaaattttttcttttatatatttttaaaattatatttaaattatttatttcttttttttccttttttaatggcttttaattaaaaattactctaaaaatttcatttttaagaatgttgattctgtccatggttatttgcctgtcaacgaaacttggtattcgatgagtgaagcacatgagtacagtgcgcgcattatgccaggattttcaacattcaaagcgccaagagacacgccgttgccaacctttttgaggggttggatatataaaaaaataatttatttttaaatgataaaatattttaaaatttttaggcggtcatattattccaagacaagagcccgatttgaccaccactgcttcacgcaaaaagccattccaacttctgatcgggttaagtaagtataaattcttccgataggtttaaacttctgaatgcactttggacatccaaatttttacatttttggtatcttccgatagctataagtattctcttatagaatataaaatttaaaattcaacaaatataaaaaattttatagttaaatttaaaaaaaaaattccttacgattttccgacattttcggcacccattcaaagcgccaattgcggcgcagacatttgaggcgtcctcctaattactgagcagaattaattggcctttaaattaaccgccttttattttcctttcaaaaaaaaggtgtcttttttcaacatttattattcgtgttataatttttttaaactattctattagataattctttgagatattgaaagtggcaagaatatgtaattttgtcgacagtcgctatggaaaaaaagaaataaaaaattaattaaattcagaatttaaataagaaatgaaaattggcatttcattccagagccacttgcttgcccgtgcaaattggtcgccgctggggaaatgttttgggatgacggcgaaacaattgtggacgatttcggcaaccattcgtactatcgttttgagtttagcaccaccgcaacgcacaattggacaacaattgttgtgaatcggacgcacaattcaagcgaagtaatttattaaaacgtgccaaattttgtggctttttcggttttattcttataggtgatttgggccaaattagtcactacagccaaaatttgtcacctctggctttaaatttttatttgttatttgtcaagtaaaattttaaaaatccaaggacccattgccaagcttggaccaaattgtcattcttggccacaattttacgcccaatttggacacggcaacattgaacggcatcccaatcaaactgtcggctgactttgtgccggaaaaaggtgctctccgagtggaaagtgccagactcatccgtctggacgatgccaacacggctgtatggacactcagctggcagaatggacacaaagatgatgatggcggacatgctgaaggcagtggtgccaaccgtgaattgtcatttatgatcgctatttatttggccgccacattcaccacggcattggcattaattggtcactggcagtaatggcatttctgatttagcagattaatacttctaagatttttttttattattatttatatgaaattgttttttattatcatttatgcaaaaaacggacgaagaaaataaatttttaaaaatattttatcctattaacctttcccgaaatttatttgtgtaaattttttgaaattcaaaatccgtctcctgcaatttttaatgcgggattgtagggtttgtccgacaaaaatttgaattccatcctgtaacttgatccgctaattttaattttcctgtctctagtctccgtttatgagccgaaaaatttatatgtttttaaataattgaaaattattagaagaaatataatgtctttagatttcccggaaatatgtatttgtttctttgccattgattacggctgatgtagaataacattataaaagagcattataatgttattttttagttgacataaattttaaattacttttttcaaagaagtgaaattttgagctttgtttcacaaattttctcaggaattttttggtaaaattataaaattttcttcaaatttgtttataaaaatgggtaatatttgacaaaataaaacaaaagaaaacacaattaaaatgaattttgctcggccataaatcgtagatgacggagccgtaatttattataatttttaaatttaaatttttgaatttttcctattccaagggctagcaaagagacacaagtacagaatattgccggttctgatcgaatcaatggtgaaaaagaaatgaatgaacaattaatacaaatagagagatacttaacctaattaatgcaagcataatcattttatatttaaagataaaaatttttcatttaagaagcacatttttagctttataaaaataaagacaataatgttagcttttaaaatcaacgtaaaaagccataatccgtgcttcctacctaaaaaaatccgtgcccggctccgggcgtgacccaaaattggcaaaacaaatttccagagactcaagacttgattaggagaaatgagttgattatttttgggggctgaaataccgatgaattggcctcgtcgataatgaaaatgccttcttattcggtttctaattaattgctgtggggcttaaatatcgatgatctggcacgtcgattataaaatatgtgaaaaatgccagggaattggattgacatatgcgtaggaggcccactttggcacaaaaaaaaggataatgaaggggaaaaattggagtaagtgaatgaatatgtcaatggaaaaggcaaaataattgcttcctatttaaaaaaatttttgtcataaaaagagcatcaagaaaaactaaattatagattttattctttattttggataaatttcggaatcaaaatccctttttccgttgtatattttttattgcattatttaggacaattttttaaattaattttattaatcataaatttctactttattcaacactttagagaatatgaaaattgaaaatgctttgccacaaattctttagattttgtgcatcgttcttcggaaacggcacctcccaaaaatgcaattgaagaacagtatactgtagaataaaaaaacatttgaattccgaccaaactgtga

SEQ ID NO: 10321 - DNA, 1909 bp, Heterodera glycines
  misc_feature (1894)..(1894): n is a, c, g, or t
tattatataaataccttttttcagcctatccctttgcctactattcgcttgccaacacatttttgggccgttttttcgcgctccaacaaaaccgggaagatgatttggtgggtgaaacgggcaagaattaaacaaaatgctaaatttttaatcattaaatacccccaataattcattaaagacgcttgcgttgaacgcgtttgcttccgctttgaaaatgccgaaaatgatgctgcaaaatgccgccgttgcctcggatttaaatgaagacaaaaatgacacaacaaaagcaaaacagcagcaagtgccacgcccgttcatcagcccggacctgcacttgaattacggcatcgcactttactacgcgtgggtatttttttcttggaatttatttataaaaaactaattatttgcaacaaaaaaaaaagatttctcgggggtgggaacgaagtgcatccttcaaattcactaaaaaattttgcgtctgttaggcatcgccggcaatttttttttttaatttttcaaacagaaggtttaaaaaaaagtcgatagaaaattttcagacttttttcacgcttaaaaaaaaattgtaatataagttaaaaaatcaaaaaacgtggttggttgggtgggggcgggggacgttcgaaactcgtcccattttttggcaaaaattttccgataccctttaaaaatgctgtatggtacatgtttcagtcaattttatgcaaaagcgttggcccagtttcgacgtgcgctggccattgagccccattttggacaggccaaacaccaattggacagtgcccgccaatttctgttcgccctgcgtgacggactgcacaaaaagggtaaaaattgtgaaaaatttaaaatttctcattcgaatttcccaagggacagactctgaaatttttatccccccccccccccaattttacaaaatttctaatttcggcgctataaaatttttttgcagttttattcaaaaaattttagcctaaaatgattaatttattaggaaatttttgtgtcatttttgaaaaagaattgtactcaaaaaaaaaatactttccaaaaaaaaaattattattttttattatttcacatgccattgaatgcgccaaattaattataattaattatgcctgacatttttttaaatgtggtacaattaagggaacatcgcaaagcgtcgcctgcgcactctcctcgacacattccctttaaaagcggcgactctgatggcggagcaacactttgtgatgcgtatgaagccggcacgggttgggttttcatagatttttttcaaaaaaaaaaattcgtaaaattgccagaccttggccatctgttcaacgcttgacgatttgattgccacctcttccaccgccaattacattggtctttcactgtctgcggttgcttccgccgcgcccgccattgtggcatcggtgaccgtccgttgtgtaggcgttgtgagcaatgaggaaaaaattccgaggcaaataaaaatttgtaaaattttgcgaaaaaatttgtatgaaatttgacattttttggcatggcatgggaaaatgtacaaaaggcacaaaccaaaaaaaaacttttaaataatgtataaacataaattcgtgtttttttggaattttcgatttttaatgaaaaaattgcctaaacttttttaggtactttccttttttgggtggcatgaaaaaaaaaatcggcaaaaatgcgcgaaaattcacaaaagcgagtacaacaattattgttttgggacgacagaaatgtgacaattgtttccataaaatcttgttaaatggatcagtttgagaatatattcattgaatgaatgcctttttgttgcttttttttaaattttggtatttgcccccanaaaaaatggaaaata

SEQ ID NO: 10322 - DNA, 3164 bp, Heterodera glycines
  misc_feature (3045)..(3045): n is a, c, g, or t
  misc_feature (3066)..(3066): n is a, c, g, or t
  misc_feature (3074)..(3074): n is a, c, g, or t
  misc_feature (3101)..(3101): n is a, c, g, or t
tttttattttaaaaaataaataaaattatttaaatagtaatgtaagtaagtaaacaaattttatttccccaggatttgggattggacgacgacgacaggaagatgaaggagtgcagcagaagcaaagatggaggaggagcaggagttgacaaaccagcagttgttgttgttgtttctgttgacggagacgacgtcgaagcgaaaagtgctgctgctgttgccaataaaaccgcggaaaatcaccaaaagaacgacgacgatgccgagcagtgtctgttgatgatccgtgtcatcaatccatcggtgaacaaattaataattaaaataaaaatggaaataatatatatatatatatatatatattgtctaaaatttttttgtgtttgtttccattggtttgtgagtgtctctcccaaacatggagaagttcaacccccccccccccgaaaaatttttttaaataagaaaaaccataaataatttagggtttacatactagaaaaaattttaattttttttttgattttgtttttattgcaatttaaataaataaataatttgaatttgttaaaatgtttgaaatacccagtttaacattataatataacaataaatttaatccaaatatttaaaaatgaatttttgttggagcgaatgggattaatgggcgccaccgctaattgactcccccgccccatctgatttaagcgccaactgctgaagaatgggaagccgctgagttcgttggactgcgcttttgcggcaatgtcaatcgaaacgcagcaaatgcaaatgggcagtcgcgcgagggccgaataaaatttcagaaaaaagaaaaatggcacaaaaataaatggcacaattcgacgaatttgacaaaaatttaattttcacttgctttaaactaaggggagaaggacaccatcaccaccaatttatcattattattatttctcgctttacatttttatttttatttgttttaaatgctttttatttaagagagcgtataaatattaatgaacatttaaaattccgtttgtttatttatttctttaattcattttttaatattaaacaaaaaaaaagtggaaatgaaattttttgtgcttctttaagtcaggctctctctctcccctgaaaaattaaaaattgagaatttcaaaagaaaaagaatttcaaaaaaaataaaagaaagcaaagcctaaaattaaaaaaaattgtcaaaaaaataaaagaaagcaaagccaaaatttaaaaaaaaattttaatttttttttattttaaaaagtaaattttgtataaaatcattaatttattccttatttaaaaaaagtacattttatataaaaatgatcaatttactcccagatcttttcttttgttttctccagacaaacacttttttccaccctcatttcccgcctaacaaattgctaaattccttcctgctgatgaacccaagaagcttggaagcgatggattaatgggtcacgtttcatttcatttcttcgtctccccccccccccgcgcggaaatcgaaaaatgtttaattttcggattaaaattttatttattttttctttttttttaatttgtctgcccccccccccctttccgtgcccttcatttttttccgtccccattttcccaccgtttcatctgctgatcggtgccatggcaaaaaactttgctggggcccaccaattttatttgctttgcggacggcattagcgtttcgctttgggtttcaatttcaggggcctgggaatggaaaagaattttttattttttggttttttgtttttcttgcaaaaagttttggactctgtgccgttgggaaaaatcgaattttcttaccaaaaacttggcattttcaagcattgaatttaaaaattgccctcctctgttctttgccatgcaatttaaagaactttttaaattttcaacccaaaacttggcatttttctctgccatggattttaaaattgccctcctctcttctttgccatggaatttaaaagggccacaaatttgataatccgatttaaaactataaaatgcgaagtttgtgctttgtaccctccgtgcgtgttctgctgttcaaatttgtttgattttattaattacaataattcagctttaaataaggctctccaaacttttttgtttatttaaaataattagtggcttcattttaagaattttcccataaaaagttttattttcaaaaaaaaaattacagcgatgtttctttaatccaaaaatgaccaattttgcgcggttttgagtcaaatgtttaggtgccgttaggcacagtcgggaaaatttaaaaaagattaaataaggaaactctgccctgaaatttaacaataatatctgctcgagaccgaaaatttctcgagccgagaccccataaatccgagacttatctcgaggacgagattctcgagcagtacagcacaaatccctggctccgttcatgtcacttgcggcgcttccccaatagttaagcgagcgctttttcaatttttatccccaaaatgatttgcggggtgccgttttttgtcgaccatttgtctcatttttttgataagtcatttcggtcgaccatttgtctgatttttttttgggattggctgtttctgtcgtcctttctttttcattttattgttgcgtaacacatatattttggcggggtccggacaatttgtcagtggacaatccaccaatagacaatacgtcagtgaaggacaaaccgtcagtaatggacaatccgtcagtggacaattcgtttcgtcagcaaattttattttattttgagcaatgatcaaaaattttgcgattgcgattgttccattattcctaagctttgggcttaggcttaggcttaggctttcctgggccaggactaggcttaaacttaattttgtaatttattaggcacccgataatcttgagatcattattttacactaatgttattattgcaaataaactgacatcaaaaacaaaaggaaactattacatacattctcaattacnattccaacaaattttaattcntcaaattnctcattaaagaattttattccatttanaaaaaaaacatttcgccagggggggggtaattaaaatagccacatgattttattgaatattaa

SEQ ID NO: 10323 - DNA, 1271 bp, Heterodera glycines
gtcagcaaatttttattttattttgagcaatgattcaaaaatttttgcggatgcggattgttccaatagggcctaagctttgggctttaggcttaggcttaaggctttcccgggcccaaggactaggcttaggcttaattttgtaatttattaggcgccggagggtcttgagatcattattttacactggtgttattattgcaaataaactgacatcattaacaaaaggaaactgttacatacattgtcaattgcgattccaacaaattttaattcgtcaaattactcattttttaattttattccatttggaattgaaacttttcataaatataaaaaaattaaaatagccaatgattttgttgaatattaagtaaatttttttattgaaatgcaaaaaatctaaacgcttttgataaaaaatcgtaggaaaaaggtagatttttggtttttgcactttttgtcaccatgatttcggcacacgatttttcggcattttgtcgctttttccgtcggcattttgtccccattttttctgtgcgtgccattctttcgtttcgtttgccattgtttgattttatttgaacaaatttttcttttttcatctcgcgtcatttcaatttgtgcgctaaaattcattgtccacaacaccaccactaataaattgtcccaacaaatttgtgcccccggggggtgcgggagggcgtcaccgatgggcgggcacaaacattggagagcccagcgcaccgtcaccgcttctcccattacgccgcacaaatttcaattgctttgtgctgcttgtacaagcattttgtgtttggtttgggcatggcatttctttcctgctccgctggctttggcatgtgccaaatttgtgaatgaaattcaacgcgcaccgccgccggtgctttttgcattaaaagcgccgcccctggggggccaactgcagtattttgtgctttgatgaagccgctgcctcaaaaatttgtccccttcggggcattgttaatatagcacacgcacaaagtcagcacaccatttttgcgttttataattattagctgtaattataattattattaaggttggaaattattgatttaattgggctaaggcacagtcttttccattttccccccaaaaatttagtccatggaagttagggcttacaaaactagcaaaaaaataaatcatttaataatcaaaataagaaaacaatatttgaacaattttttggagcaaaatttgggccagcaattaatttatgaaaa

SEQ ID NO: 10324 - DNA, 2580 bp, Heterodera glycines
attttctcagttccaccgaccaacgtgtccgttgttcgctcattctttcgtcaagtgcttccactagcaacaatcacgcaagaatcgccttacctatttcgactgtacagtgacaatttgtggacagatttatcacggatctacctttatctcgaactgtcaattgaaaaaccgggagcaaacgataaatgggttacgatagatgatgcggatactggtgtctctgccattcaaggaatagggcaaacatttgtccagcaactaaaagttacggttggcaacacggaagtgtacgatagcggaaatctgtacccattcaaagcgtatatcaccaatgagttgagctttccaataaatgccaagaaaaattttcttggttcaacagggtattattacaccgtaaaccaagatgagtcaacagacgaggggttcaaagaacgttgtaagatcttaagggtggaaaaaatgcgcaattcctctcccgtctcgactttgatttgggaaaccaggagctttatctcttaaacaatttggatttgctgttcacaatttacaaagccaaagatgtctttctcttgcaaactttaaaagccaacgattcaaccaaatatcgtttgacagttcacgatgtcaagatttatgccaaaatggttgaggtacaaccttcactaaacatgagcctttacaaatagttggaaattcagcatttcacggcgactacaaactgagtccattcatgtttgagccgtttgatttgcgtgaaatttcggtacatgccggtggggtggtctacccagctgttccttataaactaaatttttcaaaggatcactttgtcagtgcctttgttgacatgtatgaggcactcggaatggccaattcagaacgttcatttgacatttcaatgacccagttcaagaaaggatggaccttttttctgatcccattgacatccacgcttgacgacagctgtggatttgagctgttgagaagcggtacgacaaacgtacgagcaacattcaattcaccaattcccttggtggcgtggagatgattgtcttgggtgaattcgaccaaatgattatggttgattataatcggcacattgtgaccgactcaaagcttggataaaatataaataaataaaaatgaaaaatattattatataatgttaaaatgaataacaccaatacaacaaaacccaacatacaaattttgaattccccagaagagcctaatgaaactcttttacatgtactacttttttcgcattatcttcttgcatttccggtgtttttgcttatttggttcgttttaattcggtggcttaaaagtcacggtcacttaacgcccagcgaggcagagacagtaatgcatgagatgaaaaatatcccccgacacccaccaatatttttcgcaacaaaatgatgcaagattagagaaaactgacagtgaactctctctctctctcttcagtatgaccaaatcgataatgagtcatgctggcggaggattctcaaagcgactcattttttttcatctttcattttacaaaaatgcctccaaatgaaaattctgaccgtccctttcaacaacccgacaatgttcaaccaaatcaacaaccgcatcaacaacaaccagatgaagacaccgagttgcgtgcacaaattgaagacgcggaggaggatttgctcttgaattggtggcgtgaagacccaacaattgtaagctttttttttcaatttagcatagttttttttaatttcatcacatttttcagattcgttttctttttggacacagacgcgcccctgcaatcgaagctgcgcttcgtcaacgcgctgaacgtgaggccgagatcttgcgccaatatgccgagaatcagcaatgagaagtgaccgatcaaaataaatgtcgtatgtttttccatttttttattatggttataaatttttattaaaaatattttgcaaagtgcggagctgagggaggggtgctgggggggggggggtcttcaaataaaaaaaaaatccgcgtcggagcacaaggtcaaaaggataaaacttgcgcaccccttgtccgattgacttcaaattttataggccttcattccactatccccataagctgaacggcaaaagaatttcgcctcaggcaccattttaagcggagttttcccgacgccccgccccctcgcgcacccccgagactcgcgcagcaaaactcgcgcaccccttgtccgattgacttcaaattttataggccttcattccaccaccccctaagctgaacggcgaaagaatttcgcctcaggcaccattttaagcggagttttcccgacgccccgccccctcgcgcacccccgagactcgcgcagcaaaactcgcgcaccctttgtccgattcacttcaaattttgcaggccatcattccaccacccccataagctgaacggccaaagaatttcgtctctagcaccattttaggcggagttttcccgacgccccaccccctcgcgcatgcgcagcaaaactcgcgcaccccttgtccgattgacttcaaattttacgggccgtcaatc

SEQ ID NO: 10325 - DNA, 2257 bp, Heterodera glycines
  misc_feature (82)..(82): n is a, c, g, or t
  misc_feature (101)..(101): n is a, c, g, or t
atcaatcgacccaatggatgaggagcacatactcatcacctatctccacaaaaaggactgggtggatgagcatgcctgctcnaacattggtgaggcacacncacatttcctgctaattgatgcttcagtcatttctctgtggacaacatctgctgcgcgcctcgtgctgctcaaagccatgcagaaggtggtcagatcgccgggatctgagctgttgtacacgggtaatgcaacaatgcacaaaaaaaccgatgatgaaatcaaattattttagacactgacagcctcattctggtccacccggaggagcggtgcccactgaaaactggcacccacctgggtcagttcacggacgagtacccagaccacgacattgtggaattttgcagtggtggggcaaaacaagtaaagttaccatctgtgcaaattgtttttttaatttttccgcgctttagtacggcctgtgtctgcgacgcaagggcgcggaggcgggagcccaaatggaccatgtgctcaaagtgcgcggactgacgctgaattatgatgtgatcaacaaccaagggatgcgctatgagaacttcaaagaggaggtggtccggtacgcgacaagtggtgaatacgagccgataatagtcacgtacccaaatttccttcgacctaacatcagggagggaggccgagtcgtttccatgcctatgcaaaagtgctatcgtccgtttgtgggaaagggcataataggcgctgatttcaatgtgctgaattttggacacacaccgtaatttattgtacattgtctctctctctctctctctctctctcacacacacacacgactattcttttgtacctcttgtgtacattttataccattttattcgtttttaataaaaattaatgcataattaaagaattgaagataaagttttaaaataattaagcattagaagaagtcaattttaggtagaaaaatgcacaattaagcaagcgaagatgcaatctatattgaaaatgaggaatggaaaatacattaaaatatgtgggtagaaaattgcacagtttcaccagtaggatgatgatggtgcagcatcttgactgcactcattacgcccaatgtccatgtcatcgtcctccagtattaggcgcagtgatgtgtggtgcgacgatgagtttgaagcggattgtttgtcattgttgtcaatttcggtgaaaagattgcccaaccaattgttgttgtcgatgtccatgttgtcatcaatcagctcaagcagctccatagggtagtgtcggtcctcccctcccccggaaaagcgttcaacaatgcacggtacataagggaggtgaagctttattctgtggcgggcgtaaaaatgcgccgccacattgatgttgaacgggttgcgcaagtggccataagcgggaagaaacgctgcgccttgtgccgaaatcccagcaatgaagaaggttttggtcagcccgttacggtcattgtaggtggtgcgcactttgcgcccaataaggtgtttcagcacaagcgcccggtcctcggggtggttgagccggtctcgcaacaatttgacagggcatttgagcagctggccgcaaaatacgcttacgagaaccattgcaggagaaaatgaaagtcagatgtggatgggtttcacttttatatccggaaaagggatgccacgcctactccaaactttgccgaggaggcacacccactcccaaccaacatatttcatctggccaaaactcaaattcatttcaccaattttttccaaaatgaagagacgcgttgctactcttactgctacttctgctgagcaacacctaataatcaatcccgagccaaaaccacagaatgagaccctgaaaaatgttgagccgaaggacgagtaggcaaccaagaaacgcaaagtggaggaccgagagttgtggaagttggcaaagggcaaatttttgctggcgacctacttgtgtcccggtaaccaacaacaaaaattattacatttttttaattgattaattttgagatgattggaatcgactgttcaacaatcaacagaaggtgaaacgtgtggagggcgatcgtgtttgcttcagctttgaactgtgtgaggagtgcgcattggtcaattgccgcgcaacggacctgctggctccgatgaaaaaaagacccaaaaatgacttttgaatttccaattgattcgcatttatgtccctaattcagttgaattgttcccatatttgggattat

SEQ ID NO: 10326 - DNA, 4145 bp, Heterodera glycines
caaatttaaaagattctgaggattttccccaaaagcctcataaatcctcaaagtttctcaaaaagccaaaaaatcctcaaatcctcattttccaaaaaaatcctcattgacctatcaaaaagccacaaaatgaggataaatcctcagatctggcaaccctggccaaaagtcactcaacgaatgccctttcagtgcctactttttcactcccccccccccccattagtcacctctctttcaactttttgatgtccgtcctgcaggtgacgttctgccgcatcagatcggtcttctccgtcttcagtctgaccacgtccaccaccaattcctccaatctctgtctttccgcttcgtgttcttctttttcgtcgtcgtctgtccaattaatcgaatggttaattaattaatccaattctccaatttgtctcacttttctttgctattctctcgcgcttttggagtgcccctgcggcatttttcccattttttgcgtcccctgcgccgttgttgagacatcgtcggccaaccgatggtgcgccgttcggttggatgtcggccgatgacatgctctccatgccggtgtccgagtcgtgcccccctccggcgcctcctctgagtgcgtcgtccgcttcgtttagcacctcctccacctctatctccacatcgtccaagtcgtcatcatcctcggcatcgcttcctccgtgccaatgcctcaggtgctgaatgctcgaccgaaacggaatgacagtgcccggaggcaattggtggtgggcggcgtaaggggaagagggcgtggagcggtggtgatggttgtgctggtcgatgcagccgaacgacgcttccaacatggcggaagtgctgctgaatgtggatgatgatggacggaaaccatccaaaataacttttatactgcaaattcccgcatttccctcttagttaaaagcccccattaagcgatagtaattaggacggagttattaaagccacttatacaatgggttgtacacataataaggttcccgtaatcagaattgattcgtccagtactgctccttcccccctcgtcttctcacttcctttccgctgctgtctttgccatttttcccgcatttgaacgccatctcaaaagatgatgatgctggtgataattatgtgatggcatttgggacggatgagcaactgcggatggtctgtcaaaatgatgtccggatgaagaggaagtggaggcggaagaggacaggcgacagtcctccatcggtgccaccaaagacataattcgacctgctggggaatgagtgatcggctgatcagtctgatcaatggcaaattggccaaccccctctctctctggtcaatgctcttctctgctgttgcattgcgtcggccattggcggcgtgccaaactgagaggaggagccggacgagctgctggtggagcacaacgtaccggacagacgacagccaagcggcaccttttcattgaaagtattggcacatggcatcggagtgccatttgaggacacgtcttgtgacaccgatcgtgacctttgaatattgaaaaggtcaaagaataggaacaagcattcattagccaattagctaaatcagtctactgttccatcaaaaagtcatgaggatttgttgaattgttttggggtgatcatattaatgggactaattaacggcctaattgatgtccattatggtcaggtggtgctgcctgcccctcacctcgcactgaatactttcttcaccgaatggaacagtcccattgggttcgttcctccgttcaccgatccattcatcagttgctgctgttggctgtgctggtgatggttttgcccgttgttttgccattggtggtggtgcttctcctgttgctgctgtttcgtcgcgctgtccaccgaatccaaaaatgccatgccgtaaaattgggcccgctctttcaaatttgagtacagtccatccagcagcgatgcccgagtgcgttcctgaacaaacttttgattaattttcagaaaatgaaaattgccataataccgccaatttggcaaatttttccgccttataagccgcgttttccgcattgatcagtttggtgagcaaaaagtcgcgcagttggcacttccaaattatggaagagcgcggaagcgtcgggccaaagaacggcacgtcgtctcgcgctgtcatcgacacgcggtaacgcgtgcggtcagtgcccggctcaatgggatgaaccaccaaataggcgtggagaaagctttagaaaaaaagaaaataattaaattaggcactgaatgttgcccttttttgtacttgctcgcgatcatgtccggacagaagggtgtgttctgctcttggaaaacaatggccacgatgtcgttgccaatgtgccgcttgcgctgcaattgttgcgcgtcgccaatggtaaacggcaaaagggtggacacatggaacctgaagaagccggggaagagctaattgggctaatgggatgtccgaattaaagggacaattaagtttttggttgaaatacacaataaaatggatttattggcttcctctcactctcctatttttaatactaattatttgttaattgaaactgacatgatctccttctggcgaaactgtgtgtacaccgactgaaaaaggaaattaagcaaacggtaccgtatgcccgccccactctgccccaccgtacctcggtgcccgtctgtccatgaacggtgtccagtccgccacgataaccgtcaaaatgacgcaactgaactcggtggccgatgatggagagaaattcgtcgaaggctgcgcagttggaggagtcgttgctgaacagctcctcctcggtggtctgcccaaacttttggtaaattgcacctgtgaaaggggggcaactaattgatcagtgattctattttgagtgttaaataaacggactgaccaaatttgtaagtgttgcttatcacgtgctcgtcgaattggaggatcagctcacttccccccggaaaagcgatgggatagaaacgttcggccgtcaattcttcgcataacaatttggccattcgacatgcgctgggacggtcggccaatgccgaggctgggacaacctcatggaccttacaaattaggaattgatatacacgcgcaaatgaattgaacaacgggcggggaactcatttttggcttattagccaattggccaaggcattggccgttccctctgaaaataaaccaacgcactgtgccgtgacgagttcgcagaatgatgcggaagtgattttggcaggaaattgtctccgtgcgaacactcagcaccagcggaccaatcagcgggtcattcccataaaagttgtggtgttcctatgggaacattcatttatttatttatttgcttctcgggagtattgacactctcccaaatatttaaaattaatggccattacgaactcggcattgcccactgttaattaatcctctccccccaatggactgactcttcctaagaaatggcgtcggtagcacagtgccgtgtcgtccgtctccaacttcgtcctgtcacagcttccccccgtcccattctttggcacttcgtcttcctcctcatcctcctccgctttgtcccttcccttattacgtccgtcttccgcttctgcgactcgatggtacgaaatgactccgtccatccaaaagccgccctgagggggcagcacaatttgggggaaagggccgttgcccgaagcaatgatctgaagggggggggaataggtggaattgaaactaataagaatggaacaaatcaaatttattaaaggaattattagcataattccattttcggaaataatctgccaaatttaccttgccattcattctttcttttcatttttggcttaatctttcaacctgttttattgagtctcgggaaaagcctcgactcgtcgccaattcccttctcgcacaaaacgcagtggcggaaggagtcgacgcttcgccgacagatggcctctgtaagaaaggattattctaatttgatcaacatcaaccaagtgataggctaatctaacggtctgatcactctttttaaagccgccaaatattcactgaaaagtcaaattgacaataatcaattacaaatacatcaa

SEQ ID NO: 10327 - DNA, 1845 bp, Heterodera glycines
  misc_feature (45)..(45): n is a, c, g, or t
atgaagagggcaaaggaaacactgacatccaactgatcggcatanatgccaacattcgcatttaaaccactattcccacccaactccttctgatttgatgctccttcttcccttccaacgaattccactcactttttcttccgtcgatgcccccaattgatcacatttgtaccggtgataactgtcgttgtttttcgtccctttcggcgccatccatgacaatcgcaagtattttgactgccattcaacaaattccgcctttgaactgcttgatctcgccggtgactcaggtcgggtcagctgctgctgctgttggttccgttgtttcggttccgtttcgctcgtgccgattccgactccattcgcctcgtcatccgtttgcttttggcgacggttgcgtcttaacagtcggccgagaagggatttcatcctcggtggacgctgttggtcaatcggtaatgaagaggttgggtgtaaagtgtgttcattaaggggcgatgagtccgcccactgcgctaatgaggctaataatgacgacgacgatgatgatgatgatgatgaccaaggaagtggggcccgtcccccctcggcctgttgtccttctttgttcttcctccgctgggcttctggcgaatgacttttatctccggcattcttccggaagaatgaccttcgtcgtgctgttgttggttctgttgctgtaattgttgctgctgcgtccgcatttccgctggtgctggccgtgctggtcaatttgcgcaaaataggcttaattgacaggacggagtgtctccgtcgctttttgctctcctccctttttgccgcgtttgtctctgccaaatggtcctccgtgtcactcatcggcattctccgaccaatttggttgattagtcgctgctgctgctgatcgccagtgccaatcgtcaaaatgcaattcacacattttcgccccatctggtggcacttccaacatttttgctgttttagcacttcgttttgcgcttccctcccttctctgtctcccatttttcttccatttgtggtccttccgtcttccccatgtgccttttcgtgctgtcgcttccgttcgatggccccagggcatccgttgccggtcgctccccccgttgccccccaacagtttgtgccgctcgtccgccgtcccctcggcctcagtctgaccgcttgcactcgttcttcgaattcctcccacgagcacaactgctgacaattcggcacatttcgctgttcttccctttggtgccgtttctctccttctcctttctcacatttttctgctgttgcctttgtctctgttgtcgcttcgtttgattgaatgttctcccaatttgtcttttttgtctcttttcccccatttataatttttgtctcttcttttgccattcgatggtatggcacggcaacgcgccgtcgaagaatggacggaaggggagggacggcagtggtgggacacgacggaggcaaagcgcattggcatggcacatgcgaaagtggcaccgttttggcaacaaccgaacgtcgctgttgcggagggcactgttcgccaatttcggcctcccatctctttgtctcctcagaaaacattgtgagaggtcgcacagaaagtcgttgcgacggaaccaatcgaacaccgcccaaatcggagggcaattcggaaatgcgacggagtcggaccaattcgacggagacggccatagggggagggaaggagaagaaaaagcctgcccagcttaaagaggacggctttttgaaggtgtaaggcgtgatttgttgaacgaataaaaaagaacagtgaaatgtgaacggagaaaaaagggaaaagaa

SEQ ID NO: 10328 - DNA, 1025 bp, Heterodera glycines
ttgggggggagagacggacagagcagagaaatcccatggaattggggggagagacggacagagcagagaaatcccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattggggggagagacggacagagcagagaaatgccatggaattgggggggagagacggacagagcagagaaatgccatggaattggggggagagacggacagagcagagaaatgccctgggatttgggggggagagacggacaga

SEQ ID NO: 10329 - DNA, 1779 bp, Heterodera glycines
cgccggactctcttccctcacacattctcaaaaagttttttggaaaaagtgcaaaaaaaaaaatcaaaaagtttttttacgaaaatttcaagattaaatttttgaaaaaattttcagcgattttttctaaatgttttcgaaaaactattaattcctataaaaaattgaaaatccgtttcaaaattttttcaactttttttttacaagtacaaattaaaataatttattttggtgtgattaaatctattatttcaactgaccgatgttttttcaagttttcaaaaaatgcttaaattggttttaaaatacattcttattataaattagatatttttagacgttcccaagcaattaattgattttttcaagcatttgtttgttttttaaaacaaattttaaaaaatccaggtccatgcctggatccaggtctcgaggagcctggatttttcctggacctggattttcctagatttttgtccaggaaatccaggtccaggtccaacatggaatccaggtccaggcttttttcaaaatgtcgatctctaaaaataattaatgattcctaattacgaacaatactattaaaatgagaatgtctgggctaaaaatgagtttttcgcgcatttctcagcgaaacaaagcagcaaaaatgttaaatattgtaactaaaatgcaatcccttctgtaagcatagctatttggccttataaattaattttcattgatattttcattcctcccatccttgagtctgccgggacctgagaagccgggaccgggaccgggacctcgattttttttcgggaccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaataattttggactaaatgatcgagtattattagaaattcaggtttgcttttcacataactttttttcggcgcgctttttccaaaaaactttttgggaagaaaagggtccggcggtgccgataggcgccgccgggggaaattttaaaaatttgggtgcaatttgttaacagattttcaacaaaaaaaggttggtttttgcgattattaagctcaattggtaggattttcatttaaaaattttttttctaaaaatttccttcaagccatcattcttggatttgagatcactatgaggaatgaatgcactgtctaacttggtttaattaatttttttgttcacatcttcttagaaatttttgccaaatagacctaacacacaaatataagaagaaaacaaaattgggaagtgtagatgaatttttttgtaaatttacacgccctctaaaattggctcaaatttgctggaaggaaattgctagatcaacttttatgccaggggtcggtctgtcctatttgtcagttgtcctgatttggagggtccaaatctgataaaatgaaaatgtcccgatttgtaagatttgtcctgatttggaggtggtgaccaaaatttgttctgacttcttaaactaactcattatttttaaattttatggcaaaatgtcacttttatcaagaaaatataagatttgaggcaaaattggtcattgttggacaaaaatctgttaaaatcgcattaaaaattacaaaattttttcccggcggcgccta

SEQ ID NO: 10330 - DNA, 2503 bp, Heterodera glycines
  misc_feature (44)..(44): n is a, c, g, or t
  misc_feature (66)..(66): n is a, c, g, or t
taagccgccaatgtcgactaaaacggttcaaaaacgccattttngacataaaatgactttaaaatntaggctaaggacagcggggcgtacacgtgcaacatcaaaaatgacggtggagaggcgaattggagccgacactgaacattgagggtcagtttaacagcattttattaaatgacaattaagcatcgcaatgtgtgtttgtgaattgagtgacgttttgaagatgattattttttgattaaattttgacgacgcagcgtccgacgacggcgacgaagacactgaagaagcggtcccatccgttgattcgggtttatagtgtttcaaatttttatcccatattgttttcgtttttaggtctaactcgccgcattggatttgttcgccatgtcatcgcgtttttcgaggactttttggtcgaagaaatatgcctttacggattttgaattttttaaaaataatttcttatttcatatttttaacattttcaaactttacattttattagtttcggcgacgcttaacggatcggccgattcttcaccaccaatccaaatgtggatcttccttccctttctttctcactttcatcggttgataatgcttttttaactgtttctactctgtaaaaagccgctttctgaaaatcttatttttggtgtcaaaatcttcgttttagcctcgtttgtccttattttgaaaaaaaacttggcagccctgtctgtactacttacacaactgggtcttattttctaaaataaattctgcatcatcattagagaccggattttgaggcatatgctttttttgctaacttgctatggcctaatacgcacgaaaaacgagtttttaacttggtttgaagcttctagcttgaacttttttgtgccttttttgcgattttggtgccttatgcccgccacataattttggtgcctttttcatgcctttttcaggatttttggaacaaaaatagataactttttgcaatttttcttttacaatttccaaaaaatatttttcccagcggcgcctatcggcaccgccggacgccaaaaaatttgtcattttttcggagctaaaaattcttttttttcgctccggttaagcaaaaaaaaaaaaggtctgttggaaaattttttgctacaaaaatgttgatttttgctgccaatttttcgtgccttttttgacgcttttgttcattttttatgccttttttcacatttttcgtgcctatttgagaaatttgcgtgcctaaaagtccggtctctgatcatcatatttgagtgttttcttcgttaatttaacactaatgaattatctcgctttatcttcttcttttgctggtggtggcggagacaatggccttaagcgcaatttgaattatttaaaaaatgaaatcccttatttaattgcttacccgatgcaattggttccactataaagccaaaagtacacatagttccaattttcatctttcttctgctgctgaaccgccgcggcctccccaattttgcatcgtttcattatccaaatgttgtccaattcatttgctttggccaatgtcagcttttcttgcgttcgttcgttcaccaattcaaacggcacaatagtcattgtcggcacatgaacagaaaaatgaatttcgtagctgacggaagaaatggtggtggcacgcataaattcctaaacaattccaaaaatcagcgatttgccgaaaatgtggggccgcacctccttgaaagtgttgaccaaatggaggctcacttgttcattaatatcaatgaaacggaatcgcttgggttggccatcttttctcggagagtgcaaccatttgttcaacgcttggccagcagttgcatttggcccatcaaaatcatcaccaattgcatcgggcagcaatagaacggaatcgattgaactcaactgattgagatcagtgagaattgtgggcgaagtgcgacgacgcaaattgtccaaatgatcagcatcgataaagtccaagtggcgaatgtttgatgcaaaaattggccatatttcacgaacaaaaacgtcccaaatcggctgccggtcatccgccatatctgagtaaagcatccccatacgcaacttggtgccacttttgtcgaaaattttgtgatttgaacgaagaaaagcgatgacggagtgatcaatgtaactgtgaaaatggaatgaatgaatgcttttattgcgatagcactgatttttaattactcaactcgaaggcgcttaaaacgaattttgctgggcaacggacggtcgggcaatggaaatggcatagaattggcagcgtcgataaacaccgataattctggtgccgcctccgccgcagtaacactgttcttgcgacaaatttcgattcgtctccaaattgtcaattcgggttggcagtcgaaatgtttgtccaccaacgcattgaaacgtggcgaaagaagcgccaatttgaggccaagttgagcatggtcaaaacaggggaaaa

SEQ ID NO: 10331 - DNA, 2641 bp, Heterodera glycines
  misc_feature (26)..(26): n is a, c, g, or t
tgtatttaattaaattgctaatttanttggaatgaaatattataaattatagtaaatgcatttaaattattttattatatgcaattcttcatttgattgtttttttaaggatatgtctgactatttcaacttttaaaaaatattttttttaattagtaaatatctaacacaaattttgattttgttattcctctttttcattttgattaaataatttatatttaaacttaagctaataaaaataattgcaaattacataataagtgcaaccttttgtttttttattcgcctgttaattagttttctactttaattgagtatgtttctatacttttttataatatagatttaagttaaattgttttatttatcatatttttatttcacttaaattaggttctaattatgacttttcttattatattagtgaaattattttaataaaactttaataaaattaaagataaaattattttattattttaataactatttaaagttgccaaaatttatttttctttaattttaagttgccttctcctaaatatttatctaatagcttttttaaattaaaagtagaggttcctagatactttaatttaaaaaaaaagtttatttttttttgctgaaaattttatttcgttaattgatgctttattaaattattgttttatataattattattgttattttatttgatcagttcaataaaaaaatgtcagtattaaatttaaattttatttttaatattttatatttatttaaaattataatttttcatttaaactacaaaaatgggtttgtctcataaagagcattagaaattcatttcattgtattcgggccttgtttttgtcatctttaaaaaaatttttcattagttaatttatttttacattaattcgaataattcgttgttttttttataaactaaaagtatcatttggatattaatcggcagggattttgttttttgattgtctgctgaataagagcactaatatcagcttaataattatttgttcataaaattatattatattgaataaattatttaatgctttttttgcgcgcgctttttccaaaaaataaaaatttttttggcggggggggggggggggggtccggcggcgcccgcagggaaaatttttgtaagttataatacgatttgttaacagattttgtccaaaaatgaccatttttgttgatttttcacaaaaaaaaacaacaaaaatcagcaaattttctcaaaaatcacaaatcattatcaaaaaaaaaaatcacatagacttcttgaaatcagcaaaatgatgataaatcaacacattacgagcccagataataattgatttaattgaacacaattgtttcacaaaaattttaatataaattcttattttgtcccgaatcacggcccagcagaagcatctggttaggattcgggtttcgggtcgagaaaaatgtcggaattcgagtttcgggattcgggtggcaactctggtttggtgccaatgaattttccatttaattaaatttttctttatatcttattcaaacaatattttatctttttatcagattatttttcattttaaattttcttgatttttgttatatgtttttatttttatgtacatcaattttacgatattaccaattttggttagttttaaatattttaaaaagttgttttaaatttagagaatttcacaaaatcaaaaaaaaaatagaagatgatatttaaaatacatatcctcttaaataaaatctattataaaaggtatttacatgcgaaacaatgatcacattttcatatttattttcaaagtaacttcaaaaatataataattatgtttaataatttaattattttttcagtataaatttatttattttatatttactattttttgtttgtttgataatattttgcttccatttttattcataattttgttactttgaatatttatttattgcattttattttattttatacaaaatattatttttcattgcattgcttatttgtaattgtttaataattttattattttttctcttcttttaattaattcatggctgaacttccttttccgttgtcaaagggatgaattcgccatttaggaagaacaattgataatgatttctttcattacaccgtttttattttatttctgttaatagtacagttttttaaatatattgtgcttatgataaaattaccaaaactaggatttttttagcgcatttaatttttttcatgttttatatttttcttaaattttaatcattttttaattaaaattttattttttgctttttctgttctttttctcgtgttttctttcctcgcaactacttgcaataatcggtctatattaggtaaattaattttatgaattattcagggtaatttatgaaatttgcataatttgcttattaaaattattttaaccctaacaaaacatatttttttcaaagtaaaaacattcagattaataattaacaattatacttttttctacgttcggttcatacctgttttaattatatttatttttttaaataattatgtttttgttgggaacttaatcatttttaattttttattcataatcattaaaaacttttttgatt

SEQ ID NO: 10332 - DNA, 1294 bp, Heterodera glycines
  misc_feature (66)..(66): n is a, c, g, or t
tcaattataagaattttttatttttcctacacggatttttagataatatatagcaaattttaattnaggaaaataaatttgactttatcaaagtgatttaatctcgaatgattttaactaagattagcaaatttttttaagttttattatttcgataaaaaccaaacttagggacctggattaggaacaaacaaagctgtctcttggttgttatctatctatttagttttatattatgatgtgccttgactcccggccccgactttttgtcccccgacccaccgacattaattcggggaatttgggactacgagtgttgtacaaagggaggaaaggttgaaaatttttaaaattagaacaattttcttaataaaattattaatcgcaaaaattggtattttttagggaaaatctgttaagaaattgcaaattttcaaaaaaaaaaattctggcggctcctaacagcagcgcacgcaacccatccctccttctgttccccaaaagttttttttgaaatagagcgccgcaaaaaatggtggtcaagttcgaatttaaacgggttcgcaaaaatttctgttaaacccgctcccccttatcatgtatttttaaatcagggcttccatcgaaagtttttcaaaatatgtgcaccaaggccgaaaaataagattttggggtcaaaaatcttttttatcctctaataaaaataaattccggattatgggcttagaaatgatataggacagatattgattgataatatttatgcaaaaaattagctttataaattaaaaacgacaggatttgttactcaagccaatattttatttttttatgtgcattataaaaaatttatcaaatcatttttatttcagtagccgagttttaatttttgtaaattttacattttttttttataaatcgcccttatccaagttgaattattggttctctagtaagaaaaggtttatttttttctcgcaaaatgtcaaaatgataatgattaaaaaagataatttgtttgatacaatttaaaaatttattttatgattttaataatttatttcttgtttttttttcgttttaaacaatattgtttaatttattattttttcatttctttatggaaattaataatattatttccttgttctacatcttcaattctttgtgtgggatgccgaaatttaaattcctttgtattttcatttattttaatgctttttaaagaaataaaagtattaaaattgaacatagaaggtatttatgttcgtcataatacttaataaaattgtaa

SEQ ID NO: 10333 - DNA, 1865 bp, Heterodera glycines
taaatttagtaaacaaaaaaaataaaacgaacatcaaacaaaagttagcaaaaaatctactcgaaaaaatgcaaaccttttttcagcaaagaaaaactatcaaacattttttagtataaaaaatggttttttaaaattatttatttatattatacattaattaaaatttatttatttttagttgaatttgaacccgaggtctaaaaagacgaatttattaaacaactgagccaccaattaagtgaaaagacagccttaatttactagaaatttaaagtaaataaaaataaaaacttaataaaccatataaataaccatttaaataaattaattaaattgtttagtataggaaattaataatttgatggaaacagttggacttacaagtacccgaacatatggattcagtcagcatgaaaaaaaaactaaatttatacaaagtaagtaaaggaaaattcataaataaagaaataaattaataaaattaaaattgtacaacgaaccataaaaagcttaaaagcgactgaattatttaaatattaaaataaaataaaaaatacatgaggccaacaacttccttgacaaagcatatggtacacaatcagcagaagataacaagaatgaaattaaaatcatcaatgaatttaaatacccaaaacacacaatccataaataagaaatgatattaaaaaataataataatatacaaaatcgtggaatttaatcaaaaaaaaaataatttaataaaatgattattaataaaaatgaggtaatttgaaaaatctaaaaagcgcataaactgaagttaatggaaaaattttacaattttgtctttttattttaagagaattaaattaaataaaatttttgatttattagaatctatttatgacctaatggaatttgttttagtttcgaaccccgagactcgagaccgagacccaaaaccccgagaccgagaccaaaaaaacccgagacccgagacttttttcaaaaattttttcttacacacttaaaaattgaaaaaatcaattttttgaggttttttctcaaaaatttttgcttttttcattatttaatctaccatacatttttccttttcatatgattgacttttttacaccattttttgtggtgctctttttcaaaagaatttttcgggaacaggggtccggcggtgccgataggcgccgccgggaaaatttcttttaattttactgcaatttgttaacggattttgtccaaaaatgaccagattttgcgactttgagctactttttttaaataaaagtaagggtaaaattttaaatttttagtgcatttgagaatcccatgtagaacaagagcctatagaacaataaaagttggtacttgtctgttatctgtgtccagattttcaaattttttttttgaaaataaattttttttccgaaaattggcccaaatttgctgtaaatgaaaaattcttttttagaagattctttttttggcgattaattattttgagcatgtattagagaaaagcggattctaataattaataaaataaaatatattcaaattttattttcggactaaagaagaatttttataatattaaggcagttttatttaaaaaaaccaattttttgtaaatataaatcattataaatgatgacaattataaaaagattaattcaataattaccaaataaaaactgcacaaatgtttttattatgcatagattaccaaaattaataaagtaattagtcaaattgactattagagaaaattttgaaaaatatatcttagaaagcttaatatgaataactaattaattaatacagatatttcccttattaaataatgcattgaaaagtacaat

SEQ ID NO: 10334 - DNA, 6029 bp, Heterodera glycines
  misc_feature (5988)..(5988): n is a, c, g, or t
aaaaagcgaacaatcacaagaaaaaacaatcagaatgttgaagaagtcgaccaagccacggacaaataaatcaaaaataggcaaacagaagcaaagcaccaacacagacacactaaaaacccatacagaaatccaaactctccgccacagcgcaactcgaggctccatgaaagttcgtaaaatgcgagaagagaaacaaatgttaggcgtgttgtgtcccctgcgaacgcagaggacaatttcgagtaaaagttctggtgggagacgatttcgactcattttgttgcggtggaaaaggggtcaattttttagacaatgtaagaagtgaggacgtcgttgacgaggaggtaactgtaaacagactgtttatttcctttttatttattttttccccgggagagcctatccacgtccatttttagttgtaaaatattatgactcgaaactcactaaaatcatttagggggcgaatgcgaaagcaaatagaaatactctcaaaattatcctgtttagctgaaataccaatttatgattaaatttatttatgcgagtggaaaatgttgggtccggggaacagttttacaaattgagtaattgaacagagaccatggacggcaaaaaaaaacgaaaaaatttaccaaaaataattgaaacaaaatgccaatacattcaaatgaaaaacaaagtctttatgtttgatcaaattcttagtcagaggtcatagcttccaatccacttcaaataaaactagatagttttttagagatataaaataataaattgacttaaatcatttattaatgtttaaaattgtttattattttaaaattccaaaagattcgatgcctaaattttttttgagaatttttctttgttttaataaattgacaatcttttaaatttttttctttgctttttgtgtcaatgtagtcattcctcctcctgttcactgattctgtccagcatctcacaccccactcgagacattttgttcatcccatcttttcaatatcatctttttattatgtctctccaattttaacaaattttgacaaacaaactgaagaaactgtacagggaaagaaacggtcaatgtgacaaatacagagtgaacggcacataacgtaatgatatgataatattataaagctagctcataaatgtggaaaatggacaaaatgagacggatgagtatcaatcaccacctgataatgaaattagggggttggcttcgtcaaactgttattggcggattgtcaaagtaatcccgtgaagtccattcgtcagtgtcagaatggtcatctccgtcgatctaagaaaatgcgggcatcaaaaagccctaattgtcccgctgtttagtttgaaccgaaaggccctttagaacttaccgcctgcaactcttttgccgtgaagattctgggcagaatgatctgtcggaagaagatgaacagcatcagaacacttaaaaccggattaaaaaatgaaaaaaaacaaaaagcaaagagtgcctacaagggaaaagccagcgcagtctttttgaagtatttgacctgcaaaataaacacacgagcattcattttcgcttttcctggacaaacacttgccgtgtacacaatgaacacacaaatgagttgaatccacgtgtagaggtgcatcctccaaatgctcatctaattgatcatttgtccggtttgatcacactttgatcgacccgacccactaacctgttcagtgtacggtgtgacggggaagtacttctcggggatgaagaacagaacgacccgttggattagctgcacgccgcacaaattcatgactcccaagtaaaggaacacgccgaagagtgaagcgagcggaaggcgcaggtaactgccgccgaaggcgatcagtccgatcagcagggcaactccgatggtggtgatccgttgctcgatgacacagtcaacttctgacaatgatcaacgggggaagggaggggttggagaagaatttggcggaaagtgaatttattaaactgaaattattgaattgtgtcacctgggcgtgccccgggagccgtctttttcatcactgtcaaagatgaacagtgagccaatgactgaacagcggctgcgcacatccacggcaaaccgaacaccttcaaatacaagggaaacatacacaaaaatggacaagggaaaggagtacaggtcgaaacaattacatacggagcagagaaaggcgcaaatgcccatcagaacgaggtcccaatgcatcccaccgccctttttacagccgcgctccttgcgactgaggagaagcctaaaaagcggagaaaggggaacagtttcggtttcaggttaaacacacaaaaaaggcactcactcagtgatttcggtctccacaaacaaaaggatgaacaccaacagagcggcgataaacgacacgacaatgccatgccaatcggaaaagggcaaagtcggcgtgacgataagtccgtggcctcgccctgaaaaagcatttaataccgaaatcgaaaaatataattgtgagttgaacccacttgttgggtttgtaaagttgatgtggtcaggcatgtccagcctttgcaggtacgggtcggggacgagccaatggactgaatgaatgggcgaaatggtgaagaattgtgagggggggagaccgaccgatgagagtgacgacgctaatggaaatgagcacgccaaagtcgccgatggcccttctcagctattaaatacatttgtattttatcaaataatgtctctgccttttgctcacgtgtctgcccaagtagaaactctcgcgcagtttcttcagcagcagtgccaaaatgaacgtggagaacacgatgatggcggtgagcagtgccgtgttcggctccgcctccccgcaggggaaacggtggacgcccattgggtcttttatctcggcgagtgcgttgaccaatcgtctgctcgagtcggcgtccgccgttcgattccgtgttgaattgccaatgccttcaacatcaaacggaagcgaaagcaatggaacggtgtttggctgctgctcggccgactgattgtgcacgtgacgacgacagttcacgtggatcttctcgtagaaactgtaatcctccaccggattctctttgaacgtctgaacggaggagtacaaacaataaattaagtaaattaaaatgaaaaatccatttttctgcaaataataacgtacgtgccaaatgaaatgcagactttccgcaatgaaaatggccgagatcaaaccggcgaaaatgtcctcggtgaatcgcgtcacaaacaccaacagccgcgagccgtccaccgcagcgatgcaaatggcgatgagcataatgaagagaccggcgtagaagcgaatggtgaggaagtccaactgcagagtttcgcaaaactgtgggacaaaaacggagagtgaattaagggatgaattgaaaatgtataacattctattaggaaatttcgacaaaaaatctcaaaatttcccacggcggcacctatcggcaccgcccggacccaatattcctataaaattttcaaaatttgacccaaaaattgtttaaaatggcaaaaaaatccctaaaccattttttgatagaatattttaaaaacggttaaaagcttttggaccgttcatatcaaaatcacttggggggaaaacactcactgtgtaaagactgccttcgaaaatgagcacgggcccagtggcactcactttgaaagcaaaaggaatgagttacacaaggcatatttattgggccaattcacccactgatcatcaacggctgtgccgagaaaaggccccaaatgatgccgcaaatgcactgggcaaacagcgcctcgatggtgccgatgtgctcgttggtgtatttgcccatcagtccgccgaaggaaatggccggcacgaaacaggcgaagaacatgaaaacgacgctaaacaatggaaggaggaaccggtcagatccaagccatcgagtaaatggtggtcaattttcaaaactcccctcgtgagacattggaaattggcggcgtcacgaatgtcggacctgaaaacggaggagtatgccattacttatgagtcagttatccaaaattggccctaagttcttaattatgtcacactaatcgagtcaattactccaaatgggcccataattataattatgccttactaattgagccaagtagcccaaatgagccaaccattccctttccaaaatttgttttcccaactgaccaataaaaaggaagtcggttaacaaagtcagcttggagtcctttgaacagcggaaagcgtcgcttccgtttcgtccgttgcgcacttttcgtcccttcttttgtccaattttgttgcgtctgtttctgttcctcgccccctccctctttttgccattgtttttgctgttcctcttggccattgtcctcattttcgtccccatttgctgctaaatgcccttgttgtttctgctgattgttgttgttgttttggtaatgccgacttcccccgtcttcggccgtcgttttcaaattgcctccgtccgtttcgacttcgccgtcgtatcgatgccattcagcgtcaattgctgggaggtggggacccttctcccaactgcgacgaaaggtccttttctttctctctcttctgacattcgatttatcactccgatggaggaagagaaaattattggggatcaatttgcaaatcccttcacaattgacggggattaaaatgagtcaccgttcaattgaaaattaaacattttgcttacatttccttaaagttccaacatttcagttaagcggaacatcgcgccaagcggcaatgagtgccgcctcagtgcatgagcacagattcggggaggagacgcgtgacgacaaaagcggggaatactgcaaatgttgcacaatgtgtggatacgaaatgcgatacgaaaaaatgtgaaaaatgaccccgaaacttattcgcacttcggcgctatatgaaaagtggtctttttgaaaattttttcacttttttggtcaaaattttttgtttaaaaatcgtgaatatactttttattcaccataattgtgctattaatacttaatattcatcattatgtgtaaaaaaataaattttggtcaaaattttttcttcgggattcgaaataaagccaaaagaatgttagattcgtgcttagcacctcggattacccctaaaaatacttttctcaaatttaaaaaaaaaaaaatttgtttcgggaccaatagaagtcccaattctttactcgctttagccataaattgcaaatggttcataaacatgaaaagcaacaaacatccaaacattcaaaactcaattaagcaaagctcaaacattgtcttccctgagcaaattaaaaaaaaacacaaaacggaatgtcaaaagtcatctccttctccctcgccaattcgcgatggtcactttctttcatttgctggtcgctcgcccaataatgccgatagcgacgaactcggccgtgctttccgtctctttgctcttcttactctcactgctggtgcactcgccctggcctaattgcaaaaaccattggaggcattcttcggaaaacaataaacggagaaagctggcctacccgacacaatgcctttgcgcaaaacaagcgcacgaccgataatgttacggggaccaaaaagtgacaaggcactggacgaatcggaaacattggcaattccgagaatcactggaatcccaggcttaaggacaccagcaggttggacagcgggaatgtgctaaatagcaaggcagtatgaattcaattccaacatcaacacactttgaatggccagggagcgttttaatgagcgatgggatgttttgactacttttttggattcgggaggggggggggggggacttagaccctcaaccccttcctgggctacccttgaacttatggaaggagccaaaaaactgatgcccactgaccagagntcgtggcggattgagacccggacgacggacgaaagaccttc

SEQ ID NO: 10335 - DNA, 2400 bp, Heterodera glycines
agaattgattttcccattggttccccccaatcttcatagatcccaaatgcttaagttggcttagtcacctgaactctccgctggtcgccactgtccatttttggtcgttgttttcctcttcgcattttttatcagaagaaatgtcgtcgcatgcgatttgagtgaagcgatcgggcaaaagccgaccattgcctgagggccattggagaatgtattaaaggaaggagaagagtccattgccacctttgccattgaaacagcccggacttagcgaaaggtcgtcgatggcaattgagccgaaagagtcggccaatttggcaaaactcagtttgagcgaatattcgccactctgtcagcaaagggaaagtaaaaaatacgtgtgggagtaacggcacaaaacccttttgaactgttttgtttaatcttacgacaatcgctggcgttatgcccaccgccgcccggcgccattcgcacggctcccggccgaagtcctccttggaaggggcccacaacggcttggccatctcttgcggagagttgcgacgggaaaggaacacttggaaagggctgtagccggtgtggcaatagaaaaagcgcaactgtgaaaagcggataaaggttcgataggtaacaaactgcacccaaacagtcgaccaaatggaccaaccaaatgggtcaattaaccaaatgactcaattaatcactaggccaattaaccaaatgggccagtaattaccgcgcatttggcgtcatgggaaaggcgtgggaacggcggagagatggcggaggagtaaacgatgtcgtgttgtccgctgtgttgatggtgctcgtagctggagaagaacagaaaacggccggttcggtagtgccgcccctcgtaaaagtattcgcccgggggaatgccggcgcgacgttggcgcgcgtcggacacagagaccaaatgccgcgcggcggaggaagatccgttcatctgcggggcgccgcccgcttggccactgaaaatgcgccaatgggcgcagccgccggcccagcggctgtcctcaaaatcgcatttggcgccctccggcacttcggcttccaattaaaaatttaaaaagtgagtcagtcgaacacgcctttcttacagcagtgatggacgtcctcccgttcatcttcgccctcctcgcaatccgtgtgcatgtcgcaaatttggtcctcgttcagacaccgttcgccctcgcccccctccgcccttcggcatgccaattcgctctctgcgcatttgcccgcaccgtcggcgccttgccaaatttgctctgagcaaaaggtcaactttgaacccactacttgtcactgataggtgttaaccttggcagttgaccaactccaagtcatccaccgaacattcgactcgcaattccgcctcaattgggtcctccgaatttgaattttgcccatcggaaagttgcgggggatggcactcgactcgaattcgtgtgggaaacccaaaagtgccaatgccgacccgggcgtgggaccacctaaagaatcactgccacacatagcagggattgccccgttcccttacggttcgcccgaggcggcgttcacctcaaaccgcgcccgaagggttggccgtgtccaatcgtcgtcctcctcctgcggtgagtcggggtgaagcgaacgtagagaaagctgttcagtgaccaccaacagctcggcgccgcgttggcccagcagacggtagcggaaaagcaattcgcactgcgttttgacaattatttaatgggggggggtaattaaggagtgattaaatcacttggggggcggtgcgaccaaaaaaggggctgactaacatggcgattggctcctccgcattttgttttgccgaagcggccacaatttgtcgagttgcgtagtgatctaagagagaaaagagacgggatgatcagaggaaaagccgaaggatcggaaggaaaagccgaaaggacggcacccactcgacgcactccctcccccactgagcacaacgtaaaagttgtcgctgagcgaaccgtgccgaaatgactgtgccgtgccgttgttgtcagtttgaggagaggcaccgagggactggtgcgaatgggtcggactaagttcagccgaattggcaaaggtccaatagggacagtccccggcagattcaaaggaacaaagcggggaagacactaagcaattaaggggttaattgacgaatcaattaattaattggctgattattacgacaatcatttatttcttctttttggaaagcattcactcaattaataaattgtgctctttctcaccttcgccatgctccaattgaccattgcttgcaaatggcaacaaaaaaagaaaagcgacgatcgcaacaaaaagggccattcgcccttggcaaaa

SEQ ID NO: 10336 - DNA, 2998 bp, Heterodera glycines
  misc_feature (7)..(7): n is a, c, g, or t
tgttgtncatccatcggtaagagatacgttgtaattttccaatggaacttaattttatgcatttatccaaaggaaaagggacacactttttgtcagtgaagcgcagaaaggaaaagttgaagcaaagaaaataaattaatgggcgacaagtgattttgggcggagcaaagagagagagagcattaaagctgaaaagaaccgacgggcggacgacagacacactgaccaattggaagtgtgccattttaaaagccaaagacgaaaaaacggagggacaaaagacgcccaaaatcaccaaattgctgaaaaataacaactgaatatgatcatcacacgatcagagaataaatcagagagagaaatttgaatgcgagtgaaagtgaagtggaaaagaaggaacattcgcttgtgggacagaaccaacaaccaaagaaacaacaaaacagtgacatcactctcaacaaatgcgagggactcttccggtcgatcattgctcgaactgtgccaatctctcctccaattctgctattttcgtgtccttttcccgctccaattcttcggcaatgcgagacactttctccaactgatcattctaagtttgaaagtcgagcaaagatcaaagggtcaatgggcgaaggggccactgaccagcgagtcgagagtgcgcttgtaactctgattctccttagtcaatcggtccaactgttcggagttagcaatttgatcggccgtgttggcaatttcgcttttcggccctccgttcattagcgaatgttgcgccgtttgcgccttctgctgaatgtattttatttgcaccatttcactttgtgctttgctcaccgtgaggtcgtccatcagtttttccttctcattttgcatgtcctggttctttttcttttgctcttccaaacttttggtcagctcggcaaccgaattctgatggaaataccataattaaatttgatataaataataaaagttcagagcctttaccttaagtccgtcgacctctgaggcgcatttcgcttcgtttttcaattgactaaaatataaaaattaccgtttttgactcataattttagaatggaatttcaattagtggacggccaattgggcaatgaagtgataataaattttttaaatgaattaattcgcagtccaaatgatcccaaatccaaggcattgtgccgttgtcccaaatgaatgtttctgcctgatttcctcgcccatcttttggttccgtgcgttcagttccacacattttgcgctgtcattgctctgctgttttgccaaattgccataagccaccaatgctttctccaactcttggctcaactctccgacttgcttctgcgcgttcaccatcactttcatgtgatggtccttttcccgctgaatgggttaattgtctgtcattttacgatactaattgttcgtaaattacgtttaattcgttttgcaatgtctgaattctgtcgtcgtacgcagacttggataccatcgcgtccttaagctgattctgcgagttggacacgtccgacatcatttggtccaccatgttttttgccatttggcactctttatcctgcgcctttcgttgctccctttccttctaaatattattattatttaattaccccttaattaaccctctccgcctaattttctgttaattacaaacgttcagttccgcttgaagcgctttcaaagtgccttcaaaattaatgtgcgctttgcgcagtgcttcctccgtttcctgcttcgttttcattgcttccgcagtcactgcgtccgtataatttttgtgtttggcgcactcttctcgcgctttgatcaattcgtggtttatcattccgagtttttgtgtaaattgatggtcagtttgggcgaatttggcgttggtctgttcaagcatttccacgagctttttgttttcttctttcagctaaattatggacaaagttaaaaatattttggaaataagggcaaaaaatatttcgatattttattgtaaatttccatttcaacctgaacggtctccaccaatttttgccgtacagtctgttcgaaaatcaaatggcggtcattttgttccttcttttccttcataattttgtccgtttcaaagcgcaaagtttccatttcggccgtcgcatttttcaaattcttttcgaattcgtttttctctgttttgagttcctaaaagttgaaattaatacttttttcctattacggtagggtctaaccttaatctcagtgcgaaatttgttctcctaaaatagtaaattgtacttaaaagggtaatccgctgacaatgaacaaccttggccttcacatcgtttgacatttcctgcaaataattgatgtattccggttccaactccccaatttctttgagacgttccatagcctgcggcatcgaaatgtctttgagtgaggctaaaatgaaacaaaaccgataggcgaataaattaattaattggcgtttttcgtcaaattgaagtgcccaccgctctttttgctctttttcgccgttggctgtgtttcgactgccctttcttccgtcacttcttcgaagtcgttttgcctcttttcctcttcgtttcccaatggtccatttggaatttccttttcctccgctccttccgaattcgtctcggctttaggactctttgacttcattttctgtttgtgcttgtcgcttttccgtttttgcttcgaattcccttcctcctctgttttcttctcttcagagtcaaccatttcgctctttcccacttcagcagatggcatttcggactgactaacgtttactaaaacaaatccaaaatgaattattgttgtaaaactgtaattatgtcttaaatccagcaataactgccgaatcatccgaaaggaaggttttctatatggaattttaggaatataagaaaaaggatcggtcttttcatttcagttttttgcatgtgttcaaaagcactttttgataaccaaaaaa

SEQ ID NO: 10337 - DNA, 3597 bp, Heterodera glycines
catctgtgactgaattgcgcagcagcagcaagcagcaaaaagacaacaaaacgattaaaacataaaattttcgcgaaatttctggaaaattaggccagcagaggggggggggttataaaaagagagcaatcaaatttattttctcttgaacgcaaaatttttcaaaaaccgggaacggaccccctacccacaaattttttgaaaaccaggaacataccccctacccacaaattttttgaaaaccaggaacagaccccctacccacaaattttttgaaaaccaggaacagaccccctacccacaaattttttgaaaaccaggaacagaccccctacccacaaattttttgaaaaccaggaacagaccccctacccaaaaaaaatttctatccgaacttttcgaaaaatgggaacggactccctactgcccaaataaaatcttgatctgaaatttttgaaaacccagcacagaaccctctgccccaaaaaacccttcaaattctgctttcttcttcaaccaattttcgcactcctacccctacacttttgctaattttcccattcccacagaccgcgccggcccaattgaaaccaacatcagaaaactgatgatgatgaacagttttctgtgacaaatgagaacaatcatcatcagcagaggattataattgtgtgggagagagaatggaaatgaattgagaaagagcgaacaaataaataaattaataaaacagagggagcgacggacgcatttatttatttgcatatgcaaaattttcgcgcttttacaaatcaaagcaaaaagcacagattggaatcagcgggggacggacgggtcggggcgaacacacaaaaaatttatgatgatgatgagctggaaaatatgaatgcaaaatgtgatgatatatatgtagatgcgcgacaaaacgattgaccggccgaccggcggacggacgaaagggcagcgaacggaagaaatgggagaaaaatgaacaaaaatgtggaggggcaaggaagaaggatgaatgcccagaggtggacgcaaaaaaattttttgtttttggcatttgaatttttgtaacatttttttaaattttcaatttcctccaatttggtttccccgtgggaaattaaaaaaaattttttttttgacccttaaagatcgggaaaaaaaagctgttaataaaattttctcgagaatatatttaaaaaaaaaataattgaatttgagcctttctgttcgagttcagcagctcatgggaattggtcaaaattgatgaaaaatcgggcaactagggggttattgatcagaaacgtgttcaaaaaaacgcattgattgaatagggcctagcgattgatgaccttgggccctgcagatgcgactggtggtgggtggtgactcatattttcgcttttttttttggtcgtcaccatcaccaaacaaaactaacattttttgcattagtaacagtttaccctagataaacctcacttgaaccccattttcctagctaacaaaatttcttggggcccaaacgtgggggcttaaaaaaatctcgacctcaatttataaagttcaattcgccgagatttttgcgcctaaattccaataataaaaaccaattttgtattaaaaagtgattgaatggcccactcccactcactcattaattaataggtatattaaactggcttctttctgcgttcgttgcggggcgctggaattttcgcagaaaattttgtgacagatattttaacgacttatatatgagtggacaagaaatgagtgtgaatgcaatctgtaataaatctcctcgttccacccccccacttcaaccttaaataaagcctatttatgtacatagtatcaaattttggtgcaaaaattttttggctcaccgcccccaaaaatggaggtgtgcgcggcgggtcatatgatgacagcagcaggcatagtaaaaatggtgatgtaattaatttattagaattttttttaaacagacagaaagaaatctgcaggctgtgccatgacaacttttaaaaattgatcgttactggcattttaggagaggccgccgatccggggaacatagcctaactccagtgcacagactgaattattattttttttttgttagaattcggattcatatcccccaaatttttgaattttctaatgaatgggtcacactaatgattagcagcatcccgaaaagccaagcagaaggaggatgggaaaagggtgggtaaagtgtccaatccaatccgtaattattagggatgcaactttagtgatttaactatatttttttgctcgattgttttgaagaaaggagctcaaaaaatgcatttctgcgttgaaatttttcgatttggatctcactatcgatcactagaaatcactattttcacgcttcgtcactaaaatagtgaaaattcactattttggcgttttgttactattttttaactatttcgacatttttcagagattttattagcaaaaatgcaataaaatcaaaaaatacacccctaagaatcgatctaaaaaaatttcaaaaaaataaacccctaagaatcgaccaaaaaatttttttttaaatattggaaaattttttcaaaaattctcccccaaaattttttttcttgacaaaatttttgatttaaaaaatgtcaatatttgctaagagaattttataaaggaaatgtagctcatttgcaactgcaaccaatgaataaaaattatttttgcttaatttttagctgaaaattaggtcactatttgtcactattttggactttttgtcactattttggcatttttactcactattttagttaactatttcgggatttttcgtcactaaaagtcgcatccctagtaattatggtctgctaataaaagtaagctatcacagagaggtgatcaaaaattgtgttgcaggactaattaagacactcctcataacccggtccaaaaagttggctcattagagactgaaccggccgctccgcctctttcgtgcaatttgatccgctaacattaagagaacatttacacaccaacataacaatgatgcgcacttacatcatacagtcagtctcactcattagtaagtaattaatgaattaatgggttggcactgtcccaaaactcaaagtccgccgttttcgtcgcccccccccccgggcatatgactgagacacaaaaaaaaagtgaaccgccgccgtggcgacaattttcatttatgggctgctagtggtcgcggcgcaacaaaatttttattaaaactgtgcgcaccgccgcgcggttggcaaaatatgcatgcacaaaaactcattattcgttgaaatgattacacacgcatttatatagttatgtgtgttaattaccctaattaacaaaatttgtcgttcagagttggtttcaacgacgcgcgcgcgcctttgacggccaccggtggcgggaagggatggaaaatgtgaaaaattgagcaaaaaaaaaaaaaagtttttttttcattcgggtaaaaagtacgcctaaagaatgtggcgggagggggcggccgagcaacgaaagcggcgcgccgccttttat

SEQ ID NO: 10338 - DNA, 1668 bp, Heterodera glycines
atcgattaataacggaagagatgagtgagtcatcattttttcaaagattaatggttatcgatgttaaaattctatgaataaacaatatagtaaatatatatatatatatatgtatttaatgcatgggaaaatgggtttcaattcgcatcaacgctaattagtggtaattaaattggattagtgctgctggcttctgctgctgctggtgttagaagttgtcgccccgccgcacatctccggcggggagcagtcatgagatcggacaaaaaaatgggggggggggtgagaaatgggccagaaagttggctgttgaatgttttttaaacatttcgataggtgtgttgtttctttcattaaatttaaatgtgtggtttggaatgtttttcggaaattttaccgccatttttaggtaggatttgcaaaatttggagtgataagaaatgggcaaaatgttaggcctcggatgggaattgaacgcccgccctttccgtattttaaacgcccaattaaaaaaaaattttccttgcaaaattttttttaatttaaaaatttaaagaactttttacgtggaaaatggttcagtgtttcactctctgatcagcttgtgacatgaattttaattgctaatatggacgagatcgacccagaaaaggcaatggaagaaattttttttcaaaatctctaattaccctattaaattaattatgcatgaattagaagaagatatcacaagcatttgcaatgttattaatgaagttgtaaatagttttttaggccttaagatggcttagaataaactctcgagccaaaaggttgaacaaaaaataatgaataaaaaaaggaaaattttccgccgaaattcatcgcaacttccaataatgcttccagtgccagaatttcctcattaaaatgattctcatggagttcggcggcaaggctcttctgacaattttaatttaattgagaatataaggatgtgagtgagtgagtgaataattcggtaatcccacaaattccccaagggtttatctgctggcaatgcttaatgagcaagaaaagcagcctcgagaacacagcatacatataggccagaggcagccaaattaagggccaaatggggaggagaaagaagaattggaagaatttgacggcattggcacaaattggggggggggcgtgggtggacggagtagaagaagccgatgataaaactgacaatgaatttgtaaggcaataaaaacttttgaaattaaaaaaatttggcatgaaaaagacaagaaataccggagcaggttgcaaccgaaaaaattagcaaaaaatttctaacttagaagcaaaaaaaaaaaaaaactttcatatgaaaatgttaagaagaaaaatttaaaaaatttttgagcgattttttcaaagtttttcaagaattatttcagaaatttttcaaatttttttcttgaaattttcttgtgaaaaagattttttttgttttgttttttatctaagtttttgaagtgcaccaaatatacatacaaagaaaaacaataaataaacaaacataaatttcaatttcaaaaaaaagagaaaagaaatttgagaatgcagctgaaagcaaccggctggcagcagcagcagatgtgtgagaaaatgatggaatttggtggaggggggggg

SEQ ID NO: 10339 - DNA, 2402 bp, Heterodera glycines
gcccacgttttggcgcgaagccaaaaattaaaaaaggtaaaaatttgatcaaaaattttacaaaaaaaagtgaaaaacttttaccttccaatgggtttttcaaattttcaaaaaattcacaaccccctagaattttttttcaaacttcccgattttgactgtgttttatgggtgtagattagagatcaacatgtaccaggatccagccctgtatttttcctggatccaggtacaggccatttttcggcaacctggatttttcctgtacatttattttcctgtacttatgtacagacaaaaaataggtacaggccattttttgaaacaggtacaactacggttttttcaaaatgttgatctctagtgtagatcaacattaaggagtgatatgatcaacttgctgtgaacattttgttggtcaacatgaaaaattgacttagcaagaattttttttaatttttctcttcgctatgcttcaaaaaatgtcaaaacattttgaatatttttaaactcttaaattttttcagttgaaatttcaaaagttagtgatacatatggcgagacgacctctttgaagctgttgacccatccgagattcagtggacccacataattgttgcgatgtaatcgcttcggttgaccatctttgctcggcgtgtgtaaccatttggtcaacgcttgggcagcagttggattcagcacatcaaaatcggcaattccggtacttatacagtttgacccacataaaaaaaattttttgtttctaatgataaaaacgtgtttctaggggttttcggggctgctgatcacgaatatgaactctattggacgaatttccgaacccctaacccgaaattcgaactttttttcgaaaaaatttttttgtttttaatccgtttaaaatgtgtcaaaatgcgtgctccatgattctccggtgagctgctcgttcaacacatactcaaaaaataaataaaatttaacaaatttctaaaattcaacaaaatgccaaaatatgaagtgtaaaattggcgcgacaatcagttttcgcatggatacaaaagatacttttaacgaatctggctacgctagaaactgtgcttgaatctgaattttgtagtttaagtcttactttagctacgaattattttctatcatgaaccagctggacaattttactaccaaaaaactttatgaaaaattagcattggatgataatgaattcaatgactggcttatgcagttgggcctattgcatggcaggcgtatatgtccggaatgtagaactgtaatgggacgtcgccagcctaacagaaacagaaaatatggagcgtggaaatgcaaaaatacacaatgtcatcgcccggaaataggctttcttgttggcacattttttgccggctctcatcttgacattaagcaggtgtttacattgtcatatttctgggcgcaggaaatggggactcaggaacaaatgatgcgcgaaataaatatcggaggtttttaataaaaatagggtttcatgaagttcaaaaataaatagggccgcaaacgattgttgattggcgtaatttttttcgggacatatgcaccgaatttttcattaaccaccgtgaacgcatcggtggccaaggtttttttgtcgttgtcgtcgtcgtcatcgttatacatatagtagtttgtcttctcgtaggcatcgtcgttgaaattgacgagacgctcgcagtgaaacgcaaatatgagcgtggcagactcgttgtcaacgacgtttggatttaggcattttccaactccaattactttcctcccactttttgttcactttccgtcgtcttttccgttttgccatttgatctgatcagccaattgacaatatttcacagaacccaattcactttttgatcagagatggcgggctgatcagatgacgggtgaatagttttaaaaatttcataaaaattcttaaaattttcagcttcatctgcggcgactgttgccttttggtgttcggttttcttgcgccttctcagctcggcatcgaaattgcatttgatcagccgccgctttgaccacatcgtcgatgaacatttcaaaatatgcaaaaatggaattgaacaacaaattgctaattcaataggacatttgaagaaaatggcaccaaccaaatgcaaattgccaattccgcaaaatccgttgcccaacaaattcatcggattcggtggcgttcagatcatgtaaaaaacgattagtttttttatgccatcacattttctgcttttcagtcacatcgatcaaaatgccatccgcatttatccgccgttttcgtagttttttcgccgtttgttcaacagatttgtaccttatcacgggcaatgatcgtattttggaatttatctgcacttcgt

SEQ ID NO: 10340 - DNA, 1467 bp, Heterodera glycines
  misc_feature (90)..(90): n is a, c, g, or t
tccaaacaaattgcgacgaccgatgaaaattgctaaaatcaagcatttaatttctgcatttgattttaattttattaattagtagtttcnaattgatataaaatgtatgttttaatcgaatgaagaaatcaacaaaagcatttgagaaaacgagagcatcaaatcagcttcctattggcgagatcgatcatttctcaaattataattatttttcattgctttgatccgcttcttcttcattttcttccgctggcggcgataatggcctaaaattaattaatttgacaatcaaaaattgctgttgcttctcacccaatgcaactagttacacgcaacaactcaaaccggatattgttcaaattggcacccgaataattggcatgccacagctcaaaactgatatagataaattggcacccaaattttcgcggattttccacttaactggcgccgtctccccaattgggtaccgttgcaacagccaattaaccaaattgtattctttgctctgtttcaatgtcagcttctcatttgtcacttcgttcaccaattcaaatggttcaattggcattggttccacacgaagataaaattgaatatggtaactgacagaagtggtggcacgacggaatgtctaaagaaaattggtaaaataaaacgaaaatatggcggtccacctctttgaagtcgttgacccattcgggattccgtggatcaaaataattatagcgatacaattgcttcggttggccattttttgtcggagtgtgcaaccatttggacaacgcttggccagcagttgcattgggtccatcgtcagcaattccttcgcgtaacagagcaccagaatcaattgaaatcaattgatcaagatcagtgagaattgtctgtgaaatgcgacgacgcaaattgtccaaagcatcggcattatgaaagctcaaatgccgaatgtttgttgcaaaaagtggccaaatttcgcgggtaaaaacatcccaaattcgctgatcatcctcagttttgtttgaccatatagacaattccaatttgatgccacttctgtcccaaattggcttgttggaacggagaaatgtgagcacagaatggtcaatgtagctgataaagtgaaaaaatgaagattggttttctgtatagtttttgatttacctaatccaaaggctcttaaagcgaattttggtgggcagcggacggtccggcaatggaaattccacccttttgccatcgatccattcagacagtttcgcttttggtcctttgtccttgcgaattgcgattgctttccaaattgtcaattcgctttttccatcaaaatgcgtgtcaaccaaaacatcgaaacggtcggaaagcaatgccattttgagtccaagttgagcatggtcaaaagatggcagaatgtccatccaaacatccgcacaaatccaacttaaacatgaaaaaaattgggtaaaa

SEQ ID NO: 10341 - DNA, 500 bp, Heterodera glycines
actatttcctccctccgtttcccctctccgttcattatttccccgccccccgcccctccttccgcccgatgcattttcatttctctcctctcccttccttccttccttccccaccctctcttcctctctcttctgactctcgactaaacgtaatcctcttcctccgccttcactcctcccgtcatcgccattctcgaccacttactttccgccctcgggcggcgaaggtggcggcggaggcgaagcaacacaaacccctcctcccgctattcttcctcctcctcctcttccttggtgtgtgtgtgctttgccgtcgcgcctccttgcatattattttgctttcacttcatcgcatccatcccttccccatgctcttcggtctatgaaaattcatccccccgggggagagggggaagacgctcgtgtcggcctctcctttatctcctcaagctaactggggacgacatgacagcaacaacagcagcagaggcggggggggg

SEQ ID NO: 10342 - DNA, 2343 bp, Heterodera glycines
aagtccgggcgctcattttgccacaaaatttacgcctaaaaaataattcaacaaaaatttctgtcaaaattttattttaaaattatttaaattaattaattattttattaaattcccattttaattgcttgcctcctttaatcattgataaacttgtcaggtttgtggtgacatccatggccaattttatgacctcatgaaactgttcgaggtcggcggttcgccttcgtctacaaaatatttggtaaatttattttgtgccaattaatttggctggcattttgccattaatttaatttttgaaaatagcaatgttccattcaatttttggcattttgcccgtgccattatgtgttggtacatattcagattccatggattatcatcggcgaaattctatgataaacagctttctttttactaattcccgatcccgaattttaaagaatctaaaccctttaaaaatcccctcagggtgccaaaaccaaaatttgtgccaaattcagcaatttaatggcattttttcagttcctcggcgactacgtggacaggggctacttctccattgaatgtgtgctttatctgtgggccctcaaaatttgccatcccgccacgctgtttttgctgcgcgggaaccacgagtgccgacacctgacggaatatttcacattcaagcaagaatgtatgtttggatggcatggcatggcacaccgctaaacttgacgagactctcgagcagggaaagccctgaccttttggggtcccgaattcagaacacacagactctcgagtagagcttttcaatcttagcatccatgacaatctcctgagtctcgaccggagagagccgagcccggcacttttgagtatcgaattcggaacaaaatctagaatctcggcccaagcgatcgattgagtacccaagcaaaagcgacaatctcgggcggagataggcttggcctttttaagttcaaattgttggggtgttgccctgctggttctcgtccgagaatatttgaataataagcatatcaaaaatcccgtctttgccaactgatgagtgccaaccggattattttttgggatttttagaaccgggattttgttaatgcttgtatactctgtacgtggatcataaaatgggaatatttttccccattgatcacaacaatcagcacacactgattttgccccgggcaaattggcccccattatcacccactaattagtgggataatagtcaacaattaacaactaattgctgtttcctcccgcgcccatccaggcaaaatcaaatattccgagcgtgtgtacgacgcgtgcatggaatcgtttgacgcactgccacttgccgcgctaatgaaccaacagtttttgtgtgtccacggcggactgtcgcccgaaattcaaacgctggacgacatcaaaaaggcgagcagcagcagggcaggaggagggcaacacaaaatttttttttcgggattcttgagaggatttttcaggggcttttacaggatttgaaatccaatttttaagagtttgaacaattccgggagcccttacaaaagacttggcatccgaatcctgcgaaattagacgagagtcaattctcgacccggccctccgctccctaaggcatattcatggatagggctggattcttaaaaaaaaagaatattccgtcgaaacaaaaatttcattttaagcattttggaaaaatgatttttgcacattttagcacattttttggcacttttgggcggcatttttaatatatttttaaacaccataaacgacggacgtttgcattgcataaactagagtgccacgggaccgggaatttgggcaaaaccgggaccgggacttgccgggacctgagaagcggggaccgggacctcgatttttcttcgggaccgggaaccgggaccaaccgggaaattttaaaaattcaaaaaaatttttaaaaatttaattttaatttatttcaattgaaaataatacaaaattaaatgtttactttgtttttttattgaataaactccaaaagttaaagctaaattaaagcaatgaaaattcaaatcaaattttcttcagccatttcaaacaattaatcatcatttctggactaaatgatcgtatattattagaaattcagatttgcttttaacagcactttttttcgacgcgctttttccaaaaacctttggggaagaaagaggtccggcggtgccgttaggcgccgccgggggaaattttgaaaatttgagtgtgtaatttgttaacagatttttaacaaaaaaggctggtttttgggattactaggctcaatttgtacggattttc

SEQ ID NO: 10343 - DNA, 3801 bp, Heterodera glycines
gaattttttcaaaaaccgggaccgggacttgccgggacctgagaagccgggaccgggacctcgattttttttcgggaccgggaccgggaaccgggaccaccgggaatttttaaaaattcaaaaaaattcaaaaattttttaaaaaattcaaattttattttttttttcaagtgaaaataatacaaaattaattttttattttgttttttatttaataaaatcaaaaagttaaagctgaattaaattaatgaaaatttttaaacaaattttattcaatcatttcaaacaattaattattttggactaaatgatcgaatattattaagaaattcagatttgcttttcacatcacttttttcggcgcacttttttccgaaaaacttttggggaagaaagaggtccggcagtgccggtaggcgccgccgggtgaaattttgaaaatttaagtgtgatttattaacagattttcaacaaaaaaggctggttttggggattaataggctcaacaatgtgtggattttcatttaaaaatgataaaatatgtgtcaatttaaaaaaaaactatgaggaatcatattttctctacaggaaacccacgagtgtataaaaagaaaattcaaaataatttaacttctgtagagggatcgaaccagggcaaagacgaagggaaagtcaaggagactagccactaggccatttgcatacctggcagtgttatttttaaagaatatattcattattttttttatttttttcctttgactctaatttcatcactaatttttcactcagactcccgttctcaccagtgcttgtttttcccggttcccggttgccctaccgggaccgggacctgagcttttcaaaatccgggaccggggcctcggatggccgggaattcccttcccttcccggcccggtcccgttcccgcttcactctagcataaagttttggacatttaccacactcaaatgttttcgcgctgaaatggccgcgctaaatttaaaaaaaatgccattttagctggacagattcaaagagccgcccgcatttgggcccatgtgcgatttgctgtggtccgacccgctggaggactttggcaacgagcgcaactcggaatcattttcgcacaactccgtccgcggatgctcctacttttacaggtggtttaaatggcactaattaaccaattaaaattggttaattgtttttcggtcattaatgttaattaattaattagtattttttttcttgaagattattgttattattatctgaggcaatttgtcactctaaatacatcaaatctggcatttgcatattatcacgcaatttggcgtccctttgcgccaaattaggtcttcttaattgggcaattagcgtgtgttattcattgagtaattagcgtgtcaaattaacttccttaagaaaaagcgaaggtctttcaaaattttaaaagttcaacaagattagcaatctaaaaattgaaaaagcatcaaaaatttttaatttattttccctatttttaattttcgcgcatttatttttaattaaattttattttatttttgccgcttaaaatttcacttttctaattatgcctctgattttgttcagttatgctgcctgctgtgattttctacaacacaacaatcttttgtccatcattcgagcgcacgaagcgcaagacgcaggtcgaaaaatttgaaaaaatttttgaaaaatttcaaaaaattttccaaccctctaattaccccctgaaggctatcgaatgtatcggaaatcgcaggccaccggcttcccgtcactgatcacaattttcagtgctcccaactatttggacgtgtacaacaacaaaggtgcgtttctttgggggttggccaggcgcgccattgaaaattaaaaaatttttttttgaaatatttccttgaaaatttttcaaattgacatgtcttttttaatttttttctttttttcgcgtctctctctgatcgcttttattattttgatcattccaaacactgatcaaattgtgccaatatttgtcatttttgattaattatgcaccaatctcgagcattccattcaccagtcatttatttttattttttggaattccgagcatttattagttttattttttggcatttctcgcgcatcaatttacccaaacattgttttcggcatttctctagcattcacaatattttagttccatttttggcattctcacacacacaaatttctatttttcggcatttctcgtgcatttgttgttcgaaatttctcgcgcattaatttctagattacattgcttttggcatttctttattagtttcaatttttggcatttctcgcgcatcaatttgcccaaacattgttttcggcatttctcgccattaaatgtgatttttttgtgatttcattttttttcaaattttagctgcaattttaaaatatgaaaacaatgtgatgaacattcgccagttcaactgttctccccacccgtattggttgcccaatttcatggacgtgttcacctggtcattgccatttgtcggcgaaaaaggtgaccaaattaatggaataaatttcgattaattaataaaaacagatcaattcataatttcattaattaacaaaaacagacaaaaaaaaaattttttttttcatttattttaaattcaatcattttattaaattgattaatttaatttatatttaaattaataaataaattaatttttatttaatttatataattccttttttaagcaatttaattttttaaaataaatactttaaatttacatttaatttaatttaatcattaaatttaaatttcttttatgattaatttttgcttttcagtcaccgaaatgcttgtccacattttgaacatttgttccggtaagtggagtaacacattctcattcattttaccatttgttcgaatggttagacttgcattttttggagtttcggcaaaaaatcgaattaaaaaaaattgaaaattcaaattttggggatcagtcccattggccattgaaatttcacacaaattttgaatctttgttccaccgtttttcagatgacgaactgatggctgaaggcgacgacacttttgaaggtcagtcaatgccatagacccattaatcaattaattatgcgtaaatcaatcaccgttctttttttaattacgctaattaaccccatcaaaattacttaaattttcaacaaaaaaagccatgtgctgaaaaatgtgtgcaagattttgtgttgagtgtgctgtttttgtgtgtttttggctgctgctgctgcgtgtgtctgttgcaacattttcttccccgcattaattagcgcgcactaattagctcttccgcattaattttaattggccaatcacgtttttcaagacacccattaccaaattatgcctagggctgacagttttgcagcataaataatcaccaaaaagatgccaaaaaaggcacactaaaaacggctctggtttttaatcagggtgccgattttttacgtttttttaaatccctcagaaatttcaaaaatttcaatccttcgagggctatctatgtgtgtatgggtatgtgtgctgttttttggctgtctgattctgcttttttttttaatggaatgaaggatctgtgtctgttgtttttcgcaaagatttttaaaatttttatttttataaaaaatgaaaaatttttattaaaattaacattttaatttgttttttttctcgttcattgttttataacaaacaaacaaatttaattgtt

SEQ ID NO: 10344 - DNA, 2389 bp, Heterodera glycines
  misc_feature (2275)..(2275): n is a, c, g, or t
atcaagcaatgcatgtgaatgttctgccgcaaatgaaggaagtcacagcgaagaaagaagagaaggaagagaaaaagacagcccatttgatcagcccatttctctaattaattggtttgtatgttttgtatgtaggcccaacccaaatgtgatcgtatttaagccccatgaattgttcatttcatggctccgatcgcgcaccgaataaagagagaaaacccagcatttgggtattcggtagcccctccccctcgccttcctctcccacccccaccccgaaccatggacgacgaactgtcccgttgcggcttgtgggccgagccgcaacaagtggcgaccctggcagggacattttggtggggttttggggtttgtgagcaggggtagggggagcatgccggccccacaggtttttcgtaacctgtggcgtctggcattagcgctattccattttgcgttccgtgtttctggccccttgggttttttgtaacccaaggcgcctgcattccgcgccatagggcccctcgggtcttttgtgacccgtagcgcctcgcctttccgcgccttgcattccgcaccgtttggcctcccgggttttttgtaacccggggcgcctccattccgcaccatatggtcccttgggtcttttgtgacccggggcgccttccattccgcgccatacggcccctcgggtctctttttggcccgtggcgcctcgccttccgcaccacagcccctcaggaaagaatggtcatgcgcttaggcagcgagcctatctcgcactcattggcggcattgtgccgagctcacaaagagggcagtgagcctaatctgcgcaaattgttgaagcgcattggagcagcgcatgttgaagcgcaaattggagaaagcgcattggagaagcgcattggagcagcgcaaattgttgaagcgcaattggagatgcacaaattgaagcagcgcaaattgagaagcgcaaattggagaagcgcaaatgagaagcgcaaattgaggaagtgcgaatgaggcggaagggaagcgaaaattgtcagaggaagcgaaaattgaggaagcgcagaccgaggcggaatggaaaattgtcagaggaagcgcaaattgaggaagctcaaaccgaggcgaaagggaagagcaaactgtctgagcaggaacaaaaagacagcgcgcaaattgaagcgaaattggaacgcacattgaagaacgcaaatgggaacgcaaatcaattgcaggcgcaaactgagtctgagcgagggcgcagactgagattgaacacaagcgcaaacagaacgatggcgcaaactgagacgaccacaggcgcaatactggagaaccactaagtggcgcccgtagctcagttggacagagcactcatgctttgaggagatcgagggttcgagtcccaccgggtgaaatctttgtgttctacactacgagcctggctgaggccatcacgaagtcaaaggccatgggcgctggggcccattgtgaagtcaaaggccatgggcgctggggcccatcgtgaagtcaaaggccaagggcgctggggcccatcgtgaaatcaatggccaagggcgcttgggcccatcatgaagtcaatggccaagggcgctggggcccatcttgaagtcaatggccaagggcgctggggcccatcatgaggtcaaaggccatgggcgctggggcccattgtgaagtcaaaggccatgggcgctggggcccattgtgaagtcaaaggccatgggcgctggggcccatcgtgaagtcaaaggccaagggcgctggggcccatcatgaagtcaatggccaagggcgctggggcccatcatgaagtcaaaggccaagggcgctggggcccatcatgaagtcaaaggccaagggcgctggggcccatcatgaagtcaaaggccatgggcgctggggcccatcgtgaagtcaatggccaagggcgctggggcccatcatgaagtcaaaggccaagggcgctggggcccatcgtgaagtcaatggccaagggcgctggggcccatcatgaagtcaatggccaagggcgctggggcccatcatgaagtcaaaggccaagggcgctggggcccattgtgaagtcaaaggccaagggcgctggggcccattgtgaagtcaaaggccaagggcgctggggcccattgtgaagtcaaaggccaagggcgctggggctcattgtgaagtcaaaggccaagggcgctggggcccattgtgaagtcaaagggccagggcgctngggcccatcgtgaagtcaatggccaagggcgctggggcccatcatgaaagtcaaggccaagggcgctggggcccatcgtgaagtcaatgcccaagggcgctggggcccatcatg

SEQ ID NO: 10345 - DNA, 1224 bp, Heterodera glycines
ggcccatcgtgaagtcaatggccaagggcgctggggcccatcatgaagtcaaaggccaagggcgctggggcccatcgtgaagtcaatggccaagggcgctggggcccatcatgaagtcaatggccaagggcgctggggcccatcatgaagtcaaaggccaagggcgctggggcccattgtgaagtcaaaggccaagggcgctggggcctattgtgaagtcaaaggccaagggcgctggggcccatcgtgaagtcaatggccaagggcgctggggcccatcatgaagtcaaaggccaagggcgctggggcccatcgtgaagtcaatggccaagggcgctggggcccatcatgaagtcaaaggcagttgtgaagtcaaaggccaagggcgctggggcccatcgtgaagtcaatggccaagggcgctggggcccattgtgaagtcaaaggccatgggcgctggggcccatcgtgaagtcaatggccatgggcgctggggcccatcatgaagtcaaaggccaagggcggaaatgcccaccagcaaagcagaagagccagaaaaagacacaatgaagtgaaaaaggacctcatcgcacacgttggtcaagcgtgggaatgtcgcggctcgaatttagccgcgactgtccgatgatcggacagttgtcgaatggaaagaaatgcggggggagaaggaggaaaaaacaggagaacgggaaattgggcgatgaaacgatgaaaaatgggcaaaaaagtggcaatttggagagagaataacagctcaatcgaccaagcggcgcacatgaatgagcagaaagctgcgatgaaaaacagctgtcacagccaacccgacagcagaaaccggcccttcccgcccgaacatggtccgatggggacaaaaagtgcacgtgaatggagacaacatcaagcaatgcatgtgaatgttctgccgcaaatgaaggaagtcacagcgaagaaagaagagaaggaagagaaaaagacagcccatttgatcagcccatttctctaattaattgttttgtatgtaggcccaacccaaatgtgatcgtatttaagcccgatgaattgttcatttcattggctccgatcgcgcaccgaataaagagaaaaaaacccagcaattggattttcgaaggggcccctccccctccccttcctctcctacccccaccccgaaccatggaagacgaaccgtcccgttgcggcttg

SEQ ID NO: 10346 - DNA, 1720 bp, Heterodera glycines
ggcaaatgtcgtcgcacaaaaaatcacccaccggcatttaacgacgtgccgctgaaacgatggaaacgtcagcaacatcaggggcacacacgcttcagcaaattccaacgccagtaatggcgaacattccgacaaaaaacgcgacaaaaaaagtgaaaaatctatttacttttttacgcttttcacatttttggttttaagcttgtgaagcgaatccgccatgaaattgaattgccgccgccagtgccgttaacgcttcaagaattggaacttcccgagcagtaccgaatctacaaacgcaccgaagaagcgcaggagcttttccttctggcggattcaggaacatacaccaaaaatgggcgagacggacaacagcggtgtgtttaaggggaattttcagccattttttaattttagaattctcatttttggccgactttctttcggaaattgggcttccgaaattaagtacatttacgctgactgaacctttgcaagtgcaccgacgcacttttcacaactttacgtcattttggcgcggtacttttttgtcaattttgttttacattcgtttttcaccaaatttcagtcgtggtgactgggtgtttccggtccttcactgcctgctgacgtgcaagtcgtagtccacgtacgaaaagatgtttgacatggtcctcaaccgctggccgacattttcaccaacaaacgcgtccatggacttcgaacaggcgatggtcaacgcactccgtgcgaaacatccacaatgctcaatcaacttttgcctattccatttggtgcgcaacatgaaagcacgtcttaccgacgagcaaactcatgtaagaaattttattacttttcaaatgctcaagtttagcgtttcacaacggacgcagcctttgcacaagctgccaaaatgatcacttcattggcgtttgtgccgcttgaggaccttacaccggcgctggcagccctagaagatcatctgtcgggtgaacttgagggcgttctcgattggtttgttgagtttaattttttttcaatttcattattgactttaaaggttttaatcaactacgttgggcgacttcgcaacaatggcacacgcactcgtccattgtttcgtcctgaagaatggagtgtgtatgagcgcacaatgagcggcaccaaccgcacaaacaacttcgccgaagcgtaccatcgcacgttgcaagatgcgatcggacacggacacccaacaatatggaaattcatcaatattttgcgtgagcaccagaaagtaatcgacgttgacttcgaacatttccttgccggaaatgctccgccgccaaaagcaaagcgctaccgcgacacggacaaaagaattctgaggattttgcagcgctacaatgaggaaaaagcgcagccgcaaatcgaaaatgatcaccaatatggccaaaaccaaaataacccaaattcgattattgaaatgcttttcgagcaattatcaaatggattgttaattttatttgttaattttatttgttattatattttggataaaactgagatttttaaaaattaagccaaagtgatattttgatgataattgaaaatttcttatatattttttttatctgagacggagttggccccttatacactaagacggagttgtcgagacggagttggctcagacggagttggaacagacggagttggctcagacggagttggccagacg

SEQ ID NO: 10347 - DNA, 2171 bp, Heterodera glycines
ttccttttggagggtcaaattgtcgtcggattggaattcgcagaaccgtaatttcttgcgtctctccaattaattaatgaattaattgttttttattttaaggtgtttgttgcctttcaattggacctttggcctcactttccttctcccattggtccttttccttggcactgccaccggttacggtgcctactccctttggtacggtaactctcttgccgccagttatggtagcggcgacgtttccctcgcgcttcgccgtttgcttcaccggctgagcagtgcggccggcacaacgcttttggtgctgcttttctcctttggcaatgcgcttgtgcttttgcagccggccgaaatgcgcaggtgaaaaaggggcggagagagaacgaaatgtgacaaattattatgacaatttggcattggcattggcattgtgttcatttttggaaataattgaaatatttttctttaaattccttttttatttctttttccattttttctctaggagtgtcttcctcctctctctctacctttgtttcgccgtctctctgtgctctttcttccgccttttttctcgcgtcagccgctatttgccattcccttgccaaaatgtcgtggccaattctctccgtcaaaattcgctcgtccgcggcatcgacgggtgccccccgtccgggctgaccggaaatttcggtgatctgcagaacgccaagcgaggcaagcagcacgcgccagtcattttgctgcagtcgggtgaatgccaagcgattgggcccaatggcatttacggaaatgggacgggcgcaaatggcggcacaacgggcggccaagggatggacaggtgagttatcaatggtgggaaaacctgccagatccctagtgattgcttcagacaatcgctgttgcgccgttctgttgtcggtgccgccgcgtctcatcggcctgaattgtcctccgcctttccgtccctcgcgcccgcccaccagcgattgtccggcaccgtttccacttctgccggcactgttctgctcgagtcggatgacttggcctctctcgaccgggccatcgcctgcggcaacagtgcccaccaaagcccccagggagtggcacaagtcactctttcgtcgttaccgcccaatttgttcgcggaagtggacgacgacgaggcggaggacgaggatttggatgcctttttggagaatggaacggataccctcagggcattgggacgacagcgaaacgacgcgaaacgggacacgtccccccaacacaaccaccccaaccacccactcgtcagtgtggtgtgaggggggggaggggacagtgccaccgaacgaatgccaaagacgcaacgaacggctgctgacactttctcaccattcatatcatttttcactttagtctcaagactttccaattgattaaaattatttaaaagtgtttaatcattaatttatcatatcatttccaatggaaagtcttttttaatataaattacatttaaatttcaaaatgaataaataaatttgcttttgtcagatgctttttcccgcactctttgcaaattcccttttcccttggggcgccatttgctaaaaattccttcgcttttgccattttcactgattgaattccctctaaaaaatggcttggctttgaagtcattttaagttttttttcactctattaattgagagattggtcgcttcgcttccccttttaaacattaaaaatggtttaaattatgccataattttctgcaattttggcccatgcccaactcttcccaaaagtgccaccgccgtcgtcgtccccccgtcgccgccctccgtccccccactcgcattgtcataattcctccttcatcttcctcctcttcttcttcctcttcctcctctttttcctcttcatcctcctcttcttcttcttccgtttccaccgtttccaccggtgtttcttctcgcgtctcgcgactccgtgccgaatttttcgaaaattcgccttcaaaaaagcctttgcataaaaatgttaacacagtccttgtcgaagaagaaaaagaagacgacaaagaacagaaagaagtgatgaagccgcaggggaagaaggccaaaaaagcgaagaaaatgagagcggtgggggagaaaaaacaaatgtgaattttaatttaa

SEQ ID NO: 10348 - DNA, 1697 bp, Heterodera glycines
tgagagaaatcggtgagaagaaacaaatgtgaattttgatgtaattatattttataatatttaatttttttttaattattttcagccccacttggcgctttttccctcctccattgtgcgagcagggcgccaacaaaagcaacagttggccaaattcacggaatcggaaatccatcggcgggatggctgcccatttgggagagacggaagagaattgggacaatcgcaacagaggtaaaagagaaggcggggcaaattggaggacgaaaaagcaaagttattgggctgtccattcagacgaagtgccaaagggatgaagccgagcgacgcaagaaacagtttgtatacacgaactcgaggaagtgagccatttaaggcatttgggcgaggggaggggggggggcatagaggctgaggaggtaaatgggtgccattgggggcaggggggaccttggtcaggaaacacggagcggcatcggcaactcattcattcactatcaccgccgatttttcaattttttatttaaaatttaaaataaaataaataaatgattttagagcgaacaaagaggcgcgaatggagcaggggccgcgcgaatatgaggtgagttgagaatgacaaaagtgaacgtaacgaatgaatgccacttgaactgattaattaagtcctgcaaagagattggcattgacttttgtgctcggaccacttcgcatggcattccctttgtcgggtgagaaaaggcattccgtcgtcactcattagcacttttgttgatcattaattatcccatttattaattgtctctttctcgccccagggctcattcgttcttcggtcgtcccttttgggcttgtgtcactaccatcgctttctgttccttcatcattcagacgtatttcacattgtccgattacctcgaatatcgaacaatcatcgaaatgcaactcaaatttgagccgggtttggcactttgcattccattaatttgcctaattttatttgattttcagcgcctttccccgccgcaacaatgtgaaaatgaaatgattttttatatttttaagggataattcctcatttttcagatgcaatttgaacgccttcaaattgagcgaagtgcgcaaattcgaagagattgagcagggcatcaaattgtgggagaaggtgaaaaggagaaaaggaaaaatgtggcacagtgccaagtgaatgaaacaggtgaccacaattggggttttaaaggcaatttcgacgctgagtcgactcaaagagacgccgctgcgtcgtcgccgacaagttcactaccgacccatttatgtgcggtaagcgcaaaagcattaggagccaattggcaggttttggcaattaattagttgattaataaattaattggttgaattaatattaattatttaattaaatgatcaattaaatagctagttaattaattattagttgtgtgtgtgccgcttcggacgaccaatgcgtgccgcaaaggaatgaattggacgtgagaattaaaaattaaattaaaaattaaatatttttaaagcgaactgctgcggtgtgtttgtgctatgaggacgaagagacgggcgacatttggccatgttatttgtattcgttgtggaaggaaaaggcaaattttatttctttaagcggctaattaattgccaaactaactaattaaataaataaa

SEQ ID NO: 10349 - DNA, 1398 bp, Heterodera glycines
ttttgaatttccatttcatctttccttttcagtccctttgtttgtgtcagccaatttcccacttttgcctgcgcattaagccgggccaagagattcactggtgaaatgcaattgaattcaactttaatttcgaccattttctgcccaggagaaaccccaacaattacacaatttatccgtccaccgtaaaaccgccgacttcggaaatggaaaaggcatttggacttgaggtaaaatgagcaaaaaagcaaatgggaggaataatatgagaaaatggaaaaacatttaggacctgaaagaccgaggagcgatcacaacaaagacaaaggaaaatctgattttcttgggtaagcattcgattgataaatcaaatcccaagggatttgctcaattgggtttgttcggtcggacttgatcagaaccgattcgatcggttgggttttcctctgatcaatgagtttaatcgacaaaatttgtcatgtgccgtcaatttgttcatccgaagcttaagtcgccggaatgtcaacggaagtgcgcaaaagtctgagctatgggctggaagagtttgtgttgcgctgctctttcaattcgcgcgactgcgacttgaaaaggtgcggaaaatggcgaaacaattcgcaccatttgaacaaaatatcaactgtacattaagagactttcaaattcaaattgaccccgtttatggcaattggtaagtgaaattggcaaattgggggacaatgggagggacaacgaaagatggaaatgccaatgccattgacagttggactttcaatttcaatgattcggtggaattgaaaaactcgcgcgccggtccgatgtacggacttcggctattgttaaacgtcaaccaaagcgattatatgccgacaacagaagcagcgggggttggcataatgagacaaaatgtaaaattaaattaaatgcgttggaaaaggtgcgaattgtcgtccacgagcaagaccaagagccattcccggacactttcggtgggatttaccggcgaagaaaatgccgaattggcccctttcccaaggctattccgcgcccgtcggcttcgtctcgtcatttggcctaaaaactgttaaaccaacaattcaaaaagtagttttggaaaaataaattcagaaaattttgaatcgcctcgacgcgccttatggcaaatgttcggacacttttcggccccacggttatatttacgcggaacactactcgcccgaggtgctccgtactttgcgtacagtacgctagcttccgaattcccctccctacaaaagggctgctaccgtaactgcttccagcatataatcctcgaacgttgcggctgcggagacccaagtgaaatatcaaagggggaaaatgaatggcccaattaataaa

SEQ ID NO: 10350 - DNA, 4717 bp, Heterodera glycines
tggtgctgttggtgttccgcacttgggccaacatatgttggaagtccaacgggcggccgtccttctcctctatgtacgccgggtcgaggccgtcgtcgccaaacgtgaactggaccacctcgttggtggaggtgcgcaccgtgttgtcatagctgccagccaaatcctggcacaattgaagcgagtagaaataataatacgataggctaattgtaaatcatttttaatgttagaaacaattttttgggaaaaaaaatttggtttaaaattcaagggttgaaggaaggcctttgtaacaacaaaaaaaaattatatcaatttttaaattaatcaaaaattgctaaacaaatttttagtttccccgaaatttttttattatcccctccaaaaaagccataaaaaaaatccgctcaacccaggggcagaaaatttttttctctggaaaccggaaattccgaccacataaattttggaattccggtcgaaaaaggatttgaagaattcctgaatcggagtctgtgtcccatccgctgaggcattaaatttaaaaaaaaattgcgaaaaaaacgcacttccaagcacttgaccagccgtcgctgcatgtatccggtctccgccgttttcaccgccgtgtccacgaggccctcccttccgcccattgtgtggaagaagaactccgtgggcgtcaggccggaatagaacgaattctccacaaaacccttcgcgtccggcgcccggtcgttgcgctcaaagtgcggcagggagcggttctgcgaatcaaaaatttccaagaaaaaatttcccagcggcgccattggcaccgccgaactgtattgtaccattattttttgaaaattagaccccaaaatggcaaaatttgggcatggttaatgtcgtctgttttttaactaagatggaagaagacgatttaatttttgatccaatacaacggaactaccaaaaaccaaccgacctcaaatccgtcagaaggccgtttgccggagatggactgttggccgaccagggcgatcatctgcgcaatgttgatgaaggatcccttggaaccgcactgggccatcgtcagcggcgcattctttcgactaaaaaaattgcataaaatttggccaattttagacggcctttttttcggaagttttatatgattttacaataattgggcctcgattaattgggtccttggacctgtttttggtgtataattactttcatagttgtccgaattgaacctggcgaaaaatggcaaaaaaacaacaacttttttaatacaaaatttgttcgtttctggcaattgtgaaaaaatttgtaccaaaaaattgtccgggacccagtgacggtctcccccgccccaaccgagcacatgaaccacccaaattctggcattgcacggtacacccacctcaggtactgcttgcacgccttgcccgcctggtcacggatgctggacagctccttcagaattttggactccaactcctccaccaggcccaagtccggcttgtccttttggcgctccaagcgcatgcttttgttcagctggtcacaaattttgtagccggtgttcagcagcacacttttctcttgcaacaggttgacattgggcttcacatcgccaatgcctgaggatggagaaaaaaaaacaaaattatttctgagagtatggcaggcgtcgttgcaaaataagaatttttgggtgcactccaaattttcccctgtaattaaaaaaatagctaaaaaaatttcaattttttttcaaaattttggcggtaaaattttgtcccggcgtaatttcggccagcaaaattatcaatttttcaacatctttttttttcacgacattttcaaaaaagtattctaagttttttttgtaaaatttatgtctggaagggtggggatggaagtcaggctcaagctgaaaactgaccgattgagaagccccggttggacaaatagacggcggaaatgcgtgccaaccgccacatcgcctcgatggcatggccctcgccccaatcgcgcaacaaacggtagaaaattgaacatttgctttcagagccgagcaatgctttgtcaagcgaaccgcacagcaactgattatttcggatgatcacaaaggtgtcctgattgtgagtgataattgaaacaaagaaatttttaatttttaaagagtttttgcagaatcgttttaagtcgttggaaaaaataaaaaaaaaattcctttttctttagaaaataagaactcatgaaaatatttacaaattgttaaaaaaaactcgttagaaattgaaaaaatttttggttttccggcgaggtataatcccgctgcgaatttgaccacgccatttttcaaaaattccgtaacacttatgggcaaaatttttaaaactcggttttgtaaatgtgttaaggacaggacgggaaaattgtcaatttgcgatttcaatgaacaattttatttttcatcaaaccggtttccccaacacacttaaaattttaccaaaatttttcaatttttatgtttgtatctttgcaattttccgtacatttggtgtgaattcgccctcgtccgggttgtgcattcggtttttggtggacaaattcagacacacttccgtgcctttgtagggcgcaatgagcagttcgataagctggaattattaaagaaactagtcaaatgaattttgaaaaaataataattaaaaaaagaattatcaaaagaaaattaaagaataaaatataaaaaaataaattatgaagaatttgaaaaattttcatattttttaaagttaaaatgcaaaattttcatttttccccattaaatccgcccaaaaaggatcccacctgttttccagtccacaactccttgggcctgagcagtgccggcggcggcagacgaatgcgtttggcaccggtgttcgcctccacaacggcggccgcaatccgttgcacttcggaccggggcagaaaggtgtccttgtgggtgagcaaatagcccgaggtgatgaaatctgaggatggtaaaaaaaatataaaggaccaaaacaaatttaggttgagacgcaaattaatggacaaaaattcaaaaggaattttaaccatttaatcacaaaaacgacaaaaaaaaattggaaggcatttttttaaattttacaaattcggaaaaggttcataaaaaattttaaatttttttattaaaaaaggttcatttaaaaattttatttttttttttgcaaaaattttgattaggcagggtccattacaaggattgaagaaagtaacccaaaaacgaactcccgactattgaactcaatcattcttgtcaaaaaaaaaaccccaaggtgtaagacaaagcaaaaaagaatggagcagattattccctctccgccggccgaatttttttttaaattcagaaattttattaaaaaaattatttttaattgacattttctttcctccgtccaaaattcaccttgaattgcggcgatcagcggctggcccgcccgggggctgaccaggttgtacttgaggcccatcagcagcgacgcctccgccttggcctcgtacgtctggggcaagtgcaggttcatctcgtccccgtcaaagtccgcgttgtacggcgtgcaggcgcactcattgaacctggcggaaaaaaagtgggaaaattaggcaaaatttatttatttacataatattattggcagcggatccttcgccatcattcgaaacatttaattaaatttcaatttaaattgctacaaaattttagtgattaaaaattaaatcaaagcaagtcgaaataccaagaaatcgccaatttgtcgtttttgggtcaaatttgatagaaatttacaaaaaattgtattactacccatttttaaattttatttttttttatattcgataacagggccctgccccgcacaacctgaatgtcctgtacggcatcaccttcacccggtgggccatgatgctgattttgtgcagggacggctggcgattgaacagcaccacgtcgtcgtcgttcaaatgtcgctaaaattaaatgacgacataaaaatgttagtaaattcttggttttaatgagttgcttatatcgaaggaatttaaacataaaatttgaaaatgtgggatgtaattttggaataataaataaatatgcaacaataataatacctcgacagtgtcaccaattttcagttccaaggccatcttttcgcgattgccatacctgtggaaaaaaaacaatttttcccctgtcaattgccttcaaaaaaccagcctcagcaagcgcttgaagcccgacttgtcaatgtacatgttggcgcccgggtggacggagtcgccgttgcgcaccaactggcgcatgcgttcaatgttcgcctcgcacaccacctcggggaaggtcagcgtggtggccacgtgccgtggcacgcccacctggtcaatctgaaacagcaaaataaaattagtagggaatgaaaaagacgagagttatttgaagattttttaatgtcaaattttgaaacaaatagagaatggtttggtgcttgtccaaagaaacaaaaaaataaataaatatttgtttattcatcagccgccgagggggtccgaaccaatgacaaaattgtcaatttaaacgttgaaggaaaattaattacatttaccaatattggtttggtacacataaaatttgtgctatttt

SEQ ID NO: 10351 - DNA, 3104 bp, Heterodera glycines
tttaacgtagaaatgctatttttgagccctttctttcatagcatatgtgcagaaaaaaaattaggtaaaagcatacaatttataaccttagtaataacatatgtcaaaaaaatgctgaaatatgtgccaaaaacccaaaaaaatgccaaaatatgtgctaacaataaaatatgtgttaaaaattggaaaaatcaaaagtatttttgcataaaaattccaaaaaatctcattctttatcatttttgcccgcgaaactaaaataatatttttccgataaatttttttttataaattgaaaactccagccagagaattcaaaatccaataaccaattaagaattcgatttttttttaaattttttgtgtttttcttacagatatttctcaaaagtgtcaaaatatgtgtttttataaattgttcggtctaaaatataaaaatcccagctctaattatggatcagtaaatcaattggaatggaaaacagaatgtattaaagcaatttaggacaatgtaatgaaagtggtcatttatgtgggaagataaattccaaggattaaaattaccttattttttttttttgtataaccataaaaatatattatatagttaattttttatgaactttttttcagaaataaccagatttaatttctttatatgattaaaaagatcaaatatttttcaatattctgtttaaagaaaaaaagctttgtcttatcataacttatcgaattaatctcaatgattgattttcttttctcattcaatctcgacttttctgatcactgatcagcggtcctgcgggcgctgcttcaaatactgctgcagttggggcagcgcatggacacggtcaacgtatttgatcagctccgggaacgcattgatagtctccggctccaacttggtaaacgtgtacagaaagttggccacctgttggaaaaacagcgattgttacggtatttatggtacggtacagtaacaaaaattttcaagctattcaacgtaaatacaaactcataattttttataactccatgacaaaaggtctagaaatttaaaaatttacgcctcgcacccgagaaattcaaaaaatttgaaaatttcgacttcgacggttccgatgaacgccagccgagaaaattttacttgaaagtccaccattgagaggccggacttgagcatgtagcccgacccggactccttcaaaagtttctcaaacagtggcaaaatgtgcttgactcccggctcgaacacttcgccacgcaatttgtccttgggaaattaaaaaaaaaatttaaaaaatatataattaaataattcttaaaaatatattttattttataattaaatagaatgaaaatattttagttttaaatgtatttatttatattgggccgatttttttactgttttcaccaaaaactcactcaattaatgaatgaattaaaaaaatcatacttattaatgaattattaattaatttaattagaaatactcctcatattaaataaattttcataattgcattatttgttcaccaaatcgccttggcggaatcccattttgacgtataaatagggggccaaatcagtgttagcatccttttgaaagtcgatgatttcgttagccttcgccttttcgcattcatctttgccggccaagccttaaatttaaatttataattaaaaacaaataaaattaattattataattaatttaccaaatttttcggcaaggtagcgcaaaatcgtagcactttgtcccaatggcttcccgtcaacctccaaaactgggacctttccgtaaaaaaattctgaaaaaaaatttgtttattttttttaatttggcattcatttctctggcgttatgccacccattatttactcactttgcttgtacgttttctcccattcttcatagtctttaattcggatgtcctcaaacggttgggcaacatagtgaagcaacaggcggatgggttcacccaaaccgcgcccatcaaaataatatatataatttgtattggaccattttttaggacaattattacttatagtaatttcctttgaaatttaaaattaaatcaattgaaacaaatccctttaaaaacagcaaaatgatgacaaatcagcagaaagagaggtagagaatgtgagagaaacgaggagagagggaaatagagagaaagagaaacaggagagagagagaggtgagggagagagagaaaatatgaaagagagaaatatcgagagggaaagaaaagagggttagagagagaatgattgagtgatgaagaaagagtaagaaccaaagacagtgaaaaacaaagaaaaatagtcgttatataaaaaccatcaaatggaaattttcaacaaaaaactgcccataacttttgccaatgtcaaccaaattagacattgttagtatcattcaatagtcctaacatttctctacaagatcatctaaatttcaaaaaatttggtcaagtttgagcaaagttatgaccaaaaatgattgaaaacctggtttctgatgtacatcagggttgttccggttcacccgaatcccgacatttttctcgtcccgaaacccgaatcccgacccgatggtttttcggccgacccgacccgaatcccgacccggtatttttctcgttccggaacaaccctgatgtacatgtatatcaaagtcaacaaaaattttgacggtaatttagaaagtccactaggttcacgattatttgacaacaaaaatcgcataacttaattaattaagcaaaatttggtatcatttgattgttcgtctcgatgttactgatcacgaatccggtataaccgtttctgagaaatttccaaccccggacccgaactcgaacaaaaagtcgaaagtccaaattctcgaatctagcattttgattcaataaaattccattattgaaggattgatggctatcagtttatttcgtttatttaaaccgcttttgaaccaaaaatgctagtttcgaaaatttggattttcgactttttgatcgaattcgggtccggggttcggaacgatcttctttaagaatcttatatttatatactatatacttaatgctact

SEQ ID NO: 10352 - DNA, 2045 bp, Heterodera glycines
ccaaatcgccttgggcggaatcccattttgacgtataaatagttgggccaaatcagtgttagcatccttttgaaagtcgatgatttcgttagccttcgccttttcgcattcatctttgccggccaagccttaaatttaaatttataattaaaaacaaataaaattaattattataattaatttaccaaatttttcggcaaggtagcgcaaaatcgtagcactttgtcccaatggcttcccgtcaacctccaaaactgggacctttccgtaaaaaaattctgaaaaaaatttgtttatttttttttaatttggcattcatttctctggcgttatgccacccattatttactcactcggcttgtacgttttctcccattcttccatgtctttaattcggatgtcctcaaacggttggccaacatagtgaagcaacagacggattgattcacccaaaccgcgcccatcaaaataatataatttgtattggaccattttttaggacaattattacttatagtaatttcctttgaaatttaaaattaaatcaattgaaacaaatccctttaaaaacagcaaaatgatgacaaatcagcagaaagagaggtagagaatgtgagagaaacgaggagagagggaaatagagagaaagagaaacaggagagagagagagaggtgagggagagagaaagagagagagggagggagagagagaaaatatgaaagagagaaatatcgagagggaaagaaaagaggagttagagagagaaagagtgagagatgaagaaagagtaagaaccaaagacagtgaaaaacaaagaaaaaagagagattggaagaaaaagagaaggagagtgaaaacagaaaaaaggtactaattgcttttgggtcctcttttttggtcgaaatttttcaaggcgtagccagacaggcagacagtgcactatttccttctttctttttctcaccccttccttttcccacacacacaatgctgctgcacagcagggatgggccgaggtttcgcttttcgcatttcgcctttcgcattattcgcattttttggcgtttcgcatttcgcttttcgcatttcgctttttggcgcgaaatgcgacttttacacccctaagaattggattaaagtcccataaaatttttcaaaattttacctataaattggctaattttcagtgaaaaactgtttataaatgatcaaaatttccaatttttttcccagcggcgcctatcggcaccgccgcgcccccaaaactcctatttgttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcgccgcctgcccccccttcccaaaaagtttttttggaaaaagcgcgcctcaaaaaagcgttttattgatttttaaatttggaataaaattttaaaaaatgatttttgctttatgattttatctattaaaaagttgtagaaaaaatttcgcttttcgcattttcgcatattttggcttttcgcatttcgctttttttttcatttcgcatttttcagtttcgcaaatttcgcttttcgcatttcgctttttatttttcaatttggcccatccctgctgcacagccagcacacggtgctgagtcgttatataaaaaccatcaaatggaaattttcaacaaaaaactgcccataacttttgccaatgtcaaccaaattagacattcttggtatcattcaatagccctaacatttctctacaatctcatctaaatttcaaaaaatttggtcaagcttgagcacaaagttaaggccaaaagtacgcgaggtaccaagttttcacacatttttggccgataactttttttaaactcgaataaaattttctgaatttttttgcaggctaatagagaacacgtagggctatcgaataaata

SEQ ID NO: 10353 - DNA, 905 bp, Heterodera glycines
ataccgtattttcacgattatgtgcccgtctccaattatctccccctttctgaggaggttgaaaaataatatatccggacatataattagagaaaatacggtatgtatacagtagaagatcgaaaggtgacgttaaaaaatctagcctgatatgtttccacggtttttaggggcacattagtgatcagtgataactatagaacatccattactgataatgaagaaaatttaaaaatttaattcgaaacttaaaaaagaaaagaaagcttcggtgcgttgcattaatgtaagacataaaaaattctcgcccggtgtgactcgaacccagcccgggagtgtcgctttcagctcgataggttcacagaagtggtaaaacctaacgaaaaatgtggtgtctttattgttgtaatgcatttatgtacatacattgctcttgcagtttaggccccacgtaatttcataacaataaaaaaaagtcaatcatttgaaattagtttaatcaatttttaaaatttcatccatttgacatctatttttgaaaatcagcagtttcttctttctgtttaataatgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaagtaaaccatgctaatgggttttttaaattctttcgacccttaattttgacatttgcggtttttaaaaccagaaaatttggcatttattttcttttgtaaaaataaatccgttatggggaaataaaa

SEQ ID NO: 10354 - DNA, 3498 bp, Heterodera glycines
caaaagagcgcatttaacttgagacaaatgaatggcatttccatggaaagggaaaaaggagtggtggggatgggatggacagctgttcctattaatgggtgaaaggaaagtgttggcgccagagaatggggaggcgtcactttggtgggtttgctttgagcgtttcatagtttgtatttgaatgtgaccctcttcataaactctgttcgttttggcattgcttcttcccgttggaactggacacttgcggtttaattacaaaaagaaagaaaagtaagcaagaattaaaaaactcatatgtattgtatataccgtattttcacgattatgttcccgtctccaatttctccccctttctgaggaggttgaaaaatactatatccggacatataattagagaaaatacggtatgtatacagtagaagatcgaaaggtgacgttaaaaaatctagcctgatatgtttccacggtttttaggggcacattagtgatcagtgataactatagaacatccattactgataatgaagaaaatttaaaaatttaattcgaaacttaaaaaagaaaagaaagctacggtgcgttgcattaatgtaagacataaaaaattactcgcccggtgtgactcgaacccaggccgggagtgtcgctttcagctcgataggttcacagaagtggtaaaacctaacgaaaaatgtggtgtctttattgttgtaatgcatttatgtacatacatacatatgtacatacattgctcttgcagtttaggccccacgtaattttatgacaataaaaaaaagtcaatcatttgaaattagtttagatcagtttttaaaatttcatccatttgacatctatttttgaaaatcagcagtttcttctttctgtttaataatgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaagtaaaccatgctaatgggttttttaaattctttcgacccttaattttgacatttgcggtttttagaacccagaaaatttggcatttattttcttttgtaaaaataaatcgtttatgggaaataaaatacagtgatcacgatttttcggaacctttgagcccgaattcgaacacttataaatgcgaataaagtggtaaaaaaactcgtcctttaaatattttcttcaagggaatcattcactatgagtttatgtttcaaatcgcctttttgttccctaaaatggattttaaaatttttaattaaaatattttttgatttaaaaatgagttacactatcgtagcgttctctggacccaaatccaattggatgagctaacacttgaaaatctaaatctggcagatgttggaacagagcaggacatgtcaagcggctgtcagcggaatcgccagtggcattttggggctgaccggcactttgggctttctgttctatttcctttgtgttttcttacaggtttgttttttagaacctatctttatatttcaacaaaaatattatgattttcgtccttttatctgtaaaaccgtcaaccatgaacataatgttgttcaaataataccaaaattattatttctactgcaaattcataaatttaatggtcccattaattaataatcatataattgtttcttaaatgtgtttcttttccaaggcttttgtctggcaatacaagacgggctttcgatggagtgcgtttttcacgagtcgttcgcttttcctcacccattcggtcgttagtggccttttcacttatgtccttttttgggtgtttgtctacggacttgtccatgtttattagctgttttgtaccaacagtatttaattttctttattcgataaaaatgtttcggtgtttttgattttccaaaggaataatttattcattaattattatctatcttttatttgttaatggatgctaattacgttttttaacaaggaatggaatgttctaattgctctcttttgagaagagattttgaggagcaaaagatacaaattgtccgatatgaggcgaagatcaaaggtaagtaatggttaatgaacgtagccaaatgccgtggacattccctcagatttggtaaatgcctacaaaagtctaacgactgagaagcaatcgttggaagttgcgctgagtttactttctgctgctggagaggagaattccgaaaagagcgaattggggaaatcgaatggcgaagagacgggagaaattgcgcaagggacggagaaacgggaaggggacgaggtgaaattgagggagaggggggaatggaccatccaatcggagagaatttaaagacgattttgggccaagtcttggccatttaagacattgttttgcgttttttaaatcacatttgatagttgtccgttgccgagcaaatagaagcactaaagcaggcgatttccacgctgacattggtcaataaacgtaaggagatggagttcaaaaaggacaggcggtcgcttttggtgcgtccgacggactgccgaccattgggtttttatccgcgcttttaggaaacaagagacgaatttcaaaaccgatgcagcgatttggagcagcaactcaaattgctgaaacagcagaacagaagccaacatacggtactcaccagggatgccatcaccgatttccgataccatccatttccaaaaatatcaccaaaagttactgttttcgaggcaaaaacactaggaacgaactcaaactcataacatcctcttttgattattttattttaatttaaaatgttgaagaaaatgaggcaagaatttgagcttgtgaatttaggacactctaaagagattttctccgggtgcagtcaatttcttccttttattcttttgtttttcaacagaagcaactccgcgcggatttggccgattcgaaagaggcatttgaaaaagcaatgacagaacacggaatggtattggccgaacttcagcagcagtacacgaaggagaagaaacatggcgaactgttggaaaaacaggtaaaaacgaaatgggaaaggaaaaagcgaatttggacaatttaaggtcaccgaaatgagtcaaaggttggcagaaaaggacgcgcagataaagcagacggaggggcgactgaagcaaattggcaatttggagaaggaaacggaaatgctgcgcaaaaaggcgcaactgactccgacagtccgagtgataaaagacgaattggccaatgtgaaggtaagacgagcgcaatttccaattctttgtttcaattagtcgtcatcggacaaagaactcaatgtgtgccgaagcagaaatgccatccaagaagcacaattgcgggagaaggagtgccg

SEQ ID NO: 10355 - DNA, 1841 bp, Heterodera glycines
  misc_feature (9)..(9): n is a, c, g, or t
tatttatanttgattttcaaaaagcatttgactcattgcgccataatttacttttatacaaattggaaaaaattggtatacggggcaaacttttattgtggataaaggactttttaagtaataggacttttcgagttcaaattggggattctttatcttcaagtaaaaaagttggctatggcgttccccaaggctcttcctggggcctttattatttttgatctatattaacgatcttcctgatgctttgccatcaggagtaagaattaaattatatgctgatgatgttaaaatgtatatatgctataaagcaagatccgacacagaaattatgcataaagcattgcataatttattcgaatgggcaaataaatggcaaataaaagtttcaattcaaaaaacttttgtattatatttgggttcaaaaaacccaaacgaaacatataaatttgatgtaaatacaataaatgctgtggatacaattagcgatttaggagtaaacattgataacaaattacaattttccgatcatgtaaatcaaataacaaggaatgagtatttacgtatgcgttctttgtttcgaataattaaatccaaatcgtctaagatttggattacgttatataaaacttatatcaggcctttattggaatacgctccggaggtttggcttcaaaaaaatattaaaaaaatcgaaaagtgtcaaaaatatttcacaaaagggtattttttaaatgtagccttccaccccataccaaaatcgattagaatacctgcaactgccaacacttgagaataggcgaaagctgtttgatctgttatggaatcaactcgataaagaactaataaaaacaaattctttaaatcaatttaaaacaaacttaaaacttcactagggtaatatgtaagaccggaaaagctagaatataataaattttaagtgatttggtaattttatattttgacctcatttgattttgacctcattatttatttaattattttcacatttttttttttgccttttttaatccctgtgatcatccatatattttgtaacttactctacgacatatttttctgaatagtcgtcagagtaagtggtttttcgcccttctgatgacttttttatttttacaaataaacaattataattaaatattggaagattttttccagataaggagaatttttaaaaattttttgtcaataaaaaaactatgggacgaatttttgagaaaatttctcaacctaaaaacaaagttaaaatcgcgtttttcaagttgcacacaaatattaggcatttacctaaaaatgtcatcatccataataattgtaaataagcacagtttaaaatggtggtaatttttatcgcatcttctaatcaatattttgttccctttaaaagtgtccgtatattttgatcattacattcagcaggcttgtccctggaaagcagagcagtggttttttggcattttgccaaaggatgatttagtcataaatattcataaagatttattaaacttataattagggataccattttaggtgccaaaaactgccaaaatagttaggttataggttctaaaatactcccaaaataagtgctaaaaatggaaaaataggagctaaaaagtttcaaatttaggggtgtaaaatcgaaaattttctttaaaaagcaacaaaattatactaaattattaatgagatacacaatttttaaaatcaaaaattcttgtcaagaaagtaaataaataaattttgaagataaatttttgagaaatttttctttcttagggagtgcatttttgaaaattttcgggtcgtttcttaggggt

SEQ ID NO: 10356 - DNA, 1970 bp, Heterodera glycines
acactataccttaatgtaaatgaatttaatttttttaattttcaaattaatagattcaataaaatgaacacaattattgtcgtccttgttcaaaaatagaaataaaaaaacaaaaaatttaaatcgtaacagattaattaatttgataaaacaaagtaacttaataaataatcggacataaaaagaaatgaataatttgaataaaggaaacattttcacaaagagttggtcacatttatgcttgtgaaactcccttgggtgcttttattcttaaattttctttcgcaagtttaattaaactcaaatatatttagtttatccgttgttttaaatattaaaaattttagcttcctttccttctttgttaatatttaaaattatagaacatatacaattaatttctttaaatatatatgattctttcacaccgatgcgacaaatcttttaaattaaaagttgtcgatttgtggggagcgagggaggcgagagccgactttgccaagggcaaaatcagctgtttgcttccccctttccctttctctgccgtgccttcccaaatgtgggggaagggacggacgagctgttgaaagcgaaggctcgcaggagtgagagactcctgcgggggaagaccgacgaagcggtggtgagggcggtcaacgaagacgatgagcagcagaagggggagggagaaaccgtcccgaccaaatcccccggattcttttcacaaatatatatttattaagcagcagcagaaatgaatgaatggaaatgtggaagtgagcatacagcgagaaaaatggtgccctttttataggccgaaaaatgcgagggggcggggcacagaggaaaaacttaattggactatcactaacaaggcggtggaaaaaacagcgggcgatcgataaaatctgtcgctgttggcgacagaactccccccgcggcaatcatcgaatttcttcgcggtggtgtcggcgctctttcttcgccttgtgctttccatccgccgacggcgagcggtgatggtggtggtgctttcgctgcttctttgcgcggcgttcgtcatccgagcccgacgagctggcgggcggcgacgccgggagccacatggaattgcatttccgcctgtcatggttggcggtgacgaaaggcgatggcggatgaactgagcaaggcgggcttgctcagccgtcaaatacgccacagacgcacggagagcggtgagctctccgtgaacagccacgaggtccacggcggccttgggcggcgggtgcgctttggccacaattccctcgtcgtcctgggcgggaatttttttgattgcgacaattggccccatgcatttaagaatgaagtccaagggggtgactgcggagggtccgagacctcccccgctgtttgttggcgtcccccgctttacgggggggggactgattgagggtgctgccctccaacctttggagggtgcccttaccggtgggcgtgtacggtccgccttatcggcggtgatctccccttcctcgggggagtcgcggcgtgcgtttgaagtgccggagcggctcgctgccgccgttcgctccttttgaggaggaacataaagggggcaggcttttgccccgcggcgattggccagagagttggcacgccgaacacgtcggcaggcgttttgacgacgactcctccttcgcttccgcgtccatgaaatcgcggacggaaaagttccgtccgctttttgcgtcccgttccggtgtcgctgcggcgatgttgaacagttccaccgcctctttgcgtggcggtggcggcgactggcgatcaggcgatgatgataatgatgatgatgatgatgatgaataggcagacgacgacgaggagggcattttgatgggttttggcatttttggggcggagaatgatatggggacatggctaatccctgcccttatataggacttatggtcattggaggggcggga

SEQ ID NO: 10357 - DNA, 780 bp, Heterodera glycines
atgccaaggacattcttatataattggtattgctttttgatttggttccttcaagttaaaaacaaacaacaataacaacaacaacaatggaagtgcaacctgcagaaaatgatatcaaattgccccgtaagtggatgtgaaaaattgaaaatttggcaatttaaaggtcctttaaacagctgtcagctatatcgagtaagaaaaggccaaaagattactagccaaaaaatggaaaaatatggacaaagttttgggttttcgcaataaaacccgattaattttatatttaaatgcatatattgttatatagaatattgtaagagcttcagttgatccaaaccgggatcttattacaaatatagtgacagcgtatcatatgcattctttagtctgtcatttttaccgtatccccttctgggtacgatatatccccatatgtgcattcacttttggaattgtccggtcaaatctcgatgtgccacccacagcgttaattgattttagcgcactaattacattttgtatttccagcaaaaatcgtaaatgaccatgaaattcgtggtattgcgccggtcggagtgctgctcaacgcatttgagttgaatttgagtgcggtgccagacaaagtgttccagcacgaccttcgcttcgtggctgagtacacaaacacgaaagagggccaagcgaaactgcaggaattggcccgtgggcctcgcaatgagtgagtgactcattagcggagtgccaatctcgaacagcaaagatttggtgccgagacta

SEQ ID NO: 10358 - DNA, 4125 bp, Heterodera glycines
gggaaatttatttaacgagaattctcgaagaataaattacataaaaatcgcctttatttttcaatttgggtttttttattaactatttattcaatttacaaattttcaaaaattgccacagaatttcaatgcgttttttttcgcaaaattaaatccaaaaaaaaattactcatttatttaattagagtccactaattaatttacctgctctggcaattccacctcctcaattttggcactcaacaccacaatcactgagctgaacccattcgcgtcaaccaattccttagaaaagaatttgaaatttcaaaaaaaaaaagtttatttttatactttacaatgtgcagacattgaagaggcctcgaccttgaaaaatgaaaaatcaaatttggagaaaaaaaaattatagttaaaccaacagcataaacacgctttgctccgacttgtgcggcaaagaaggacaactaaagagaatcaaaatgaaaaatattttaggagtcatcaattattattttttaaaaattagaattctgaagttgaacaaacgaaaatttcccatttaaaaaagatttatgatataaataataaaaaaaaaattgaaatttgttcaaaaattccatacaatgcctgtgccagcgccgacgtccaacacaacctgaaaaagcggaaaaaagtgaaattagaaattaattgaatttccctaggaaacccaaaaaaaaaataaacttttttttttggtagatgaaaaattcttttatttaattttttctgcaacaccatacctttcccctaaaatcgtgccaattgtcaaaaattgcccgctgataggtggcggttcgggtgaagtcctgcagcatgttctgctgctggaacagcgagccataaaattggaaatattggacggcggaacctgtggggagaaaaaggaaggaatggaaaaattaattttaattgggattttttttttgaattaagaattcgtaatttcgtttttgtcagcacatgatgcattaaaattgaagaaaaacgtgaaaattaagttttcaaaaattaggaaagggtgagaaaacagagaaaattattgcattttctgtagaaaaatttatcagaattaacaccatcggccaccgataatttgtctattagcccaattcattttttcaactagaaaaaactccaaaaaatcatgaaagctaaaaataataaatttttaccccaaaaatggcatttttggacagtcgttgggtcagaattgaaagacccaaacaacaaaaaattatgtcattaaacgataaatgtgaaaaccttgttcggttctcgagtcaaactccgagtgcgtcgtgttttgctcatgttcaccgccaatgccatcatttttcatcccatttgccgctgtgtccgcagcggttgtgccgatgtcgtcgtcggcattgttgccgttaattccgtcacatttgcgctttttgttgttgctggcaccggcacagtccgtctttttgccggcatcggtcccgtcgccagtgcccggggcggctgcgattggttgacgacgacaaaatgtgtccaaattggtgcgaaatgtgccgagttctgggtaaaatatttatttttaaattaataataaatataagtgggaagtggaatatggaaagagacaaattggcaacagtttcctggtttttgagtataactcatttcatatttgtgcgaattgaaccaatctattatcatttggtaactctaaattatctctattaggaatgcaaaaatttccaaaaaatttcgttgtataacaaaaaaaaaaaattatgaccaaaaaacttaaaaaaaaacaacaacaactgggttttcgagtattttgacaataaccaatcattatcatttgatagccctaggctttcgtctattgcctgtaaaatttgtaaaaaatttgttagtcctcagaaaagttaacaaaatgttcagaaaggcagttttttagtttttttggtcagcaatttagtgaagaggcaagaggacgaaccatgcaacaaatttactaaattaagaattttaggaaaaaaaaaattaaaaatccgacggtgccagatatatgcattcgtggaaattaattaacattttacaggaaatgaaaacctttttcagtgctgaaacagatgacaaacgcattgagtgaacacagtgtgccattgttgggctcggcaggcggcgtcgaattccgtcgacggaatgcgattgatttctaaaaaaatgaaaattttataaaatcaaatttcaaaaaacggcatttagtgtcaaaaagcaattagatttcctgtttgttttgttatgaattgttcgttgggcagttttttaatcaacttataaaaaaaatgccatccctccctctcacaaaacctcagtgatcggcatgcgctcgtagtcatttggtctaaactggaagatggacgaagttttggcaccggatagttgctgttgttcattgcgggccggtgatgcgtcggttaggcctaagaaaatttttaaaaaatgaattgaaaaaataagtaggactttgaaaattgtcccaagcctattcagactactaataaatggacatcaattttgtttttaaatcaaatttgaaattaatttttacaaatttggtgcctcaaaagcgcttgacaggcctgttttaccatgcaaacatttaaaatttcattaaggtagaaaaaatatgtcaaatgaagcacaaaaaatgagttgtttgcccttagattggttttcaaaaaattccggttaatttttaaactgattcaccattttgatctccatccaaagaattaagcctcaatgtgatgccgttgctggcagaaggcaaaattgatagtcgaaatttgccgaaaaattgtttgaccatcggcggcacagatgcgtcatcatcacagtcgcggaactcgcaaattcggacgaaaaattgaagatgcggaattgacatggtacaacctgcttctgggtttctctttatatggtggataatattacgattaagcacaaaaatcaattttagtaatggacatttcttttttggccaattcgtttttatcccatcgtttttattatccgtattcgtttttgggccaaaacgcgaaactcgaggtcgaatatgacagacactcctaaatagaacgtagttttgtgaggaaaaaatggatatggtttaattttaaatttttgaacattatgccaaattattagaaagaacttggaattttaaaaaacgagtaaaaacgataaaaaggcgtgaaaagccgaaaaataaaaaatttcttttggaaacattttttatcaaaaaaaaacaaaaaaaaaatctctatttttattttcgcactgataaaccaaatacatttcaagattttctggagtgaattctggggccggaattccgctctctaagaataatttttggtctcgtaattccgaaaatttttgaatttttgaattccgatttccacattttcagccgaaacagttgccgaattttacaaaagttgtctgcttcaaccgcagacattggaaccatcatgagtacgatctcattgggaacatatacgttgcttaaattagaaatttccatctgttcgtttgttgtcagtgctgtgcacattgcaacagaagtgagtcaaaggcttatatgaaaatatgcggcacatctcagttgggctccagcaggtttttggactataacttttttttttctttgtcaactaaatctaacaatcttggtatcccttaagatgctctattagcatgcgaatttccaaataatttgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagtaatttttgaggttttttggccataacttttttgtaaaactgacgaatttttttgaaatttacaggctaataaagaatctgaagagctatcgaatgataacaaaaatttttaa

SEQ ID NO: 10359 - DNA, 1038 bp, Heterodera glycines
tgatgaacagggatgccaaaaatatgcacgaaaagtagccaaaatatgcgcataaatatgcaaataaaatcatgaaatatgcacaaaaatcgcaaaatatgcaccaaatatgcacaaggcagtgaggctccctgtttacccactcgcgcatgcattcaaatttggatttaattttaggcataataaaaattttttcctaagagatattaaaatcggaaaatatttgacgaaaaatggcaaaatatgcaaaaaaaatctgaaaatatgcacaaaaaatggcaaaatatgcatgaaatatgcataaaaacccaaatatgcaaataaaagtcccgatttttatacgcaaacacaaaaaagaaagtgtttttccttttttcctactatttagagcaaggagaagccaggaaaaaaatatgcatttgcatatttttggcatccctggtgatgaatagtggcactaaaaacgaaaattttttgaaaaagaatgtgtttttcatgcatttctcatcaacataaagctgcagaaaaaatagttaaaaaactagaaatcctcgccctacttatcatgaatcttttgcgatgtttgagttgtttcgacctttcttagattggaaatttttttgcactttttagcacttaattatttttgggtaacctcgattgttttgcagtatttattactttttacgcttatccctatttaccattctttcaaacatattttccttttatataagttgtttataatgtaagttgaaggcactctatgtaaattaaaacttttggcttccaaaaaatttttctggttgctaattattaaggatataattgatattatttttatgtatatttttaagttccaatgaatccgcttcatgatcttatggttttgttttcgaacctgaatgttttccgaatcagattagatagtcaaaataaaaatatttctatattttcgtgaaataatgcggtagtttccgtttaatgccgcccgaccatttttaaaaactaagcattagagcgcgttcaatatgcata

SEQ ID NO: 10360 - DNA, 1261 bp, Heterodera glycines
  misc_feature (10)..(10): n is a, c, g, or t
cccggaaaanatctgcaaaaaataataaaattaaaaaacgtcaaattttcgagggggcctagctcgaaaatttctgaaaatttcagaaatccgaaaagatggttggatagagctcgtcgagctctacaaaaaagccgcttacaccgacctcctcccatcaaaagccggggagttattccaccagcgctgaaatggcccaaaaaagtatgcaatttttagtcagtttttcggaaaaactggtaggccctaggggttcggtgaagaaccaaaaaatgtgcaaaacattccaacttaaaatcctatgggagcggatttttcatttaggcctttaaaaaatttttgaatcccaaaaactgcaaaaactgcttcgaaaaaagtgacttttcggcgcctggcgctcagttggccctcggatcggaaaatctatagttttcctgaatgcgccgtcaaaagttacccccaaggtcgaaatttcgaacccctcccggccttcggccgggagattttgtttttggaaatgaaactcactgttgttctaaagtatataaactagcgtgtggcgcagtagttgcttggtgtagacagtatgctttgcacagtattcgctcggtgtagacagtatgctttgcacagtaattgctcggtgtagacagtatgctttgcacagtgattgctcggtgtaggcagtattcttgtgagagatgaaaagaatatgcagtacatgagcgcttcgctacaaaggacttcgttgctagtgcatgcgattttgttcagtgatgagcaagtgcattcggccgcgtcgcggcctcagacggcgccttgcgtccgtttcttaattttgcgggggacattcggccgcttcgcggcctaaggacgggcgctttgcgcccgttttttaattttgcgggggacattcggccgattcgcggcctcaggacgggcgttcgcgcccgttttttaattttttgggggtcatttggccgcttcgcggcctcaggacgggcgcttcgcgcccgttttttaatttttcggggggtcggccgcttcgcggcctcaggacgggcgttagcgcccgttttgtaatttcttgggggggggggcatttggccgcttcgcggcctcaggaggggcgcttggcgcccatttttaaactttgttgggaattttcggcagcttcgtagccttaggacgggcgcttcgcgcccgtttttgaattttgtggtaatcattcggccgtttcgcggcctcagaacgagcgctt

SEQ ID NO: 10361 - DNA, 1513 bp, Heterodera glycines
  misc_feature (28)..(28): n is a, c, g, or t
tttgaaatttttacatcatgtagtacancattcgatagagcttaaatagctctacaattttgctctaaggcactttttgactaaaaccaactcctgaccagttatgggcccgggactcaaatgtcccgctgaggccaaaaaatttttctatttccgggaaaaatcgaaatttttccgaaaaaattaccaatcgatagagctcgaaaaactatgttttggaagtggtctccgtttttctgggaaaattcgttaaaaaatcctaaaattcaaaaacccgaaaaccgttttttaggcctagctcgaaaaattttgaaaattttcgaaattttaaaatctggaaaaatcgagctcaccgagctctacaataagtctgctggccaccctgcgctcaggtcaaagcctaatgagttattcaacggggactgaactggaaaaagttggtactgaaaagttgccaatttctgcagcccttccaagtataggtagaggcctggaattttttttgaaaattagaaaacacttcaacttagtttcctaccagcaagcattttttgatcagagttttagaaaaaaagttatgggccatcaaacgcaagcaaaagtgagaaattggccgccaggactcagttggccaccggagcggaaaacccttatttttcccagatgcgcctcaaaaagttgtaagacccttccactactttcggggcgctcccggccttcggccgggagattttgttttttgaaacgaactgcaacgtttctctatagtagtataaactagcgtgtggcggcgcagtaattgctcggtgtagaccgtatgctttgcacagtgattgcacggtgtagacagtgtacttgaaaagcattgggttgtgtgttgagattagcgcttcgcgcaaaaggacttcgttgctagtgcttgcgcggcttctttgtctaattgattcggtaaggcctaatgcgttcattcggccgcttcgcggcctcattttattattcttaattaattaaatttaactaatttattttcattaaaacattaaagtattatgtttgcacattaattgctcggtgtagacagtatacttgtgagagatgaaaagaatatgcattacatgagcgcttcgcgcaaaggacttcgttgctagtgcatgcgcgtttgataagtgatgagcaagtgcattcggccgcttctcgctctcaagacgctatcttttccctaccagatattgtgaatccacttttgatctattgatgaaaagatgactattgtactagtcgcgtgtttgactccgcaggaataatagttcttgactaaaaatggctatctctgaaagtcactattaaatccctaccgggaattggacatcaacttttgtcttttgttgtagcgctgaataaagcactaatagtgtgtttgaaaacgcacgaaaaatagttattgacaaaaaatagctatctctgaaagtcactattaaatccctaccgggaattggacatcaacttttgtctt

SEQ ID NO: 10362 - DNA, 1432 bp, Heterodera glycines
aaaaaaaaaattttcaataaaaaaattttccccgcattttttttgggttttttttttttatcttttaaaagaagggggagagtgggggcccctttttggggggggggttttgggattttttttaaaatttaggggtgaaattttcaaaggggccaaaaaattttttttttttttcaaaatttttttttccccccctccaaaaaaatccaaaaacgccaaattaaaagggcatttttggttttcacccccttcaaacttccccagaaaaagtttttttttggcaattttaggagcaaaattatttttcataaaatgcaaatccatgggggtcccccctttgggttttgcattttaaaatttatttttattttataactttttttatattaaagataaaaatatgggataaagcacattagatagagcttaaaattctctacaaaaaagctcaaagacaatttttcgctaaaatcaacccctgacgagttatgagcccgggactgaaatgtcccgctcaagccaaaaaaaatttctatttccggaaaattttgaaattttttcaaaaatgccaccaatcgatagagctcaaaaaacggttgcttgaaagtggtctccgttttcctgggaaaaatctgcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcctgaaaaacggaaaatgccgaaattgggtgccaaattttgccattttctgcagcattggcatttacagatagccccgccaaataagcgccaagttttcccaaacattccaacttgatttcctacctccaagcattttccgctcccgcttcttcccgcaaagttacaggccaccaaagacggacaaaaaaaatttcacgccgtttcagcgccgccggcgctcaactggccaccggagcggaaaacccatatttttcccagatgcgcctcaaaaagttgtaagacccttccaccactttcagacccctcccgacagccgttcgactcaaattagtttttaagacgagttgcaacttttctctatatatgtataaactagcgtgtggcgcagtagttgctcggtgtagacagtatgcttttggtatatatgggcgggcgctgacatgagcgcttcgcgcaaaggacttcgttgctagtgcatgcgcggttttgaaatgaatttatggatgtgataagggattttggtctacaggcatcgcgaggacgcattcataattttgtggaggactttcggccgcttcgcggcctcaaagggtgctccgcgccggtttttaaacgttgtggggaacattcggc

SEQ ID NO: 10363 - DNA, 6528 bp, Heterodera glycines
tttgtgtgtgtgagctcctctcgcctggaattgctggttgatggactgcgtgttcacgtcaatgccgctcagccagcagccgtagcccgggtgggagtggtaccagccgaccacctgtgccaaatttgaacaaatttaaaaagccattttcgaaaatttctcacacagcccctccaaagcatgatttgtatgagtccgcaataattggaacaagacgggacaaaacgctaatatttcacacgaattaaaaaaacacaccttttccaaacggccaaccgcctcgcaactttcgctgaagttggtcataaattcgtaggcctgggcctgcgcgttcacccgcgtttcggtgcctaaatttcaaaaaaaaaatatggactagttcaaatgtgcgctgatttcaaaattggcacggcttagtgaccaacgatcccaacgacacctgggattatgtaagaacaattggggaaaaagtaaattacacttcgttcagtgaccaaaaaaaacacccgacaaaatgttgaaaaaaatcctttaaaattcgaaaattttcgagaaaggagttataagctcaactatagccaaattcaatttcccatcccccaaaaacaaaccttcgaccggcagcgcaaaagcgtccagcacaataattgtgttggcgtccacccggccctgcatcaaacccataatttcgatgttccccccgctgcgcgcgtgcatcaccattttgacaagggccaaggccgaaattttgacttcctgaagacagcgggaagccattttaatgaaatgagcgtgaaatgcttgagaaattaagttatttggacccctctaaattaaaaagattttcataaaaagccgttgactggcccctttttggcaaagattttgttttaaaaagtcctctaaacaattttttgcatagttttgggctcgcttgtcataaaacaaacatgcattttaactaattttggtcccaaaatcgaacgttttaaatcaaaatcaaaaaacgtcgccgaaattttttttttagcaattttagtggtatttccaacttctaataagatttttaccatgtaacaaatgacaaataaaataaaaaaaagatttgaagtgttcattttaaacatggacgagtaaaatgggttcatttaaacttattaaagaccaaagagggacccttaacgaagccgacactcatttcagaccaatccctaccccgaagaaaatgggaaatttttagttttttgttcgaattgtttaagaccttgaaatagtgcggatcctgctcccatggcttcacattgcgtatcatccgctgctcctcctggtcatacttgaacatggagtcggccatttttgaaatggggaaaaattggaaaaaacctaaaaatcagtaatgccaaaaattgaattacttatccattttcaatgaccatacatacatacatacatacatagtatcttcgccattattggaaaacatttgatacgttcgatgcagaatttttttctctatcgacatgcaaaatttggtgtaaattgtatgagtagaaaaaaagttatatgtggcaaagtaaattcggtttttctctattaacagagataaagaaatagtacgccaaaaagagagatgtttttttctctgcactctctttggttcatgtctcgttttttgaaacggtgtgttaatgatgtcaacagaaagttactaatataaaaaatttttacaaaaaagcctaagcctaggtttaagccaaaagcttaggcctagtctaagccattgttcgagttgcctgtgtatgagttattatactttatgtttaacaacgaagttttagttaaaaaattactgaataccggacaaaaaaataggtttcatcatagttattaggacggctaaaatatgtaccatagaccagggatagcacttaattctggtttccgaaaaattttgagcctcggaatgacatccctgccatggacacaaatgccatgggacgcgtaaactgtttttgggacgcgtaaaatgccatgggacgcgtaaactgttgttgggacgcgtaaaatgccatggaacgcgtaaaaccgactagaaccaaaaattattcccagggagggggtccgggtcgatgattacgagtctgacattatttcaatcaattttgaattattttacacaatttttggtattttttcaaatgttaaaagccattttggccgtttttaagatatactttagtgcatacggtatttgggcattttttggatttaggacatatttgagggatttttagtgcgttttaagcgccgtgtttcgacttttgcaccgcacagcaaaatcgacatatgagccgcgaaatttgcgcctcgacacttgcgctgactagcaaaaatgaacatttacgccgttcgtcaaaaatatatattttttaaattgttgccaattttcaaaaagatttaaaaaagtagtcaaaaatgcaggggttttcggggtcgctgctgctgatcacgaatatgacatcaatttctatcaattctgaatcactgactcgaattcgaaaaaaaaagtcgaaattttaatattttaaaaaatacatcaatatttatggtgctgttagttttcgacagtgttggtttcgacagtgttgttttcgacagtgattgatttcgacagtagaattttgtttttaaaagtatgtatgtatatggttatagtatcgccacatatcttcttctgctaccatttttcggcaaaatggacttaagcgctgtgttccattcaaatgcgtgttccaaaccgaatgtcatccctttaaattcacagaaatcccggaaaaatttttttaaacctttaatgaattgttgcttctgctgagattttttgcaactcggtctaccatattccacaaattaattgcaaaaagggcagcctgttgtctcaaattgagcacttaaatttgacccctaatccatgcatctggtgcccctcccgcatcacgtacaagaacttcttcgttttcaacaatttgccttgggccaatccatgtcctcacaaaataaatgacaaattcttaattttagaattacttcatttttttataagactagaccctgcaattcatggtttggctcaagcgttgccatcaatatgcaaaagtaattgtagacatttccaaccggaacaaatgctaacgcctgcagcgagcgaagagttattcggacattctcaacattattaaactatccaaataaattgggaaaagtctgaattcggcgaaaaattgcttggccgaagtggaacaagcagccgctttgttccgactccgggaacacttggcgtgctgctgaaattgatccggcttcaaagtcgctcttaatccttgccgggtcaaaaccacgtggactcgtctaaatcgacatttatctgacagccgacttttctaacaacttcaaacgttccatcaactgccacttcgtctctgtaggcccggagggtgttaatcccaaattgtgaacagaaaataatcattcggcttccttggagattttggttgtagatgactcgatcaaccaactgatcgggaatgacaatatcacgggttggaacagcatccaacccagcgtcgccttcctcaaataaacaataaaaataatttttttctatattttatttttttgaccgccatttgttgttttcggcggtgataattatatgtccatctcatgcaagaagggcctggtgcagacgcaactcgaactttaagaggcaaattcgaacggacgtcattgacaatatttcgccttgaagttgggtattcgctccttgcttcttggcgaagcctttcagctgatactcgaatctgtccaactttgtcttatacccttagaagcaatttatttgtaccaattcagcaccaaatgtagccggatggttgtgttcttttgtaaccctgcccaatttatactgtactccatcagcttcttgatgccattcgatttggacgcacgcacgaccaggacaataaggagaacggcaagggcaccgccaatattcccacccatctttgaccttagataaagccttaaaaccactgatcagatttttgacattagtttgttggacctcaaatgcatactcaaacccggcatttgttagcaggattttcccacgcgatgatttagccgcattaaaacgcaataaagccattatttgactaagaaaaaattgagtaaaaatggaactatggattgaggagaatgataatatggacgaagaatgaccacaggtcattcatattataactttactcgaaaatcttatctaggaaattgtttgtcgagaacagcacagcagcaggagatgtttgcgcagaaaaagttaacgcgataagaatattttatatttttacaaaaaataaccatacaactttagttgtgtttaatattatttatttatttatttaaattaaatttcttataaattttttatgtatatgaaaataatatttaaaattaattcatatgtgcatatacataaaaaaataattttaaaaaaataatttaaaaattttatactgtcgaaatcaatcactgtcgaaaacacctggtacgatatttattaccagtaaataattaggtaggaacatttgatcgaattccgaaaatctatggttttcaaatcaatgataagaccaaggaattttgcaaagtgatcgtattcatgatcagaaacgcaaaaaccccggattagtcttttcataacagaaaaaaaatttttatggggtcaaactattctcggtgggggtcgactgggcgccgccaactgggcgacgccgactgggcgacgccaactgggcgccagatcaactgggcgccgccgactgggcgccaatcaactgggcgccagtccccgtttccctccctactagagaagggattccgagaccacaaaaatttttgaaaattggagttccgaagcccaaaattttttcgaaacggaattacgtgctatccctaccccctaccatatatgtgataaatagggattttttaggcaaatgcataaaattttgcgtaatagttatgattgtaggcccccttttaagaaattttttttgttgttccaaaagttttctgggtcgctgacaatgaatcctgtatccatttcgaaccctcggacccaaattctaacaatttttgttcgaatttgggtccgggttcgtaatttgtcgaaatggatgtcggattcgtgataagcgacccaaaaccccttgaaatcatgctttcatgacttttaaaaataaaaacaaaaaaaaatttctttgaaaatacacccttcagaattgaaaataaaaattctcaaaaattttattgcctcttcgaaaatttgtgtctatttaaacctattttgcgatttttgtgcctaaagaaagggaatttgaaagtgggtcttggcgcccagtcggcggcgcccagttgagctggcgcccagttggcgtcgcccagttggcgtcgcccagtcggcggcgcccagtcgacccggtccgcaagattctccagtattaccgttgtgatgatgcatcgactattgtatgtatagcagcgctctttttttaaaatataagcaaaaatcaaaaacacaacacttaaatagcaaagtccgatataataaaggtcacataatcgcatcaatcacccaaattcatttctgctgatcaccactcggcccagcggaagcaggcagcatcgagaagacttcaaaaacaaaatttaaacaagaaatttgctgagatttttaaaatttttcacccattgtcgactccactgtctccgatgaaaagcactaattgtttgtttccatcagttaattcattcatgaccgcattttgccatttttcatcatcgtctgctgcaacacaacggagtcaatcggagaggacggacgaaagttgacgaaaatgccaaaagcaacagaagaagaagcgatggaaaatgcctaaaaagaagacaaaaaaaatgaaagaaaacatgtcggaaaaatcactattcaccgttttgatttgctcgactgtttccaaccattgttgctccactgttgaattgtcaattcggacaaagagctgtttcatcaaattgtcgtgacaaggcgtgaacagccattttgccaacgcttggcaatccgacgcattggcactgtcgtcgagcggaaattcggggcaaatgccgtcatagaaattgacgacacgaagggattgacaatcgttgaacaatttggttctccaatgtccatttgcgcgttttgaaatgttcgtccacgcggcggtcaaatcggcgactgatcatcgcaattccgaggccaagttgagagcgtggaagcaaaccgaacacttcaagccaacaatcggcagaaatgaagctgaaaaagcaaaatgattggcattgaaattgaaatttagaatattacatcgctttttccatttctctctccgcttcattaggattgtgggacatttttagaattaataatca

SEQ ID NO: 10364 - DNA, 2097 bp, Heterodera glycines
  misc_feature (30)..(30): n is a, c, g, or t
actttatgagtccaatcaattgacaatccncgggtttttatacaataactttttccatgttcgaacaaaccctatctttttggtatcattcgaaagtacaaagtctaacgaagctaaaatatataaaatcgcagcgttcaggcaattaccaaaaaaatttgattaattaagtaaatacttaatattttcgtttgtaactttcttgaaatgttagatttttcttgttttctcgtattattacattacttagactttgtactttcgaatgataccaaaaaagatagggtttgttcgagcatgaacaaagttattgtataaaaatcattgattggtggactcataaagtgcactagagcccaatttcttgctatttttttaaattattaatcattaacctttgtgtatgagtttcattgtgccattttcgtaaccgatctcctcacaaattcgctctctcaattccaccaaatttgttggcatttgctgccacagttcgtttggcttcgccgccgcttcacaattgtttagtgagcaaaaaagacctcctgacaattaattcaggaaaattattgtgacataaattaatgataattattgcaaaccttataaaccaacgcgttggcaaacacggcgccccgcgccacaaacgcattggtaaagttgcgcttgtttatgcgcttaaatttttttccaaaaattatggttattacctgaaaatataaataaattaaacatattttataatatgatataaacattcaaatctgcaaaatttattaatcatagtatcgacacaattaatttatttttaatggctaccgatttttctctatttctttaacaaaattcttttctttttttctctttctctcgcacactctctctcactattctctctctctctttctcgctcctctctcactttcctatttttctatcgcacactctctcctccctcactattttctctctttatctaactaatgtatatgatctaattatcccccccccgtggggttgggggggggggggattattttttaagctcctcagagactgagggattaatggagattggtgggataattagagcaaatacagaattttctctttctcaaccccatccaataggtttgggtttgtggaaggggatgtcagagaaaaaaatctccaatcaaattatcgggcgaaaatcaatcgataatttgattgggaatattatctactcacatctccaaattcaaatttttctcccatttttccttttctcaattttaccctccttttgctgctgcttgtgtgaaagcatctccataatttattgaattggtcaaaaatgacatttttgtttgataaaacaagcttatattttatctttttataagaatataattctgttgaataaataataaaaaataaaagagagaaataaaaataaatgattattccttcattttcttacatttttttaaactaattttcggcaaaatgatgactctaaaaccaaaggagcaaaaaaaagaagttcccaacatcctcatttatgaacaattatttttttcttttattgccggaggatagtcaaaaaatggagaaggacaaatccgtcagtaaataatccgtaaggaaatttatttttaaaacacccagatttatttaaaatcacttggaaatttaatttaatcgctcaaaaagtaaattaatattttgggttattttataaatattatgaaataagcattttaaaagaagtaaatgataatttcattcaccagatggtcaattaattgaagtataaagtaactagaaagattaagaatttatgaaaatataacaataattttcgcaagatttttgattttgctcaaaaaaattgcagacggattatccactgaaagattgtcaaaaaaagcaaacgatttgaacgaccgaattgaaaaaatggtcagaagaaaagtttaaattttcgaatttcaaatagacctagcgctatcgattggtatatatttcgaccattttcggctctgggccatatgatcaatatttacccatttgaattatggtttcgaccttcccccctcaccgtccccggggacg

SEQ ID NO: 10365 - DNA, 1449 bp, Heterodera glycines
aaacgacccagtttccccatccccgtccacgaggctcaaaggctccctgaaaatgctacaccggcggaaaatccgacaccaaacatagatttttaaaaatataaattttgatttttttttgaattcagagtccggaaaatgattgtataactttactgatttgtactttaataaaattattttactaaaatttttgatgaacttcccaaaatttgacattttttgtcaaaaaaaaatttgttcgtaagatttcgtcttattctcaccaataccacaatatcaaatttcaaaagaacaacagcgggggataggcgcttcccccgctaggcagtacggttgaattgtcgatgaatatttttttaatttttgtgatttttagcacctcttgcgattttttaaaaatctgtttttgtagctttttggcactagaatttttgacaaaattgccaaaatatttaagaatttttctgtctgctcctttcggccaaatcaaaaattctcgtcacaaaataaataaataaatttggagatgaatttttgagaaatttttcatttcttaggggtgcatttttgaaaatttcgggtcgattatttttcgatcgggtccctgctctaatataacttttaattcagattaaaatccttttactccaacatggacattttttagatttctatataacctgcattatttggattttccattttatttactgtttattgaaagcatttgaccttattgaccgttcactacgagagtaaactaataattatttcatttatttactcatttaatctttgtcattttttatctcggaactcagactttcgcataaataataaactgacaaaatatttttaatcaaattaaattattaaatgtgaaagtcaaatattaggaaaagagttcaggcattttgattggctagatataaatcaaaaatattataaataaagaaaattactattcctggtacataaaaaattatcattattttttcaaatgcttttccatttgggcattttcacttttactcaagcattttgtcatgaattcggacgccaatgattgccagggttgctaaaaacaaaacatttaacgagaataaaaaaaaacaaccaaatgccacgacaatgaacgacttcgggttaatgcagacggtgccactatgggaatcatcaacgttgatcggcacaaaaatttctaaacaattacaaatatagattctgatgatttttttggattcatatatcatagaccgatggaatcgattgctacatattagattccttcggtttttagactttagacggttcagtccaaagccatttgagtgccgggtcttaacgggaatcgtttccgccaaaatcctttccgaatgatatatgtgattcaatttaaaacagaaaattcttaattttctgtaatttttcacaaccatttttatt

SEQ ID NO: 10366 - DNA, 1526 bp, Heterodera glycines
cttttctaactttttatgaaattcaaaaaattgactaattgaaaggttgaaacaaagttttgattatttttttaatatatatgtagataatatttaaaaaattatattatttgtttacttgcatgacgtggtccaccacccatttctcgtgctcaaacactttgatttccggcaaccaaatgttgagcttaacgaggagaaaagaaaatgaaaatgttgttaagaaaatatacgaaatgaaaaacaaaaaagcaccgttttgttcttgcctccttcgctgcaggtgtggttcacttccagcaccacgcggtaactgtatctaaacaggaaataagccagtcaaacactcactcatccatttacataataattactttttaataaaattttaaataaaattttgaataattttatttatttttttacttgagcatttccatgtcatatacgggggccggtgtggttgcgttctcttttggctcggattcggtggttttcttctcagcacagagactaaaaaaacgaatttttggcaaataaaaattttttttgttcagcagttttttctttttccaattgaaattttttgtgttatttatgtgacaaaaatcaatttttacaataatagtgcgtgctttactgcacataattaccgtaccgttccatcagcgtaataccgtaagcaaagctgtcagccgtcactcccaccagtgctttgctaaaaaacaaagaaaacaaatatttatttatttatttgtttattttttacgtcggccgtttaacaaatgctgcacacgtctctttcaacagtccctgaaaaaattataaaaatagataaataaatgttttgtttttgagtacctgtggcatgtattggcgaagtgacagcgatgcagtcattttagcgtttttgcaaacgacgcaaccctcaaaaagcagcaacaccatgtctgagagggaaatgtttaaaattaaattgaaaatttagttaaaatttattcgattgaatttgggtgccaaagtcagtctttaaaattgttaccaagcccaagccagaaaaatttttttttgggggggggaacctgaagaccttttttgctcttcgggcaaaaaatttttccattaaaaattcagaacccgagagcaaaaaaaaaaaatagggacttgtagccgtttttgcgtcaaaaactgtcaaattttggcaattttggggctaaaattccaaaaaactaaagtaaattggtgggtccggcggtgccgataggcgccgccgggaaaattttagacaatttgagtgcactttgttacaaaaacgcctataaaattcaaaaatgtcctaagcatttttggaaaattaaaaatttcaccaattgaaaacagaatttaataaattaatttttagcttctcttccaatgcttgcaaatttatgatgttcaatggctttttcaatgccaacaattcaccgtgcatgaagcccgtattgtcgaactgggtctggtttcttgaagttttcctccgcccttct

SEQ ID NO: 10367 - DNA, 2575 bp, Heterodera glycines
cccccccccccccccttagatacgggcctgatgtacccaaacatttttgttcaaaaactatttttcatttttttttgccaaaatgaaaacacacgcagcagaagcggagaacacccaaacttcagcaaggacagtgaaaataattgtctcatttcaaaaaaaaaaatttcccgagtttaatttttattttattatttatttaaaataaaatttgtttttgcccacccctgctggagtacacgctgctgtctttccgttaaatttggcatcggagacattttttcgcccttcgatttgtgtaacatatctcgttgcgttggccgatgaattcgacgggtccacctcttcaaattgttttaatttattttattgttttaatattaaatttggggggggagaagaaagtcaaacatttcttggacaaagttggacagtacacaaaagttgcgattgtgtacacaaggacaaaaaaaaatggtcaaagatttgcatgtttttggggcaaaatatgctaaaaaaatgccaattaaaaaatatatagggccttcaagctgctgaaaatttacagaaaaacatttaaaaatgaaaaatttcgagaacccaaaattcgcataaaaatagcacatttatttgaaacgggtaaaaattgctatttgctttttccatatgtaagcatagaaaatttaaaattttttgcccggttcactcaaaaccacaacaaaaaataaataatttacagacaaaaaaagaggcaaatatgccctgaacatgcaaaggtcaaaatgattgaatgcgaacccgggacgaacaatgaatgttttatgcatttacctggcagtgtcaggtcaaatttatccggaatcggcaggtcttttttcggttcaccggtcggttcgggtatcggttcaccggttgcaactcccggttgaccgcttggtgcaactcccggttgaccgcttggtgcaactcccggttgaccgcttggtgcgactggtacgtctggttttattgtttcagttccagttccattgacactcgctggtcccgggactgcaaattaacacaatgattaaaccagtgattgtgtgtgctatcaaaaacaaagggccaagctgctggtgggccgttcattcaccaccaccatcactcatcactcataaattccccaatttcaaattgagtttttttcgtatattttacatgaaggatcatttgaagcagcctcaaaaattttgtgcttccgtaaaagggcatattgaacggggcaagggggaggagaggtgcagttttgaattcatccaattacctgtctcattgcctccaccgcctcctccagcagtctttcctccaccgcctcctccagcagtctttcctccaccgcctcctccagcagtctttcctccaccgcctcctccagcagtctttcctccaccgcctcctccagcagtcttttctccaccgcctcctccagcagtcttttctccaccgcctcctccagcagtcttttctccaccgcctcctccagcaggatttcctccttggcgcttctgccgtgagttgggctctccttaataaaaaaaaattgaattatgtcctccacatatttatgtacagttcatattggcattgctcacctttcgccagtgcatccgttttgtgcttcaacagtggcggttctgggccttccggtgccgattcttcaacatcgtttggctccggcttctcctgtccttcctcatccgtttcctggctttcagtgagctggtcctcgtccggatttggtccatcctcttccacttcctggctttcctttggcttcttcggatttggtccatcctcttccacttcctggctttcctttggcttcttcggatttggttcatcctcttccacttcctggctttcctttggcttcttcggatttggtccatcctcttccacttcctggctttcctttggcttcttcggatttggttcatcctcttccacttcctggctttcctttggcttcttcggatttggtccatcctcttccactttctggctttccgttggcttttccgggttatttccttccgtgtctgttccctggcttttgtccggttttgctttgtccgagtccaaaattcctggatcaaattattaaattaattttttttttgttatattcatttttatttacctggcttttcgttgttcggttccggtttcgatgcgtcagcgtcggcggcgcgctgttgtcgaacaacagcgctgtccagcgcgctgatcagcgcgatcaacagactgaaagtggacagagagttaatatttggccatggttcaagccccacccctccctccaattaacttacacaagtgcagaccacttgttcatgttagacggtcgagagtgggacgggttgctttgaagaatgggattcgggatcagaaatagaggaaaaaatcacttcctaaaaaacaatgaaatcaaaatattggcttttaaaccaaaaatttttttgatttctaaatttaagtgaaatacaaaaaataaagcggttttcgaaaaaaattatttaaaattttttaatcg

SEQ ID NO: 10368 - DNA, 3100 bp, Heterodera glycines
tgatagaaatatagtcattttattattcgaaaatttttgagttaattgctttatttaattgagctgtaattttgaattcaaacaatttaaaaatggcattaatttttgtgtgtagcaaattttaaacgctctctatcttgtacatagtattttgtttttttcaaaaagaaaaaaaaaaaatttccaccccgctataaattttttctgacatttaaccctgtttttcaatgtgtttcatcggtaatagtggagaatgtgggctccaccaaaaaaaaaaaatttttttttttggttgagcacagattctccattaaatatgagttttcaagagcgtccttgaaaaaaacgggcacgaatgctggttttcaaaaacatgccggcttttgggtgaaaatatttttgcttttttccactttattacccccgttgtttgtagtggtagtgccaatgccaatttcttcctccacgtcgccctcccaaattggctcgttgtgcagcgacatccttggcattgtgccaaaccgttttgccatattattttttggttgcaatgaacaaaaacgggcaaattgggaaacaacaatttgttgttggcattgttgttgttgcgattcgacagcaacagcattatcattggcatttgcagcagcaacaacaacaacagttgaagaagagttaggggcacgcaatgagccctaaattgtcaaagtttgttaagtttttaaatgggttgcattttatcagaatttcttaaaatttgattttttttttgaaatttcataaaattctaaacttgttcgttttaaatatattatgaattattatgaataattttgttttttaaaaatcactttcttagtgcccaaaaaaaaaactttggaaagcatttcagacaaaatcttcaaggaaattttttttggatagattgcatttttgggattccacaattctctcaaaaattttagtcaaattttatttttttacaaaaatataaaacattaaaaaacaaaaaaacaccttaccgatcgttcaaataagctcgggttgccgcttggccgtggtgtcgaagcattcaacactgatgttaccgtaggcattgttggtattgacggcatactgtgcctgcggatttgaaggaattacatttcgccaatttgcccgcaaattcaaaaaatgattgcactaactgtacctgttagacactgtcaccgaattatttgtttgctgcacttttccatccaccaaaattgccttctgtggatcggatcggcgttcactgatcgacaattggcgaaacgacccgtaggcttgattggttctgtaaatacgagaaatttaatagtgagatattaaaggctctaattttttgagtttaactaaaaaaaattaaaattaaaaaaaaaattcctagggggttggaaaaatttcttgaaaaattattaatgaagcgccaatttgtcgtggattttcgcaaaaatttcgcgcatctttttcggaaattttttgttaggtataataagtattgaagggggtaacaacaaggaaaatggaaattttcagtaaaaaaccacaattttttccttggagtcttcttaacctgtctcatttcgattttatttataacttttcgaaaatttttatattccaatttataaattttttaaatttcccgcctcgcaaattctcctccacctccgccacaattgtcctcaatgcccgagtccaattccacagtatgcgcaagcgcttgtgcagtacggtatgccgccgtttctgcgtcccgtttccgcttcttctcaagacagacagtgaacgcgcagccaaccgcatggcttaagcgttcgccctatggcggaatgaattaataataaaacaattaatgaaaaatattatttattattttatggctaatatagctgaatttaacatcataaaattgcaatatatttagaagaaattatttaattacttagtataaaaaatatatttcattaaaaattgtaaaacattctcatttctttattgcttttttatgaaataataatttttttcaatataaactatagtacctacagaatcttttgtggcatggaagccgtggcacatccaacggcgcgtggcgccgtcccggcaaatgtatgaaaagcccttctcattgcttcgatccggcgcacaaaatgatactttttcgattgtctgcaaaacttttaaaatttaaatataaaatattcttagattttttaattgtcggtgcctgcctgatcaacgatcagtcctcggttgtgttcttgatcaaccacacggatgccgtccccggaaatgtacaacaatgccttggtcacccgctttcgggccttaagattttgcataattaggcactgattgttgttgtcatgtataggtgtgacaaggacgtccttgaaaatccgaagtgtccttgattttcgaaaatttgtcagttttttaactttattccataaacttcaaattttaggcgcaaaaaatgcctgtcaaagattggaattttgaccatgttaaattgaaaatagtttatattttaaataattaaaaaactgaattaaaatagacccaaaagaaataagcaatttacgaagaagacaaataaataataaaatatttgaattaaattattttaaatggttattgaaaagagaaaaaaattttgtttttttgatatttcaattatttattttaaatttgccaattttggaaaaaatttaattatgctctaaccctgaggtgttgaagcgcactttcgcacacggacatgccacgcgattcaaacacttcacaagcgccgagatactgtaaatatcgtatacttttaaaaattgtataaaattgtttaaaatcaatttaaaaaagccaaaaccattggaatttaactaacaattcgagattttagagtataatccaataaaaatgaataatgaaaaattctcaaaaatccacaacactttgccaacccaaacaaagtaagcgggccaaacaatttatttaattaaaaaaaaatgccgacaaaggcaacagaatgaaaaaaaaaattgcatttttagggcatttgtaattatcgattttg

SEQ ID NO: 10369 - DNA, 1363 bp, Heterodera glycines
gcaataattttttgcgccagcgccggcagacggcccttcgctggccgactgagtaccaccggcgccggcgccatcatttgctgtggccgatgattgagtcaatgccttaggcgagggaggatagcaatttttgaaataaaattgccgaaaattttaaatttcagtttaaaattattgaaagaactaagccaatggaagaaattgagggctcgaatctatggaaaataaatttttaaactgcatatggagacaaaattttggcaaattttttataattttggaaaataaaaaataattttaaagagatgggtaataggggaggcaggaagagctggaaatagtaagttcgggaaatttaagggtaaagaattgggatttttcccacaaaattcgccactttggggcttttttgactaaaaattgttattacaaattttgtttttttctccattttttctgcttttaaagtatgtaaatttatgagggaatatgaaaacgcataaaattttttaattttcgtttttccattcgtttttttattaatttttttttagaaattcaatttatcgaaagattttaaaaatagttatgattttttaaaaatcgttggtccctttcgcgaagcaacttttccattaacttccagctataaaactgtgttaaaattcattttttccataaccgatgataatccatctatatcagacaattaaggaataattaatcaatccatgataattagcctagccagctaattaggtgtcaagctgggtggttaattgaacctgtaattgatgacacccgcttgagccgcctttacgaaatgaacgccgaatggagcgccgaattcggtccatgccacggtttaaaaaatgcctaaaatttgttgcgtaaaattaaatttagtcagattaatttttaaacattaattggaaggatatagattattttaaatattttaattcgaaaatttgcaaatttaaaataaatttaaaatggaataagtattttaaataaatttgaaattggataaattattctaatggcatagagaataaatttttttaaattaaatcagagcaatcgaaagtgtactggatttttcgaagcctataataaaacttgaaaaaaaatgcacaaaaattattattttaaaaataatttaattaaatttttttttttcaatttttacggtttaatcaattaaattgggagcattttattgtgtttaagaaatggcttttacgctttgactttggcttgccaacatcgattactcatctatgcacatccccaagggtatatgtattttctgccgctttgggggggcaaatggcgtcgcatttttttgccttttcttttg

SEQ ID NO: 10370 - DNA, 6237 bp, Heterodera glycines
  misc_feature (5942)..(5942): n is a, c, g, or t
  misc_feature (6175)..(6175): n is a, c, g, or t
  misc_feature (6188)..(6196): n is a, c, g, or t
  misc_feature (6200)..(6201): n is a, c, g, or t
tgtgcgtgtgcattttggtcgtcctacctttcatggacatccgtcgggtgggccaacgctcggcacaacaacaaggggaggaagaagaagcaagggaaaacggagaagcggggggagaacagcagaagcagcggacgaggcagaattgctctcgagtttggtgggtgaactgctcggactcctccgagtcatgatcagtcagtccaatgcgtcgtaaatttttccaaaaaactaaatcaacctaattgaaaacatgagatggacatcgacgacatggcccactccccccccccccctcccatcctccgccctttcaaaagctcagaaaagtacacgggaatgcaatgtgaatttggttttagatttgccgcgcccggctccgacccttcaaaccttggcacaaattggtgaggagaagccgcccaacccgaacatcattacatcatttatgcagtcaacatcattttcatggttttattttgtcctaatttagttaaaaatttacaaacatcggcacttttgtcaattatttggttaccccacatttgcgcccggacattagtgcctcggacatttgcgcctatgtccaaaatcgggttaaaactttattttttcaatcccggatggcttaaacagtttcaaataaaaaatagaaagtaattgtatgcgattacttgattcagaaaatttttgaaaaattatagaattatttttctaataaaccaaaagaactagttttgttaaatttaatgctgtttaagacgtctaagattgaaaaaacttaagtttgaacccacaaatgtccgaggcgtaaatgtctggacccggattatttgcaccaaaaaatgaccaaattaaaaaaagagcgactacaaatcacaaattggctactttgtttgttctgtggcccctcatttttatagtcaaacaaacaagccgtgagtaacaaaattttggctttagtgcactttaggcgtctccatccattagtttctttggcccaaacttttttatgacttgatcaaggcctacattcatggtaatccttcggaattggtgtccgacgggaaaaagataaaaattttctttgaacttttattagagtaaaattaatctctgcagttttttttgtgtttttataaattccaagtctttaagccttcgtttgataccaagaatgtatttagtgacaaagcaacaaaaaacttagaggccaaagaaattgaggttgaacacttttttaatttgaaaaatgaagcgccacaaaacaggaaagtacttgaaattgtattcatttcaaccaattccctaactatttgttgtttgtcacaatataagccatgagtcaatttctcaaaaaattaccactaaaaatataaacttttgagtaaaataaggtatcaaattactttaaactcgctgatgcataaattggatttttttatgaaatttatatttttggttgtcggcacattggtgctgggcattggcgcctggttgcgcatcatgaagagcagtttctgccgactttctcagtgagcgctaccgttaggcggtccacgaggcgttttgggtaagcaaattttttttggatttttttttctaatagaggcctaaaaatggtcaaacaaattatactggactttaaaaaaaaatttttttttttttgcccgcttataaattccaattgaaaataatgtttctttttacttttacatgaaaaacattttctgattggtgaaaacgaactgaattgctgcagcaaaagatgaatcctgtttaatttgattataggcaccaacttgaatttttagaaattcgttttttttttaatttttgagtttcgatttggggttcggaattgaactgattttaatgccgtgttcatgattaaaaatccatgagaaccaaaaaaaaccttggaaacttttgaaaggaaaacaaaatcaaacatttagttgaaaaattcgaccaaaatatggtactaccaattttttagttaaacttcaaattgcacagatgcataaattggattttttacgaaatttaaaataattttttttttcggttgtcggcactttgatgtaggccacgtgcgcttgactgccacgtgtggtatttgcctccgatgaccaaagaggtgggcaaaaaaattaaagaaatttttttcagcgattgatgtgtgttttttcgaaataggaatttcccccggtgggggtcgactggggccctggcgaatcggccatcgagtttggccaatcgggtgaagaaggcaatcgctgtgcggggcggactcgtcgacttggactgggacgggcagctgaagcggtacaaagtgccggcacggatggttgacgaacagcgggaaaggtggtgggtagaaaaaatttaataaaaaattttttcctcccagaaacttaaaaaaaaattcggagaaggtcgtttccatccgaaaaatttttaaaaaaatttcaaactagtattattattcaataaaaattttttgaaaaatcgctgaaaaaaatttcttcaaaaataccaagtttggaaaattttaaaaaaccatttcagtggaaaccatgcgtgggataatgaaccgggaagttttatttgaatttttttttctatgtttttcgattagattgttttcctacccccaggtactaccagaggtatcagcggtacacctccgacccgccttcctctgcctcatcggcgcccatccgcagcacaatgatggcggacggggacgaggaggagtacaaccacagccagcaggaccaccaccaccacaatcatcatcatcatcatcatttgggtgccaatgatgccatcatcaacaactgtgatgcaagcagtgccaacgacaacaacaaggagaacgatgacaatgacggaactaacaacactgattgtgaacaacaacaacaacgctcaaatgataccgctgaatttttgattgattaattgttgatgttgtgatgatgatcatttttatccttctccaccccatttttttaaaactataatagagcaaaaatatacatatattttttaggaggaattatagccatatacaatatataattatttatgttttatttacatattttttttcttactttgctcataaaaaattttattttttgtgcaattaaaatagctcattaatttcagaaaaaaaagctataacctaaattatggatcgaaaagcgtcgacctcgaagaagcgcaaacaaacggagaaggcccggagcaaacaacaggaggaatgaagggtcagacagttttttggtagtactagtaggaatgtttatatcccatttttttgcaaaaaaaaatcaaaattttttcgtttagacgtcctgaaaataagtaccaggtggttttcgcggtcgctgaccacgaatatggcaaccatttcgccaaattcgggatcacttaaccgaattcgaataaaaagtcgaaaactcgagtttttcaaaattcgcattaagatcaaaacaagctatattgaaacatacattttgttcagattatactagtaataaaacaatttcaaattttctaccttttgttcgaatttgagttaggggttcggaataagccaaaataattgccatatcatgatcagcgaactcgaaaccaccacaaaattgataaattttcttaaaaaaaatttttcccctggcgccaccggactccaaaaaaatttaattttttaagatcaattttaaaagtctttagtgaccaattattgcaatttacaggaaacttctggatcagatgacacggactacgaaggcgagctcacgataattgcaactgcgtgcgcgatggcaattttgctgatttgattgtacgcgttcggagcacactgaagaaatggaagaagccaaaaattgacaccccgcgggtaagaacatcaatttaaaagatatataaataaattatcaaatgaaatttcccaatgcaatataaaaattatcatttttcaaaaaagtgtcaaaactttttttggcgacccgatcatttcggcgttcgtttttcgccgaccgttttttgtgactcattttttgtgttcgttttttcggcgcccgtttttggcgcacgagtaaaactatagatggtgggtcacctttttggatttcgattccatgatcagaattcgaacaaaattcaaaaactcaaaatttatttttatgtttgtatctgtatatttgaccgttttgatcaacttaaaaacaaaggtaaattttgaacttcgactttttgttcgaattcgggtcagggatccgaaattagtcaaaatgaatgttggattccggttccccggccttcgataatttattgtaaattgaatcgatttaaaaatcctcaaaaatcgaccaaaatttaatcaccaaaaaatgtgaaaaatcgactaaattttcagttccgtatcctggttccggttacttattggcccataattttttgattgtgagctaatttatacgattttaattccattcgaaagcacttgattttggttaagatgtatgattaagcagaagtaagcgattagaaactcaaaaaagttcaaaaacaaaattcaccgatattttattgtaactattcaagtgttatttattaatcgctcagtttttgctgaatcatatattttgaaatataaataaaaaatgtatctctttgagaggatttgaaccatagacaaaacccattttgatggtgatcaccttacagattattgcgaaaaaattaataaaagcataaattggcgaaagaaaaataaaaatttgaaatttggtcaatgagtctaaaattacaaatgaaaaaaatttctaatttaattttaaggcatacccaaacagttccaaacccagaggcctgtgtctgatcatcaacaacacccactttgatcaaaaaattgtcatatcattgttgatttgaattattttggcgttttgttttagtttttgtgaccctttattttattttgttttgtttggggtatgtgtgatatatatgctcttcctaaatttgtaattgattgctgtgtgctgttttattaattggaagtaaaagaaagcagtgaaagagacggcgatttggttttggatttgggatacaattcccctttcccattggactattctttttcctacgacggctttttcaatgcttaatgtgtgttgtcttttgaaggcttcctttgctttacaaaacctcggcttttcccccattccttttttaatgagcgcttacttttgtatttatggcatgtcaataattaatggaggcgaaattttcgcgtgttgtttttcccccatcgctcgtgccattcgctcatttgacattgatacattttgtttcgcctttcctcatattagcattattttacagctaactaattatttttgagcaacaaaaagcagcaatttttggcacaatttcccaaaaggaccatttgctggccaatgctaatagtgtaaaaaaatgtgccaattgtctttctctttgcctgagttggcattggcattccctcgaggctccaattgggcggccaagctatataaaagaagaagcttttttggacgaccgactcatttatttgtttcttctctcatcgtttcgttttgaggggtcccaaaagtgcctttcccttgagaaagtcttttcattctttggggcgttttgttttataacttacaacaattattatccaattacgctttccttttaatacattaaaaatgatcgcaaaaaatcattcttcacttcctctgaacgatcaaaatcaaaacttcttcattgatggcgtttcttctcgacttatttacggtacgaccgtatgattaattaggcaatttttgaataacaaatcatttatatacctaataaataaaaacattaattaaaaaattcatttaattacacanaacactccattcaatacctttccctcttataataataatacatacacaaaaaatccccataaacaaaattccatatatcttcacaattcatacacatacaaatacctaacccaatttaaaatttaacattattataacacaaattcactcatacttttactcttacatataaataaactcataaataccttataaatttccttactatatcattaaaaaattcatcaaaaaanttcccctcccttnnnnnnnnnttcnncccaaacctagcagtgccccacgggaatgatttgtg

SEQ ID NO: 10371 - DNA, 4116 bp, Heterodera glycines
  misc_feature (779)..(779): n is a, c, g, or t
cttttctcagagccaaccaaatttcataatgttctcctttataaacgaaaatttaaaaaaaatttgacgaagtttaaaatggtatatcaaaaaaaaaaaaatctgtaagagttgggcttttaccgtgggaaggcagttctgctgacttttgcagtttatgtgaccaaaaatgaaaataaacccataattaggatcttgtaaaccgaaaaatatttggaggcacgagtcgtgccaacaacatcaagacaccggagcacggaacatcaccaacccaagggttcaaaactataaaaactgcgtaccgcaaattgatctttttatatatttgaaaattgaatagtgcgatcagcggttttgatctactggtgtaaatttgatcactttagaaacaatcaaaaaagatatccaaatttgttgcaaattgcaacacctttttaaattttctttgtttaaaaatttaaattcataaatagggatgcaatttttaggcaaaagcctatttttttcctgagctccccgtggcttgaaacgcacgaaaaacatgtttttttcggctgttgttaagctacttttcgagttattagtgcctattttctaggcttttatttttagcgcctaaaaagcctaaaaatttttgaaagagcctatttttgcctattttggcgttttgcccaaaatttgttaacaaaaatgcaataaaaacgaaaaatacacccctaagaatcaacgtaaaatttttttcaaaaaatatcccctaacaaccgacccgaaaattttcnaaaatacatccctaagaaatgaaatttttttcaaaattcatctccaaaatttatttatttattttattgacaagaatttgtgatttaaaaattatttatctcaatactgatttggcctaatttttttatttttttgaatacattttgtcattttacacccctaaatttgaggatttttagtgcctatttttcattttttagtgcctattttaggggttttttagagcctaaagcctacctatttttgcagtttttagagcctaaaaattgcatccctattcataaaaatttaaattttaaattaattagccaaaacaaaatgacaaaattatcaaatttaaaatgcaaaaactgaaaattataaaaaaaacacaatgatgggattgcatgtgattttgctaattttgcaaactaaaaagcaagaagttaatcaattctccattcttttctgctaaaatttcttaattttatattgaaaacataaataaatacaaaaccatttgctgtgcttttagaacaaattaaatttgataaatttgtgcattatttttgtgatcaaaaatgacagaagatgagacggaagacacatcaacatttggcagctcaagaatcgatggctatctttacaaggcgagttttgaagcagtttatttccaaaatgggaacggtttgtggtcccaaattatggcacccaaacaaaatcacctttttccctttattgttaactgtttcagttggaacagcgtccattcgtcggccaaattcgcagaaagtattggtttgtgctgcctcgcgatactcccgttttatattggtatggcgaacgaaaaatttaaaaacgaacgcctaatttcagcccttttccctcattttcaggtacaaatcgcccactgattttaattgtgcgggtcgcattcttctcacgggcgctgcgttcctttacaaccccagggagcaagggattttcgagattcagtgaggaagtctcgattttatacgatgaatacttctgattctacttttccacccttcgggattcgtttttctcgactaaaatttcaaaaaaaatgaaattttctacttatttacgatttattgaatttataggacaatgaaatttagtcaaaacggatgaatccaacataaacaattccccaattatttttcagaggagtaaaatttctccgtttttagcgtcgacaacaaatgttatcttttggaggcgccgaacagccgtgcccggttggattggctcagcgccatgcagcaaagtcggcgtcggcactaccgtcgcgagaaggaggacaccaaagagaaatcatcagagagggaaggggagggagccgaccgaaccaatgccaatgaaaacgacgacggagaccaaatccaaggcaatttgccatcgacctcagcagccgaatcagtgccagacgaagaggtgccatttggggattaaaaaaatgcttccgaaatgtaaaattgaattatttaaaagtccgaagactccgcccggtcagtgttttacctgcgcgaggacggcgaactccacccgggcagtttggaagtaccgccggccatttacaccgtttgtgacgcggtggaactgaaaattgacacactgctcacccgcggtgtggaggagacccagcagttcgaagtggccaccaaaaagttactgcacaaggccaggagctcgttcaggttcagttagaggggggggggttgcatttgggaagtgattttcgggcgaatttctttttgggttgggcgtgtaatgggacccgaaaataaaattttcaacctcgattttttaagtttttctgtttgcacacatggtttaaatccgtcgataaaggacgaattatgaccattttctggattatttttccccgggaatttacattttcattcctcacgtaattattaacattttcatcatcccccaacagcaattcgttcccatcgcagcatcagcccagagagaattgtgctcgttgccaagaagttgttttcctaattttaattgcccacgagaaataaatgatttcataaatttgctgcagttgaccgagtcgttggagcagttgcgcaaccgctgctacgaactcactgacgatttggtggtccaccagcagttggtcaaatgtctgaagcggggcgttgtcgctgcacacaatcagcgcgatgcactgtaagcagttggatgaaccatggacaattgtttagggaggggaggggagcattcgtacatacctgaaaatttttatttaataaaatattttgaagaaagcgttgctgcgtggattcgtcgaccgacgcggaaaaggtggagttcattttggaacgtgaaagtgcgttggccaaggcgcaatttgccatttcggaactgagccgagacaacgagacgctgaaggaagagaacaggtgaagctgctcattcaaagcctttaaatttaatttgattatggagtcttttttaaatattaaatttttcgagttgaaataattttatttgttcgaccgttccctttggagtttgggacaaatgcataaaaataaaatgactggcccattcattgcattaaggtcaattttcccaattttacagacgccttgaggcggaaaacagctctttgaacatcactgtggatgcctatcaggagtcggtgcgcaccaaagacgagctgatcatgaagtagtgttaattaggggattaattatcaaaaaaaggcatttcttaaaattgttatttcccaatgtttgtcctgtttcttcagcatggttaccaacgcgaccaatgccctgccatttccttcatcgagtgtgccgtccacttctgctgcgaccggtgccatcgccaccaccacttcggtcggcacaagcggaactccgccaccgctcgcaacgcttcgcaaatcgctgattgggtcgttcatcggcaagggcacttcgtcgcctaccgcgcaaccgacgcccaccgctccaccggttggggacaaacagtcgccagcaaatgggaacggaggtggtaagtcaaacaatggcatttaaatgtttggaaaaaatttcagccgaagcgactgaagcactgctcgtcgactttggcactccgacggacgtggcggcaaagaatttgttcaccgaaacggcggtgaacgacctgaacgaaatgaaggacctggtagacggatatcggaaccaaaacaaatttctgaacaacgaagtgttgggtgtgtgcaaaaagaaatttcgcccaaaaagtcgaggaatttaatttattttttccttcaagcctcaaagaaattgtccaatcttggaggaccgtgagcgaaagctg

SEQ ID NO: 10372 - DNA, 1469 bp, Heterodera glycines
cgtgagcgaaagctgatccgacaaaattttaacattgaagctgtttactaccagttgaagagccgctacattatggtagaaaatgcaaaattcgaccaaatttgaaacatatttcgaatttagttgctcaaccatttccaaccgtcaatggaccgccaaaaacggctgcccgtggaaccgtcgatgatccaagaactgatcgacgaggtcaccagacctcactctccgatgcgtacacacaatgccaattccctggcggtggagacggtcagtgattgggtgctacggtattttaatttgatcagaattaggcaaagtcttcgtccactttggccacattggtcgcctgtccgcgcaaagccgttgcgatcatcgacgccaacacggacggcggcggtgttccgcaccacaacgacccggacacggactcgctgggcttctacctgagctcgccccggacgcgcaaagcgattgccgactttttcgcgaaggcggcaaattccgccagcggcgaggagggcgacggaagcaacgaagacgaacagacagcgaaggcggatgaacgccaggaggtgggaaagcggaacatttgcgagtcaattaaggggaaaatgggtttctttgtcagccggaccattcgacgacggcagccgaaatgccaaccgatgaagcggtgggacccgcggagtccgcaggatcggtgccaaccgaagcaacagccgtctccggcaggttgttcaaatgtgccaagattttcgaaaataactcgaactccttcagcccgtcgatctctcattttgtgccgtcctcctccttcgctgcttttacttctccttcgtcgtatgaaaatgccggcgatgcactcaaacaggacgattggctccttcggttggccgccgaccatcagaagcgatccgatgacattttcgcatccattgagctgagcaacaatcaggtgttgtcattttaaggaaatccccggatatcggtttaactggtagacttttgagaaaacggttttctcccttattttggactttcttacatttttcgactccttggggaattcgtgccaatgtcacgtgtaatcccacccctggcatcattaaccaacacttccccccttttcagaatctcgtcgaatggctgcagcgttgggacgcctatttggtcaaccacgtgctccagccgatgagtccgaatccgcagctgaaaatgttagtccgctgtggcattccgaacacataccgtgctcgggtttggagcaggttttacagtgccatgccaaataaatgctttttctaacataaaatttctccagtctcgtcgattttctggtcgggtcgaccaaatccgagacgggcaaaggctattacgactgtttgttgcgcaaagcccaacgcattcaggagcaaagcgcttccggcacggcggacgaggacgcggcactaaaacaggtacagtaacaa

SEQ ID NO: 10373 - DNA, 2857 bp, Heterodera glycines
tctatcccattaaaaaaggcataaacatcttcgaaattttttaaaatgataatggaaagccgatcctatttgggtacctccaattcgattaacaatgaggaaaataatgttgattaatcggctaaaatttaaaccttgtatttcacattaaatgccccgttcgtctccataatgcttcttccgttcactttcttcaacaacggtatgagcaggtggtcgaaaatgagcaagccggccgcaattttcaccgtgtcaaggctgaccaggaagtcggcgatcagaagcttctcgtccgggagcagcgcatttggcatcaaatcgacctaattaaccgggagtaattaagaacaattacacggaagttttgaaccctctatcccattaaaaaaggcataagcatttcgaatttttttaaatgataatggaaagccgatccaatttgggtacctccaattcgattaacaatgaggaaaattttgtttgaaaatcggttaaaatttaaaccttgtatttcacattcaatgccccgttcgtctccataatgcttcttccgttcactttcttcaacaacggtatgagcaggtggtcgaaaatgagcaagccggccgcaattttcaccgtgtcaaggctgaccaggaagtcggcgatcagaagcttctcgtccgggagcagcgcatttggcatcaaatcgacctaattaaccgggagtaattaagaccaattacacggaagttttgaaccctctatcccattaaaaaaggcataagcatttcgaattttttaaaatgataatggaaagccgatccaatttgggtacctccaattcgattaacaatgaggaaaattttgttaatcggttaaaatttaaaccttgtatttcacattaaatgccccgttcgtctccataatgcttcttccgttcactttcttcaacaacggtatgagcaggtggtcgaaaatgagcaagccggccgcaattttcaccgtgtcaaggctgaccaggaagtcggcgatcggcttctcgtccggaattggcgcatttggcatcaaatagacctaattaagcgggagtaattgtgataatagcctcggaaattctaaacctccaattcgaagttgtccaccgtccgttcaatcagcacaaccatgaagaaatgggttggcacatcaccaactcggctgtcaccaatcacctgtgaaatttggacaatgaggaaacttttttgaaaatcggtgtaaaaatttaacattgtatttgacacacaatgccccgttcgtcgcaattttggccaagcacagcggtccattgaacaagaacatgttgatgctgctttccgcgccaacttccacacattcatttccaagtcgtcgttccatttgccacggttgaaaccctaggggggcagggagtgaatagcagaaaaaataggagctttaacggtgaacaacaaaataaaaagccacttttgtacgaagcattgtgatgaaatccctattggttttttgaaaaattttagaagcgaaataccaatttgtgtttttttgtaatatttcgcaattgcgctggtcatatcagaattttcttagtataccaactcaaacgttcgggctcttgctaaattgttttaaagttcaaaaattctccccactggaacacaaattccattttttcgtatgtaccggaccaaaaggagaaaaattgattatttcaatgccattaacatttgacaccgattttccacactttgtatgtgcttgtgttgtcaaaacacgtgtagccgatgcgcatatgattcggtgtgatccacacagggtgatgaatgggcggtgggaattggtggtgcggaggaccatcctcgtcgttgttcatttcgtcttccgctctgtcgacttctcctcgggcgacgagaagatcattgatatgtttaaaaaaacagagaatatagattaccaacaatgtggtaaatgccacccaaaaagaaaacggatattcttccatctaaattgaaaaaataataattaaaaaacacgaattttaacgagaattaaaaaacagaatgaaacaaaataactgaaaacatttccttttatacatagaaaatggtctaaagaaaaaagaaaaatactgttacttcagagttcccaagtgtccttatttgtaagatttgtccttataatgagggaagaggtgtttggccgagaggatgcgctgatggggggggggaattgagcttagctcgatttttcggctacgatgtctaaatttgactctcaattttctgttgagtcgggggcgtttggaccccagtttttgggccccagggtcgtttggggcccaagtacagaaaaatgaaaaatcacagtaaaaacaactttttaaatttcagcataaaaacgtaaaataaacattttaaaaataaattaaacaataatcttaacaataaaaaatgtaaaaattaacagaaattcccgggttcataaggtaatttggacaataaaacaaaaaatcacgggttcattcgatagttgcgagaaattccccggataaactccaaaataatgtgaaattgattgcgattttggtggtaattgtgatcatggtcgatgtttgcctgcattcatcgggacgtaaaggcgcaccaaattaagaattcgttcatctggtgccaaaaactttcgcttttttggtggtggctcctctccggcaatgaatgacgcgtatttgacgtctgttgtcttctgctcacgacgtagcacggcaatgaagtgaaaaatcgacgggtgtcggaaattgaaggcgccctgtagacgatgatgctccgcctcggagtggttgttggtagagaccggcgcggga

SEQ ID NO: 10374 - DNA, 2512 bp, Heterodera glycines
gagttaaatttatttttagtcaggattccggtaatttttgcgtttctgtcagattagtgggttggttggtaatttaattggggaataaaagaaaaaatcatttttcagggccgtgtagggctgtggccttttatccgcttttttctggtctgcttaaacatcatcggcacattttcaggtgcttcggcggtgaaaatgggcaaaaagaggcgccgaaagacggcaaatcggcgccagaaatggttgttgaacctgccgaatgtgttcttattcggccatctaacgatggtgaattctttttgaggggggttcgggattgttgggttataagagggttagggtttttaaattaaaaaaatagtaaattggataaacaacagcatgcttctatagcaagggggaagaggatgggaattcacgctcctggaaagaatttttttgttgttgttaaaacttgactgtaactcctccacaaaatgcccgcacatgtcgccttttagaagtcccctaatgtcgggctactcttttggtccaagtgagtttgtgctcgttttagtttactaacctcgagtagtcacactcgcttgcttcaatcctggcggtatccgctttaccctccttatagtcatgagccaaacacttcacaaaactctttatttcggaatctttttggtcgttacttttttgaagctcatgcaaatttatcgaaatttcatagacaaatgagagaaaacacttagggctatcaaaagatattaaaattatttaattcgatcagctatgaaaggagttgttccacaatggctggcgcccatttggtcggcgccaaattgtcccacggccggcattggcattcatgtcgttgcctgattttcaaaatcccgactttttcaatatttcttgccggcgctctacccaatgcaatcgttgtcgagaagctcgaagtcaattgtgctcaaatcgtcccattcatcgcaattttccgctttcccagccgctgccttcacaattggacggcgacgcatctcccaacaatcatcgtgctgataatccggcgatggcgccaccttcttcagcaacagcttttcccgcgtccgttcattgaccaattcaaattttttaagctgggtcgggtcgtccagctgcaggttaatttcataggaagaagcagcggtggcactgagaaaagcctgaaaaattgggggaggggtaaaaaaaatttcgtaaaatttccaaaaagtaatggccaaaattttttcgaaaattttgcaggctaataaaggacatgagaaatattgaatttggtcgtttcaatgaaaagttataaagcgtcaaaattcgtctcactcatcaaatgccccacatttaaatgaccatcgccgaccaggccataaacacaggcttttagccgttaggaaaataattattttatttaataaaatattataaatttatttatctatcggatttaatcaacaacctatcacctatttaaacggtttaagctcaatggagcaaaaaaaaaaaaagaaatcaagatgaaaacaaatttaaatttaattattttgaacaaaaatttttgtacaaaaagcatttaaagaaaggaatttttgaaattttaacgatgacatttcgttgacctgcttgaatttgttgacccattccgcaacatttgtaatgcctccgttgtagttgcagcagtacaacgccttcgactgaccattagcgcttggcgtgtgcaaccatttggacagcacttgcgcagcaggtgcatctttctgatcactgccaatcatttccgggtctggccaagagaaaacggaatgattttcaaaaataggccaatcaaaatagagagagcccgacatttgcggccccagccaaaaacgtcatttgcggaccgacatttgcgctcggacattagcggtccgacaattgcgtcccccagccaaaacgacttttgcggcccaaccttttccacacaaactaaataagaaattattttccatccaatttaaatgaatttttatgctcttctaatatgccgattcaaactttctagaaaaattaaaaggggaggaaaaaaatcatcccgtccatttgaaactgggttcaaataagtatcgaactgaacaatagaaaaactgtggaaaatgtgttagatcgagcaacaaaatgttttgcgctacgaaatgatgaagaaataagtatgaacagtattaggaaatctcagatctctactctctctacagtatcaactggccgatgtaagctttcaagctctgaagagtttttgaacaagcccaattttgaaaaagaattactcgattgagtaaattttggcaaaaatttgaagagaaaaaggattttcgatgggagaacaattttgactgtggccgcaaatgtccgaaaatggccatttagaaatgggccgcaaaggtccgaggcgtaaagatcgggccgcaaaagacggaccgcaattgtcgtttttggttgggggccgcaaatgtcg

SEQ ID NO: 10375 - DNA, 1305 bp, Heterodera glycines
  misc_feature (1216)..(1216): n is a, c, g, or t
  misc_feature (1258)..(1259): n is a, c, g, or t
aaaatatatgattgactattggtaaaatttttgaaaaaaatttcgcattttcgcatattttggcttttcgcatttcgcttttttttcattctgcattttcagtttggcaaatttcgcttttggcatttggcttgttatttttcaatcttgcgcatccctgatgcacggtcagggtcgttttcgtaccgccattttcgtaccgccgttttcgtaccgccgttttcgtacggggacgttttcgtaccgcaggggggtcgttttcgtaccgccgttttcgtacggggacgttttcgtacgagttcttgtacaagcgtcagattcaaatagaaaaacttaagaagaactaataaaaccaaaatttatcattttttgtttcccattcataaaattttgtagaaaattcataactttataataataacaaaatccaggacaaactaggtcgcatctcataatttcggaaaataccagcgagaaaattgttaaggttttcgggattgacattggcattggcataattgtgatcattttgagggacaatattgttattgatatcgttgtagcgttggacgagacgaagaatccgtgcgtcggcatcgagatacttctttttctgtgcaccaatttatcattatttagttttgttttaattacttgctgctggttcattttgtagttaataaaagcttaactgtcaaaacattaaaagtaattttaaaaaattaacaaattatttgaatgtaattttttttttgcatatccgctcgtacgaaaacggcggtacgaaaatgtcccccgtacgaaaacggcggtacgaaaacgtccccggtacgaaaacggcggtacgaaaacggcggtacgaaaatggcggtacgaaaacggcggtacgaaaacgtcctggcccgcctgatacatacttcatatatagagaccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcngaatccaatgacgaattaatgaattcgagatttcattagttnnctacatcgaagaaaaattttttaattttgaaatttatgtaataatt

SEQ ID NO: 10376 - DNA, 1262 bp, Heterodera glycines
ctctctctctttcgtctttttccacttaatgcatttttcttcgcttttaaaggtcgtgtgcaacaaaatgaatcggctcaaccttttaaaagcgaaatgctggatggcgattggcttcattgtgcgtgggttttatccacaaatttgctgctgctggggttgcaccgctttatccgttctttgcccgtttagttttgtgtcatgctaagctttggccttattggattaaaaatttggagttggtataacaaaagtgagaaagatgatcccaccggtgccaaaacatcaaatattgccaatgctttctctgatctcggcatactcattccgaccatcttcgcgtgtatttctactgcatttgttctcgtcatgttttgtttcactggtgtggttttttcttccctttttttgttgttcgaaacaaattataaaatactcgaatacttaattagcacttctttcaaataattatgacagaatttttcattaatagcttttcttttccgaacttttttggtcaattttttgcaactgacttaggtattgctttaaatttttttaaattaatttttaaatctttacagattttacacacagcgcactgcaggtgaagtacaaatgtcgccagtgtggccacgaagtgcacaaaacatacgaattgatgggtaatggtggaagatgcaaaaaatgatcatttaatgttttgtttcccatttaagaagagttcagcaggggctttagcgacactttcagcgaatggggacgctacacaaatttgtgcgagccggaagtgatgctcaagaagaccgattacaacgacattgaggaagaattccgcgccatgtgccagtgctacgtacatgtgttccatgacagccgagtgtggaccaacaaattgatgaagcgcatcagttgaagagacatgtgggaaatagcgaacgaacgaacgatggataaatggaacaacaatatttgttaaatgaccaaaaagaacccctgtttattatgtccaattgttcatcatcgtgtaaaataatgtctgtaataaatgcgtaggaacttacactagttttattgtgcacagaaattctaaaaattcgaatgaaacctaattggtcctggtttaactgtttgaaaaggttagaagtgtctcattttttacattaaaaaagtgcatttctccacgaaaagggtgcggcacttaaaactgtcatttttattgggcaaaaatgtaagcattgtccataaactcttcgcatttt

SEQ ID NO: 10377 - DNA, 1614 bp, Heterodera glycines
aatttcttcttagtaaattttttgcgagtttgacctcttgggtactaaaaaatctatgaattttgaccaatcgtcataaattttttaataaaaaattcctatagtttcaatcatatcggaaagagcaaattctgtttcttcaaagatgttggtgcataaaaaccgccaatctgccatcaaaagaatataaaattaaaatatgaataaaattatatatatttttgtcatttgagtaaatatattacagtcgagatttctctagttgtttgtcaaaaaaattaatctatgaatgttatacaaatgttttattatttgagataaatttgcttaatagtaattaaaaaataattaattataaaataattttatttgattaatttgcttaataacaatgaaataaattagagttgctcggtaccggtaccgaccggtaattaccggtttttttggtaccggtacccgtaccggtaccggttttttcaaaaatcaaagtatcggtaccggtttgtctagtaccggtaccgccggtaaaaatttgcactggtaagaatgggggtctgggtgagaaaggagaaggaatttgatgaagaaggagaaaattttgagaaaaaaaaataaattatttattttcttttaaagcagttgttcatatgcataagtggtcaagtggctaaaccttctgattttattatttctcgcttgggttcaattccccactgggatagaatattcttcatattttctttaccattattttaattgaaattttaattaaaaaaaatattccaactttttttctttcattttaagcatcctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggaaccggtttttgcattaccggtcagtaccggtaccggtttttttacaattaccgattaccgctcaactctaattattaggttattattaagccaaagaatctaaaaaaataaacacccagttaaataaaatttaataataattttaatgtcaaatttcaaatttaaatattttataattatttttacttatcttcaaacggtttgggttttaatcgggtcaaatttattgggctatagaaatgggttaaaataagaaaggattttatagaacataacataatacaataaattaaa

SEQ ID NO: 10378 - DNA, 1900 bp, Heterodera glycines
  misc_feature (253)..(253): n is a, c, g, or t
ggattacacacatgcacatgtggtgtagtggttaaactttctacctttcataattttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaattntttcccggcggcgcctatcggcaccgccggccctccttgttccccaaaagtcttggaaaaaacgtgccgcgtaaaaagcggtgttgaaagcaaaaaaaggtcattgatttacattaatttacatggccggagaccccttcgcaaaattggaaaattggccgctgattattcaaaaaaccgcatgtctctatgacttatagcggctgaggtatgggcacttcaattttgacgtagtgtaaaatgcactattttcttaagaaatacagtactttttataggcaccgaaataaaagtcgacgtatctcagcgggcctaaaagtagacccactattccaaaggcaattcggtagcaaattttgtgctctataaaatgggcctactcaaattttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaacatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgtatgtcctgaatttgaaaaaaaaacttggtcaacctgaatatacatatacttctgaacaattctaatgctaaaaaacaggtactcacgcgaaaactgaataaaaattttgtatttggaaaattttgtccaaaaatttttatgttctaaaattaccggtttttaccggtaccggtaccggttgaaaaagatggtaccggtaccggtaccggtttttgcagtaccggtcagtaccggtaccggtttttttgcaattaccgattaccgctcaactctagttatatgtaagaggcaaacatttcaatgggtgagaaaagttaggagcattaaggtcaattgttttgcgtttttgatcgtttaaactaaaactggcttagagcaactcaattattttcccggtaaccaaccccggtaatagtttagatggttccccccatttttcggagaattttttttttgttttcaaaagtcatgaaaacatatttcagtccttgttttgtcttttttgctctggtccatcccgaaaaccctgctggtccgggtttttgcaataattacgggctgtactttcgaaaaagttatccgattcaaattgcgcttaatttaggccgctgtctccgccaggtcaaagcaatgaaaaagtgttctctttttccgggtccagtgatcagcggaagaagaagtgatcatttggggaatggccgatcattatcgagttatgatgaattggattgattgatgaagttttggttgctccttgattaatccaattgacgctgacattttttgctattaaaaaaggaaaatttggcacctttttttttcttt

SEQ ID NO: 10379 - DNA, 3419 bp, Heterodera glycines
  misc_feature (3386)..(3386): n is a, c, g, or t
cgtaattattggaaaaacccggaccagcagggttttcgggatggaccagagcaaaaaagacaaaacaaggactgaagttctgtcttaacagaacccatggccctggcaagattctgggaaagtactgtacatgggataccgtttccctatccgtgtttcatacaaaaaaggccttatttctgctcacccaatgtcatcgtaaaggcggaagaacactttgttcaaattggcatccgaattttcgtccttcttctgctgctgtttctgaaccgccgccgtctccccaataattgggcatctctccaaaagccaattgaattcaccagtgccatccttcgtcagtgtcagcttctcatttgtcacttcgttcaccaattcaaatggctcgattagcgacaagaaaacaccaaaacaaattttgtaagtgacagaagtggtggcatggcgaaatgtctaaataaaaaattggtaaacacaaaaataatttgacggaaattctgacgagacacacctctttgaagttgttgacccattccagctttggtggaaccacataattattgcgatgcaattgcttcggctgtccatttttgctcggagtgtgtaaccatttggtcaaagcttggccagcagttgcattgggtccatcgtcagcaattccatcggggcacagataaccggaattgatcgaattcaattgatcaagatcagtgagaagtgtcggtgaaatgcggcgacgcaatttgtccaaatcatcgccatcgtgaaagccaaaatgacgaatgcttttcgcaaaaataggccaaatttcgcgggtaaaaacatcccaaaatgttacaaaatgttcgaattacttaatccgaatgtgattaaagcggattttgttgggcagcggacggtcgtggaacggaaattgcacacgataaccattggcatatattttcgcttttggcccttcctccttttcaattcgattgttctccgaattgtcaatttcgtcgttttcccatcaaaatgtttgtccactaagatgtcgaaacggtcggaaagcaatgccattttaaggtcgagttgagcatgttcaaaagatggcagaatgtccatccaaacgtcgccacaaatccaactgaaacatggaaaatagggaaaatgaaaatttttaaaatctttctttaccgtctgttcatttttgctatggggagaggcaaaagtcttctgcagtcgggcatgccagctttccacgccatttgttgtccttggcagatggagttcagtaatgtctttgcaattccaaaaatcgagcgaaatgacggagtgcgacgctgacgaccaatccaagcgttttcaaggtattcaagaaaatcctggtgccgttgagtgtcgcaaaccggtgaatgaacctttctgccaggtcattaaaacgtgccacaacgtcatcaatttcacaaaatgcgagtgcagagaactgtgaaaaggttcggatgttttttaaagaaaaatcccgccccttttgcccctcctctaaaaaagcactttcttgattgctgtctcgtatgcagtgtcttgactgtaccgcatctgcatgtcatgactttgaactgaccgccaatgagcttgtgacaggtgaaaccaacagccgtgcagaaatgcggtgggaattttcgctcgaaatgcattttcagctgccttttcaaagtcattgtgttggtcggttgtgccaccattctttggttcttttttgaccatttcaaaaaacgacgacgccctctcaaaaaagaaatgtaaaataaattaaacagaaaattttgaaaaattttccaatttttcagctttatctgcagcgattgttggcttttggtgttcgattttcttgcgccttctcaactcggcctcgaaattgcactgattagccgccgctttgacttctacgtggatgaacacttcaagacgcgcaaatggacgttgggcgaaattcgaatttgctacaaaattgaagaaaatggcaccaagcaaatgcatattcaccatgccgatgcaaatccattgccaatcccgcaaaatccgttgccgaacaaaatcatcggattccgaggcattaagatcgtgtaagaaaccgatcatccagattgttttgatttaggacactgactaacattttcagctacatcgatcaaaatgtcgtcgcatttctccgccgttttcaccgttttttctccattgttcaacggaattgggcattatcacgtgcagaagtgactgtggagaaattgacactgcaacaagaagacgaagatgtttggctcacgcgttgtccaattggatgggatgagatgaaatggggaaatgtgcaggatgaattattgaatgacgatccactgaatgcaattctatttttgatcagagaggacagattcgacgacgggtgaacaattttaaaaattcaaattgaattgattttaatgatgcaaaaatgcggttaataaacattgaacagtatatgatagatacaaaaaaaaaacaaaataattaggatgttagttggttgactcataaaatgccattggccccataaaaattgaatgctcttaaagtgtaattaaatcatcatcgttttttcaggcttctcgacgcagcttcccaagggccgagtgatcactgatcaacagcagaaatgaatgaattaattattaattgatgcgattatgtgacccaaatgatatgttggcactgtgccatttcacggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttatgttcgattaaaacgtacatttaatatcaattgaaaactactaattaataaaattaaaatcaaatgtagaaattaagtgcttgattttagcaattttcatcggtcgtcgcaatttgtttggatttacccaataatttactaaaaattttttgttcaaaaaagcattcgaacgcaaaaaagaaacgaaagagagagagagcagttcaaagagcaaacaattgtcaacaatcaatccaattgattataaaaagtcaaaaatgtcggtcatttcaagtgtttgtgtatgcatttgatacggatgtccaaccaatttgngatgtttttacccgcgaaatttggcctattttt

SEQ ID NO: 10380 - DNA, 853 bp, Heterodera glycines
ttataatgtcaaagcaattaacattttcaaaaagtactcatcggccacaaatgtaccggaatttctatttctattaaaaatgaacttttctcattttgataaataattagccatacataaataattaagcctaatacaaaccataaaagccccctctcccctcctctccacccatccgttcgggcgaacatttgtccccattaagtgacgagaataggccacgcctcgtgccctcctcttctccttcttctgtgggcgacaaatcccaataaaagccggcgcttttcacagtcttacaaatacattccattctcagtgtcaacattcatcctccggcattttgccatttaaaagcactttcaaacgcaagctttattttaaagtattcttaaaattccttaaatacctcaactgcaagcagtaaattgagcagcaacatacaacacacaccaatcgcaggaacattaagcagtacaataagcaccatggcatttctcagcaggacgatgacgacgttcaacacaacgacgatgctgctaaacctggcacttttttgtcagtgcgttcattcgttggtcatccatccgcgactccgctcaacttcggctgcggttgctgcacgtcaaattggatcagggccagaaacaactgctgctgaagatgaacaactgcaacatttgattgacatcagcagaagcagcgataagtgcaaaaggatgcgttggtacggagcagaagcaaagcaaatgctcaggtgaggggacagattttagtgaaggcaatgaatgtgccgtttatgaagacccggaatatgccgcttttgagtcagagattgtgccgttctttctttggg

SEQ ID NO: 10381 - DNA, 2619 bp, Heterodera glycines
ttttagacaccttgacgagatcaggcttcgaacggaggcggcacaacggaatgcggtgtccaaggttggcaaagtgtcgctgctggacaagctgttcgcgctgttcacggacaagcctgacgacgaggggcccaagcatgactgcttcttctccgccttcaactgtccagtgaatccggcacggaacatcccgggcgttcgtcgagtgcgcattacggcggatgagcgtcggaaactgttggccgccaaacaacgtgccgcgacaatcggcagtagcggtgacaccacggcacggcactcgagaagcgcacggaaccacccccaccaccagcaacggatttgaagcagtgccattgaagcaggaagacggcacaccaccgattaattgtttgttcgctcacttattagggctgccaaaaatatgcacaaaaagttgtctaaatattcgacataaatatgtaagaaaaatcccgaaatatttaaagaaaagtccaactatgataaaatttttgaaaaggttattttttgaaaaaaaaaatcctcgtaaatgataaaataggcacaaaattccataaaaatgactttaataggcttagaatcaccttgtaatattttaaaaatttccttttgttttttcaggggtacattttcaaaattattttttcactataaattttcaaaataagtaaaaaaaatgaaaaaaatgtacaaaaatatttgccaaaattttggattttttccaaaaatttccgtgtaaaatcctcaaaatatgtaaaaaaataaaaatatataagaaaaaagtccaaaatatttacctacatattattaaaggttcaatttgataaaaaaaatcactctctttgtaaactgttcaaaatccagaaacatattgtgtttcacttactacccttaggctaacccagcttgaatttttatcaggcatacctcagaattaaattaacaataaaactaaatgttttttatatttttggtccaaaatttgctgttccaaaactatagactttcatcagatcactccttcatggttatatgcagtgagtaaattttagccccccaaatcgacttgaaaaacgaaaatttgggcaaaagtttatgtgaatttttcaggttttcattcgctctaattgcttaactcatataggtaatcattagggttgggaattatatgcacatgcattttttttcctggactgcgggaggctgaggcctgaaacggacgaaaaacatgtttttagcttgctttgaagcttctatgacgtatttcccatatgcatattttgcatatttcgcgatttatatgcatatttttgcatattttagcatttcgtgcatattttatgtggtgcatatttgggcattttttaaaatacccctattagaacggccctatcaggtaaattggcctttttgacccctaaagaccgaaaaaatttccgaaaaagacattttttagcaaaattttgtcgaaaatattgactaaattaaaattttcttaaaaattgattaatttatgtccaaaataagcaaaaaagcgaaattttgcttttcaggttgatttttcgtaaaatttaagctgtatcgtgttttttcttctaaaatgattttaataccatattttagtcatttttgaaagttttactttgcgtttagcgaatttaaagaaattttgaaaaattatacactcaatttggaaaaatttatgtgcatatttttcactttttatgtgcatattttgcaatttttggtgcatatttcatgcgcatattttaagattttatgtgcatataattcccaaccctagtaatcatattataaaaattcattttgattacccaactcttcaaaaaatttattttttgtattttagacaattcaagccagaaatagtggtccgcaaaagtcgttccgcaaatgtcggctaaccatttagaacatggagaatccaggaaaaatatgtatttacataaaattggcagccctatttattatattatacatttattcgttcctcaaaaaataaaatgaagacatttaattttgtttttttttaataatttaaaaatgtgaattacactataaaacatttttgatcatgtgattcattattagggatgtcaattttatgtaaatacatattttttcctggcttctccatatattttggactttttcatacatttttttacatattttgaccattctttgtacttatttttgacatccctattcattataggggcagggtcgttttcgtacgggccgttttcgtacgagcacaagtttttggctataacttttttatttgtctaccaaatccaacattgttggtgtcattcgatagccctatgtatcctctattagcctgcaaaatttcgaaaaatttcgttaaaagttatggccagaagaattcaaaaaaccagattttccaacttttttggctcgaactttttttttaaactgaacaaaattttttggaattttgcaagctaatagagcatcttaagggctctcgaatgataccaagatcgttggatttggttggaaaataaaaaagttatagtcaaaaaacatgtgctcgtacgaaaacggcctggtccg

SEQ ID NO: 10382 - DNA, 1132 bp, Heterodera glycines
atcagaagggctctcgaatgataccaacaatattagatttggtggaaaaagaaaaaagttatagtccaataactgggctataaaatatttaataaaagaaagaggaaaatgagcgtttttgattcctgcttttgttgctgagaaaatttttgcttttactttttactacattatttaattgtttttttgccgcgtttttcattattgaatttgttaattgtataaaagaatttgttaatgttaaagagaaaagaatttgatagttaaagagaggtgtgtttttgattttgtttagtaaaaaattgaagaagcaaaggattttgaatttgttttcattttgtaatatgaaaaagatcgactgaatttgatttgtgatttgatttgtaaatggggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacagttacacctttttgaacaattaagctttggctttattctccaaattggcaagcgaaggcaacgaaagcaattcgatcaatttaaatttgttgatcagtcaaaggtgcttgccctgtctcaaaataaatcgaaacaataaaattatgctttatgcaaaacgaattaaagacacgaaataaccaaacaaacacaatttcaaacaaacttgaaaatcggcgagaattaggcacagaagaaaaataatcaatcacacaattaacttttatttttccaacataagcactaattaaaaaaaccaaaacaaattatttaaggtcaatttgaataatcggaacgccaaaacaaacataataaattaaaaaattaatgaagtccaaaatgatatcacattaccccttggagacttggacatttcgtgggtcagcgagaaattcagaactaaagaaaaaatattttgaaaaaacattttcggacccactcctctttaattttgtgggtcagcggtaaatggttatatgtgtacacttatttcggtattaacgtttgccaaaataagtttttaaaatttgtgtcatttaaatgt

SEQ ID NO: 10383 - DNA, 3147 bp, Heterodera glycines
agatgtagccctcaaaattcagattattgcaaaacaagggatcagcggccaattttccaattttgcgaaggggtctccggccatgtaaatcaatgaccttttttgctttcaacaccgcttttttcgcggcacgtttttctcaagacttttggggaacaaggagggccggcggtgccgataggcgccgccggggaaaaaatttgtattttttaatgcgatttgttaacagaatttataaaaaaagaccaattgattaatttttgggtttttaggatgcttaaaatgaaagaaaaaaagttggaatattttttttaattaaaatttcaattaaaataatggtaaagaaaatatgaagaatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaacaaggcaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaatttttgagtaggcccattttatagagcacaaaattctctacaatatttggtatgctacttatctgttgaaattggaaaatgacaattttatacgcaattatttttttcaaagcatgatgggacaacacttatgaccatgactgtattattatttcttgaaaaattcgaaaaaaatggggttttaattaaaaaatttgggaaaaatcatcattcaattaacttttaattttcaagattcccaagtctctatgattttgtagacccttacccttctttcaatttcctatttttttaaacaagttttcgcagaagatttctctccatggaaatttttgaaaatctgccaccatccatcaataaatcccacccctcctccgtcgccctcattaagtcgcaaattttttaatttttttgtcaatgttatgtatgccatttcgtgaaatttgaataaaaaagacttttttaagtcaaaggttctaaaaatcattcaaccctcttttcattcaagattctcgcttgtccaagtttttttttgatctttctgtaattttctgtttttaaaaaccttacaaatcccgcgcctctcaaattttaattttcacaaatttttgcacattcgccgccaccccacaatttttcattttaattttgcaatcaaaaattcccatattaaaaatcaatcctcccattcaaattttgcaccatttctcaagcacattttcgtaaaatctccccccccccctccctctcctctcacatctctcccattaatccttcccaaccgtctctcccccctcccctcatcccactaatcgatccccacacatttctcacccattttccacctctataatttgtttttttttgtgtaatccatcccatcccaccaaatcccctctctttgctgcttcttccatacaatggtggaggagcgcaagcattttcctattttccaccagtgaccagcagcagattaaagccccccggggggacagctttttattttcacaccggcggggccgaacgagtggattaagaaattggataaagcataaagcggcaataggcacaacagcagaaaaggaggaggaacaaagtgtctctcactttttcttctaaatgtctctgctttgtctgtttctttgtacactttcccaacacactctctctatctctctctcttctctttcaatttctctcgctcacttgtttctttctctctgcttttccccttctctctctctctcgctctgtctctctctctctcatttttctcttccctacacaccaaatcaatctctgtttctctgctgcactctctacactctaaaccatttttttggaagacaggcggaatggggaagtgttccccccccccctcccccctacattcccatagcccatctccaccaccatcaatcgctccattaatgtggcacaaatgggcgaggatgtgctgctgctttcctttatccgaccttttcccctatatctctgcgtctctaccccacacatatatcttctgcttctctgtgctcctcactcactgttttcctacttttttttttgctcagcagaacaatcatcgcttccacttaattggtctcattagtgtgtgtgtgtgggaagttggaagttgagttatcctttcctttatccgtgtctttctttccctcctccaattccctctgcgtctctgtctgcccaaatttatattctgcttctctgccgctcctcctcactgtcttccctagacattttttcaaattggtctcattagtgtaagggaaaattggtggagtgatcatcaaaaggggccgacgtttctctccgattactcctctctctgcatctctgtcggatgtactatttctcacactccacattttcctgtttctctggtgcagcccccgtgctgtgaattcattacatcaatcacagacagagaagcgagagatttgtgtgtctatatttgttcagcagcatatataggaggaggtagaggatgatgtgaggaggaggaactaatgagatgacaaccacgacgacgactaaacattttccacttccaccgttgaggaggaagggggggacattttgtcccataaatggggacaaattttcaaaaagtgggacattttgtcaatagaaccggggcattttgtcccataaatgggggacagatttttaaaaaatgggctttttgtcaatggaaccaggacattttgtcctacaaatgggacttttcgtcaatagagaaccttggacattttgtccaataaatgggagagaattaaaaaatgagacgtttcgtcaatggtgcggaggacagcttatccaataaaaatgaaagagaat

SEQ ID NO: 10384 - DNA, 1141 bp, Heterodera glycines
tcgctcgtcgtctggaatcaatcgtagtaaaagggaaatggaaagaaagtccatcattagggggcatgcttctttcgccgagtgtgcaattttcgaaactgaaagtcacacaaaaagtatggggtgctttctttttagttgttttctttcaagcaattgtaaaagggatttcttcttatggcgctcaaaatacttcggcaacgatagaaatacatgaatctactgggtgatgtgcaagaatctatgggattgataataggtagggcgatgggaaccagttttttcggggcgtttatcgcacctcttatagttactacgctctatccactccttttccattcctcctcccattcaaggggtacaacaaccactttgcctcttcccccctcccccctccctccaatatttccaaccccaatttcagtgtgcagcagcagcacacacgcagtcagcatcatttcttaaaaataaaactaattttttggtttcttcgcccccatcattcacccgtaaaatgggagcccaccaatcagtcagcccccccccctcctcaattaccactcattagtgtggtgtatctatcaattagtgagagataagggggtgggtagtgtatgtaattgcgctaaatttggagtggggttggacaaattagtatcatcatttgtagggggagggttgtttggttgttggatgatttgatatgtaatcactcactcactcaccactctcttatttttatctcatcatcatcatcatcaccattcgttggggtccatggtcacctcccccgcattcatttccccccccccccccccctccccgctggccgctcgccgacgacgacgacgacggggaggagaaggacaggacgattatttattccaaatttccatcattcattcattttggtgctggtatggggtgagaatatggggaggggaagcaaagcaagaagggggagggggctttttgtattgcaaaatcacaaaactaatttcatgggtggggtggttagcagtgtgtgtggcaatgtccaatcccttccattcccgggacaaaaaaatgctttcaatcattatgagcctctaggcctaggtcttaattaggggtgcgtagggtaatatgaagtgtttaaggg

SEQ ID NO: 10385 - DNA, 5161 bp, Heterodera glycines
aaatgtgtataaaaggagttgtttttcaccatttttcacattcttcctacaattcacgcattcattttcttattctacgaattccttattgtcttcaatacaaaaatgtcgggcaaagcgtcgcggatgacgcgaaacgtcaaaacactcattcccgaagcggtgaatttttagtcgaattgttttccatccaacgcattgaatgaattgtttttgatttcagcagaaagcagcagatgaaaaaaccaaaaaagaagcaaaggcacttgaggatgtgagtgatctcccgtaaacacatcaccgagatgcagccgattcgcttcaaattttattggacatgaatttttgtctcccggaaattttttggcactaagttcccacttcttaaattcgaaatcggattctgtttcttgaattttctgaattcgtcaaaatttcgtttgcgcgtcattaattagaaatcgtgtttcggttcttaaatcatcaaatccgtcgaacgttttgttcacgattcttaaattcgaatcatgtttcaatctaaatccgaatgtttcccgcttatcaaactcgaaatcggatttctgatgcttttgaattctgaatccgttgaaatttcgttcccgatttttaaatttggaatcggttgcatccctaacacggcacctacgttcaactatacatcacataaccattttttgcatttagttcctggtctcactgagtccgttcaacaagaagtgggaagtggagcgcacgctcagttctggcgcctacggcgtggtgtttttgtgcaaggacccgttaatggagtgagtttttcttggccctctgctgctggtggtggtggattaatttatcccatattttgcttatcaatcatctctaattaattttaatccattttcaacaaaacagcatcaaaggcgtcgtgaaggttgcgcgtgcggagtccggaagtgaaacggccgagtgggaggcagctgtcatggacaaagtcacgaaaaatgtacgcctcggcaaaatatgccaatcatgatacatacatataacagggagggatggaatgctaatttccgaaattttctgcgaaaacgtattttagaaatattttttcgaattttgaaattttcgtttttgaaaaaattattaggcctaggaaatgccattcctgtgatacataatacttttgttacacaacaccaagctaatatccttttctcatttttacccacagacacacggaaagagcataaacattgtcaaactcctggacaagggcgttctggttgctccggacaacagtcggctgaacttcatggtgctcgaattctgcgaattgactgtcaagaaataccttagctatgtgtgtgcattttgttggtctttacacacagaattgttggcaattccaacttaattaggcttgtcgtccctatggcttttcctttggttcactaaactgcgctaaagtgcccaattgtttatgatgatcatcatcatatgccatgttttgtttaagcgaccggctggacctccacgaagggctcgcatctgtcaagtgttgctgggagcattgaaggccatttacgacatgcacaaccaaggactgttgcaccgtgacttgaagccggaaaacatgggcattttgtcgagggccgacccggtcactgtgctttacgatttgggcatgtcacgcatgtttaccaaccaattgggacaagtaaatcttgtctatacttgttgaccgtatacatatcccctctctgtgtttaggtgcgcgaaccacgaactgttgtcccgttcaagggcaccgttgagtgggcatcgggccatgcgctcaaggggcgtgagcaggtgcggtgccattttggcaaaatgacggcctaattaatcaaactttatttccaattccaacacatttcagactcgttgggacgatttgatcgcttggctgtacattgctgtggaactgtttgacccggacgtgaacaccgaatcgccgtacccgtgggacaaccacaggatcaacaacaccaaagtgattggcgattgattgatttcattcaattgatttcatattatttgcgtgtttttcaggccgttcgttatctgaagagctcgtactcgccggccaaagttctgctcaagaactggtaaggattgttgatggcatcattaatgtgttattaatgattgctaattattcccgtttagcccgcgtcaattctattccatccacacgtatttgtattgcggtaatcgtctgcttgtgccggactatgcattccttgccgacaaagttggacaagcgatggaagaaatccaggagcagatcaaaagtggtccggttactacgcaaggcaaacagccccagcagtccgcggcttccgtggcaatcagcaaaagctctgtggctcagtcgatggtcagcaaacgctaataggaaaaaacgatgctcaaaaaaatgatccttaatgatgctattatatgtttatgtatgtatgtaatgtatatgtatttattgcattgttgtaatattgagtgcgtaataattacgcctgacagtctgatcaaattaaagttgtaatttttagtagaacaaaataacgaaataatcaattaggtaaataatggtcaagtggcgattataaattgtcaaaaattaaattattatttttcagagataatttaaaaatcaaatttcaacttttacagattagaaaagatgctgcttgcttgttgtatttgaataaatttaagccatttaagacttcgtgcattattaaacgtcggacgattaagtccccgttgaaaatagaaacttcagtatccgaattttttaacatgaaaaatggcaagcgctcccctaatttgcatttttctcatcattttaagccgttctaaatcgaatcccttttgtttttgggccctcagattaatattttccgctcttgtttattaaaattttcgaacttttaaatttgtacgtatgtcatcaaatgtcatcatattatattgaactaatgggcgaatacatatgaacacttagcgtgctttttccttttgttgtgtatgtctctcgtatctctctctctcttctctctttttctatgtgtgccctctttttctttttcccctttatttcccctatcttttcactttctctctcgtcatttttttccttgttctctttcctttcttctctgctcttcgcacacgcatgaagaaagcgtacgcctttttttctctctttactctttttcttttctcccttaactatttccatgcatgtctatctttctccaagtatttcttgcgaattcctttctctcccccttcatcttttccctctctctgccctttgtgtgcatttgatttctttctctccactctcattgctttccatccacgtcaatcgcgtttgcatttgggcctcctcttttgcctctttttcatttctcctaacattcaatagattttaggccatcctaaatattttgcgtgtgttgaaagaaggtgtttttctccattttcctttgcataaggtggttttacaaaataaaattttaatcgacttcgctaatcgattttcgtttttttttttgcaattaaatgagcaaatagccaccaaaaaatgtagtggttgcttaaaatcgcagtcatttggatgatttaacccgttttttaaaattgtctcttcttttttgtgttaattgcataatttagtattttaattcctaaaatttgattgattttctttgtttatcatttcaaattagataggtttgcatttaaattttgactattatgtaggtaaagtcgtaaattgaaacagtgggtaccggttgcgcattagttaatccatcgatttttatacataacatttaatggtaatggatgaacataaatgtacacgagttaagggggaggggggagatttgccgacaaaaaagttaaacatattaacattcaaaattttttgttgtcatacatattttacgttggtattcaataattgatttataatgacatcatcactaaaaattaaaatattttgtcttccgattccattttccacaatgcttttcgctttgaatattataattaatgcttattaaaattaggtatgcttctgctgtatgcaagcacactcattcattcatatgtttgcgcacctttcattcaaagatttcccaaaaaacagcgaccaaagtgttcaggggagaagggaaggggcaggtggggtgcatggaggcaagaaatgtaaaaaatgcattaatatttattattttcttatgtaattaactctgcttttctttgtattacatagaaaaatggctcttaattaaatgaaatatataaaaatataaaattgcatttttgtttttctgtaataataataaattaggtattttaaattgctttcatctccattatcatatcacatatcatttacacattttgacttatttcatgtgtcttaagacttaggcttgattgtttattgcttcactcccacatacacatattttttttctcatattcaacggccttgggcttttgctttccaattggtacagtcagtgtcaaacagaaatggcatcatttgtcatcaatcccggtggtcccggcggttatgtcattccaaagcgtcgaaatgcaacggaggaggaaaagaagaaagaaagacatggggcggcggcggcgacggcggaagatgacgccaaatgtgagtgcgcattaatttttgaatttatgctcaccggatttcattgctggtgttatgtttttgcattactgtagtataactgtaccatttatcccaacaaactaaagagacaaccttatagaaagttgttgcattgctaagtgtaattatgcagttagagagtcgattttatgtgttatgctgttttttatagaaatgcattttagaatttactaaattttaccgtttagtattgcttattaagcgattaaaatagcggtgaatgaaacaaaatttatttgattgggttcatcattatgagttttgcctcccaaagtttgcccatatggaaatgattccaattcatccaagcctaattacatattgtccattgttactgtatgcaattgccctctctaggagtaaggattaattttatgattgtggaaattg

SEQ ID NO: 10386 - DNA, 819 bp, Heterodera glycines
taaaagcctttaatgcctatacataaatacaagacaaaagaatcaaattgaaaatgataaatcaattaataaaagttgtaaatgctaagaacaatttgtttattgagtgaaacaaaaacgaacaaacaacaattttgggatttgttacgccgctaagtccacagtgaataaaccaaaagtttattcaaacaaataaaaagggacaaggcgaacaataaaataaatattgattggaagtggggtcacagaggaaaaaggagaaaaatgacaaagtgaacagaagtgaacgaaggaggaaagaggaggggtatttatgcaaaaatatatgaggggtcaacagcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaatgcgaaaagcgaaattttttctacaaatttttaatagttaaaatcataaagcaaaaatcattttttaaaattttattccaaatttaaaaatcaataaaacgctttattgaggcgcgctttttccaaaaaaactttttgggaagaggggggcaggcggcgccggcaggcgccgccgggaaaatttttgaaaatttgattaaaatttgttgacagattttcaccaaaaaatcatcaaatttgtgatttttgtatcatttttctaatgagaaataagagttttggcgcgccgctgagaacagattttcattaaattaccaaattttgcgattttgggccattttctaagaaaaataggag

SEQ ID NO: 10387 - DNA, 2547 bp, Heterodera glycines
  misc_feature (90)..(91): n is a, c, g, or t
  misc_feature (97)..(97): n is a, c, g, or t
  misc_feature (102)..(103): n is a, c, g, or t
  misc_feature (106)..(106): n is a, c, g, or t
  misc_feature (115)..(115): n is a, c, g, or t
  misc_feature (132)..(132): n is a, c, g, or t
  misc_feature (138)..(138): n is a, c, g, or t
  misc_feature (143)..(144): n is a, c, g, or t
  misc_feature (149)..(149): n is a, c, g, or t
  misc_feature (158)..(159): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (182)..(182): n is a, c, g, or t
  misc_feature (184)..(184): n is a, c, g, or t
  misc_feature (187)..(187): n is a, c, g, or t
  misc_feature (197)..(197): n is a, c, g, or t
  misc_feature (205)..(205): n is a, c, g, or t
  misc_feature (207)..(207): n is a, c, g, or t
  misc_feature (219)..(219): n is a, c, g, or t
  misc_feature (231)..(231): n is a, c, g, or t
  misc_feature (239)..(240): n is a, c, g, or t
  misc_feature (251)..(251): n is a, c, g, or t
  misc_feature (261)..(261): n is a, c, g, or t
  misc_feature (270)..(270): n is a, c, g, or t
  misc_feature (273)..(274): n is a, c, g, or t
  misc_feature (290)..(290): n is a, c, g, or t
  misc_feature (304)..(304): n is a, c, g, or t
  misc_feature (315)..(315): n is a, c, g, or t
  misc_feature (320)..(321): n is a, c, g, or t
  misc_feature (328)..(328): n is a, c, g, or t
  misc_feature (333)..(335): n is a, c, g, or t
  misc_feature (340)..(340): n is a, c, g, or t
ttatatttcttgttcattttttgtgggctttattacccccccggggctatcttttgtttaaatgttattattagttacccttaaagttannaagatntgatnnagnaaaaggggntaataaatgaagaattngttgtnatttnngaatntatttaganntgnatnatnatnagagtagggtngntanttttagtganagaaaatntngaaatagttaantaaaatagtggnaaaaagtnngaaatagtgangaatagtganataattttnagnnaaaataatttttattnatagttgaagttgnaaatgaggtanttttnntttgaantattnnnttatnaaaatttttgttaaggaatttccctaaaaatgtcgaaaatatgttttttgagctccttctcaaaaaaaattgagcaaaaaattcgttaaatcactaaaaatagcgaccctaataatcagataagaaaaaaaaacaaaaaacttttaaaattaaaattaatattaaaaaaaaaataaaagaaaggcttcttcgtgatcgtttcgtccatctttcaccattaaaaatttcaatttttatgcatattggaagcaagaaaatgacacatttttgggtcaattttcagaagttgtttaacggcgcgctgtcaaaatcccgctgcgtcgaaatcccgccgcgtcataatcccgccgcgtcgaaatcccgccgcgtcataatcccgccgcgtcgagatcccgccgcgtcataatcccgccgcgtcgaaatcccgccgcgtcgaaatcccgccgcgtcataatcccgccgcgtcgaaatcccgccaaagccaaaatgagtcgaaatcccgccaaataaaaattagcgaaaaagccttaaaattacgttcctaaggcttcaaaatacgaaattcattaatactttaccagaatcgcataaataaataaataacaattttcacgaaaaataatgatatttttaaatattgaatgaatcgaaaaaagagaattgtatgatcgaatattcaaaattttcatagtgcatgaaattccgagctcaattcgctgcgtccacttgtcggtcgatgtttctgctgacttcaaaaattaagtcggaaagggtcgggcgatcagacacttgccattgccttctcctcaacggattcttgagactgtttttctttgatggcattctgcaaaaggaaaaatgtcgttaataattcccatctcaacgtcacccgtccccgataaacaatatttttacaaggaaaacaacctaacataaaaaaattattaactaagaattacagttttaaaattgtcgagaggggagagggaacaaactattccaaataaatatttatgtgttcttgaataaaaattatttcttggaataagttagttatgtggagatagaatcaggtcttatatgcacaagaggtgtctccagacacatctccccctagagtgggacagaaggagaaaaatttctggaaaatttggctcaaaatcgcaaaaatcggtctttttggaaaaatctgctaacaaaccgcattcaaattccaaaagcggcacccatcggtactgcagaactttcccactggagtgcacttcattctcccgccgtttccctcccgaaaaaattttcaagaaaaactctaaaaattcttattggaaaattccacggccggagtcccttcgcaaaattgaccaccccagactcttttcacaaaaatttgtttgaactccccgcctttttaatgtatgattggtggtcacctgcaaaattccgttgaaataattggcaaatgcatttgcgctgttcatctcgccaaggtcctctgcagggatcaggttgatgaagtagctgaggaactgcttgatctggaagattctgtaggcggtcttggcctgcatacagtcgaagttgtcacagttgcaatgcgttggagaagtgcgccatgtcggtggacgtgccgaaagacggctgctgagacgtaccaggaactgcggcagtgccatccatggtcaaatgaggatggcaatggcaaaagttggcgaggcagtctttcgctctcgtactccttccaagcctcctctcgttcctcaaacaaacaaaacatgtttaaaagttattatcaaaaatataaggcaaagccttttaaatttcattttcccgatttgtcactcccttgtaacagtttgaataaacgaatacctctgaagtaagctgttcctcctcaatgctcgtcaacagaaggtcatgcgtgtggtaacttgtctacgggtaaattccaatacaaaaatctttgttgctaatggagacaaagagaagacggagagaaaaaagaaaaagtgagtgcgtttttggggcttttgtgagaacgcaaaatgaacggcttcacaggggggcggaggaaaagcagtaagggaggagggtgaagagaagaggaggacggaggggtaggaggggggaaaggggagagtgggaagggggtaaagaggtgagaggggaaggaaaaaggaaagggggaaagggaggcggagagacagcag

SEQ ID NO: 10388 - DNA, 832 bp, Heterodera glycines
gagagagacagagggaagggagggggagagagaggaagaaataaagagaaataaggacagagagaaagctagagagggggatgagagtaagagagaaagagagagagaaagggagagagagagagaaggaagcgaggagaaagagtgagaaagaaaggggtagggagagagagagggaagggagggaaagagagaggaagaaataaggaagagagagataggggtagggagagagagagagaggaagaaagagagaatttgagaagagagagagagagatgtgaagaaagagagagggggagagagagaggaaaaggaataaagatagagagaagagatagaaagagatatggggacggagagagagagagagaaagatagaaaaatgggagagggtagagaggagagagagagtgaggagtgagagagaggaaagtgagagggagagagagaggaagagatagaggggaagttagaaagaaaggaataaaaagtgagagagaagggaatgaggagagagagatagtgagagagagagagaagagatgggtagggagagatagagaggaataaatagaaaaggagagaaagagagagagagaatatttgaggagagagagaacaggagattgagagagagagggggggatagagggttaaagagaaagaaggagatggtagagggtaaagaaagagagaatgggagaacgaggagagattaaatgagaaagatagtcacatagagacaaagagaaagatagagcaagaagaaatgatataaagcaagaaagggggcctttttggtgaaaagagtaaattattaaaactaaaa

SEQ ID NO: 10389 - DNA, 3111 bp, Heterodera glycines
  misc_feature (28)..(28): n is a, c, g, or t
  misc_feature (53)..(54): n is a, c, g, or t
agtgctgcgggaggtcgatgatgaaganccttccgggaccgctaagcgtcaannaggcgttcgagggcctaagccagcccaagaaaagggactaaaacgaaagacagctgggacaagtgaagacgaagttcgtgaagaggacgaagacgacgatttggattatgggacaacgaagaagaagaagaaacgagttggcacagcttcgccaggcaaacgaggtcgtccgatgggaagcaaaagcaaaacgattgccaaagcaaagaatgtgggacgcccaaaagaaggaagaaacaatgaaaaggaatccgaggacgaagacgctgaagttgtttacgacgacagagtttccgaaaaagaacggacgacggatggtaattcttatttaacttattttatttttcgttaaattagacgaattcgaagagacaaagccttctccaaacaaagcgaagacttcggttcaagcaaaggtgcctgctaagaaacgtgggaggccgcccgggcgtcgtcagggccaacaatctccggttgacagtggaaacaccgcgaaaagtgaaactgatgaggcgaaagtcaaagaagaggcgggcggcaaccaacaaacgattaacgtggaggcataagctgcggaagaagacgcgtgaaatgggaattgctttgaaatgcgtctttcctcatctgagggaattaccaccactgattttatttagccaaccaatatttatttgctttttgttggtcggtcgatatttcaatgagaattgaccaaaaataccttttctcgaaccattgtaattcattctgcttcaatgccgttaatgctcttgtcggtcggtacacaaaataacgccattggagtttttcgatgtattttgtttacccaatttctctgctacatttacttcaattagcctttttggcacgatttgattatcacgtttatttgattgaataaatgcaaaaaccaaatacttggattttgtagagttcaccggtactgttgtccaattttttttttttttagattttctcccagctttttataaagaaaatggttaagactttgtttcagcaattttgagaatcgttgtcagcaaaatatgataccaatcggagaggttaatttaaaaaccttttacatacaaattctttaaattcagacgaaagatggacgtgcagatatgtgagttctgatctgtttggcaatgtgtttaaatcactttaggacaaattttgagatggatttgttcgacacccaagtttatcgcaggggaggtaatccgtaacaatggctgcattcgagttccctctgcatttcagataaagatgaatcaaacgaatgttgcaaaaattcgatcgtaaaaccggcatgccttcccgtcacaattctcgcgttgcttttgttgatggctttctttgttccgatgcttaacgaggaaatgggcgattttgccgtgggcagcgcaaaaaaatacgaacggacgggcaaatgcaccgacgaatgcaggcaaattgaaaaaatgcacaaacggtcgactgttataccttttccgtttgcgttttgtcgagtcaataccgacgggaatgaatttttctgactcgtcgccgaggcatttgagtacttttcacgcgtggatggaattactacgacttgcgcaaaaagcggtggacattacggcattgtattggaatttgcgggacaaaacgcattacgaaacttcctggcaggtattgtttcaaatcgaaattttctgagtttgaaaacaaaattgttttactatttaggggaaagaaatatttggggaaatcgtagagactgcacgacgagatgtgaaagttggggtcgaattcttttgcttctttaatattttttcagattcgaattgcgcagaattcagaatcggtcttcggacctttaaatgatttgaaattcctggaaaagaaaggttttttatttatcccaatttttcccctcgttttttcaaggcattgtctccgtttcaacgctcaattttactgaaatttttggagctggtgtcctccacaccaaactttggattgtcgacaatcaacacttttacttgggttctgctaacatggactggcaatcgttgactgaggtgctttcttttggcactttcatttttttctttttgcctttaaaggtaaaggaaatgggtcttatgcttgtcaactgttcctgtttggcctgggaactcagcaaaatcttcaccatttactggagggttggacagaatcacaatcgagtgcccgctgcttggcctgtttatttgcgttcaaaatttaatgcccaacacccattggaaattcattttggggttgaaccttctcacacttttgtttcggtatgaaaattgtttcacgccttaatctttctgcccttttctttaagcattcacccgaacaattcaacccaaaggtgtccataattatttgataattttcctttcatttgtctgtagggcagagagcacgacctttccgccataactttttgtatgagcaaagccaacgaatttattcgtgtttctgtgatggattatattccggcaacaatttactcgccaaaaaacgacaatgtgtatgttctttcttctgtattattttcccaactttgaaaatacagcttttggccacccattgatgatgctttaaaagctgctgcttaccggggtatttgttgttgtattaaaaattagttacaacagttacttttaggagtaaaagttgaacttttggtgagcctgtggcctcattcacacaaaaaggctgtttatttcctccgctctctgctcgaaattaacgccgcacttccactaacaaattcggggaggaggggcagcatttccattgtgagttcgtttatttgcgttggtttatccgatttcttccagaaatacttccgggttccggttagtcctcagcaggctgttctggaatttgcgagggtaaaccacaataaatttatggtcaccgattcttgcgcttggattggtgagtttgggtcgtctttttcatgaagtgaacattttatttaaataaagggacatggatggtcgggcgattacttcactgcaactgctggtgttg

SEQ ID NO: 10390 - DNA, 2870 bp, Heterodera glycines
taaggaggtgtcctccggttctgctgatgatcagctttttgccgttttgtacgtgattgtacctcacaatatgcttttaattttacagtttgacagttgtctcaaatacactattagctattaataattgatctcttatgtctttctaacatttctttaaaatgtatcaataaatttttaatttatatttgcacgaaattaattatttggtaacataaaaatcagtttggtataccatattatttggtaatggaaattctctattccggccatatttgttttcgcttgaatatttccaccacgaatggagtgcatcggctgcttggctttccgaacttcgttctctgttttgctcagaccattcagttcggccaactttggtcagggagcacgggacattgggtgggttatcccatttaattttgtacaacagatgtgtttttagttcttgtcacaatgtttcgtcacgtcattcggccctccttgaaaaagctttggctccctttgtaccgcgtacggcgaaggaattggccgaatatttggccaaaaatgtcctctaccattctgtcggcgatgtcctcgtggtgcacaaaccttacggcggttagaaaaggctgaacaaaaggctgtttgatggactctatcagattagttgctactcatttcagttggctctttgggctatgttcaaaaggaatttggcatttttccgacaacgcaatacaaattcaaagatcgaatggacctatttaacggagtgaaagtgagtagggtcgctggggttctgcaaaaaaggcctttcagaaggatgattcggttactttggaggatgcaattccgcacttaaaagaaatattccacgagccaaagttacacttttgcaccggtctcaaacggtcggtccctttgagcctttctttgcgatacgtcctctttcagttgggtgtccggccccgtggtgcttccctgctctgagaaggcttttaaaaacatcggtcacaggttcttcctccaatttggtcctctcatccattgtccttttgtgccctttcagccttttccaaggagagtccatcagtcacagcaatgagcattggacagcccagcacatgcaccgagcattgtttgtcgggtgaactcaaacaaaagtgaccggaggcctttcttcagggcaatttgcatttcgcgccctcccagagacgaaggtgccgtcgatggctacgccacgttccaagacacgagccgtgccaacgaagtgagttaatatgacaaggctaatgggtctatcgaccaattattacaacaataaaacccgtttgttttgtttccgggtttttagtattgcctttcatcttttctttcagtatattttcgtgccttcggtaaaaatcagaaggcgggcgaggtacgggaaatttgctgtgcagggcgaactcttctaccgcgtgcttgactcgcagtgcggactttcactcctcgacattcatttctcaaaatgtgctttttttagggtgtaggaatgtaatttgaaaacaaaaaagcatcgttttttggctgcgtatttatcgaaaattaaattgctattcccagaaaaggatagaggcaaaacattaagtggcgttctcgctcgacataaattttgactttcgtttcagtcagccgacacttcccccggctaattctctcccatttgggctgtccaatctttggcgattggatttacgagcagagattgcttaacgttgacggacatccgatctgtgccgagccgaaggacgtgtggagggctgaggcgaaaaagttcgagccaagcgcctttctcaataaaatcggcatcggaagtttcggggagttgcgacctccgccaccccttttttttgcggtgtacgaaagcactttgcctttctttggcactacgaaatcggaaagacgaagaaccaatctcgtctccagaacaccgcctcctggtgaaaaaggacgaaacaaaatttaaaattctttgggaatggttgaagaatttttataaattattccaaacaacttctaataaagttattttttacagtaaattgtttacagatcatttcatggccatggttgacctgctcaacttcggaccatcagttgaaaaattgctaatgtcgcttgaacttggagaattagaagaagctgaaattccaccgaccgacaaaagcactaaaagcagcggagaaacaaaattttgaatatgctcaaacatttccaactttaatttgatagaaaataagtttgttagagaaacagccgtttttataattaatttataaaatgagtttaatttggacaactgtgaaaggagttgcactcaaaaaccgtgttgtgtgcccattgtcccccaccaagttgacttacagaaaatagattcattctatcggtgttttgcgctttgtcactttaactgtgcttagaaatgccgaaattgtcccccccccccccctccaccgaatatttcataaaattgcttatgtgcgaaagctgttaacaaattatgtcaaaactcccctttccaaggcggcgcctgtcggcaattgttatgatgaataatatgaaaatttatgcttaaatatttttaaaaaatgtgtattaggtctttttttaatcatttttggcaatgatttacttattgttattgtggaaatttcgatggatctttgtattttgttttttttaattttgtcgtcatgttctaatgcagcactttgactgagagagtattggttgaattgttttggctacatgagtctccattatttgttatttttcactttctttttaactaaattcttccaacgtcacttttattgattttccattttatggtttgttcttaa

SEQ ID NO: 10391 - DNA, 3768 bp, Heterodera glycines
  misc_feature (3587)..(3587): n is a, c, g, or t
  misc_feature (3606)..(3606): n is a, c, g, or t
ccggaccttctgccctcgtgaatgatggcgaccgttgtggtctacccgttgttgctaaccacgaagattgtctctccctaatttttgcccgtccttttcctctccccttacgtattgtcccccggtatgatgtcttcctttttctcttatttgtacattttggttgcgagatggtagttctgaactgtgtactgatctaattgcattttttcgcataattaaaaagaatattccgaaactgttatctaatagcaaattcaaaaacaatgatgtttataccggtgcatttgtatatttttgacagccctgaaataaaaacacaaattgagaattcatattttcggttgcgtattttcctttcatgttcgggatcgtaaatttccttactaagatccctattggtgagatttagtgattacctgctttatgagataaatatgttaaaaaagaattcccgaaggtatagattcaagtgattccgagaaattaaaaaattcgttaaatatcgtctacaataacattttacacgacgactattaaataataaaatcattgattgattgattgtatgtcgtcatattttagcaattagaattccttccgactacgcataatatataggtaatttgcattttttattttcattcattttataatattattaacacattaacaaaatggttttcatcaattttattgcaattttgccatttcttacaatcttttcggcagttgtgggagcagacaatttaattcagaatggtgggtacgaattcgattcgacacgatttgactgggttttaaaaagaaatagcattttctatttgtaaaatttaggtaacattaattataaatgattgaaaaagaaattgaaaaaataatctaggatctattaaaaatgagaatttttgtgcattatatttttgattttttttaaattttttgattttttaattttaaaataagatgatgatgagctccttgaactgttccaaaaatatgtgttgctgctcaaaaaatcggagccaattttggaaatggaaaaacaattatttaacattgaaacttacaatttcaaaaatgaatttttgctcaccgaaataatgaattttgcgctgaatttaaatgccaaaaatgagacgcaatttgctcggattattaacgaagcgacggccgatttgaccaatttgggattattattaacaaaaaaagaccaaaccgaggaggggcagcaaaacattgtggaaaaaatgacaaaaatatgctattccgaaagcttttcattatggttggtgaacaatggcattttgctgaaaaatgcaaaatggagaaaattccttctccgcaagggtttcattaatcaggtcattttttagcaatttgttaattttatgacaacaaattataaggggggggggtaattaattaatttgtgtccgaaagcataaataataataaataaacttttaaatattttttaaggattgtccttttttcttagagttgactgtatgcttcaaaaatatgctaaaatttataaaattgcttattttaaaacaaaactgttaacaaaacaactaattttaaaaaatagacccaaaagtattttgggaaaatctgaaagcaaatcctcccaaatcgattaaaaatcgcgaatgttaaatcaaataatattttaagcttttgaattaggttttaaaggtgtccttttattttgtgcataaattttttttcatttcagtgatgtccttttgtggaatttttgatggaagcccggcttttaaatttatttttcgatttttggatttatttttatgtcttattttaggcgtcctcaatgcttttattttttaggctcaattcgatcagattaagccatcagaaaccgatttgaaatggtccgaaaagaattgtgaaaatgaattgggcattcaaaaagttatgaaactttttaccgacacacaatgtgaagtgcacttctcagtgatacaaaagctgattggcaaattcccgggtttgaccaaacctttcgccgacaaagcttgggcattaccacggtatcgaaattacggtaatgaattaaaaatagaaccaaaatatttttatttcttcgtaatttaagcgctatttaatgctgaagaacaaattgaattatacaaatttatttttaattcggacgagaaaacatctcacgaaacggagacgaaattggcaatgaaacagttaattggaatggcaaaagaaagggaggagagtctttttaaaaccccagaaattgcggacgaaattcgaaatgccaaaacgcagacttttacgatgatggcactatccgaaactttttgtccctccaaagaatggcccatggatcggatgctttgtccacttggacagtacgtccaatttttgagtgaaatggccaaaaatcggccgaaaatcgaatgggaggccccgatttggtgctttgcacatgatatcaacgaaattttcgcatgggtacgacaaattttatttggaaaacgggtcgaatttttcaaaaattatttgaaaagagagacaaacggaaaggacgacgaaatcatcagaattatacgagaaaagccgggtgcaattttgagactacacaactttgttcagcataaattaatcgaggaattgtggaaagacgagcaaatccgcgagaagctttacaatgtgaactgtaagtgaaacggacttactaattagcactaattaatgacgaataaaaggagttattcggtcgattggggtcaactgctgataactttttttttgccataagattgggtcaatttaattcttaagctgaaaatgcgtcagtggaaaaggcattattaagtattgttgactaaattcaaaattggttgcgttctgatttgataattcggtttttcagacattcaaaatttaacaaaattttttaaaattaccaaaatccactaaaaattctgattaattaacgcattttgcactgatgcttttccggtcattttttaaaaaatcattctgatttagtttttcatggcttttttagtcttctccaacaaatcgcgacttttgcacaattatcgccgtgcaatggccaaaagttcgtcgcccattgagcgcctcggcgcccgtttggccgctgacattgcggcgatggccaatcatttgtcggccaaattcccaaaagttcagccccatttgcgtgccgctctttcgtcgtgccaatcgttttctccgccatttgcatcaaattcgaatttgtcttccttttctgaactgctcgacgtcgtttgggttgaccttcgctttctttacgataagtcagacccaacaatttgtgatgaaagaatctacaaattgacaattatttttgtgagcaattatttatcgggtgtgttagtggctttggcaattagttagttaattaaaccataataaaatggcttatgaattaccagttcttttcataatcacttatttacagtgaaaatgtaatataaaacaaaaattgagtgatttaacgcagaaattcaaaaaacttttccaaacaaaaggttttaaaggagcgaattgtgtattanactccgctactttggttanaataataatttaattttgctttttatttttaaaagaatattttttagttaaaatttaaattgtaaaattataaaaatgggagaataattctcgtgcactttctttggtcggattgtcaaaagcccagcctttttgtacgcttttgcataattttattctcat

SEQ ID NO: 10392 - DNA, 1731 bp, Heterodera glycines
  misc_feature (24)..(24): n is a, c, g, or t
ttagatgagaaaaaattcattganaatttattgcaatttttgaaaatgggcgacataaaaaaattatttgaaatgaacggaatcacatttaatgagagcggcgaatttattacagcaaatgaaattgaggaaaaaggaaaaaatatgcagcgaaatgaaacaaaaaaaggaaaaggaaagaaaaaaagaaaaacccaaaaaataaacaaaaaggaggcgaaagagaaaaaggaaaagcaaaaagaaaaagagaaaaaagcggaagaaaatttaatggaggaaaaagaaaaagcagaagaaaaaacaactgaaaaactggaagaaaattcaccagaaaatgagaaggaattggaaaagatgaaagtaaaaagtggaaaaaacggaaacaaaaaatcaccagaatttgttttattggagggaaatccaacggaatttgtggaaaaagtgagttttaattgattcaaaatttataaagaataattaattatatttagcataaagattttattgtgatcaattgtgtggccgagcagaaaagtgattatgaaaaattttgcaattttattcgaggaaaaattcgatcgaaaatgaataatttaatggacaaaattggaatgaaaaattcaaaagaaattgaaatttgtgaaatagacacggaaattaacagagaagaaacatttaaaattgtgggcgaattggtccaccgggaattcaggtgaccaattattgttcgggttaattaattaaggtggtgaggggataaatgatcatgatttagcgttttgagtaattaattagtgaaggggtagtaattcataagcattttgtggagatattaattataattaatttaattattatttattggcggcataacttgcaattttaattctctctattttgagaagtttttgagaggtaattaatgcaaatgaattaatttaatttggttcccaaaaaacacaattattaatttgttcaaattttagcattaattttggcaaagtttggctttttggcattaaaataccagcgaatggcaacgaaaaattgaaggaacacttgaggaacttcgatattgaaatgaaaatggaatatttgcagcagttgggccttttgtctgttgaaatggacgaaacggaaataattaacgaattccaaaaattgggtgccaatgttttgtcgacggtggcgaaaaaatggtttttgatggacattttggaggagaaataataatcaatgaatgattggattgattcatttgtttttatttatttttgaaaattttttctaaattttctaaataaaatttttgtgcggcaaaagcagcaaaaatttgactaacttttattaattttgaaaaaatcccggggtttattttgatttggacctgtaaagcataaaatcgctttattcaacccaaatcagacattctcatatttttcaccaaatcataattgtaatacctaaaaatagttagttttaatttaaaattaatatttttataaattttatatttttacatttctttctttaccaattcacaaatcgcctgctgtttggtagtaaaacaggaatatgtgtgtaaattattttataataatctttgttcctatgaatgcattttgcctttaatatttattattcatcattcggccatttcaacaacaatttttggtaataatttgaatttgaaatatcaaattattcactcttaattcgatgactaat

SEQ ID NO: 10393 - DNA, 3935 bp, Heterodera glycines
tgatacgctaatgcgttcattcactcgtcgattctctcaacactttgaaattcaaatattttgtgcaaaaagtgatacaaaattcgttgatcaatcaaaaaatgattagctgacaaattggtgatactctggcggtacttgccctctaaattttcgggtctttttgattagccatttattgccaatttgtctttggtcctaaatcccttctttcttcatcaatgaatataacggtatttcacatttaacttctgaattgcaacaattggggtgggcagttacgcggagacggacggtcccggggggcgggggggggggggtacggtaaaaaaccaattcctactgttctccgtgaatatttcccggtgattcctatcggaactacaggtccttctaatcaaatttgttttaaaaaagacagtaattttttttggctgcattagagcccaaaatactgggggtggcgacggtgccccgcccgcaagccgaaaccctgggggaccgtgcctccccatgcaattactgtatttcgtcttttctttttgttttgataaaatttgagtttaatccagcagcaggatcatcaaatttttgacaatctctcacttggttgaccacattggtaatactgccgattacaacatccgtttttgccaatttcggacccctgacccgaactcgaacaaaaagtcgaaaattttcgagtttttgggtcgaaccatggatggtagatgagggtacccttggtacaggaagcctgtaaattcattgtccctgatgtgatgaatggtagcgctggtcagagcccgaattcgtgattagcgacttcgaaaatcccttaacacttatttcattaatttctaaaattaaaattttttcatttaaaaatgtgtgttaaaagtataccgtaaacccaataagtacccaaaaccattgcaacatcaaaaaatggtcattgtgtacaggtacgaacataaaagtgaattttgaaacttttgaattttcgacttttttgttcgagttcggatccgggattcgaatttgatcaaaaggaatgttagattcgagattaacgaccctaaagaccccataaaacgtgttttcacgattttttataacagaaaaaattgtcaaaattttgaatttgactatagacaaaaataaattcatttagaaaaatcgcgttttctctattaacagataaataaatacgcaaaataagatatgtttttttctcaataaggatgttcattcatcattagtcgaaaaactggaccaagcctaaatttcaagaattggagcctgaccagggtagaaatactcattgaaagcatacctgaattccactttggctaattttgaaaaaagaaagaatttaggaaactaatagaaatgacgaaaattctaccaaattcaaatgatatcttgtgaaaatacggcgaatagaggagagattcattgttggaaatggtggcggaatattgcggaaaagagggaaaaatcaccatttacttgtggatgcatttatttgtcgaactaattgtccaaaaagtactgccaatagagaattttgaattgttcaacattaagacggcaaaaatgcaccacaagagaccaaaaattgaaatggatcgggaaagaaaagcaaaaaataaatgattgaatatgggaccaccgttcggatataaatcagaaaattgggttgggactgccgaatacccgctcacaatcagttcatttgttccaactggtctttgatcttggccgcaaaattggtgagagtaaggcccaactcggccagaatagacacaagcagctcgacgttggcagccccactcacacagcgaggaatgtctaagaaaaacaatggaaacgaatgatgggcaaatgaaaaagatcaatgatccaaaaataggaagtccaatgccaaggcgactcaccaccgagttgtgtctccaatttcgactccggtttaccatcgtccaaatgcacgtccaatttcggctcctcaaattcaacgccgtctaaatgaacgtctttttcggctcaaaataaacgtcaaattctgactcccccggcttaccatcattcaaatgaacgtccatcttcggctcctccgattcaccgccattcatatgaacgtccatcttcggctcctccgattcaccatcattcagatgaacgtccattttcggctcctcagattcaccatcattcagatgaacgtccattttcggctcctccgattcaccatcattcagatgaacgtccattttcggctcctcagattcaccatcattcagatgaacgtccattttcggctcctctaattcaacgccgtctaaatgaacgtctttttcggctaaaaataaacgtcaattctgactcccccggcttaccgccatctaaatgaacttccattttcggctcctcagattcaccgccatccaaatgaacgtccaatttcggctcttcctgattcaatctgtccctcaaatatgacattatgacatcacctaaaaaagcatttagcttagtttaaacaaatgagccagttaattgcaaataaaccttgtataacttctcctggtttaaaagaagctgaaataagctcaacgggcggtgctgtgagctttcgttcgcgacgtccgggactaaaaaacgcaacgatgaaatgatagtgacattcaaaattccattttggttactcactcaaagccattgtaaaatgcccgcatttcatcggtgtaaacgaattccttctttggtcgctggggcttgccgcccctacgaaagggcgcaccaaccgccgcgttgccgccagtacgcgggccacggtaaccgccgccaccgcctccgccagtgtatccgccagttcggtaaccgccaccacctccaccgccgtaacctcctccaccagcactgtgaccacctccaccgccgtaacctcctccaccagcactgttaccacctccaccgccgtaacctcctccaccagcactgtgaccacctgcaccgcctccgccggcaggtcgactaactgcgctcacaccgccgacgtttccgtacattttaaaatttgctaattgcaagagaagataaatgtaacactaacactgaaaatttagaaatgatgaagcgatacacatatatttgtaataattttcgggatgccgcgagatcaatcccgcatttataatttgcaggaatttgcgggattaaatcacttttttgcggcgtgctttttccaaggaacttttggtgaactggggcggtggtgacgccttgaaaccctttaccgatttcctaacaaattttgtccaaaacttaattttggcattttgtcattgcgattttcaaagaatacacggatcccgcgggagcccgcaccaaaatcaaatttacggatgcgcggcggaattgaaactcaaaatttttgcatgacgggaagaaatgtagttattctctttgatttagtgcctatgccaacagtacgagtcggggcagtgcgatgggtttttactttttttttgttgttattttcttgtatttatattctagagactttaagctttctttggtaccaatgatgtaaagactattatggcctaataaactgaggatagtcattgattggatgcacaaaatccgcaatccctggaagaatgggtgtccctaatttaacgtttttatttttggctcaaaattagtttccgggggttttctaggatgctgattacgaatctgaactcggatttgcccaattccgaaacccggacccgaattctaacaaaaaagttgaaatttttttttcaaaaatataagttaaaatcggtcaaattttggcaaaaaccgcgcatttatatccgattaacactttgaagcattgtattaatccaaaaaataatagtgggtgcatgaattatagcttttat

SEQ ID NO: 10394 - DNA, 391 bp, Heterodera glycines
acacaaactttgggtagctacaattcgatgtgcaaaacggggaagacgcataaatatacaacatatacagggcacacaaatgtatcattcgtcgtcagggctcgtccgttgtgagaagtgcacatctacaggttgtaaatgaccggcagattcttgcggcgcaccattccatcctcggcgaaccactccagcttgaaaacggtggcggccgggtcgggcgtgttgcaccactccacgatcacgcggtcgttcttgatgtcgtcgttgttcgggtcgaaggtcgtgacggtgatgatcacgttcacggcgtcgccaacgccgagcgtgccgcacggagggttcaggaagatgcgcttcggcttggtcgtcttgaaggcgtacccaatgcgct

SEQ ID NO: 10395 - DNA, 4555 bp, Heterodera glycines
cccccccgtagtaggggtcagttgcgtctgagccaagcttaatacatcatactttttttcaggctggccaaattttataaattttgtatcattggaaagctctacatgtttagaagctttttaagttatttctaagcgattgaacaacttattaaaaagttgaaacatgaacactgccaaaaagtcagaatttttgcacattttaactggcccgtttcggttccccccccccccccgccgcatttctcacattttattgcccggaatttatttgcttaaaggatgaatcacttccatcacccactttttgattacgggaaatgggcgagaataaaggacaatttgcactgattgggggtgggggtgagtcagaagaaaatgtttcttcggcttctccttttcgggagaatgaatcattcgtttgtcaaaggaccaccaatttgataggtgaagattaattgctgattatttcattcgttttgccattttctttggcttaattaatcaatggcactttcgccacacattcactaattacccaaatgctttgttttgccacctcaaaatgttttcctcaaagcttcgaccaattcaaaagccgatcagtttcactgatcttcatctttttgctgacgattcatcttttatttgcggaaattgcttcggaaaagtcatcaaaagaaacatttaaagatgtaaccaccaaaaatgagttaattaactgattttaggcagtggaaagtaaaggggagaggacaatgagccgaggggggggggggtaatcacaaaattgggcttagtggcattttctaattttgctcctatcctcgacaaaactccaaaattatttacttttaaactaatcaccgctaattggccaatttgaaacaataattaccttttacagtctctggtgcaaaattcgccaaaaagcgacctcaactttctattccaacaacggagcactcagaaaacagctttcatcagacatcattatgcttcttccgtagcaaatggccaatctggacaacattctcggcaccggcgacggatacccaccggaattattggcaaattaattgccaaattaagcggaaagacgggaaaaattgcagcgactgcaagcaaaagcgatgatatttttgttgggaccgcaaagggtaaaatgaagcctcaaaagggtatgtctgtctcaccaattccccattatttccaaagttggacgaattccaaaccgcgggacagcgcccggacgcttttacaaatcgcgcgggttcgaccccccgccctttgtctcttacgcggcccccgcaggaagcgaagtggccaaaaggacgagggcaaatgcactgacggggacaaaagtggcattggccgccgcgggagtcggcacgggcatttggtactttggagcggagaatgccggtgggaaagggacgaagccaatgtttttggcaaattaaatttgaaagcaatccctttttatttttttttagctctttacgtcgcatttatcgtcggaggagtgctcatcgttttgattttggcactttctctgcttttttatttgtttttgtgccgaaaacggaaaaagggatattatgcggtcaatgagcaattggcttcggcatttgccaagaaagtgctcttttatttgttctgttgatttttcatttttgacaatatctctacatataatttcttttttattatttttttattaatttattttttcaataattaaattttttataattttatttttgtttccaaaaaatcaccaaaacgtaagtaaaaataggattgatagaataattgtgttattttttgtccaagttcgtccccctttcgctcctccgccggttggtgccaattttacgcgactttttaagggttctacaaaaacattttacaaattaagccgggaaaatttaacgaactttcgtgcaaaaattggtaacgggcatagaaaccagtgccatcgaaaatagcttaaggaaaaaagaattatcatttgtaattttgaatacttaaatatcagatgaaaaaaggaaaaaacgctgaaaaatgaaaaacattaaaaaaatgtattttaattattattatatatagaaacattaccattcgtatgaaattgcattcggaaataattcgattcgctttgaacggcgccttttggcctcaattggccgcagaagcgacgatttgtccttaaggcaacgaaagtgtccaaattggcaaaatggtccttttgctaatgacctgtcccgggttttgtagttgctaaacagcacaaaatcactttgggtggactcctcgcaactgaaacaaaacattcgcatttttgtccattaatcgcttttctttttactgtccgaagccttcgacatcgaaataccttaagaaggagtgaaaaaggaaaagcgaacaaattaatgatcaattagtgttaattggtgggcgaccaactcgaaagtgatgtacaccttttggcccggccttccgatgaaaacgtattggcagtcgacgttacgggggtaaaagcctcaaaatgagtcggtaaatgtgggaacatggcaatggccaatcggccgtgttaattacccgggtaattaggactccaaacatttcccgtcttttttattgtgccgttgaacacaaaggaacatccttcttcagtcaattgttttagttgggtgttaattagctgatttaaagataaaactcacttgatccgtcatcagccgaagcaatcgcttcgattggctgcgccccgaaatctttgatgaagcgatattcggcaatctgtgccaccaaattaattaccctcccattaattcccccccccccccttcccgttcccacccatccaaagtgttcgtcttccgtttcgtctctctcgcgaagtcgccaatcgcccgcccattttcgagtgttttgtgttgggttttgagcgaagaaggcacttttgagcacgtaagtgagagtgagcacattctttgcggacattagctgagccggcaattcgtcgccgcaaaagtcgtggattttggacattcgatcggaaagctaaaaaaacgaaatgaaaaaaagggggaaaagaagaaaaaattaggaaataaaataaatagggaaaaacggataaaaaagagatttaatttgaaatgaccagcacatgcgccgagagatggtcgttctcttcgcatcttaagcaaacaatttgcccccattagcctcactttctcaccttttcgtcgtcacattttgaatctgtcgcgaattcagctgaaatcgctgcttcaggcggaaaaaatggaaaatgatttgaactttttcgtctggggcaccaacaaaaatgaattggcactgaataattaatttggtcaaaaagtgtaactgctttgccttataattggccattaggctgttctccgcttcgggttcgaagtgctcactgaaaagcaaagccgtgttattttgccacggcatttcggtggagccttggcccatttgagtgtccgaattcggcccaaattgacgcaacaatcgccccgaagtctgtccaatgaatgcatcaatgaatcaaaactccaaaaattggaattttcacctcatttggcccatttccattcagtaacccattcgaaaaaacccgcacagggcacgacttttgctgggaaacgccaaaattgaggagaatttgccaaatgaaccatcggaatagccaaaggaaaggcacggaagacaaaagcatggcaaaagcttatcagagagtgtggaatataaagaaaaaggcagcaaaaggataattgtaattagcagagacaaataattagcgggaaaattgagtgaaagagctaattaactgtaataatttgaggatgcaaattgaaaaattttaaatattatttatttagcaatgccattaacttttttggccattcgatggcatttcccccccccccccccttttttcctccgtcccttttcttcccatttcatctcgcaaattgatttagtcaagggccaacaaaacgaagtacgacgacaggaggaggacggacatccaacagaagaaaaagaagaagacggagaatggcaaaaaacgacgcaatttggggacataaaaaagggaaggaattgggagatgaataaaataatcgcaaaacttggagcaattctcacgaaaaagaattgtcaagaaattaccgtatctttttaaacaaatctattggtaactcttttcaaaataaagcctaagcatatgcgaccgaaaatgatgagaatgaaaaagccattgtccgttcattcgccgttcgttccgccgattgtttttctgcttgccggtaaataccgtacgcggacattcgctgcttccgcgacgaaaagcggcgcgttttggtgcgtccattcggtcggatggtttctcagccgtttgtccacaaaatgagttagcattttgttgtgccctctgttggacggacttttgtgagaaatgtcgccacggatcttagcaatggagacaaaagcaaaagaaagcatttgatggcattaa

SEQ ID NO: 10396 - DNA, 3726 bp, Heterodera glycines
  misc_feature (1222)..(1222): n is a, c, g, or t
  misc_feature (1261)..(1261): n is a, c, g, or t
  misc_feature (1267)..(1267): n is a, c, g, or t
cttttattatgagttcgagaccggttgactgtttttcctttttcatttatttttatatgattaataagattttttaaaccaaaaatacacattaaaatcaatcatccttggcataatttatagacgtattgaacccaattttattttctttgaataaaaattcaattttttgactaaatcatgaaaatttacaaaaaaaaaagaaaaaaaataaaaatttaccagaaattcataaatttttggtgaaaatatgttacaaaatagaccctaaatttcaaaattcacccggcgctgcctatcggcatcgccggcgccacaaaaaaacctattttttcttaaaaaaatttggcccaaacaaaaaaaagaccaaaaaaagatttatacagattttcgctgaaaattaaccattttagatgccttaggttgtgtttttaattaattctatacaaaatatttatgataaaaaaaataataaaaagcacataaaattattattacgaaatttaaatatttttaagcaaaaatttataaagttttttgactatttggcataaggcaaaaattgaaaaacctcgaccccgaccccgaaccccgaacgatttggcaaccccgaccccgaaccccgacacttccaaccccgacaaccccgaaccccgaattttcaaaccccgacgtcggggttgcaaccctaatttaaattatcaggaaacggattttatatgtgctaaaaaatgccaaatgtacatgtacttttatatgtgccaaaaaacccataaaatatgtgctaaaaaccccaaaatcggccaaaatatgtgccaaaaattaaaaaaaaactgcttgaatttttcaaaaaaaatctcatttttacccatttcacaagcacaattctaatcaaaagcatttcaatgctttttgaagcatctttttctcgctttctaagattttaatcattttttggaattttcttctctgaaattaaaattttgccttaaaagtgaaaaaagtaattaaaaaggtcaaaaagtacaacaaaaaaaaagataaaattttgaaacattgttggacattttgccaagaatttaggtgtcagaaagccgctacttttgaaaatttgtcaaaaaatcgacaaaatatgtgctagaaactaccaaacccccaaaatatgtttttattagcaaaaagaccaaaatatgtgaatgttaaatactataactttaagtanattatgtatttgatttttcattttaatacccccttttgngacttngaaaaacgtccgatccaaccctcaaaaatatgtaaattttaattcttctatagctctaagggttttatacatagtagtctgtaaaatattaaaaaaaaatttttaattgcaaatttcaaaaaagttatggccatacaaattcaaaaaacttgatgtttcgaacattttttagcctaatttttttttaaaactgaacaaattttttgaaaatgtccgtccgcaattgtccgtaaaacattttagcatatatattttcttcgataatatgttttaaacgaatacacatattatataataaaagccacgttattatattattgatatgctggggatgttttatattattataggcataaatatttgcataatgattgttgggctgacgtcactatgtgtataataaattttaatgttgaaatatattgtattgattcttcgattttatgaaattattcgctattacatacattcattttaaacaaatacgagcatttaaaatttattcaatttattagttattaaatttttatatttctctattatataaatgattttaataaaaaatatattaagatgataatattacatttgttccttttcctttcatcaattttatgctgttttggcacaaatggagtgcaaagaaatgaacaccaaaatgttgctgaggttcaattgaacgtaattaaatttaaccataattgtcataaagtatatctcactaatttgactaagacatgaagtgagagagagagaatggttaagagtgaaagaaagagagagactgagacagagtgatatgagggtgagatgagagagagagagcgagagagagagagagcgacagagagagtgagagagagagagagagaaattgataaagaaattttttaattgggctttcatgcataatttaaaaataaatatgtatgtatttagaatgtaattgatcctaatgacttgtcatcacctgggaactttgttgaagacgaccacccgccgaagttctttcgcatggacatgagtaaataaaattttgaatttaagataaatatatttatttatttatttaaaataacatcaggtcgataaaaattttttctagagttcttaaattattaagaattattgggtcttgaaaaatccaatcccatgcctaattaaaatcttactatacctgcaatctttgtattaatggaatatacatattgaaatttaaaattttcttagataacacattgccaaaaacttttgctgaagagccattacaaagaaaacggcgagcaccagaaaaatatgggacaggaaagaataagcaggcgcaaaaggacaagtaattagtaggggtgccaaaaatatgtacaaaatatgtaagaaaaatcgcgaaatatgtacaaaaaaccacaaataccgaaaatggaaaaatttttcaaaatattaaaaaattcaaaattttgaaacgcaaaatatcatatttctatttcaacattttgggcttttataaatttctttgtaaatattttggcatttttcgaatttttcatgtaaaatttcagaaactttttaacaaaaatgcaataaaaatgcttttttattgacgcgatgacattttttggagaaatgttcaaaataaatttcaaaaattttccactaaataaatctgtcgaaaaataatctccctgtctccattagtctgaccgtctctaataatctacccctttctgtgggggttgaaaaataatatacctgggcatataaaaagagcaaatacggtatgtatcaaatatgtaaataaaatttttaaaatggttattttttggaaaaaaaatccctcgtaaatgatgaaataggcacaaaatgcaataaaaattacttaaatatgcttagaatcaccttttaatattttaaatcactttttttagtatttttcaggggtacattttcaaaatatgtaaaaaaaaatgaaaaaatgtacaaaaatattttccgaaattttggatttattttttaggattttcaaaaattttcgtaaaaaatccttaaaaatgtaaaaaattaaaatatttaaaaaaaatccaaaatatgaaccaaatatgtaagaaaatctcgaaatattaaaaatattaaataaaaattcccaatttttagtaaaaaaaataaaaagttatgagtaatctcgatcaaaataggacaataattttgatcaaattgagaaatggccaagacaagcgaacaagttccaactacatggaccttgaaagtccgggatctgccctgtcttctgtacgacgatctgacagtgggaaaagcccgaaaaaagtgccaagatttgccgaaagtccggcatcatcatctcgatcgtcagctcttgggcgtaataaacaaattaaaacgactcttaatgttgacatttcatccaacagtgacaatagtttggaggaaatttacaagagactcaa

SEQ ID NO: 10397 - DNA, 1264 bp, Heterodera glycines
  misc_feature (52)..(52): n is a, c, g, or t
  misc_feature (128)..(128): n is a, c, g, or t
ttttatgtaatttcatacaaattcaattttttaaattcacatttttctaganaattctttaatactgtagaaaaaattataaaaattatacaccttaattaaattcctcaatttcaaattgacttatntaaacaatatttaaacattaattacaaaatttattttttattttttgctgctggctattggtctgctgctgctgatggcctctttctattaatgcataaaactttccattgtggcacgagtgggcagccagtgccaactcattttcacttaacccgcacatttttattggcaaaatgccctctcccattggccaagtgccgtccgtcgtcattgtgctatgtccactaaagccccccccgccctcactcaacgcgttgctgctggcaatggccaagcaaatgcattggccattttttttcaactcaaagctggggccatgatgagaaaaagcacaacggcatcaccaccacattggccaacacggcacaaaaataaaataataataatactaataataataataataattgtcgggtggcgacgagtgccgtgccctcctcctcgctcgtcggttggcaacgtgccgttgtcccggctcgggctgctttgtcccatcccatcccaacccactcattacactaggcaaaagcagccactctcggcacacacacactcacacagaaactcattttagctccaaatgatgaagcaaaatgcatcatcagggactatacaattattcctatggttgttgtgattgtaagccgccgccgccgccatggcttataatttcaaaaacaaattttattgtacttttattcgggtgatgtctaatggcactgtattaattattggtaaatgataattatagtaggaaaagcactttcttttgtgattttgctaaaagttgggacttttaattacagacttttttttacatgttttggcatttttttcacatccgtctcaattagttagtatcagcagcaggcggaaaatttcaagagattgcatgatgcaatcacaaaataaattatccattgtcaaatttaacattatgttatcattaggaattcatttttaggcaaatgccgaaaatttctgcgcacttaataagcatgaaaaacgcattttccgcttggtttggggtgtctacgatgacttttataaggcctaactttgcctattttggagtttttgtgcttgaaagggcctaaatgcctattttaaatacaccccctagagaaatggacct

SEQ ID NO: 10398 - DNA, 2434 bp, Heterodera glycines
  misc_feature (2336)..(2336): n is a, c, g, or t
catatccgctctttcttttatggatcttattaaaccccctttccgcgttttaaccgcccaaccagcttattcttggcttataaatttctgatagctcgtaaacgtccttttttataaaaaaaagtccttaaaaacttcgattactctgtaaatttctatctacaaacttcgacatttaaaaatgtatacttctatacgctcggccaaatttctaggctaatttaaagcaatttaacatttaaatgctattgacaccaaacaattaattcgtgtgaaaaaattaaaaagtgccaaagtcacgctttgaaacattttctgactacaaattgttttcaagattgtttgactttttaacaacatttaaaaattgcgtgctgtaagcatttcatttggacaaccacagattaacaatttatgcgaggcgcaaatgagcggtcggggtcgttttcgcgtggccattttcgcgtggccgttttcgcgtggggacgttttcgcgtgagtacctgtttaggactgaaattggtcggatttgtgcaaaacatccatgtttcgaatcccgaacccgaattcggacaaatttcttgactttttaatttttttatttcttgcggctagtatcttctacagtaatttgtcagtttggtcggatgtgcgtcaaacggaaaaaataattaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgattgttattgatgtcgttatagagtgcgccgtcatgttctaacttaactttgtttcgttttgttttaattttttgctgctggtccatattatataatttaaatgggtcggggtcacttcggcgcggaccatttcggcgccgcaaattttgaaatgctataacttttttatttgtcagttaactttagccaatctggcatcatttgaaagctctatgtgtgctctatattcacatgtcaaaatagaaataaatgattcaaaaataaaaaagttatggcacacggcgccgaaaaagccaagaaaaagtcaatttttgaggttttttggccacaacttttttgtaaactgactaaattttttgaaattttgcaatctaatagagaatctcaagagctatcgaatcaaaaatatttaatttggttgataatgaaaaaagttgttagcaacggcgccgaaaaggccggcgccgaagtgggcggtttacgaggattttttttttccaaaaaataaccatttgaaaaatttttatttacatattggggtttttgtacatattttgggatattttaatttaaaaaatgacaattctagaataaaatctgataaaaacttgtccggatcaggcacttttggtgcccgaaagtggtgcgatcggcttccggaaaatgaccaatcaatcactgagttttttgtggaacgcacacactgagcttttttgtggaatgactcaccacggattttaccctctaatccctaattaacatcatatttttatgtacattttttatttattaaataataaagtttttatttttatctcatttttgccgttttcccaactctttcgcctgcagcagtttgtgcctgtctttttgggtcaccgttttgccctgaacaatcaaaggcaattcgaataatgcataaatgaatcaatcaaataacctttctctttttattatcttttgtccatcccattttctctcattttaaagcattaacagtacaattatggtgaataaaaagtatattcacaaatttttgtctcaaaaaaattttgcaaaacaaaagtcactcccccttttgttttgataaaattaaaaatctgtcactttataactagcgccaagtttgttaataggcccaaataattgtcatattcgtgatcagcgacctctaaaacccccgggcacttggtttcatgactttataaacaaaacaaaaaaatttaccaaaaaaaagtttaaaaaattttcaaaaacggtgactttttcactagcgcctcgagatttttagtcactaaaattcctagccctagttattaccaaaaatgttgtaaaaaacttggttttttgagcttctcaagtcctcccattggcacattgtccaacccctcggacgccaattggcaacaatttaaggcgaacaaaattcagaaattatttggataaaatgtgatttttacgtttctttcatcaagtacatactataaggacactttggaaaaccgaacaanatctcaacaactaccaaaaagaaactgataaaataagctaaataagaaagaataaatcttttttcacatttctgtttattttgcgaacagaaatatgt

SEQ ID NO: 10399 - DNA, 1063 bp, Heterodera glycines
tttctctataaaaataaagtttccaacgcaattaattcttcttccctttgtgacgacatcattcggaactcggccaaattgtgctaattgctgccaaaaatgaaccgacggtaatgaattttaaaagtcacaaattcgtcgtttatttgactaaactgttttcccatttcagttggatttgcaacgacgtttggatggacattttcccctcttttgaccgtcctcaacttggcctcaaattggcacttctttcgccacgttttaattcgctggtggacaaatattttgatggcaaaagcgaattgccaatttggagacaaatcgtaattcgtcgcaagggcattggaccagaaatgaaactttatgtagagatggattacgtatttgtgccatttccattgcccgaccgtccgttgcccagcaaaatccgttttgaatggcttcagattgagtaattaaaaaacagttttatggcaataaaagcattcattccattttcagttacatcgatcactccgtcatcgcttttcttcgttcaaatcaccaaatttttaacaaaagagacaccgatttacagttgtcgattgcgctatatgaaaagttaattcattgatcatttttattgttatttgaattttatccattttttcattttcccatccttggccaaatatttcatcaaaagttggccaaacttttgcattaaatccaaaagatttaactaacaaagtttcgtcgattggacttattatgaatgataatgacaatataaaaaataaattataaaattgcatttcttattttgtaaaatttttgtatatattatgaaaatggctgtcaaaaaagcttaggttttatcattggaaatgaataataattttggtaaaaaatcattaaacccaatatatatttttttttattatattcttacttttgaaattaaaatttgttttaataaatttaattgtttaacgaattatttttgggtcagattttttaatgacttccgcccaatggtccgatcacgcccaaaaaaggcataaaaaggaaaaaagggcacaaa

SEQ ID NO: 10400 - DNA, 2755 bp, Heterodera glycines
  misc_feature (45)..(45): n is a, c, g, or t
tggaatttccatgccggaccgtccgttgcccagcaaaatccgttntaagaatcttcggattgggtaaatcaaaatcagagagctatgacaataaaagctttccttccatttttaggtacactgatcactccgtcatcgcttttcttcgttcaaatcatcaaattttcgacaaaagaggcaccaatttacacttgcggattcaatcatcacacaccacggaaggccagcggatttgggacatttttgttcgtgaaatttggccaattttttctgaaaacattcgccacttgggctttccccatggtgatcagttggaccatttgcttcgtcaaatttcgccgacaattctcatcgatcttaaccaattggtttcaatccattcatttggtctgtcgcccgctgcgtttggtgatgattttgatgggccaaattcaacaatttctgctggccaagcattgtccaaatggttgcactctccgagaaacgatggacaacccaagcgattgcgttgcgtagattacaacaaacaaacggacttagattgggtcaacaatttcaaggaggtgtggccccacattttcaacaaatcactgatatttgttcctatcgaattgtttagcattttcttcgtgccaatgccatttcttccgtcagttaccaaattcttttttctgttcgtgtgccgtcaatacaaatggtgccgtttgaattggtgaacgaattgacaaaggaaaagctgacattgaccaaagcaaatgaaaatgactgggagaattggataatgaagcgatgcaaaattggagaggccgcggatgttcagcttcagaaagatgaaaattggggcaacaattttaacaatgtggccatttggcttttcagtactgattgcattgggtgagcaattaaaaaaaacatttagttttgttaaataattcaaatttcgcttaattaaggccattgtctccgccatcagcagaagaagaacaagaagcgggacaaaacagcgaaaaagtgtcgtcttctgctgacaattagtgacggacaaacgaacaaaaacggaacggtgatcagccgcagaagaagaaatgaattaattaagaaaataatggaccaatcataattgattagtgataaaatgtatatttataaaaaaaacctctcaaatatattttaaaaattcggattaaaaaccgcaaaatatgtaggttttatgctctaaaaaaccctaaaaataggttctaaaaggaaaataggctctaaaaagtctcaaatttaggtgtgtaaaatgacaaaatttattcaaaaaagtaaaaaaattaggaaaaatttttaaaaacaaaaattctttttaaaaaataaaatttggaaatgaatttttgagaaaattttaattgcttaagggcgtatttataaaatcaaaaataggttctttcggaatttttttaggcatttaggatttaaaaataaaaacctaatagtcactaataactagggaaccgatttctagtgaaaaaactttttttttttgctcaattgttttgaagaaaggagctcaaaaacgcatttctgcgttaaaattttttcatttggacgtcatttttcgtcactagaaatcactattttggcgtttcgtcacttaaaatagtgaaaattcacttttttggctttttgtcactattttttcactttttcgacattttttggaaaatttgttaacaaaaatgcaataaaaacaaaaaatacacccctaagaatcgacctaaaaatttttcaaaaaataccagttagaattggaaaattttcataaaaatttttcccccaaatttttcttacaaaatttttggtttaaaaatttcaatatttgctaaaaaaaaatgtaagaaaggaatgtaaagatttttttgctcaatttttggctgaaaattatgtcactattcgtcactattttggacttttttcactattttggcactttttcgtcactattttagttaactatttcgggatttttcgtcataaagttggttccctactaataactagtgatgctcgagagcaaaaatttcccgagaccgagacttgaccccgagactcgagaccgattccgaacttgaccccgagactcgataccgagacccaaaaaacccaagacttatctgatcaaggaggctgcagatgatgaagcgaaagtgttctacttaaaattagttccttttttgttcaaccttgttaacatatgcgtggcccattcttggttctgttccttacagatccagcagcctgaaccgatccaagcacaaaatttgccagccgaacccgacgaactgagcccacaaacgccgaaaaccgtccgttgttccccaactccacgtccagtccgtgaacggcgtccggttgttcgttactcacccgaacccgtggcaagacgaaaacggaaatgaggacaaatgatttaaaaggggagatgttggatagggatttaaatattttattatgtattgacacgaatgattatcatccatttcatactgtatcccacttcccaattcttcctcatttttcattcagtcgacgcatttcccaattttctgattttggtcttttaaaattatattttcttttctctgtcaataaatattatttttgtttgtcctttggacacaacacttacaacatttctccaacgggaaggaagtttgcgaatccccctacggaaaaagtctgtgccgatctttgaggtgagggtactgcccca

SEQ ID NO: 10401 - DNA, 1339 bp, Heterodera glycines
  misc_feature (8)..(9): n is a, c, g, or t
tgcaggtnncatgattttgtccatcaaaaaattggccattattttattattcattttttggcatcattagcttttggccattcggttgttggacggatcatacataatgtttaattaattaattgttttgtttgttgcccaattcttttgtcccttagctctttcggttgtccgtttgcccaacaatgtgcaggtgcgcagcgaggaaaaacagttggccaaactgatcggactcagcacggacagcctcaaatgtgtgcacaacatttgttctccgtggtcaatcccgtccaaaattcgtggacaattggacattttcaactcaaaactgtggccaaataatgtgacaaattcattttgtgggggggggggcaattaattttaatcggcaaagttacaaggcatttcaagtggtaactgcaatatgttcataaaagggtaacgatcttgaagtttgcaaggcagtgccaagcttagaaaccaggacaaagagacggcaattttaaattttggggcaattttcttcggaatcaggcaaatccgtcgtgcgcttgggaaaagccttagctctctctcaccgtctctctcttcctctctctctcaccgtctctctcttcctctctctctcaccgtctctctcttcctctctctcttaccgtctctctcttcctctctctctcaccgtctctctcttcctctctctctcaccgtctatctcttcctctctctctcaccgtctctctcttcctctctctctcaccgtctctctcttcctctctctctcaccgtctatctcttcctctctctctcaccgtctctctcttcctctctctcaccgtctctctcttcctctctctcaccgtctctcctctctccccctaagccccactgtctgtccctccctctctctcctcgaatttgtaagggaatgtttattttaaacactttcccaatttgtttcggaatgaactgacaattgacatccgtcgctttcccattgaaacaccgacggatggccgtacaaatttgaaaaggagcagcagcagtgcgcttattgaacttggcattaacttcaatttggcaccattgaaagcatttgaaagtgttttcgatgccatcgaacggtgaaaaaaataatttgtggggaaatgaaaaaatggcatcaaatgagccaaagggactttgtggtcttatggagtgtgttgaggacttaattatcttttttgttggcatcctcattaaattggttcccattagtcactggcctaccgtaaccgaggcctttctttttaaaagtcgtttatggtcccgaaaaaaccggaaattccttaccgatttg

SEQ ID NO: 10402 - DNA, 2218 bp, Heterodera glycines
  misc_feature (16)..(16): n is a, c, g, or t
  misc_feature (46)..(46): n is a, c, g, or t
  misc_feature (110)..(110): n is a, c, g, or t
tgataatgggggcatntaatgtctttcaaaggaaaataattacatnttcgaatttctgccgcagggactgtcccaggatttcggctgatatatcttacaattagaagatntagtcaaaaaatgaccagattttggggcttcgatcaaattaaaaaaaaaagtctttttagggtccggccgaaaggcaccgccgggaaaattttagattttcttctcgaatattttcagtaaaatactatttttaaaataaatacgaacacgaacgtcctaaaatacggaatgaataatatccctggtccatacttttgccgctttagccccccggcacaagtgccaatgtttcctttttgctcggcacttgtcggtgcctcgggcaattggccactttcgccctccaatggttcaactcctcctccacccaactgctgaatctgtcccatttgcgtctcaatgtttccgtccgtttgtgcttggaattgcgcggcgctttgaccgaacgcaaaaaattggtgaataattaattaagtacttcaaatttacaaaaattaaattagttggactcggccagagaattgataatggccaacatttgccgcttttgggccaattcaatggaccaaagttcggaaaatgtttcacgcgcagaaattccaatcggaaagtcgggaggaaagttagaattcatcgttgaaataaggcattttgaaaattaattaaattattatgcgattatcacaaacagatttgtgtcaatgccaccaaattcggttggaattttgtgaaatttggtcgaaggaatgtcactcgtactgcaataagagatcactgatcaaaatatgatttttggaattttgttattattttaattaattcaataaaaaccatatttatcatttttgggataagtccaaaagcaagtcaacgacgattttttttctttcaatatgtgaagtttggacgcaaaagactgtgaaaaacgttaactgcgaacgttggattttactcaatattttttagtatactttcacatatttttaaggaaaatagtgaagtatttttgctaagtcaattcgcagttttcatctttttatgcattcgtaaaaaaaagaaaaaaatagagaacggaagagaaatttcttatttgccgatggtcatggcctcatatttcgtcatgatcccattcaattctttgcgcagatggaagccatccttctgcgaagttttctcgagcagtctcccaaccaattcagcgcaatattgtgctggaaaaaagcaaaaaagaattataatattcataatgaacgaaccaaaaaagtgattggtgggcggaatgagccgagtcgattccatggcacaagagttcaactcctccgggtggtggtccggcacgttctccttctcttcagactgtgtggctacttcactttccgccggcattggtgccgtttttgcctcttcttccggtgccaacaatgcctcctccgtcgcattcgcttccgacaattcctcgccggggttcgctggtgcaacttccacactttgctcgggctgtttattttccatttccggcaaagtcatcaattccttggcaaataatttctcctatttttctgtgtttcgttacccaatttgggtggataaatgagagaagaaccaaccatgccgtaattgtgtacactctgtgccgattggtcccattcgtcaatgcccgcagtgccccaagtatcaaaactaccatgcattccatgaaaaagagtgaatgccgatccgtcggaattgtcgctgtaggggccacgggtgcgtttccttgacctacgcggccggcgtctgtccacgtttcggaccagcggcggacacccccacgggcgcctcaaggctaaagtgccggtgccattgtgactgttgccagtgccggaaccaatgttagtgccggtgccattgtgactgttgccagtgccggaaccaatggtactgttgctgatggtggtggcattgtaattgttactggcgcagttgtaagtattgctggcgctggtgccgttgagactgttgctgctgccaccgaggagaccccacgggcgcctcaagccaaaagtgctgatgccattatgattgctgctggtgccggtgccaatgagactgttgccggtacgaatgtcccaatatttgtcgcggtcatagcaagaacatttatgtcgtcgtcggaatcgccactaaa

SEQ ID NO: 10403 - DNA, 2449 bp, Heterodera glycines
  misc_feature (75)..(75): n is a, c, g, or t
  misc_feature (2340)..(2340): n is a, c, g, or t
  misc_feature (2399)..(2399): n is a, c, g, or t
  misc_feature (2401)..(2401): n is a, c, g, or t
attttcacaaattaagtgtgtcccgctcaaaatgcgaaaagcgttggtcgaaataacaaacgaattttgcgatgnccgccaatttccaaatggtggaacatttttacattgtttctgatgctcattttgttatttggtgccttaattcttctggtgagacaaaattaatggaaatctttaaattaaattgtcatttttaattaattaattaattcccaaaattgctttttgagtttttgggccttaaaatcaactcaaaaattgaacaacaagcgaaaatattgtccagattggtggaagagaaaagtcagcacaaaagtcgaatgattgtcttcacgtcggacagagaaattgtggttgtcgaaattagaaataaattaaattaattatttttgcttttcaatttaggaaattcttggcacagcgattaaaatgaaagtgccgaaaatgacgcgacttttgggcgagaaagggtcaattaacagccgaaggagcggaaacggcggagagaaatttggacgaatcggtgccattcacaacacaaaagacgaaggcaaaggcagcacaatttgcccattaataagcgatacaaatcattacaattcaaccgctgctgagaacgatgacggaattattcctccgcctaattttggcgtctcattttggcgttctgtgcgctttcaaaatgttcttggcgttgtttctcttactattgtactcctcctcctcgtccatttcctcgtcggcaccgtaattcgttgccaaaatttggccactccaaacgatgggaaaacggaaacggactgtcatttcgatacggaaaccgataaaacaaaagcaaaagcagtcaaaagcaacggcactggcgcttctgctccttttggcgttgagaacggcggcggagagatttggcaaacggcggaaggacaaaaagaggcgggaatttaaatttgaaatgacttaattagacaaaaagagagtacccgagaatgatacctccttattcattagaatctgttcattaggaaatgaggaaataattctaaggaaagctaattaaatatgacccgttttgctaatgggccaattagcggactttgggttttctcaaccgtaggccatcattaattgtgaaaacgccaattattggatgctgttcctttatttccctttcttcaacagaataatgtttcgttggaaacgtccgtttggtggcaatatttttcggcgccggtcaaagaacaaaggccaaaaaagggtgccgaaattgacgtgccgaccccgcaaaagccatcaattctgaagaagagggtaatgcagaacaacaaaatctatcaaagtccattttaagccttcgaagaaaccctttgaaatggacaaaattcaaaatggaaatgattcagtgaaaagccatcgctttgatcgttttgccaattgtcaattgaacaaagacgttcattttgtcgcaaggacttctgctgctggggaatcagcgaagcagataaagtaaagccaacgcaaaaattgcaataaatttgaaaaaaataaataaaaataaattttagcactttttccgatttgatggcaactcgtttgtccccaaaggtacgaaggaaattaagcctaacttaatggcatttcaatttctaaacttaggaaacgcattttgaattgttcaacgaaaattcgcgtctttttttgattttgcgacatccgccggacaaaaaagggacaaatgaacaacaatttatggaaagtttggaggagaaaatggcgaaacgaataggtcaaaagtcgaattaattaattgatgagtaaaactaacggaaattaagcagaggaaaactgttggggatggtacagtaaccggacaaataacagtgacgagggacaccgtaagaagacgaccaaatgggtacggttgttggccgccatcgaaaggcgacggacgaacaaaacgacgccaatgaaagcgaatcattcgaagaaagcaatcggataatttaagaacaatcatcgtcattttaacttgtttttacaaataaatttcaattttttgttcgcttctttcatttttaataaaaattaaatttttagtaattaataaaaaaaaataaattcaaatgacaaaattaaaaaaagcattccatgggaaaatttaatttaattatttttttcagacaattagcaaaagaaagggcaaacaaaaaaaaagttgacgcagtgtcagtaataaaattaatcattaagtaaattgttctgataattttcacctgcccaaaacttaacgaaaaatcatttcgtagcaaaataacacaaaattcaatcactttatcttanatttaataaatactttaattttcactctaaatatcatttttcaatgaaaattttaattngntaatgaggtacttttttgggtagcggcaacgcgtgaaatcccccgggg

SEQ ID NO: 10404 - DNA, 4659 bp, Heterodera glycines
  misc_feature (2034)..(2034): n is a, c, g, or t
ttgcgtttgttggcatacgaagtgtatatgaagatgaacgaaacaggcaaaacaaacagtaaaagaaattgaaaaacgatgtttatattttataggaattccttgtgacatgattacgggtgaaaatcgtctctttgccgttgactcggacaacccatccgcccacacttcagcaaccatcgagataatgtccccagagcatagaattgaactttgtgtcatcgacgagatccaaatgctcagagacccacaaagaggtgctgcttggacaagagcactgatgggagcgcctgcggatgaggtaagaaattgggacgtaatcgtttttaaaaacatttttcctttgcgatttatcgggtttaatcaattttttttagttatttacagtacgaataaatttcttttttaaacaaaaattttcgaggttttagttcaaagacttaaaaaagacgatttccttttctgcatagctttttaaagaaaaaacatagaaacagtattatttctagagaccgagatttcatttatttattttttgcctattttaaaagaaaaactatccttcattttttaatctaaaaaatgattttttaaattatttagttatattatacattaattaaaatttactgatttttgtgtggaaactgcccgccattgaaaaactcgtttgactggcttggagaagccggatccagactggttgaaaacagcagtttccgggtccggcctctaaaaaatcagtcaaaccgggtttatatattttcggttttctccaagtctatacccatatgcttgttttactatattcagattcatctttgtggtgaagaatccgcttatgatatcgtctgtcgtttgctggaccctattggtgaacatgttgaccttcgtcgatatgaacgcaagggcaagttggtcgtgatcgtaacccacggacttcgtgatctgagctcaacaaaggtcgtaatattttttcattgtgttatttaattcaaattaatccatttatgtttaggatggtgattgtgtgatacatttttcgaaaaaaggcattctcgacatggcacgccgattgaaatttgaatacaaaaaagaatgtgctattgtatttggagatttgccccccgaggttaagcgagaacaagtcaaacggttcaacgaccagaacgacccgtgcaaaattctgcttgcaaccgatgcaattggaatgggaatgaacttgaacatcaaaaggtcgcttttctttttaaattgcatgggtcaattaatctttgatatttttcagagtgattttcacaacattgaaaagtcgtgatggctctttgctccccgcgtatttcgtaaaacaaattgccggcagagctggcagatacgcgtcagcatattgcaccggcgaagcgatggcgttggatgatgctgatgctggactgctcgagaagctgatgaatgaaccaattgattccattgaccaggccggcattttgccttcattcgaccaaattgaggtgagtccacgctctttttcattcatttattcagaaccctttaataatccattgaagatgttttcctttcacttgccccaatattcgctgactcaactgctcgacatattcgtttcaatttgcacagttagcgaaaagtactttctgtgtttgaatgactcaattaaacaaattgcgcaactcattgaacacatccaactttcacttagggttctcttctcatcatacaatatttataacaattttcagcaattaaggaacgttacattttctgcctcaccccaatcccttccggtgctcacccctttcttaactcggcttttatcaaaatggtccgacgttattctgagggcaatgcaataactttcgcatggatccgtcctttggttttgcctgagttgcgaattgtcgacagagtcgacgcggtcaatcgacttgttgacgtttacgactttatgggcgcgtacctttggcttagctatcgttttgaggtaacccttatttgaatagcaatctttacaatgtnttctcaatatttaggaacatttttccgaccgagacaaagtccgcgagttgcaacgagaatgtgtgggatttattcagaaaagcatggacaaaatgttatctgagtatggagaggaggaggcaaagggagcgccgcgcaagggaaaaaggagggaaaacagcgattcggagtacgaattgagggcgatgggactgcacaggaacagctcgaaaaggcatgacgacactgtttccaaagtggtaataaacacatacttaaaaatggaatcactttgtccggtttacagcagaaggaaggcctccaggaacagttcaacgcgctaatttctaaaatgcggaaacaacggaagcaagtcaaatgaagggttcttctgcttaccactcattaattgttatctcattgataaattgttttgtttgaaaacctttttcataaataatcgtcgattacgattgaatgcttctcatttattgattgtttttaccgctcattccttttttcaaagcatggaatcgtccaatgaggagcagcagcttcaggaaattgaggctttggaggtgtaactattttttataatagataattttgtttaaaattttatttagtcaatgtattccaacgaactgagggttttgtgccgggactttccgaatatcagtgtcgaattggatgtccgccccgatttggtttgctcgttcaatggataattaactattagaatttactgattaaggacgaattcactgaactcttcggcaagagtgtcatttctctgcgcgcaacttttccctcggactatccgaattgtttccctgtcatcgatttgccagattttgatggggacgacgatgaaaacacacttcagaagactcagttttgggatgaatgtgaacggagagtgaggtcggaattggacaaagtgatggaggattgtgtcgggatgccaatgcttttcacactgctcggcgctttgcaggttcaaaagctgtacgtttcagataaccaatccaacaaaacaggaattctttgtccaaatggcagatgattaccttaaaaaccgtgatgaattggagaggataaaagcggataaaattgaacgcgaggaacgggccaaattcgaaggtaattgtttaaccaaagcgagtaggacagataattttataattcatttagggacgagagtgacggtcgaatcattcaaaaaatggaacgatgcctttttgaagtctgtcagagtgccacaggaaaaaataaaagtttaaaatgttgaatttttaatataataatcatctttcacctacaggacaatcagacgacaaagagaatgaccggaaaacagctgttcctttcggacaaatcacttaacatttccgatttgcaatttattggaaatgccaaagacgaaaatgtagttgaaattgaccagtctctttttgaggtaaggaaatcagtgattaacaatcattgaaagctgttcaaatttactaaagggcgacatcgatttcgacgacgatgatgaggattacaaccccgaggctgatgttggaccagaagatgaaagcgaataaagttccacattatttatttttgacaaattgttattttcgggatcgctaatgaatccggcacccatttcgaccaattccaagctcaagaaaattcagatttgcaaagaaaaaaaagaatttttcttaaatattttatttataaaagcacactttattggtcccataatcggtgtcatggcaactcgtatacgagttgccttttgtacgagttaggggtgcaaaataatttaaaaatttattcctcataaattttatcggtggtttttgcaatttcaaatcaaaatttctcaagtttgacgaaaaatgcccgggacgcccggtaaaacggcctttttttgaccgggcccggccaattgtcgaagcccgagcccggtcattttgccgggctaaaacgggcttaaatttcaccagcgaaactgcccaaaatttgaaaaataattattatttttggcgaaatgtctttaattcaaattttcaaaatagcatatatcatcattttgacaaaaattgcctaacattataaaaaaaaatgagtattgaaacgaaaataaaaaaaacataaaacatgaagaaacagcagacactatgagtcagacactacactaaaagttaatgaaaattaaatgcatacaatgcgccaagaggaaaaagtgataaaacagtcgtttttctgaaatttctaatgcttataacttggccattaataaaccaaatagagcaattttggtttcattttgaagagaaaattctgaagaacatgtctaactatcgttttttacgtgtaaatatcattttttgctggaaaaggaaagaaatttattgaaatatttgctatgctaaaaaatttttccctatgcacagattttcttcaaattttgcataggcccatagtttgaccccctctatcgaatcacagtttattttttagctgtctagtttttaactcgagatcggctcttccatttttacaagggaaaatctcggcaaaatttttaaattagtggggttttttggcgttttgtccttaggcaatttttgcaaaatgatgatatatgaa

SEQ ID NO: 10405 - DNA, 1851 bp, Heterodera glycines
  misc_feature (26)..(26): n is a, c, g, or t
ccccccccccccttaatgcctccccncatggcagccacctgtgagtagccgccgcccgcggcgccgcctttgatgccaaaggttggcccctgcgacggttggcgcatgcacgcgaaagtgttgcgacccaaatgggcgcacaagctttgcgcacttaaagcagccaattaaaaaatggagcgttgaaaaggtgtgtttgtggatggaatactgtaataatttttctaattgagcgccgccccgggggcactaactgagaaaaatacggtagtatcaatgatcgaacaggctgacaattttggcattactaacgaaatcacatccaactgggggtgccatcaaaagttagggccagggccggaattcgggacgagactaatataggtcgggatggccaaaaaaccaggccagggttcgagacgataaaaatgtcgggttttcgggtctcagttccgggattcgggcggtaacccggctccggaataccgtaaccacacttagtaaatacggaaatatttagtgctgtatcgtatactatacatacagtccaacggtggtggtggatttgccttcgcccaacggagtcggattgatgccggccacgacgacataccttcaaacagaggaaggggatttggataatgttttaggtttttggttaagcacagcaagactgactcgtcctcgagaatttaaattatttagtgaagagtttggagacaaaaaatgattttaaatttttagaatatttttaaaaattccatcaaaatgccggatttttaattttcataaataagttcaaagcccccgccggaccttccgctcttcaaaaaatttgaaaaaatagcgcagcaaaataaatatgaaatttagatactcaattaaaaaaaatatatttttttaggaaaataaaaaataaattaaaatttcgctctccgttttccggcattttttggcgccgaaattttcaggcaaaccccctgtgcctacggtaatttacggcagcaaaatcgagaattatcaaaaagtgggggctatgctaggcctaagaggacgaagccatgtgccaaaaatggttgttgttggcctaacattccattcgggcgctccttgagacggttgagcactgccaacgacactttggctttgctgtgcccgtacagctccaactcggactgggcaatgccaacttcggccgccagacgaccgatcgccttgggctgttgtgcccgggaaatgtcaatgtcagtgggcacgggctgaacagagcagggagagaaagaaatgatcagaaaatacggatttattggagagtaagtattctttgatcagctagtgatcaaaaatggtagaataaatgtaaagtgatcaattgctcttcgatcagtagtgatcacagatgatggagtaaatgaaattgatcagtatgataaaaaaaaatgattgatcggctgatgagtggtcaatcagttcggaccaatcagttagtgaagttttgtgatcagagagagttaataacgaaaacaagtgaaagcgctctgatcggtatcagactcgaacaaattaaattgattaataattgcgataagttttaagttctttgatcaataagtgaccgataaaatagaaaaaccggatcagcaaacagcaatataaacggaaattatgaattagttatctgaatagactgatcaaattaaacaatcagtcttagtggaataactgatcatcaaaaccaaccgaagacagatcgagcttcaacgggtaaagcttccatgcgttcactgcgcggcttttcacggtcccatcgggctcaacacggccctggaggaaaatggggggggggggggg

SEQ ID NO: 10406 - DNA, 1303 bp, Heterodera glycines
aaaagccgagagttatcgagtcgagattcgatactctggaacaaccccaagactcaagataccgcaaaaaaaaaacgaaactttatgagtcgaggactcaagaccgggccttgaaaattgatgccgagacagtaaaagcccgagactttactcgagacttcgacactctcgagcatcacccagtgctgcttacgttcagtttttggcacaccgcctggaggaaggtgttgcggacgagcattgccacggtcattgggccaacgccgccgggcacaggcgtcagaaagccggccaccgccttggcctcctcaaaattcacatcgcccaccaggtgacgcttttcaccatcgctttgcaccacgttgatcccgctgaagcagcaataaaattgcgcgcgagtttttggcgaagaattttaatttaaaaaaatcggcaaaatgttaggcccctcgggtgggcatcgaacccacgcctcctgacaacccgccagcaaactctaccatttagctaccgaggcaaattagcggagttagggggtttgattataattttttttttttttgatttttattttaatttgatcttatccttaataagtataaatgaagaagaagatttaaaatataatgaatctgaatttttaggaacactatctattaaggaaaaaaaaaaattaaatctatatgatcatgctcgatttggtattggaaatgatcagaatggatcaagactttgatcgcaatcgaatttcggacgggtccaggatttggaaaatacgtaaatccatattttactgtcctggtagtatttcttccgaaatgtcagaacccggcatcttgaccgatcccgatttataaacccaaaaataattaaaaagtgaaagtgttcggacagattacggtaaatgatccacaaacttattggaatagttcaaaaaaaatttgtttgtttttttgtacttttgggcacaaaatgcagcattaattatcctgtagcggttttaatgaaaaaaatatgaatatgttctcattgggtgctaacattttctgttcaagagtctcggcgtcgcctatcagatatcgattttggctgttattgataagaaatcttgactaatgaagttggctttatcagtcagtaacagtcaaaaaatagatctcggccctgtttattaaaatccgagtgggatcgggatgccgacgataaaattgggatttgaaataaatttgataagctactttacttgattaaaaatttattgttagtaaaaaaaagggggatggctggcagattaatggagtaa

SEQ ID NO: 10407 - DNA, 1681 bp, Heterodera glycines
ttaccatatttttgaaaaatggagggaaaaagacaaaaaatattaattttttggcgaaaaattttgtaaaattcacccccctaattcgggatttcaaaaaacgaaaaatacacccctaaaaatcgaattttttacttcagcccccccccccccaaagccaagggctggctacgccctccccctcccgaaaaattattttctttttcaaaaaaaaaaacatagaatcaaagtgatctatttatgatcattgtaaaatccttttctggatttgtttccgtgccaattatagaaatgcattaacaaattctcgggccttacttggacaataatgccatcagttttggcatccgtgttcaatgactcgaccaggttgaccagctcagcttcggtgctgtcgctgctcaacttgtacagcttggcatcgatgccgacctccttcgctttgcccatctttctgctgatgtaacaggacgagtcgctccgatcgccgaccttcaattaactaattaatgaaataattatccgttgaatagacaaattgactaatttggcggtgggggtcgattgggcgccgccgattgggcgacgccgtttgggcgccgccgtttgggcgcgggtacgattgggcgccgccgattgggcgccgccgtttgggcgccatgcggcagccaaatttttcgttttcatattatccaaaaacgtaaaaaactgaaattactacaaaaatttctagccattcacctgaattacgagaaatagcactcaaaaacgtaatgtttatggggttaaaatctatttgagtcacaaaattccttcatgactccttcttttttaatggcatgggtcctcgaaattatgccctgtaacttaaaatttgaagctgtccttgaaaaagaattcgagaaaaacaattagtttatataatgtttttaatcatctacattcttttgaatagattttgggacaacaaaggttgatttgatgaaaaataaattttcgtcttttatttgaattcgggtccgggattcgaaattggtcaaaatagatgtcagatttgtgatcagcgacctgaaaaccccctagaaatgttttaaaaaataatttttttatggtttgtaaagtgcatacataagtaccctgaaatctttcaaaaaaattttcctgctgatcggcaaccgccggaaccaatgttcccaaaaagttttttgcaaaaagcatactgcaaaaaagtgcacatgcggtgaaatgaggaaactgatgaacagaaacaaaataataatgaaaatatactacaatcatttttcattgcatattataatttttttgtatccttgaatttaatgaaactttcacgttacgtccttgtaaattattatacccgtccttggaaagtccttaaccctaagttgaggcaaggttaatgaatttaaatttccccatggcgcccaatcggcggcgcccaatcgtaccggcgcccaaacggcggcgcccaatcggggtcgcccaatcggcggcgcccaaccgacccggtccgatcgggctacagagatacattcatactaaggtctgatttttttgaattctaagctcagatccatgatcagcgtattttttcaccttagaaaactcgaaaagaaaaattaaatttatttttcgcagggacaccaattctccagtatta

SEQ ID NO: 10408 - DNA, 3169 bp, Heterodera glycines
  misc_feature (7)..(7): n is a, c, g, or t
caaaatnttagaaactgggcgcaaagcgcccataagagtccgcttagtcgctaaattatcccctattattttcgatcaattcgaatcgcttcacagcctaggtagcgaagctcaagaagcgcgcagcgctttatccccactaaatacccaacggttcacgcacccactagttatctcattatatcattcagcacactattggctaaaaacgtcctcattttttgaaaattgtttataacttggagaaatcactggccgatcaattttttggctctgccgccattagctgactccgaccgatcaatttgtcggtcctgtcttctttagcgatcactttttggctctttcttcgagtgtcaatcactttttggccatatcttctattgcgatcactttttggcccagacgctgatcaattcgccccatttaaaaaataacaccccaaaaaaggataatttttttcgaaattttggaattttaggtattttgttcgcttccaaaaattttcaaattcaaatagaatgagcgatcaaagatcttttaatttccattttcttttataatttaagtcttagtgccattttcattccaaataattggctcaaatttcatttctttaggcccaaagacggccaaatttctcagctttttggagcagttcacactgtgcacaatgttccgcatttttggccgtttcgtcggcacttatcccatcgcatttctgatcttctcattgatccttgcttcgctgtcaggttgagcaaagttgcaaaaaatggaggccgaaatttagaaaataaaatggaaaattatagtttgcttaggttcatttcgctcatattaaaattcaaaaaatattcgattttttggaatttgagataataaattccatttcttttctatgaatctatttattttttaaaacatttttaaatattctcgaatatatacatacaaatttttaatttaatggaagattttttaaaaattcaataaatttaatttttatagaaaattctagattccgagccattgaaaaagcctatacctggacctgggttccatgttgacctggacctggatttcctgggaaaaaattttgaataatccatgtccatgaaaaatcctgccaaaaaatgcttggacctggacctgtttccagaaaaattcagacctgggtccaggacgaaaccgagaaaattcgcattttccaacccgccatttcctccttttcatggcatccggtatgaatttttgcgactttttattgtcaatttttaaagcaaatgaaattttttgcctaaattttgaaggcctttttattgttttactagcaaaataaataattttattgttattataagacaaactgaattcataaaatgttaattgcgccaaattcgaaatttggaaaaaatgtaagtttcaaaaacaaaagccgaattttcatatttttgaaaacttttaactagaaaaaattttcgaaaatgtaaagccttttacaataaaaatttaatacgaaaataaaagtaggcaaaagcaaaaataaaaaaccaaaaattttccaaaaaacttataattttaaaaatttgaaaagctttacaataagaaaagtctctatttaaaatataatattacacatttaaaacgctttaccatggaccaaaattgaaaataatttatttttattaaaatattttttacccttttttctcattttaaaattttacacaaaatgccccaggcgatcccctgctgaccacagtgatgctgcgagcgcgcgaccggcacagcatgcaccggctccgttggctggacgaatgcgttcggatgcacgactttttgcgcctgaacatttccgccaccgttgggggacaggtgaaaaagcagctaaaaagtgccaaaatatgacaaattaaatttcacccaaatgccaatggccccgaaatccacaaaaaatttggcagcattttaatgtaaattcggccgcatttttaaagttagccatggtccccaaaatccagcaaattggattttctttgaataggctaattctttaaattaaaaaataaactatgactaaaactcccctattttcgggttccatatcccaattttgaacccgttttcattagtaaattaggggcaggcaggcttttgcattgaccgtaaccaaaaatgcatattttcgggaatctctatgcattattccgcatttctttcaaactttttgagcggaatgatgactaaatccaaagttaccctcgaattagggtcctcgccatattcataatttctcgtaaaaaataaaataaatttctattgctcaaaatccacaattatccctctggtccaatactttgtgatgggtacggttttggcaccgtttcccccggcattttgggtgttgcccaaaatttgtttcaaatgccacgtttttcgatccaagacagcataaacagcgagaaattaattggataacagggggcacaaatgttcaatcccctttaatgggggataaagcttggtgggggtaggactcaatttttcaaaccccctggggctctatttcacggggactctaatttaggggggtcggctctattttaggaaatatgctatttaaaatttactcatttttcatttttgcagttgactaacgtggtcaccttcgccatcggcgccttaacaccaaccccgggtttgtcttgtgattgtccgccgaagagaagagggatgtgcgaggaataattttttgccggggaattgagccgggaataggcattcgcattcccgagagcgataccctataaatcagcgaagaaaaaccaataaaactgactcgagaaaggggcacaaaaaagagctgggaaaataatgactctgctagaattggtccagaaaatgacaaagacaggagcaccgagggataaatagttcgttagaaaattttaaaaaatcttccaaaagctagtggaaaattcttagattttgatatttttaaaattttctcgggcggaacgatgtgcttatttgttagctcgagacccaacaaggattagattgaagcacgccgagaattggttgaccccgcgcatacagatggaaagaaagacccaagaaaatgtcgacagatttttcaaaacacattaataacaatgagaattaa

SEQ ID NO: 10409 - DNA, 3529 bp, Heterodera glycines
tgcagttgtgcattcaatgcaatttgcaaaactctcacatcacgtgtttcagttgtccattcatttgccaaaccagcagcccgttgtatacagggccttccaactgggtgagtaaagctgaggaaattcagcgcggcgaactcccagagacgccatgctctgcctattggaagcaatggcaaaacgaatggcagcatgttccttcgctcaaggacatgctttttcaaaaagtcccagagcaatttcgatgggcaaaagaccgttgggtcccatataaaaggaagcctaccaagaggcccccaatcggtcgtgttgtacctgtccctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgcttggcgaggcagccttgcatcgctggccggaccagatgagatggctcttcgtgagcatcctcgtttttgggcagccaagcaattccctggaactgtggaacaagtacaaagaccaaatgtacaatccacagggcattatcagtgcggctatacgccaagcacgggagcaagaagcgctagccgacattgattggcgattgcacttctttaactcaagctgcttgcactgtggcctcccagatccaccaaattcaaaagccaaaaatatcaatttggcagttgaagaagctttctttggtgatgatgatctgaatatgtcgcctggccagcaaaatcctaggcagcagcaaaacgctccacctccactcaacagcgaccaacaaacggtctttgatgctgttgttaaggcaattcagtcggacccaagggatccgactgtgcctcgccgtttcttcattttcggcgatggaggtacaggaaaaacattcctgtttggccaaattatcaaccgcttgcgcaagcccccatacacctataaagtgcttgctacggcatccactggctgtgcggctattttgctgccatatgggaaaacagctcattccacgttccgtctcggcagagaagtctcgctagacaagcttccaagcattccgcttgaaagcttctttgctcgacggatacgtgaggcccagctcatcatcattgatgagatcaccatgcttcataacacggtgattgcggtaatcgaccgagtgtgcaaagaaatggcaattcgccagcacaaggacctcctcttcggaggaaaaacggtcatttttagcggtgacttcaaacagtcactgccggtcgtgcctcatgaaggcttacccgctcaggtgacagcctgttttcaaacatctccgttgtttggacagttcaccacgatgaaattgaccatcaaccagagattgggccaaggccagcaagcgtacttgcaaatgtgccgccaaatcggccttggagagaccggagaacacttctggattcctccgcagttcctcgtaaagagcagggaagagttgatagactttgtctatcccgacttccaaaaactccttggaaatgacaaggaactgctcaatcgtctgatcctcgcacctcacattgacacgtgcgatgagatcaacgaaatcatgatggcgaatgtgcctggtcaagtgcgcgaatatttgtcttcggacaagccgcttgacgagcgtccactggacatcgatgaaattgagtcggaagtggcagcgttgaaccggcgcacagactctgggatgcctccccaccgtctgcgacttaaggtcggaagcgtcgttgttctacttatcaacaaaagtgataaggaaggactgatcaacggcacacgcatcgttcttgaagaacttggcgacgatcgtctggtcggtcgcgtcattaacagcaacgctgttggtggccaggttaagttcttcatcgaaagaacacgaaatgtctacgaggacaaaacgcctggcggcttaaaatatgagcgtttgcagtttcccatcaaacctgccttcgccatgaccattctcaaaggtcaaggccaaacaatcagcacggtcggaattgacctcgaaagggatgtattttcccatggtcaattgtacactgcattttcaagagcaacggacgggagcaacgtccgagtgtacgctcccagaagggagaccgatgcacaagacagagtcaaagtgctgaatattgttgcaacgaaaatgctcaatttgcaataaagcaaacgagttaggtccagcgcgtgcacactttaagatgtcaccccgttctcatctgcacttaaaacggacacatattcaaaaaagtgctgccagctggactgaatgaggcaggtgggccatgacgtgcgagttagggcacttccggtttccattgcattgaaaaatgcagtgtgtcaaggtgaaaccaagtgcatgtcggctgacgcaaagaccctaacacaaggcctaggtagcgaagctcccaaagcgcgaagcgctttaagaaccaagaaacatgtaagcacacacccgctagttcctacataaaacgggaacaaaaaataaaatatatacaaaaaaaaaaagatttttttgtgcacactcccagtctatatttaacgcattaaaaattaccgtaggacaaaagaatagaagaagagggtggtttattttcctaaaattattttttatttttggttcatcatttatgtggttattaaaactgcttcttattccaatcatttcattcctttatcgattaagttggaccacaacaaaaaaaacggcagcgtactgcgcagtaaaaatagcgaaccaatcaatacctataaggtacgggattgatgcaaaatctcgagtgccctctcgagtttactgtttagcgggagagacctaaaaatacgaaccttttaattgggggaaattgcgaaataaggaaccaatcaagcattttattgacaggttgtcagctgacacctggcatgtgactgtttttcattgacattgtggaatatttcgttgacaaatgttacattttcgacgcacgggcagaatgtcacgtgtctattgtgaaatatgcaacaaaaaaaagtcacgtgcagattgagaaatatgcaacaaacaaaagtcatgtgcagattgcgaaatcgatggggaaattgcgaaataggaaaccaatcaatcaattttgattgacaggtgacctaattcggtcccttattgcgaaatagtcgtaaagtctaggcagattatcaaataatgggagagaaaaaagaccatttcagaaaacaaatttcaatttaatttatttaaatgaatttttatttattcaactattgtccaattaatattactatatcttacaattaattcgaatttcattgacaattttggtgcttatcgatttttttcacgactcggaatcgcggcgcatcgacggagcggatgagagtggcggtctcattatcgaataattttatcgattttttttttgcgcg

SEQ ID NO: 10410 - DNA, 1516 bp, Heterodera glycines
ataaattaaatcaaattttttattcaaaaacctaaaaaaaaacaaattactattcgccgctgctttgtttgcttcgtaacggaacattgccgcaaatacgtcggaaccgcagttcaaaactgctcggtgtgctgggataatcttaaaacagaataaattttgaaaaataaaataaattgacaaaaaaaaaaattagagttgtacgggaccgggaatttttgccaaaaccgggaccggaactgccaagacctgagaagccgggaccgggacttcggcttttgtccgggaccaaccgggaaaaaaatacaaaaaattaaatttatttcaagtgaaaatagtaaataattaattttttgcttgctttttattttataaaaccaaaagttaacgcaaatttaaattataatatatttaatcaatattgcaaagcaaatttattttaattatttcaaaaaattacgcatttctttaaaaaaatgttaaaatattgtgaattaaaaaaaaatatgttgaattatttttgtcaataataaacccatgaataaattcaaaaaatttttaatttctgccaaaacttgcctcttttccgtctccgtcgcccaccaaaaagtgcacatccgcataatcacccgtgctcagcatcagcttcatccgatcaaccaacaaattggccataataattagtgccgaattatgagtattattagccttaaaaaagcaaaaagattttttgacttttgaaaaagttattaagaaaaaatttcaaaactttgacttttttttttttttgctattttgatgctataacttttttagcaattgttgatagcaaatcaataggttagaaatagcttttaacatcttaagagctttcgaatgataccaagattgttagatttggatgaacaagaaaaatgttatagccaaaaacatggtggggcctttttgcgtggggcccggcccaagtgctgaggtaaaccgctattttcacgttttataaattcagccaaattaggaaaaatgtaaaactggaaaagctaacttttgagtccgagcaaaacaatgaaaaggggaaaatcaattaagggattacaattaaataaatgcaaagaaaatgaaagagtcagaggaggattaatctcagataaatttaaaaaatttataatttaatggagaatgaagagcgagagcgaggaaagggaaaacaaccatttttaatgagcaatcggatcaatgcctgatcagtgatcagacattgcttcgttttggtacgatttgataactagaaaaataattttggtcaaaaaatatgttcaaaaaattaaaattaatttctaaatttataaattagtgacttgaacttcctgctggtgactttatgtttgatcaagttcctaatcagaggccaaagcttccaatccacttcaaataagtcaataaatgttttttagtgtgctaaataaaaactctctctaattgaatgaatggaattaccaagaataaaaaaaagaacaaa

SEQ ID NO: 10411 - DNA, 4096 bp, Heterodera glycines
aatgcaataggaggacacttgttgcaaatagtaggcaccaatccaaatggcgtaataaaagtacggatactccccgttgggttcgcctgaaaatttgacaaatttattttagaaaaaaataaaattttaattgtaaatatgaaaaaaagaaattaaaaatttattggaaaattgtgatttcgtttctgatttttatttgtgtgtcgttttagagagctgctcgattcctgcccgcaattcctcgcccattaatatatttttatttcaagcttagaaattttaagatttttttttattagaaaattcgaagaaaaaaaaattgtagaattcattttttgaagcttaattttttttttaagtttattaatttaaaaaaagttctcggggtaaagggaaatgagttgctcccattgtaaaccccaatgcattaatttcttcgcaaattattaaaaatttatgctatttaaaaataaaacccagccctatatttttttgcttacgaaatgacggtgtccagtagacgagcagtgccagtgccaaactcatcaccagtcggtacgggtacgcccacaagaacacgttcaacggcttcggcccggccgtctgtttgccgagcacccacggcagaatgatttgcagcggagtgaggaagatggagcgggacgcaattttgtccgtggtcagcccctcgttgatcaactgaacagcagaaaagagaagttaaattcgcaaaaataaagtgtttatttttggaaaatttaagaaaatttatagcgagagttcgtcccccccccgtactttttcccccagaaatcaaaaaaaaaaattgaaacgaaaagttaaaaaaattttattgttagaaaatgtaagaaaattcaaaagataaaaattttttcaacgattttttggagtaattcaccataaattttcaaaaaattttataaaatttttcttgtaaaagttccaagaattgtgtttaaaaaaatttttcagcgggaaataaacgggggagggagtggtggtggtaatagtggacccagaaaaaaacaaataaagtttttgtttataaattttgtaggccaccttaaggtccgtcatgccatctgtggcggcaaaagctatctgaaaaacggaaaaaaactgtcagtcaaatccaaattcaatctcccatgttggacctttcccgtgagcagcacaatgaccatgatcagcatcggtttgaggcacaaaattttgaccaacaccgcgtacgtctcgaagacgcccagcgacagttcctcgtcgttgttgttgctgtcactgtcgtcgtccatcggattgtggtgaccattttcggccttccttaaaccgtgtcaaaaatggggaaattaggcaaaaaaaaaatttttttttactcgtgcggttgcgagacgacggagtggtcaatttcatgcttgaaaatgaacaccaacgtggtggtgacgaggaacacaaggccccaaaagaagacgaaccctgtggaaaaaatggcatatttaaaatttttttaatgaaaaatcaagtcgattttattttcaaatttaaactcagaggaaatattggacccttctttttaaatatattttcgaaacatgtgttgaaacgggtcaatgccttttgtaccgctgaaacagtaccaaactcaaagcattttagaaagaaaaaaaaaataacgaaagaattttttttaaataagcaaaaaagaaatatttgtgaattttcaaaaatgctctcgaaaaaggggcgcggtcgcccccgaaatagaaaaatggaggcggaagagcaaccgcaaaccacacacagttagtcagtcgtcaccaaacaagttcggtgacagtgctttttctcctccagtgtttcgtcacttccttccactccaaccgccctcccccctccttaacaccattcattcgtttcccatcacttgcagcacaaagggttcttctccccgtttaatcacccgttcttccacacaacacacatgcgcattgcccacacaaattccaagtttcgttttccacagtcctttttcacccataaatattaatttggttgaaattgggccaagatacgaatttatatgtcttatattttcttgttttcctaccacatgcggtttttaggaaacgatctagcacccgccccatcctcccaccatctacggattttgttttgcattcttcgctctgcgcatgtgtccttgaggaaggaacaaatgtcctccggcaacgaaatgatgggacttgggggtgggcttttgagaggggcaaacaggctgatttattcattccaaacattcacacaataacccccacaagttggctgttgggttttagaaagaaatttaaatgcaaattttacccatttaacgatagaagtagaaaatgacaaccaccaaaagcagataaatctctgacaaaatgccatcaatttgcccacccattcgcttcccccgcctcgcatttcttgtgaccacactcaatgcagaagagtttaaattcaattaacccacccagaagtagcacactcattaggcattagttggccgttgtggcaaaatgccgtaattcactcgttcaaaaaatcatgaaaaataattttccggcagactaaaccaacaaagttggtcccccaaatgtgccaaacctacttcctttcccaacaatgaggacggacggtaaattggaaattagggaactgccgagcccatgtgggtcgcggattcataaactcgaggaaattagccacccaaacagccaaacacacacacaaatagtgcgctcgctcatcaagcccaacaaatggcccataaaattgggccaatccatggcacacacaattgctgacatcattccactcgttatgtgtgtgtgtgtgtgcgagcgatgtgcaaaaactttttttccgccatttccgtttaaggcatcgaagtccgtccgttcgtcccaataatcccttcgccggtgtgtccgctgctgtggcaccaaaacaatttgctataaaaccccgcaggcgcccattgttcgccatgccattccttgttgctgttggccaattactgcacattgacagccgaatggcgttcagccgagcactgctcattgtgctctccgcctcgctgacactgcccatggaaacgctggagaggagcttcagtaagtgcaaaacgagtggaagaaagcagaagcgagtagagggccatataatcaattgggtaatttttgaggaaaattaaaaacaacaaattttcagatgcatccaacgtctttcagtagtccataatttcatttaaattttttcaatttttgctcaaacaatctcaaaaatggagctgctcccgtcttctacaaatatgagtatcaagaagccagacccgtgtccagaaaaaaaaattcaaaggggttccatttttttgttgctctcctcttcaaaatttttagtgcaaattttgaaaattgaggggatacattaaatttgtacgagttttctgcgatttaattaaataaaatggaattccatgtgattaaacttgaaatacacagaggacaactgcaagtcggaaaaattgcgcgaaatcattctggagacaatcggactctatccccaccagtacagctaccaagcaaggtattaccgtattgtaataatcccttggacaaataataaatcggtcgtattaataaaacagacacatgaaacaagtgtcggaaaatcggtttggtaattggtggagcgcggtgattatcagtgagaggggcggctacggcatgagtgccatttatgaccaacatcaaaacacaaggcgagtggaatatgggcaagggatgagtcaggcaaaggccaggcccggatccttttttgacggaaggtagaaaaaagccggaatttatcggcaaaatgtacaaatagacataccaattaacatttaccaacaaatggttttaaaaattaatgccaaaaataaaatttgaaaaaaacaggaaggaggagagaccgacaattttttgccggagaaaagtgaattaagtttaacttacgttaaaaaaacttagattaaatgggcaaaaagcaaatttca

SEQ ID NO: 10412 - DNA, 1606 bp, Heterodera glycines
aaaaatgaaaggttgacagcaaattgggagcagcacaaagacagcggtcgaagagcacattcaattgttttttgcggaaagttaacaaaaagaatttaaaaagtgaaatgactcattaattcggggacaatttgctaatttgccaattttcgctgaatgaatgaatgaatggatgagtccgagccgcataaatgaatgagcaagtgaagtcgtcggtcggtagatgaatgtgccattgcccaaataaatatgcgagacgcgccaaacaaaacaattgggggcccagccaatggtggcattggcatgcaaaacttggcacgcgcaaaggaattttcggcacattaattaagggtaattacgcggggccatttccgcctacggttttggcgctcctttaaggcaaaaaatgactttgccattttggctcagagcaggaaattatgccaaactttctaaagctaatgccagaaattaaattgcaagcccaaaataaacttgaaatttggtcaaattttccaaaattatagcccatttattcacacgataatcattttagttgtcaaacgcatgccaaaaaaataaattttattataaatttaggacttggtagctattttgatccaaattaattaaaaggccaaattccattaaaaaagcattgtgccaattgcctaatttggccgttttgcgcggcattcgccacagaacgccccgggggaaataaaaacaaaaaaaaaagaagaaaagcattgccattgcccaataatacccataattcgtgaccatcaaacccatcataacataagcattgctccgtccgccgtgtgcaattccccgtcatattgcccctcctcctgctgttgctcctctccgctcgtcatgttccgtctcattaattgcacttctcctcatccccccccctcccccctccgtcatcctccgcccattcatcccctccctccgctccccttcttcccccttcgcctccttatccccaaaacaacaatttattcattcttcttgcaatccttcacatcgccgcagggcgggcggggcggaagatgcgcgtcggatggttcgtccgtttcttcgtcttttcttcgtcctcggggaattgccctcggggaggacagcggcgggagggagggggcgggatgagaagaaaccgctagagggggacaattgatggtgatgatgatgatgatgacaatgacgaggaggggggaaggaggaagaggagggaggaggatgacaatgggttccggaagcccagagggactgtctcaagaagatgaatagatgaaaagaggtaatatactttaaaaatagttgagacaaaatatccaagaagaacaataatctatcgcaaaaatcttaattttttcgatgaagcgccaatcggcaccgccggggccaaaaattcataaatcttaaacacgagagttctctcgagtcgagaccgagagtctcaagcattgccaattaaaaaataatgcgctgctttcccacctccgtacccgaaatgtgtctatccccagccatttccatggttcgtcgagtgagcgcacgcccaattgggggtcccgggtagcgttccttcaagtaa

SEQ ID NO: 10413 - DNA, 2339 bp, Heterodera glycines
gcgcgcgggggggcgacgaccaggccctgagggaaatggcccgacgggcactgttggccaaaattgaggttcgggaagaggaagacgggtccggaacagcagcagatgaaccatttgccctttccatagcaatatgagtgggatttactgaccacaatcaccagcagaattgataatctcatgcaaatccttttatttctccgcctaattacccaagcggacattgctcctttagttacacagtatttgacttttcaagcgcaacaaatgtaaagttaagggagtaattaaaataatccaattaactgggggggggggagaagaagagaaaagagagaaggagaggatttgaatatttatatgttttacccaagcaataaattaattaattattaattaatgatgccttagcaaatttaatgagctcaattaacaactcattgttaagaacatatacacacataattgtttttttttattttgtaattgatatgaaagttataaaatttggtaattatcagtgcaatttgaaaaaatgacaaatgtaaaatttaatatttaaaaagtaatgtgtatataaatacgttaaaatgggcaattccattctttcttcgccctttgtactcaattcaaaaggcattcattcagcttatttttggaaagtcggcacaaataaacggatggacggacggacagatgacatttctcggcacaatcaatgcttttccggagcaatgccaatgccgggcatatttcgcccttccggcaacggatgaacgccgctgaagtgccccccccccccgccttcctcgtgcccccgcggctcactccgtccgctccgaccggcacactgagtcccgtgggcaatcagtgccgatctcaaatgtgcacttgtaaattatgcccagttatatgtgaaaaagtgataagctgataagagtagttggtcactctgagacttctgtgggtctgttggaatttgttgtgccattttctgtgccggactgattttttggcactgaatttgcttttgctgtggtgttatgcctggccgagggccgaggtttgcttttcctcgccattgccagaaggtttttcgttacccagccacaccgcaggttcattagctggcaaaactcaattttgcgcttctccccacacttcctgtgccgccgttgccgttgacgggagtcgttccccccctctccgttccccccccccttttttttattctctctctctctcgctctctctctctctcgctctctgtgtctctctttgtctctctgtgtctctctttgtctctctgtgtctctctttgtctttgtgccgtgccgtctttaccgctaatcataattcgaattttccgtccatttttatccccgagacataaaacaatcaaaaaaaaaagtcactaaaattttatttttataaaattttaaattcaaaatagcattaatattcatttcaatattttttggacatgttggaggacggccaattgagtcccacgggcggcctttcgaccatcgtcggttgcatttacattggcatcgcattggtcggcttggtccttaacgtggccacttgtgtgatgatcgcttcaagacgggtgtgtggggtgatcagcatcagctaactgatcagaacccaagacttttcagtgattaccatttgctcttttcaggtgtatcgcctttctgcctatacgattatggccaatgtaattaattaattaattatctttttttctaaatgttaggttgaaaaagtcaaatttggcattcaaattgctttgagtttggaattttcggtggcacttgccgactgtgccacgcttatcgttgcgggcgtcgcctgcggatgcgctttgataattccgcctggagcagaacaacttttggcaaaaaacaacagctcatgttttgccgaaaatggtgtcgatggtaatttctcttctgctggccaagtgattggcgaatcactcttcggcatttccgactttggcatcgcttttggcgaaatttcttcatggactgcgggtgttttgtcatatgcttatcttggcatcaatcggtcatatttgaacgatgatttttagcagaaagaagcgttatcattaaacacaataattataaattatgtattttattttattattttttggattttattttttatccaaatattaaaataaaataaatttttaaaagccatttttaattatcagttgtgtggccatccgcttttacggcactcgtgccaaacagttgaaccaagtttgtgtggcaatgattgtgtctgtgctgagttgggccttcggattcgcattgggtgaa

SEQ ID NO: 10414 - DNA, 3182 bp, Heterodera glycines
tgaaaatggtgaacaaacgattaaaaccataaaacaattcggtacaaaaaattccaaaactcacgttttggagtcgaacagtcgcccggccgatgttgcggacgcccaccgatgtaagcccagcgatgtgtgactcggtgtaaatgtgcgatgcgcaggtcacgccggattccggatgttcgacgtaaaaggcggagatgggcggatgatggctgacttgctcgccgatgaacgtcatctgaaacgtgggaacaaatgttagatttctcaatgagtgacgaggctatcacttaaactggacctggttggttgctgagcccgggaacggtccaccggcggttcggcttgcggacaacggcacgccaggcagggtccaacggcaacggaacacttcgcccaggatcggattgtacggcttcttcgcgtcgtcggttttgcgtgcagggtagaaggagttcaagtagtatttgaggacggcaaggaatctgaaaaattgttgattcaaaagcgaataaacactgtttctcagccgtattctcgtaggcgccggcgaaccttcgcctttttaaaaagccatgccaataaatggggatttggtcccggcatgtacgtctccgatattagtgggacaaccctaattcggattgtcaaaatggaggtcgaatttgcatttaagacgactaaaccctcctattaaacgccaccgatggcgtcgatcattgccccttcgcgcacatgcgcctcggcggagtgaatgttgcagaacaattgttgcgaaatcactccctcgccttggtcccaaagtgccaaaatgcgtttcagcttctcggattgctgaaagtgcgttggcatgtgattagaaatgtattttacccccaggcgaaggacgtcaattgggacggattggtcagcaaatagcagaagaaggacacctaacaaataaggggggagggacattaaatgggtaataaaattgccattaaaatccatttaaccaaattttgtagaaatggaaaatgtgaccatcgaatgacaccaaaactaattgcagaaaacccatatttatagttgaaacaaaccaacaaagtgacggagagtcggtgctttgccagccccttttgtcattagtagttaattacccaatcaaccaccggcggagagtacggtaagtgttcctcatcactcacaaattcccctcacctcctttttggtgggctgtgagtgggcgtattccgtgcaaatttgtgcctcctcccttctgccaatgcgctgactctccgccgcattgccccgttcttcggcgaccaccaaacgctgcagagaatggctgtattctgaaagagaacgaatgaatggccacacacaccgtagtaattaatgaatgataaatacatttttttcactcttggattattcaatttcaatttcgaaagaaataggtttccgattaaaaattcccctgcccttttattacgttttattgcgtttgggtccctcttctgctgttgtcctccttttccgtgccattgtcgtgtctccaaatgggccactttggcctcgtaaatgcgtcgattgcccgcattcactggcccccaatgcaattgcggtggcgcaaccgttcgcgcagttcgtccagccgaagcatggcgaattggtgccgaagtgcgtccagcaaagcctcgtcagagtggcgttgcacagcatcaccctcatcatcatcaccatcgcttggctcaccatctctacaaactcggaaaattcttaaattattggagccgcgtttccgtaagcaaaagggtctcccctacagttgccataaaacaaaagtgccaatttttccactttctttaaaattccccctcccctccaccatttccgctcttcgatcgtcttcatccttctcgtcaccgttgttgttgttgctgtcctcctctcgtgctgttcgccatgtctccagcctggccacgttcagttcgtcgtccgtcgttgtggtccccgtggtgttgtcatccgtcagaaatgcctcccttacaattagccaattaaaagcatttatatgttaaaatcaaccatttcaaatgagagaaatgacggtcgcaaagaatgtcatcaaaaacaacgaaaacataaataaaacaagattccacaaagtttaccttttttgatgagctaataacaaaaattaaaattcaaaaattcgcatttcgatgggtttaggtgttcaactttttattggaattagggtccggagtttcagaattggtcgaaatatatccgtgtggttttttcagatttcacgaaatcaaaaaataaacgatgatttccgttaattttcaaatgcgagtcaatggattgcctaaactttgtcgaataaataaaaatttcagaaaaaaatgtcagcgtttttgtgtccgtcctcaacccctatcgttttgcaatttgtcattcaaagcatagattctatcaaaggtcgcgcgaatcggtggaaattgcgctcagcgccgcgtctcccaatttgaagatggactccaagacggacagttcggcggaggtcgtgtcgaggcctgcaaatgggaaaacgaaattttttgtcgccaattttatttcgacagaaaggtaagtatttgattttgaaatgaaaaacccaaaatggtaaggctcactcagcacgtcactaccaacactcgcctgtgaatgcgatccaatcgttgacgcaacagccggcaccgatcagttccgagccgcggttgaccgtcccggcgaccaatggcactttggcgagcgaggcgaactcgcgctgcacctccggcggtgtttttgctgccaccaacgcaccgtttgaagtcatcgccgcgtaagagcccacctaaattgacgaagggttttttgtcggttcggcttaaaacagcggtgaactgcttgaattcgtggttcccaaaaacggatgaacattttattgtcggttcggcataaaaatgtccgtgccgccaatgttgtcatcatttttgtacaaccgtgcgatgccttccaacgcgccctagtggtcggttgagacagagtgccaacagttggccaaactttgcacgagcgtccgccaatttcccatcacgttcaagcctaaaatgaaaatttaataaaaatacgtgcaatatgaaaagaaatactaattttgcaacagattt

SEQ ID NO: 10415 - DNA, 2047 bp, Heterodera glycines
  misc_feature (9)..(9): n is a, c, g, or t
  misc_feature (192)..(192): n is a, c, g, or t
gtacttgtnggaattccggttggttcggctgcagttggacggcagctccaagtcagtcagtgcggcggggaaattgcgacagccggcacaagccgcgccacggccagcatacgcgtcggcacaatgctcgtacacattgagcgccttgttgaagcactgggccaagcaaaattgagggggaacaaaataccnaatgtcataaaaatgggaacccaaaattttagagccatgtcgcccaaaaagatttttgccatgcccgtgccgtggacaaccttgatagcctcgaagcatttgttgtccctcgtcagttcggcatcccgtcgcacgtgtgccatcaatcgccaatttgagcgactgttcggcacggagctgttgcgcggttggcatggccgatgatgagggtgacatgccaccgctgtcatggcgcacgaaagcggctaatttggcactgagtgatgggaggccggaggaacgggcacagcccaacgaaacgccgagctgggcggacaaattggagttttcgcgcattagttggagatttaaagggttacgaacgaaaaatcacattttaaaacccgtgtcttttgttcgaaatttccccctctccccccgtcaaaaatggtactgaatcaaccacaaaaaatacctttttttcggtgtagctgccgcttttaattgcatgtaaagttcggcctaaacgtccatcccagtccacccacgtacctcgttctcgtcaatttccaactcaatctcttctcgccattactcgtttttgtgtgcctctgaatgaacgtctcccaatgccagaatcattttatgttctcaataaatgcggctttgaaaatcaatttttagagttattgagcttttcaatttatatagatcacaattaacaaattaatacctttgcagccttaaatttatttccatgtcaacaagatcatacgtgtgaaatcagcatttacatgaaacgagttcgcttagctttgctcccttgtccatcgtcttcttccgcttcattttcctccgtttccttctcttcctctccttcattttccgcgtttttctccccttccttttccgcatttttctctccttccttttccgcgcttttctctccttcctttttcgtctcgttgtcctccttttgctccactttttctcccttcttctttttgtcctcctccatttcctccacttgtccgtccttttccgcttcttctcccttttccttctttttgtcttcctccccacctttccctccaacgcgttccttcaaaaattaattttcttttcaaattaaaaaatttttgattaccaaaaaattggcatcctcaagagcatccacaacacttacagcgtccagaaaattttgctccattcgggacattttttcctccgattctgctgggcgctgacaaagcgtgtttcattaatggaaaaggaaataagttacagttctacctttgacttggtccgatctgccttgagcgcctgcttcaactgttcgttttccttctttaaatcctcgttttctttttccaacttaaccacacgatcatccaactcggcaacacgggcatttgcctcctccttctccttcttttccttttccaactcagccgacattcgctcgcatgaacgtttaaggtcctcggcattctcagatgcattaatttttttttgttggagaaaaaaacgcaatacaaccttttccagaaactttggttttttcaaaagctttagatttttcatttttaacttatgtgccattaaaaaaatcaaaatagaaccattttattcagaaaaaccataaggccataatattgttttttaaatttttgtgcattggcagaaaacactgaattcgttgatcaatatgacatttgtgcaggctttacgcatgataattgcccataaaatcataatttttttcgtggaactttgttaaaaccaattctaataaaggggttggggggtctgggaaaggatttgcgaagcccgggagggagcagttgactgctgggtaatagtacggatggtatga

SEQ ID NO: 10416 - DNA, 2331 bp, Heterodera glycines
  misc_feature (2276)..(2276): n is a, c, g, or t
  misc_feature (2294)..(2294): n is a, c, g, or t
  misc_feature (2310)..(2310): n is a, c, g, or t
gcaaaaagcttggcggtgggcgttgggatggcgatgctctcgggtgcggtcggagccactgtgaccgcgcgggagattttgcctgctcccttgcgggcctgagccgttgctctcctcattgtgcgaccatcacagcccgggctcccccgggccgcccctgtcgacgcggcccttggtcgcgacacccaatcggcgcacgcccgccccccgcccgccttcgccccctactcgctgggtcacaagggcccgccacgaccctcggcggaggctggggatttattagcatttatttagcgtagaaatacgagcagcagagagtgtctctctcaccaaacacacactatttcttccacgaaatgggaaccaaatatatggaaaaggccaaaaagcattatttttttaaatttcgaattcaatttgaacagaaaatttattatcttaatgatttttcatataaaaaatttttagaaacctctaatttttagtaatcaaattcaattttaaaattctggacaaaatttgttaacaaattttaaaaagtattcagaaaaacttactgacaaatgaggttaaagcaaaaaaaaaagttcaggaatccgtccaaaatttttctcattgccaccgatgcaatttcgttttcttcgcttattggcagatttccaaaaatgatttccaatgatatttaaaaccgcggaaaatatgcctgttaaactgttttgttaaggtttaattttttgaatatttttcaagccaaaaggccatttgcaatatttcttttttgggaatttttttttaattttaagacccagaaactacctattcacctttatcaattgaaaggccacttaaatattattttaattattattcatattaacttttttattattttatcattaatgaattaaatgcttttgctttttccccccaaatccatcaattcgctgttacgcaatttccgtcaccacagacatcggtgaggacaaaaaacagcgcagaacaaacggtgcgcaaatcaaagcggctaattgaccggcgaaacgcattaactaattggccccgtgcgatggttacacttttggccgatgcttttatggttcagctgctgattcactctttctttcatacattcgtccattgttcgtctgtttttttgtttgtttattgtccattgtttttccgcgtaatttctacttaaattacttttggtatttatttatgcattataattttttcattaattttccctgcgaatttaatatttaatggggagaatccgcgcatttttgacttaatgaatgcaatttgatgttcattttcaaaacaattaaataatgaatgtccgttgctttgtcctaatttcgtcatgtctcagcggatttttggtgctcgtcgctttgcttatcattggccttctttttaatgtaaattcggcaaatgaattagtcaaaaagaaagtatatagaaagggaagataatataatttgttaattagtcaattttcgcaaaattaatttgaaattttttaaatatgtctaattatgtccaaattaaggagattaacacattttacgccgatgttctgctggaaatggacgaatttcgcgtgttggccaacaacgcctggggcgaaatgcaggcaattcagcagcaggtggtcaaacattatgccaacatgtgaatgagtgatcaattaagcttcaaattgattcagggtgaccattcgcccctcctttggttgacctcgcgcggaaaacgcgtcagccgaaacagtgggggcggcggcggcactttgaggataagcatcagcggacacggatacgagttggtgcagcagcagaaacaacagacagtggaaaacacacgtaaattaaatgattggcatttttttggaaaataataattaaataattaattgattgtcaattcagaatcggtgggtaattattacccaaaagccggcgggggaagcggcggttacgcacggcaacagcaagtccaagtggcaccgtctgccgcaggaggtgaaaagcaaaattttccttttccaaattttttgaacatgaattttctcttttttcggcttcccttatatttttggcgatgtgtcacttttaaatgtcctcaggtggcggctattccaatgctgcaatgagtagtcgcgtctctggcggtggcgaaacagcacagacggcgataaattgtccagccggccccccgggtttgcctggacacgacggcgagccgggcgagcacggagagcctggacatcctgngcaagacggcatgcacgngcacgaggtggccggntgcacacatgacgccagctgc

SEQ ID NO: 10417 - DNA, 2812 bp, Heterodera glycines
  misc_feature (2746)..(2747): n is a, c, g, or t
  misc_feature (2778)..(2778): n is a, c, g, or t
ccgcccggcggctacgggcccccgggcgagcaggggccttccagagagccgggatggcatggaatgccgtctcggacacttgttcgtcattgtattatcattaggatgtataccccgagttttagcctggtccccctgggccacccggcgatgtcggattccctggccaaccgggaaaccccggacaacctggccttcctggccaagatgcgaatgacgggagtatgggagcggtaaccttcaaataattttattttttctttattttaattttagcccggccttcctggcccgcccggcatgcccggaatgcctggtccgatgggcatgcccggcacaccggcagggcccggcatgccgggacaacgcggctttcccggaatggcgggcaatgttggcgagcccggacgtgccggactcccgggaattgcaggacaatccggacagagacaggcggacggcggatagtcagttttttttaatttaaattttaaattttattattttttaattaaattctttctttcagttgtccttgcccaccaaaaaggaaacagcaacggtcaatgcttgttgttggagcggcaaaaaggagccttctcttcccgtagaaaatttcttttttgtttagccaatgaataaatatattaattattctttaacattgcttatttaatttgtttatcacccaattatatttcttttattaataaaaaaaattaaacaaatttctttatttttacttttatttttattatcccttttttgtcgtgtctgccaattaacgtactttttttatagctttaaacaggagcttaattttaaaggcataaatctccattggtctgtcaaggattgataaaaagatcttctgaaaaagactcttttcaaaagatgactcataaaatacgcagaaaagtgccaaaaaatatttaaaaaataagggcaaagttaaacttatttttattttattaaaaaaaaaaatctttagaaaggtctatccattaaagcggccttttataaaaaccaaaaatttcccaaagaagtttctcgaaacactattaaaaatttaacttgctaaattttgtaatttatgtcaaatgaagtccaaaaaggaaaattttctttacttgattttctcaattaacacttttagctttttctaaaattgtttttgatgccatatttatccattttcgagaattttaacctaaatttagcgaaaatgaatgaattttggggaaattttaccctaaatttagcgaatatgaatgaattttggggaaattttaccctaaatttagcgaatatgaatgaattttgaggaaattttaccctaaatttgaaaaagttgtgtacatttttatgattatctgcatataacgcgagttctgtttatgactgactatatgtataaatagttttggcatacaaatgcatcggatgaaaacggcacaaattaagaaatggaacaattaaaccgaatttgtaacgaaatcacagcaggaatttcgtcaagacataattggccacgtcaaattgaaatgggttttcgccaaagttggctttgattttggcatttccaaacccgcaaaaactgatcgttgggaaaagtttggcatcgtttgttgccgatcgaatcaaattatcatgagtccctaaaatctttgaaaatttatttattttttacataaatcactcacaaattaattctccatttttcgtgccaaagaatgcattggcattgtacccaaatccgaccacatcgcccgcgccatatgcaatttctgattgacttttgggcttctcctcgtcatgccgaattatgtcgtcgccattggcacaaaattgaccattgcttttgtacgcaatggcacttggcaattcgcataaattcacacccaaattcgcattgagaagtggcgaaactccaacaagaaagcaatccctatgtttttttttattagtaaattctagaaactaatgggtgcaccccaaaatatcgccgcccgaaatatcgccgagacaacatattgccgtagaaattgaaaaagaaaattaacaaacttagaattttcattaaaaaaaatcttagaaaatttttataagaaaatttgaagaaaaaaatcattgaaaaatttttttttggaaagtttttcgaaaaaaaacttaataattttcataaaatttcaaaaaaaaaatcgttgaaaatttcaaatttttttttatttaaattttcccataaaaaaagtttgttaaaattttttctttaaagatttataagtttgaaaaattttctttaaaattctgcggcgatattttgtcccgtccccaaaactattttatttacccgcaatcaatggcaatttcgaagtaagtgtaaagtcctggcactttttggccccattttgcctgcacaatttcgtttcccttcggtgatagcagaagcttttgcaacttttgctctccttttgtttgtgccgtttcggcacttcgctttgatgaagccgccaattttaaagtaaattgtgtccctttttggccccattttgctttggcagcctcatttttgtttgatgttgccgccggtgacgtgaacatggtcggcactttttgcttctgttttgcttgcgaaggttcaattgttctctgtgatgaagtcgacgcagaagaataagcttcttctattttcattatcagtcattataattaatatatttatttgattaaatttttatatttttannatttcaaagcgaaaaataaattctttaattntgtattttggtaactactaaatgcaagtctaatt

SEQ ID NO: 10418 - DNA, 5039 bp, Heterodera glycines
caattttactaatgtgacaattgtaagggaagtaattcaatgatcgtctcaaataattattgtaaatattaataaatatctggaataagaatttagatcacaattttgagtcttgggttttcaaacttttgggtatgattattttaaattttgtaaattttttcaattatttttcgataatttttttaggttcgatcgagcaccaaatggaacacttctttcttaattaagacacgtatatttttaacataattaagatccaatacgatcgactttaggatattcgtatacataggtaatttaattacatattgccaagatactaaaataatcagaacactcaaaactgatatgcttttcacaagaatcacagaaaaatcatattgaaggcgctggggccgaactgagccggtccgtaaataacatatataaaaaaatgctgaaatatgtaacaaaaaaaatatacaaaagccacaaaatatgtaccaaatgtgtttatttacataaaaaggaatccctagaaataaataattaaacatttgttgtttcttttctattaatcttttttttttttaattttaggagacaataacaacggtaatttttatgctcacaatcagttttttttaatttaatttaatttatcgagcaaaccaaaggcacattagtgctcttacatggtgccaaaaagaaaacaaaacaaataaatttgatcaaaataaaaaatacaaaatgaataccgtaataaaaataaatcaaatgttaaaaattcacaggtgattaaatatggaatgtaaaatatggcacatgaatattcctactcagaactcattgcttttagtaaacccctgaattcctttgccttattaatttgcaccgctaccactggaaggttattccagctttttactattctattgaaaaaattattttgagttttggccgtgtggcgctttacccgtaaaagtaaaggcctcctgagcctttctgagaaaaagaaactttttccagcatcgaggctggtgaaccctttgattattttaaaagctgttgtcaaatcattgatttttcttctttcttccaatttgtgtaaacccgtgatttttagtctttccccatattttttgtacacaaaaccacattttctaagtgcttttcttgtgaaaaatttttgaacacgctcaattttatctatatctttttttaaattagggttccaaacttcggtaatgtattctaattgaggtcgtacaaaagttttataggctgctgttagagtttttatttccctgcttttcaacactctcaaaatttggaaaattctaagatatgcgtttcgtataattttgctaatatgttctgaaaaattaagtttcgagtcaattataattcccaagtcacgtacactttctaaggtgattggtatttattatgacactaataactattgattgttttatgaaactaattaattattgatttgttaattaattaattaataattatttattatgaaactaattatttattatgaaacaaattaactattgatttgttaattaattaattatttattatgaaactcattaactattgatttgttaattaattatttattaggaaactaattatttattgatttgttaattgatacattaataattatttattatgaaacaaattaactattgatttgttaattaattgattatttattaggaaactaattaactattggttgttaattaatttattaatttcccacaaaaaaagctgccgccccgcccattgacggagctcgctgaatgcgaaagtgcgaggcaaaaatgccctcatcatgagtacgcttgtcttccggaattcggcgctcccgcgctaacctgttgtggcgccggctataagttcacttgcatggaggtgggcaaaaaaaatggcaaaaaatgccgaccattttaagtaccgtaattgccaccctgggaactctgtctcaggcaaatacggtataaaattttactttttcaccagtcggggttgggaccctctttacattttgcccactttcttttccccactgtgtctgacagttttctccatcttattaccaaagatgtacagtatagactgagataccgtaacatttttctaaatcgtaattaaaaaaaaattatatttttattcaactacactctgtccaactgtgaatatgattgttgttcaattttcagccgtcctttgtgtgggaagaaaaatcgccggtagggattactgtattctgcgtgtcaaattactgtgttttttacatttaaaatgcattttactgtggtccggtttcgtcttaagctcgaatatctggccaattattttttccacgcgcccgaatgcgtcggcaaaattttttgcgcctgccggcgcccgtaccttgtaagcccggaacgctttgttggcagatgctgcgacagcagcccgagctgtgcatgttgccagaaggtcatgtcaatctcacgctatcatgcttgcaatatggcccgattcgcgatcacagattccaagggatttgaaaagtcgaaataccaattcctggatctgatagttcagcttagagcttgacatggacttgggtccagaggcctggattttttctgaacctgggttttcctggatttttgtccaggaattaattataggtccagcctaaacatgaaaaaacttaggtttcttggacaaaattttagaattattattccaaatgacttatcttttttcaagttttcaaaaaatgattaaataaattaatttaaaaacatattattcttacaaattagatattttcgagatattcgtaagacaattaattgaatttttgaatagattgtatttgttttttaaacaaatttcaaaaaacgaagatcaaggcctggattgtaagaaatatgtaatttaaacaactaatttttattttgattaacttttttcatttaatttcctaattttaggacccattagtggtcaagccatcactggtatggaaatgctttaccaaaaaataaaaatattttattaatttatttgtttaaattagctaagctcaatacggatctcggaagagtgccagaagatgcttggacaaacacccaattgttcatgtccgcttagttttgaaataagaatgtggagtaagttgtcaggaaaaaagaatttcaaaaaatttttcaatgaatttttggaaaaaatttttgaaattttaataattcatcataaaatttttcgaaaaaaaatctgtgagtgtccagatcatttttgaaccatttttatcatcgtatagagagagatagagtatagtcaatttaaaaattatttcgtcattttgaacaaatgtatggccaaaagtacatcatcagaaacctgctggttttcactcaatcttgggccataacttttttgaacctcaaccaaattttcgcaattttgcagacaaatagataactcttagggctatcaaatgatatcgaaaatcaaaaaaactggttgcttttgcgcaaagttatagataattttttttagaaaatttcattctcgacgagccttcccctccccccttattatccagataaatggggcccaattatattctatggtctcgacatgcccgaaccgatctttgtaaacaatccgtcaccccactcgtgcgttgcggagccgggttggccggaatcggcttgctgcgccgagggcagtcgtctcgaatgttgcgcatttccagaaaaggagattttggttcagtttttgagtttttccaggacattttgttcagtttttgagttttttcaaacaaaaaaaaacttgaatttctacaaagtgaactggtgaagctttatagaaaacatgcttcaaagtgatcactctcatcacaaatccggtacttttccgaaccccggaaccgaccgaaatcaaaaatgcgaaatttttaaaaatttgaattttctgatttttttgttcgaatacggatttctgcgggcgctcagaatttgtcaaaatggatggataatgactctacagaattttttgccagtggatctatgaaataatttgtcccattcaggcattactgtattcatcggaccaaatgaggtgtgtatgtacaaattagagatcgcataactggggtgggaagtgatccggcccgaatccttgtccctcaatcccaaaagattttggaaaaatgatggggacgaatcccaagtcgggatcccgaaaaatttcgtggggtcccgatcaaatcccgatcaatcccaaaagatattggaaaaatgatcgggacgaattccaagtcgggatcccgaaaaatttcgtggggtcccgatcaaatcccgaaaatcccaaaagattttggaaaaatgatcaagaatcccaagtcaggatgcggaaaaatttcgtgggatttttgagctttaacactagggttggcccccgacgtcggggttggaaaattcggggttcggggtcttcggggttggaagcgtcggggttcggggtcggggttgccaaatcgttcggggtcggggttcggggtttttcaatttttgccttatgccatatagtcaaattttttttataattttagcttaaaaatttttattattcataataataattttatgcatctttttatttctttttatcataaatatttttgtatagaattaattaaaaacgataaggcatttttaaaaagaacaattttcagtgaaaatctgtaaaaatagtcaaaatttcaaatttttcctccggcgccgggcctccaaaacttattttttcttaaaaaaaatttggctcaaaattaaaaaattggttatttttggtgaaaatcagtttacaattcattctaattctctaattttcagaaatttttcgcggtggcgcttaccgacactgccggactcttgttcccgaaaaaattgttatttttcaaatcatcttttgtcgcggcgcgcatgttctaaagacttttggagaaatgtgtccggcggtgccgataggcg

SEQ ID NO: 10419 - DNA, 1098 bp, Heterodera glycines
ggggggggggggggggggccccccccccccctttttttacccatcaccattgttctcccttttcagtgcgtaaagcttcgaccaacacccaatgatcaatttccattacatgatgaaatggttgctgtgaaattttgtcctgaccgcgtttcgcctggctttggcaaaaagcattaccgcaaagtggactgtatgctgtacaagagtacaatgcgtcaacggtatgttgttggttgtcatacacttactgtacgctagtatactgtataataaagtaataataataataataaataaattgaaaatatggctggcgatgtcttccttacaaatcaatgttataaaaaataagtgttacaattagtatatattttttaaattaaacaaattttaaaatgattaaaaaagatttaataaaatttttgtgcacccatttaaattattcaatttaattacatttatcaattttaggaatgttgtaaagttaacgtaagttttttattattaaaaataatttataaactacacaatattattattataaatttgtgagttttttctctcttttttttagcgttgctgctttgaaataagagtaagtgataataataataactaactctgacaatcaaatatataaatccattggatatattatatcctattaaaaaagtgtgtggattttcaattttcaggattgctgtgggcagcagaaggaaaaatccgtaaagattgatttaaaatcattacaaatattatacataatatgttaagaaatgctgtacaccaccacacagcgaaaatgtatgttgatgattataaaaataatattatatataattaaaatgttttttgtcatccaaatctcgcaatcttgttatcactcgaaagcttaacatgtttagaaactttttctaagttattgcttcgcgattagacaattactaaaaaagttatacttaaaaactgcgaaaaagtcgaaattttgaagattttctaaataaaaatttttccaggcttgaaaatcttttcgtttttttgtaaggctaatagagcatgttaagagctttcgaatgataccaaaattggttggatttg

SEQ ID NO: 10420 - DNA, 2422 bp, Heterodera glycines
ggggacctctagagtcttgtcttttcagaaagtcatgcttaaacaactgctcaaactcgcgctcaataccctttcgcgtcttttgaattcgtccgatttgagttccgctttcgaccaacaagtctgcgacaagttcctcagcgtcgcttccctcatcttttgctggaactttcaacctaaacacctcttcctggattttagaattttgtaatttttcccattctctgttttcaataatttcctgtccattcttctgtttgcaattgtactttctctggtttcattttgattccttttcagattccatgcgtttcgtgcaaattccttccgccctccccaagattggcatgagctgttccaagatgcttcaattgtcactttcttcatgcaagtaactcacccccccccccccaatttattaccgttttgccccctttaaaccgctctttcctcttttagttgcacagtcgtgttcgttataatcagcagttgtgtcagaattcgttgacttgtctcgcccaattggcctctgcgatgggcgactctttgagtctcggcccttttgctttggttattccgcaggtcagcagcgaccttagcgagcgtcgtttggccacgtcaatgggcggagcggtggaaaatttgtctgcagaattgtcaacgcacgacttgtacgtgcggacattcagtcgcgaactcgtccaactcttttccgggtaaaaactatcatttcaaccaagtgtagtttaaattcttcaaaatactttattgtttttacttccatttagagagtatacccaatttcttttccaattaattcctttcgtctctcaggctggtccttgaccatgaaatggcttctctgtctctgatcatttacaaattgttgtcctgccaacccattcccgtgtttaaacgctttccagccgatctgttgcgcagttttgtcgagttcgtctcctccaacatcgtcactctcgtcgagccttccatgcaactcgctttggttttggcttctcctccctccttttctgtgatgcttttattccaaatattcagaaaaatgaccacacttaccacgagcccattggtcaatttctttttcgcgatggcgcactttgctccgtaccctaaataatgacaatgaattgggcgataaacgaatttgtccgcctgcaaactcggaaaataatcgagtgcttcttcaactccgttttttcgcctcctttcggaaatcggacaaaagtttaaaaagaaatgcttttaaatcctttaactttatttttttatttcccacagatttccgataacgaaatttttgaagagaatgaggaggaggaggacgaccagaaaacctttatggatttgctcattgacctcggccatttctctctccataccatcgattacttcacagatttcgtcattgggttgctttttacgacacaacaattaattaaattgcctttgtttttacagtgctttggtccagcggttgcgcgagttgtgttccatggacgtcagggcgtgcactaatgaccaactaatgacttggcaggtggcaattttcttattaacctaaacaattagcttataaaaggattacattttaggaagactttcactggcttctgctcataatcggtaattatgggtaattattgctcatttatttttcgtctttccttaagacagtttcatttggcaaccatcgtacagcaacatcggaaattaccctgaagagttggcattgcgatgtctctatttattccatttctctcttaatttttgttttcataggtctcaatggctacaaaagcggcgaattcgtcaaattggacgactcggagtcgctgttttgcgcttgcctctccaacccgccgttcgaccccgcgacataccccggcaaattggaccccgtcacactgtatggcactgagttttacctaatgattctgattttccttcagtattgccacacagatcctttcttggttagttttcgtttgtattattcatttttttatttgtttaatgtttcgttttcccttaggttttctttggaacaccaaatgctcgtcaaattgggccccggcgcttctctgctgagtcccaccctttgtgagacttccttttccaacttcaacaatcttcttgttctgctgactccgtctgtttattggtccgccgaatctccgcagaataacgaagaggtgaaaaacacaaaaccaaaccaattccatgttgtgacaagggttgagttttacaggacgaagacagggagaggaattcggagatcaaatctttgcccacaattccgagagggggcaatttgtcgtcccaaattattcaattgtcgctcgacaaatttgttcaaatattaacgaaaatgcccagcgaaaaaaggtggggaaactgttgc

SEQ ID NO: 10421 - DNA, 2329 bp, Heterodera glycines
tctcgaccctttgatgtcgcgctttttggcattatgtgccagcaaagggaattgctcggacgagtcggccttggccgattattacgaatgttttgccggcgttgctgagtctggtcaatcggacacagcggacactttgttcggtgctttgccacttgcatttccttggctttcattttgtgtttttgttagcctttttgttgcccgctttccaacattgtgttcctctgatcactgcccaccccgactctcgagtgctggtcgttgcaattctcgacttcatcaagtcggcgactgatcttctctttttccacggcatttactttttgttccaatttgtgccatgacttaaattttcgctttcagttgaccatggtgctgatttgccttatcaccaatttctcatcgatctcattaatgcctacaaggtgattgtttggttgagactgggaatttggtttttgcatttccattgtttagcaaacgcaattccatcgctttcgttccggtgtttttgtgctgcgcggtgacagcagcgaagaggagcagcagacgcaggatttgagctcgctgatcgaaatcctttgtctcttccactcgaaaacctatgtgccgcctctttctgttacggagtccgaatgtttggcggggagggagaaaatttcgatgcatggtaaacggagaagcatttgagattggtagatgaaaatgcattcgacagggttggagctgttgttgccgttgatgaccgaggagttgctgaatgtgccgcatttgtgcgcctctttctttcggctgctcatttttgtttcggacatcgccgccgagggaattgcccaaagtccgccccaaatgctcgacgatattttgcgttgtgtgaaagccgctctcgactactctttcggcggggacagagtccgttctgcgctcgaaattgtcaacggattggcagcaaattgtgtcgaagactccgtgaagaaaacggggaaatatgcgacaatgactgaacgtcttctggccttggttccggtatttttttgcgaaattagctgtcacttttcatttctctcccaagaaaatgtttcaattggccatggagtacagcttcgagttggatttgctgagtgatgcttcaagcgcacttttttccctcatccttctcggcccggtcctttttcatatcaatcaatgcacttgttatttattgccttcctaattaactttcaggattcattcaaagccttcgttactcatttgctcaacttaccatccaatcaagaaaaccgagagcgcctggaggaagcgtttagccaacttttgacccctttccccggcgttgacgacatttctttcccggtccagccccattctcagctgaaccgccgctttcagcgtaacttttgaggtgttttctaatggaagaaaagcatcgccaaccaaagaaacctttcacatttaggattttctgatcagagtcagcggttgtctttgcttaaactgaccaacactttcacaccttcgaccgttcagttttaactgttaagctttgatttgacgggaaaacaaaaccatctcgctttatatttgatcttttgttatgaatttcccttttgttgtttccagtcagggcgtatgggaaagagaaatgaccaaaatcggagctcatgattttcaaaaaggaagacaaattggcaaatctgtcagcttcggtcttggttttctacgccctttctctctcctgattcattcctttttctgattgttaccgaataaaatgatgggttccttagtggaaattgtgccattctttgcaaaatttattccatttacctttccatggtaaaatatttgtggtttcctttttgtttttgcttacttttcctagcattttcagctgtcaaaatgcggttgacatgtcaggcgatggttcggaaactgcacgcggaattggattatgcaagacattttccgaaggtgaatttgcacaatgtccgctgaaaatctaagcgaaggacgccgaatcggccaaaaattgttttttgatcaaattaaggcttatctggacaaagcgcaaaggcatgtccctatgaaagtgtacgacaatcgctttggcgctccgccggtcattcgttgggcgtaagtcgcgcagattttgtggcttcaaattcgtattattttccccaaattgtcagaattcgacccgatgattgggcgatgagaacgaaacgtccgtgggagtacggagaagtggaaaatgtgatcagacaggagaagatgtaccaaaggcaactgttttccacaaaattctaccgaaaaaatggaacagacc

SEQ ID NO: 10422 - DNA, 4450 bp, Heterodera glycines
  misc_feature (4385)..(4385): n is a, c, g, or t
tggaatggctgtctgtttctttctttctttgtttgtctgttccgctacacatattttttcttcctccgtcattaacttcctatcatttttcaccttttcttcttcttcttctgctgctgcttctcttctgttccttctcttcgcatatttttcatttcctttcgatttgccttccgccgatcaattcattccccgtcgtatgaattacgttttctctttctcagtttcattttctgcccgcccgaccaatcatttccccccttttcccaaccatcggcaggggatcttacagatctttccatctcatcctaaattatgctacaaaagtgttatttctttcattccgttgattgagtgagcctttcttccgactcatttgcggtttctcctcctttttcttcttcatttgctgctttttcttcgtcaccgccgtattttcatcttcatcaaaatgtacgttctgatggaacatcgctctcccgagaggcgtcccgcccgctccgttcactccgtcgaacgacatcgtctgccattgctcaggggccgtgccgtcgtgcacagttcccacccatcctccccccatccggcggcaattcgttgtcgctactcaatcactccgcagatgagcagttcggcgacaagtgcactgctcggcattgaggagaaaaggaggaaaacatcgtctggccaacaaccgcaacagcagcagctgaggagacgacaatttgttagacagaacggaattatggcaacagacaatgagcaaaatgacgaggctaataacagaggaaaagcagcggaagagcaccatcagcctaattttcaacagaataagagtggcgagagagcgagagaagcagtaccgacaaatgatcagcaacggcagcagaatattagcaattggacacctaaaaaattgtcatcgtctggcccttctcgacttcggcatgttcaacctccaccaaacataaaaggagatcaaaatggaccggctgtttcatcatcaaaattgcagaaaacacaggcgcatcactacgatagtagcaacggttgtgaacgcattgatcagcaacaacaattgcgaattgcggttggccggcaaccgcttaaatacgccagcagtaaggtgaggccggtgaagacgacaatgccgcaacaacaaattgaaaaaggcggtgaatacggtgacaaagcacacaaaaatagggaggaggagaaggagaacacagtcagaaaacggatcagcaacagcacaccacggcggacgacgccgaacacaacgcgcaaagagttgcaattggcggtgacgccaaaccatcgtcagcaaagtgatgttgaggtgattatgatgatgcacaacgacggaagacaacacaaacagcagcagaaacatcagaactgtaacgataacaacacttatgagcaaatttcatgggacaattgcagcggaaacaatgcaattagcgacaacaacaacaacaacatgatgagagtggtcgtacccaccagggcagttgcaatgactgaatggccacctccgacggatgaagaaccacaacagcagaggaagcggagaaaggccatgatggaactgcagcagaaagggctgagcagaagcaagtcccagtcgcgcaacaaccttttgctagcacaacaacagaaagcatcgctggagcacttccaaatgggccggtccaaaacggcgacaaatttggcatttgttgccggcgaatactcaacgcttggcgtcgacactttgtcactgaacaggaaggggggtggcggacctttcgcgcttctccgtcgtggtgccaatttacgaaagctgtcactgcagcggtgtcgtcccgccttttcgggtgcccaatcggcagtcgttgatctgtttgatgcattacaaagtgatcagagaagggaagagagggagcgagcagaagcattgcccaacggacagtttgaaaggattcagcgcgaactcaaagcattcgcggaacgccgccatttggcgttgggcaggcgacgcaaagtgcgcattgcggagttggggctggaccaactgcacgcgcagttggctaccaaacaggcgaaggccgatgcttcttctggcactgtggaaggctacaattattccaccaaaatgtttcagaggccacgcaagaagccattgcacgagtactacaacgacgacgacgccgaactggagggtgaggcagtggggaagatgaaggaggacccaattagtttttatttataatctacctccaaaaagctaattttcaatttttaagaattcttgagcggacatgctcccattttttgcttttcaaaattcatttgtgatccaaactcatttgtgtcttgtgtctttagcgctggccaacaccgttgatccgaatgccccacaatcaaatggccaattgatagtgccggctcgaggcgactttccttcggccagtacgagtggtgcgtctgcgccgcctcccctgccccgttcaattgactctgtgctgtacaaatgggcaaacacacagccaaagagtgtggcagcggttcagttggacagcggcggaaaggcaaccgcaacattaacttattgtgagagatttatcgagcttgaagatttttgggatcggattttggcatagatatttttttttgaattgtctcaaaattcgcgaaataccgttaccaatatgccgttccattctcttaaattttgattgtagccaaattgctgagtcgtgccaacaaagtggcctaccaccttttgacacgacaagtgacagtgaacacgggcggtgtcaaagagcgtgtccatctgtgcctgcctgacgatagggtcgcgttggtgttccccaacagcgaacccattgcctttttggtcgcattttacgggtgtcttctcgccggtggtcagtttattgtaggaaattcgtttgaaagggaaacaaactcccccttttagttgtgcctgttccaatcgaagtgccaatgccgaaaagggacgtcgccggcctgcagcagttcggctttctccttggcagctgtggtgagtttgtcgtccgacttggctttggtgccaatgtttttctttactctttcctcctctaaggtgcccatgtcgcactcacttccgaaagttgcatgaaaatgctgcccaaggcgggctccgtctcttccgcctcggccgtcccttcctgctcagcttcggctccttttggttccgcctcctcctcttccagtgcccttctccattctccgtcgtccaccttcgcttcctccaacgccttcccttcttccacaacgggttccaccggctccggttcaagttcgggtgctcaacgcgaccacaacgcattcattcaccattccccgcctcagaacccaaacgatgtgaccgactttaaagtgcccacttattgatgcttttaactgcaaatgcctaaggagtaaatttccattttcaagggatggcctcgtctccattgggttgtcactgaacaccttggaaaaccgtccagggattggacactgccatcgttggttgcggatgaccacccggccatacattgagtacaccttcgatcgcgaaggttccatcaagggggtaagagaggaacgaacttggcattttgttcaattcacactctcccatttttcattgtcaggtggaatggtctcgacaagcaatgctcgcccattctcgagccattgggttagccgccggcttcaaggaaggtaatttgcgatgaaaacaactctcatcctaaacctgagggtatcagctcgaaattttgacccatttttgacttatttgtcattttactgatttcccatgcattccctttttatctttctttccgctcagatgagacgatggtttgcgtggtcgacttccgaagggaagtgggcctttggttcgctgtgattggtgccattctccatggaatgcgcgtccatttcgtgccctattcgctgatgaaagtcaacccgaccgcgtggctttcccaagtcacccgccattcggcacaacattccgttgccaagtcccgtgacttgcactggtcgctgatggcgatcggcgaccactcgcaacaaattcaactaaaatcacttcgttgccttttggtagggaatggagaatcgctaaaagttttgcaaaattctttttaaattttattttaagaactgttttccccggaagaatttaaaaaattattatcaaaagttagaaatttttcgaatttcaagaaaaatttttgaatatatttttagcgattttttaaaaaatttatgatgaattactaaaacttgcaattgaacatggttaaatatttgttaggaccaaaactttattacccttttttcattgtttttgattccanattatttccccccccccatcggatttgttcaacttttttttctaacccccttcccaaaggtggcg

SEQ ID NO: 10423 - DNA, 1022 bp, Heterodera glycines
cgggggtggccgaaggcccccctcgaggccgcgaagcggccgagtgagtaccatgggcgcaggaaaattattaaggaggagggttcattatttattgatttttgcaaaattaattttttattattttttgtgaaacttatcagaagcgccccaaactttgcagggatactgaaaggaaaagaattaacctgttttatcacattagcttgtcatcaatttttataaaaaattttcaaaattctgagtcttctatttttatttttgcaaaattaattcatattaattttttcagaaagtgttctgaaacgcaccaatttttttttacatgttaacaaggtcctcttaggtttatattatgaataagggtgaagaataaaaatttttctaaatgttttccttatatgttggttatttcgttcaactttcggtggggtgcttggaaaagtggaatcatgcgtacccgtccgatctgacaagttaagcaacgctggctgactattcaaaaggatgggcgccgtgatgaaacgaaaccagcactgcttaccccgcggcacccggcacggacccctgaaggaatggatttaattaaattctctccttcggggaattttttccattaggtcgtctgttagcgtttgattgctctagtcaatttttcaaattttttgtgaaatatttgtcgtgctctgaagggcgggggggggcagggccgaaggccccgcgggggtgggccgaaggacccctcgaggccgcgaagcggccgagtgagtaccatgggcgcaggaaaattattaaggaggagggttcattatttattgatttttgcaaaattaattttttattattttttgtgaaacttatcagaagcgccccaaactatgcagggatactgaaaggaaaagaattaacctgttttatcacattagcttgtcatcagtttttataaaaaattttcaaatttctgagtcttctattattttattttttttttcaaaattttgaagggcggggggggggggggg

SEQ ID NO: 10424 - DNA, 6189 bp, Heterodera glycines
  misc_feature (6159)..(6159): n is a, c, g, or t
tatatattatttttttttggaaaaatgttttggaaaattttcgtaatttagttatattgaaaattttctaaatcctctttatttgatgaaatgccattataaatcagaatttctaaatcaataagaatattgtagtctttttattataatctaaatttttttattattatgagctttgacttttaaattatttagataataataaaaatattagtttaaatttggtatttaaatttatattttgattaaatgtaatgttattttaataatattctctcgcttatcttagccttaactacagctattgtgtcattcgtgtcattcgctcactgggcacatttattttcaatttatttttattaatttttagaatttttcattctttttcaattaggtttctgtttttttcattttatatttagcttttatttaatttttaaaattctttttgtattaattggaattttaattaatagcctttaaacactttcttttaatatttagaaatttagtaaatatataaataaacttcagtatggtaaaaataaatttattacatcatttattatttgtgcatttattttaatttctttcaacatgttcattcatacatgacaaaatgacaatataggcaaaattagtattttaactttttttccattaaataaattactttacttaactgctgatggttacttttattatttaattaatttattttgtttaatataattttagttttattttttattaaacaaatattattcttattgtatagttttacctaataatatttttattataattattggaatcattatgttaattgttaaaatggtgctagtgaattaataaactttaattctatttatctctgagtaaaaaaatttcgaaataagagaaaaaaaattttagccaagcttctcatttgttattatggtatggaattttaccaaatattttttttgctcttactttaattacatttaatattaatcaatgcgtatgtgtttgatatttattttactaaattaattccattaaagattttatttaaaacttttggaaaatgtataatcatttcgtaatgtataggaatgaataatatttgcgccaattttattatttttgatttttaattttattctttttatgttttacaatgtatttttaaatttcatgctgaatttcctctcgagaaattcatagatttttgtgccggtgaatattgccttaataagcaacattcataacaattaatttatttctttttattagagtatatttttcctttttctttaattaatttaatcttttcttttataaatttctaattttgagataattatattaagatatgcatttgactgattttgtattttcttaaatttaaatcgcttttaaaatcggttttctttttgcgagttattaagaaatttaaaagcggaacaacacatagtggtcttacaggcactccataatagttttatgttttggggaatttgaccccctgggacctcaaaaaattagtgaaatttgaccaatttcaaaaatcgccctaaatcatttgaagcgatattcacagctgaaaatgcagattcttgaattttgttagaacttttttaattgtctatctcttgaagttatttttgaaactgatatatatctaaaatttcttgatgaaatatttaactttcaatctataaaattaataattgcaaattcaaatttaatgatattcgaacgaattcatgttattatacgtagtgcgacatttgcagaacgacttttgtagaacgacatttgcggatttaagtgaattaaaaaaataaatataataatattaactacaatttaaatgaaacaagaaaatgattaaaaaatattcaaatatatgagtgagtttagaaaattaaaaatatataaataaaaaaaggatataaaaattaaataaaccacattatttgctcccaactagagcttcaatgttattaatttaattattcttaggatttttaattaatttctcattcaattctatataattattatttatctcttttaaattattaacttccgaattatccaaaaaatattattctccatttaatatcaactcaattttattttattataaataaatgctcaaaataaaaaaaaatagtaaactttaaaactttaatattcatttgaatttaaaataagatttattgtcgtaataataagataacagttaaatcttagagtatctgtttggttataatatgtgattttcctaaactaaatataattatttatttttttctaccttgaatccaactcctcatatagtttaacaaagtaaaaaaaatactgaaaagaattaaagaaaatattcaattgctcaattattattttataaataaaaatatatgttatagctgacaatatctatttattattaatcagtataattttattcttattttaatatgatatataaatatattagtaacactataaattaaacgtatggtcgattgtatttgacagctctagatgtattttctctaccaatagatctctcttgatactttaatggattaaaattttatcaaataataaaattttatttttttaatattattttttgaaacttaaactgcttatttacatgtttttttacttcacaaaaaaagtatattgaatttactctaaatcgttacagtaaaatgaatgctgaaaaattttgaaggtcgcggctaccttaaggtaaagactatttatttttgttctgatcttattttaataatataattaacttaaaaataaaaatgcctctgtcgcatgttgctgcgtggtaaccaaccatccaggaagcaaaattgaaaattaaatataaaattactttaaatctatggtttccatttctgaaaatttttaaaatttatgtagtacagaatatataaaattaaaaattttgactgattttttgaaaataaaaaaatgaatgtggactgcgagaagcaattactataatgaataattatatttattccattattttactcttaaagtaattaaaaatttttaatacaaaaacaaaggcaaaaagtattaagattctcataaatcgatcaactggacgattggtactcaaattaaagtgaataatggaaataaaatgataaaatataatttaaccgacctgttcagcgtaattttaaatttcattaactgccttcaattatgaaacacactttgaacattacttgtatcggggagcgcctttcattatatatgatagaaatttgatattttattttttgctggggtgtaaagagagcgagaaatgggtgaaagaggggtgcacattcatgcactatttctccgcagcgctcgtttctttaccgtaaaataatgtaatagttagtgtactatttctcccattgctgtttactttctttctattgtttgttgttgtttttttgaataattttgtttatgaaaatgtttttagaaggattttttcacattcaaaagtattttttttaattttagattgtaggattaaaatcgttgatcgtttgaacaataactctatttatgtaaaatgggtaaggtacattgggaaaaactcatttggtcaattaattaataatttaaaatcatataggtatttcattttgcatgaaggcactcatcaaatactgagaaagtgccgaaaaaatttcaattacgaaaccgaaaaccggggggggggtaccggttttaaattataaaactttagactttttaatataagccatattccagattttttaaaaatcaactccaaaaattttggctttttttgagtgcaattttatttatttttaaaaaatttctgtgagtccaaaaagtgaaatagtaaatgtatttatttacctaattaccatttgctaaaaactttaccgctctggacggtgcaatcacaatgatgatgaagcgcaagtcttgcatggagcggcccaaatttgtcggatgggacagtcgcgcaatggcacatggcgatgctgcaccgtgttcagtatgcatctggaaattgaatttaaaagtaaattaaatttcaaatctaattttaaaattaaaactttcagccgaattgaatagaaaaatgtttggttcaaatttttttttgaattaattttttttttttgtaaatttttgcctccaaccttctttgagttagagtttcttattggaaatgttttttttgttttgaaaatttttgccaatcataagaaaaacttacagcgcacatatccatgtctgatcatagtcaaatgtgccaccaacagtgccagttgtgcaaatgctttgcaccgtacggctcagaatgtggactgaaaatgatgctaattactaattagtagggctgtgatttctagtggaaaaactttgtttttgctcaattgttttgaagaaaggagcgcaaaaaacgcatttctgcgttaaaattttttcatttgaacgccatttttcgtcactagaaatcactattttggcgttttgtcacttaaaattagagaccggacaagaggatcggtcggtcggtttcggttaaaaaccgaaaaaaaccgaaaaactcaaaaatttctcggtcggattttttcggttaaaaaccgaaaatcgaaaaataccgaaaaaaaccgatcggtccgatctctaatataaataataaaataaatattaacataagaaatatttatgggtgccaaaaatcggttgttctacgagagactaaatttatgtattacgcttataaatttttatcaaagaccaaaaaaagtcaaatattaatattaataagagtaataataataataatctaatttttttttattaaagcattgtcagaaataaataaattaattttgaatttgtttctctttatattaaacacaaaaataacgttattaaaataataataattttattgctttttaacatgaagaatagttattaattttatttatttaacaaataaaaaacttttggaaaaaattaaaaatttaaattacatttgaaatatcaaataaaatatatattaaaaaattttgccgcagagggcaaagtggaccaagatggcatgtcctcaggccattttaaagaaattaaatttttgacaaaaaaatattctcaaagtcggcgagcattttcaataaagattggacgaaaaatcacaatatttaaatttattatatcaactaaaaatattttaaagactttaagatcattcataaattaaaattaaataatattcgggcatttatgcacatgtaggttaactttgttggcttattattgatatattttttattttttcctaatgtgaattattgtgacttcttaattaatcaataaatgaatcatttaaaaaattgcatttattttaatttcatcattaaaattaataattacaagccgtaataattcgatacattattattaaattaatattcaggcaacattaatcacacgggacaaggttaatactaaaattcaaaattatataaataaatgcaaaaatatatttaatcgactaaaaaaagttcatctggtaagataattatttgaggatagtgaattttatataagcttttagcaacataatatttatactaaaactaaacacgaaaactcaaattcttataatttttctctaaacattatttattgctagaaatggaaacaaacaatgaaatttcataataaggatgttgctattgtataaaaatagactaatttttttgttttttataaaaaaaatttaaaaaaatcgattattcaaaaacaaaaattattaaaatattttgattaaataaatattacattttttttgatttttcatgtctttaaagaaaaatatttaaataaaaattttataccatcactgagattaaataaaggtcaaaaaatgaattgaaagttaaaaaaataaaagttacataatctaaagatgagatacataataaatgagttaatttaatattattttgaaaataaaacattttaatgaagtaagtcgtgaatatttgatcaacttaacgaaattataaaaaaataattttatttttattttggaaatgttttataaaataatttcagttatagactatcataattagaatttaatanattaacaacagatttttaactgctgaaatg

SEQ ID NO: 10425 - DNA, 2764 bp, Heterodera glycines
acaaaaaaaaacaagattaaagtttttttaatttatcgcggggaagaaaaaacctagtccacctctcgaaaaaaaaaaattcaagaaagagaaatttaaaaaaaaaattttagcgaatttttttcaaaatgtccttgagaaaggattaaattttcacatgtttgtagtggggcgatggacagttgtgctgtttgtccgggtttgagtactggtaggtacggcagagcatcgacgtgggtggaattgatggatcagtaacagaatcggggtcaacaagcagtacattaactggaaggttgaggaggtaacaccgaaaattattttaaaaaccccatattaaattgaatttcaataaattttttttttaattttctttatttatgaaaattttggagtaattttaagtcagtttttagtccatatttggccattcttgagctttttagtccatatttcgggcattttagtccatatttgaagttttttagctggtactcaaaaaatccaaataaaaaatgcatcgtacatcgaacaaacagtgtcattgtctaacagagttacagtattcctcccctctgtcctaccgtccatgcgatggtagccgcactcctgcgcgtccaacactgtggccaacgcgttcgacacacgccatacgcatccccagacgcgcgcggacggtttgcgctcaacggacgctatggcgccctgccaacgctctgatcgatcgaaaaaggtcaactcaaagccgggcaacagtgcggcagtgacgaactcggcaccggtgatctgtgcgcgatggaaccgaatcatatgggaaaaaatggacggaatgccagaggcctcgccgggtgggaatttttgaaaaaacggtcagtaaaaaaaatagaatcggtcaaatttggaaatttcgtttttttcaaaatttctgatcacatagcacacattgattattaaactgatccggaaatggtgattcataaaactaaagacttgggaaacggaattgttgccggactaaatccaatggaattatcgcgcaattaattgtgaaatttacagattggattctacacaaaatccggcacggaaccccgtgccgcaatcaatcgccacttaagaattatgccgaaaatggaaattaaatgccaagaatcattgtatttagtttaatagagtgcccacatggacatggattcgttcagtcaacaaattgctgccgtagctgaaatagtgaaacgcatcatcagccggtggcgcttggtgggcttgaacaaccgtcttctgctcgtccgacttttcttgaatttctgccaccatcacaagcgctttaaaacgggaatttgaattttatttgtcataaaattccacgatccaaccaatttaagactaataatttaattttttcgccatcctccaaattattattttttttaaattgaaaaacttgagatttaaaaaagcagactttcatttagaggaaataattgggggaaaagcggaccgtatttttggcatcatgaaacacaatcaagcttattaacagaaaagtttacctattattgttattttttgctattcgccctttttatgaatattaatcattttcaattttaatagggagggaaaattaaaaaaaaaattgattgacaaattttgaatttggtacattgcccgattattctcgtaccggcaaaattttgcgtttcttatgccaccacaaaacaaaaacgaacgaccgacagcaacacaagctaaaacaattacaaatgagaaaaataagcaaaaaaaacataatataaaaaacagaataaactgcaaaaaataactcacaaacataaaaaacaataataaatggaataaaaataattgaaaaagaatttaacaaaaaaatacgaaaataaatagcccaaatttcggagatttcgacaagtggtggtacaacacaagaagaaatattgtacaaaaaaatagaatggaataatataaaagctgctaaaaacaataataacaaaagaaatgattgattgattggatatcgaaagaaattcacagtgtccaccgaacgtactcgcccgtccggcggcattcaatgtgaaaaagaaatatgccaaaaatgtcaaaatgattgttttttttgtaatgtaagtataaaggcccttcctctacaaaaaaagagccagcatttattaatatagcagacttttgaaaaatacagcatttaatgctttaagcttaatttaaaggaaagtaagattgcatatattttgcgatccgtcaaaatgccaagaggcagaaagggaattttttggaattttgaaaatcaaatttacaatttttttccattttggtgggagagggtgggcaatagggcctgtatatatgtgtgaacacttatataattaaataatgatcgatcaaatatgtcatcagtgctcacaatcagaggtgatcatttagtatctcaatgatttgatcagagtttatcactgatcaccaccatcctcggcctccattcttgtcgacgtttttgatcgtcgttcgccgccggcaacaaaatcggtgacatttggcaactgcacaccagtgttggcgtcaaacccgttctgttgttgttgttgatgctgcattgtctgatgatgatcatcattttctgttgctgctgaaaaaaataattaaaaaaaatcgacagccttggccgggtgttgaacccaagagcaaaacattaggcattctttaaaaaaaaattcggagggggggggggggg

SEQ ID NO: 10426 - DNA, 1481 bp, Heterodera glycines
aatgccgaacgtgccttgttggatgatgccaaatggtgttggtggtggtgttgctgcctcttcatggcgtgcatcattcgctgttgttgctgatgatgatgcttgtactgttggcgttgctggcgccgttgttgctccccctcatggtcctccccatcttcctgctgctgctggtgttgttgctgctgttgacccatgccgccaccggcggcaccgccagccaaaaagttgttcacagccaaattcagttggtcacttggacagtccgcgtgggcgcccggcggtggcgccacgggttggcccgtgtagcgaaagtatggcattttcaggtccaacacattccgttggtggtgttgctgttgcgccgcaccatcgtcgtcattgtcgattgctgccgccgctgcatcggtgtacatctccaactccatgtcgtaagattgtctgaaaaaaggcagattttaattatttcttctaaaataaggaaaaatgaattaagtatacaatcgtaaaaaattggcgagcagctcgttttttcctctcccgccgcatgaaaaaaaaaccaaacagaattttttcaatgaaaattcatgagaaataaaaaaaaaatttctagcaattttttaactattttttccaaaaatcattgtttttttttcttagaattttccaataaaaaggtatttaaggttgctttttaaaattttgcgctactcaaaaaactcctaaatttttttttatttttcgaaatatgaacgcgtacttgtcgttggccaccatttccagactgccccgtacatcttggccggccagcacgagcatgggccgtttgatcaggcagcgcacttggtaccaatgggtcaacggttcggtgggcgccgtggacagccaaacggtacgaccacttaaaaaatttttaaatgtaaaaacgaatttaaaaaaaaatttgaatttcccaaattacttggtgccatcaaatgccacatcgaaccaggaggcgagcccgtgcacatggcatgaccgtttgacattcatctgcaaggattggttggtggtatgtgaaaatggtgcgtaaaacggtgtaaatttgatatttaatttttttacccattaaaaaaatttcaaattttcatacagaaccaataaaaatcaatgtctattaaaatgaaacatatttattgttcttttccctcccgaaaaatgtaaaatggaatttaaattttttttcaaattttgatgatttttgaagaaaaatttgcacactcaaatgaaaaagggggcgggggggggggtcaaccaaattttttgcgaaatggttcagccatgaaatttacgacctttttttgttgctttttaataccgtttttttcgcggtgcgcttttttcaaaaaaaaaattttttttgggggggggtcaggtggtgccgctaggcgccgccggaaattttttttgaaaattcagtgcaatgtgttaacatattttca

SEQ ID NO: 10427 - DNA, 1006 bp, Heterodera glycines
aaaattaataggaacattaggggtcgtcaataatggggggggggggagggccttggtcggtttttttgtcgctgctcttaccaccaccggctgtcggacagtttcgtccagcgctggctctgcagacgcgccaagcgcaacaccgtgaaacgtttgctgggcccaaaaggcggcccgctgctgctgctccgcgtacagcgcgtcgtccgtgaacagtgccaagtgcaaatcggcacgggtcggaaacatacgacctaaaagcaatttatcactggatttactagttattttttaaagagaattattccaaaaaatcgctagaaaaattttaaaatttaaagggaccaaaatgcaaaaaataaataaaacatgaaaattaggcgctggaaaatgcaattttctaaagcgggataaaaaaaaacaaattttccccgatgccgtctaccgacttctctgggacgctttaacgactttaagtgttatatttaaattctttaaatataaatgtccttttgggtcggaaaaaattgctaaaaaaattttctcccgcaacaaaaatatttaattttttttttaattagtggagaaaaatttttttgagcctatggaaaaggtccattttgcactttggtgcttaccccagaaaaggctatttttaaatggtttttttatcttaacctataaaaagctatttttaagcaattttttaaaatatgccaaatattccattttttgttgcaattcgatttcctaattaatggtgtgcacatttgtaaggtatgatttttgaaaaagaaaattattttgaaaaaaatttactaaccgccagggcgaaggaatttgcgcgcgaacataaaactctccaacatccgctcgttgaccagcatatagcccatgggctcggatacaatgatatcgaccttgaaaatatttaatttttacgactcgttaaaaatgtttttttttggggggggggaaatttatttaacgagaattctcgaagaat

SEQ ID NO: 10428 - DNA, 5696 bp, Heterodera glycines
tgcgcgatgcgcggccgcggcaatttgaatgcgcgatgcgcggccgcggtttttttctgtgcgcgctccagccctgctcctcatcgatgagcgtttcgcttctttttttttgcgggtcccaaaatattgattcaagggaaattgattaattagcgaatgcaaaaaaaaaaatttttttgaggtgcatataaaaattgcagttaaaagatttagttaaaataatccctcctcttctgttcttctctttcgacctacgacaatttttaatgcgttaataaaggacatattacaaaagcgtgaatgcgttttttaaatctcggtaataaattctttgtaaatcactatcatatccgaacttttcacttggtgaattaacaattaaaaatctggtattttaggttctccatccagtaatcaaataaacattaccctcgagaccgaaaattataatgcgtttaaaatttatagaaaaattttttaacgtacatatactctctttgttctttttttgatcctacggtatttttaatgcggaaataaaagtattggattttatatttttgtgcaccaatccaaagtaattaaacaataaaacagtgtttaaatagaatataaaaaagaaataaaaataaaggttttccatttcctttataacatttaaaagttttcatttcctactaaaagtgtgtataaatatatcataagccttatttattttgggcccacttctacggtagggtgtaaaaaaatatttatcactctattttttcgactcaccatgaggcaggattttcatagatttacgtataatatctagtataatatagccaatttatatttgaacaaaatttcgaagttttattttgattcaaatttcgcgaaagaaaaaaaatacgaattgaaaaatgctttttattcgctttttaatttttgcaaatttttaaatcagcagaggaaaacgtaaaaattaccttagacaagaagccatttgatgaaaagctgaaagaaatgtatgaacgagcatatgagaaagtgttgcaagaaaatgcaataattgctgaaaattattatttcgaattgaaatttccagaatttatagattttaattgtgccttctgtggctttattaaatcttttctattatttccaatttcgaataaattcatatggatttataatatggaaaattccgcaatttataataataatattgaaaatgcaaaaatatttattaaaaataataaaagcatctaataagtttaagttttttgattaagtgtgttttgctacataaaaagcgttattaaatattttatttaaatatttttgtgcctttttattgcctattttgcgatttttttcctgcatttttaagtggtgcctatttcgcgatttaaccattatgcgttgaaatattttcagaataagttagtcttgtaccgaggagtatggctataatatttgatgcgtttattacttatagaaagaagagttaagttcgataaaaatattgtaaatataagcctaaaaataggcataattaaaagtggtataaaaacataggaaaactcaaaaatgtttttaagaaaactctgtgattgaaaactcattgaaataagtattgttctcagctgataccctgtcccagtatttgatgcgcttctgatcactattcgagaaattataaggaactggtattcgctgtaattaaattactaattacaaattttggacaagaatataacgtttagtggatcaatttttagaaaattttcaaatttgtaaatatttcaataatgctcagtcctaaggggttatttatcaaaaaaatttaacgtagaaatgctattttttgagcccctttcttcatagtataagcgcagaaaaatattgcaaaatcattctatttataaccctaataataatcaccaaatttgccctcctccctttcgcaaatgaatgagaatcagaaaatacttgattgacaatgtttgtaagaaaatattgatatcgtttcttttgcgcacttcttcctgaaactgtttatctgaacataccgtacttgtttttcaacccatctcgaaaggagtgttctaattcagagggggttggttatatttttcaaccttcattttttcaaaaaatccaacaaaaggtgacgttttttaagctttcgcaaaaatacagaatttttttttcagtgattttaattaaaaatgttattttattttcaatttcggcaataatttcagtacataaaatattttcaatggtctgataatttgtaaaatgtataacaaaataacgtatcttcagtcaatggagtctgcgattttggcgtttaatcaaatcgcccgtggcttttcccaattcccgccaaattctatctggattaaatggtgcatacctagttggtcttgggtggtgggcacagtgcgtatccctcactgttgtaagtttgtccggtttcctaaaagtaccttcccaaatttcttaataattagtgccgtaaaggaacttttccaattttaaactgtgccgaacattttcatattaatataagtattgttgtgattaggaataaaatgatggaatattaaattttaacacattatgtgaagtgatcagaatatacgaatgatgtgagtgaagctaatgataatgacaatgggtgtaaagaagtgatcagaagagaacacacaaaaagcgtacaaattatgccgtggaaaatgtggcgataatcaatattaattaattaatttgacgaaaaaagattgcgtaattgaccaatcaaattacaatataaagagcattctgttgacaatgtgtgaatgatgacacaactaatttccgctgtgattatttggagaaaatgtgagcgaataatggcgagacattttccgaattttagcacatttcctcgtcaaaattgttatattggactgatcgagaaattatcgaaatgttttttttctgttatttgtcaaaaaaaaacgttccggaatttcgaatttatatttttaacggcatggttgaaaaaaaactggcctgcactaatgaattttttttgcttatttgaaatttttttaaagaaaacttagggttgatcagtacacatttgcgtttttaaaagttcaataaaaaaagctaaaaatttgaaaaattccatgtcgattctcaaaacaatgattttgacatggaattgagagagaacagccagttgtagaaaacatggattaataattaattaaattctgtgggtaaaagtggccacgcacacaacacacaaatacaatataaaataaacaatgtgtaattaattaataatatgcacacaacacaaacaaaaagaactaattaaacagcaacagaaaaaccatgtgccaaaaaattgaaaatggaaaatttgtcaaagtgttgagaaaaatgaaaaatggaacacaatcttggcgcgctagctgatggcattccgcgccatgcccctcattaggcatcattgattcgggtaattatggcggcggctttttttctttggtgtcattcgctcgtcggtggtggtcgctttggtggtggcacggagggcggcgttggaggcgccggcgcggaaccaacgccgtgctgctggagcagcaacgcggcggcggccgactgcgcttgtttggcacgaaacgcttgcgcattgatcggctcctgaacggagggaaaagcggaaattattttaatagtatactgtatgttttttactcaatctcggtacggtattaggcgaaaacacccaccaaataataatcgctctccgggtcgttcgggtctgtaattggttgctgatgatgggggattacggtcgttgcggttgccgctgatctactagccgcagcagatgcttaaaattcacagcagtgaatagagctatcatcatttttttaaaaagtttttcttagtctttgttggcagtctaaatttcctagttaatcgacaagcagtgaaaaaacccacgaaaaaattttcaaaaaatgctaaaagatattacaatactaatttgtatcttaattacagtatgtatgtccatgaaaagaaataggcaacatcctgttatgtaaaacaaaaaattttgaaaacctattcacaaaagtgccacgaattattggagggggggaggggaaggggtattcaaaacttatggaatacattaatttgtctttttctttttttgaaattttggggtcattaaaaacaaatatgtcacaccgtcagagccgcgactttgcgcgctcattgggcgtgtcgcagcggcagatgacgaactcgccgcgtggtggtgatggtgatgatgctggtaatgggcgtgatgatgaccatggtgctgctgttggtgtttgactgctcgcgccaccgctcctccgcccccggcaggcgcgggcgccgttgtggcggcgctcgccgacgaattggtggtggtggacgacgtcgagcggttgatcgccgcctgtgccgtcggcgggtggttgtggtgggggcgaacctgttcaatgaacgggcggatcagttttggttttaagcacccgaatttcattttcaatggatttgaccaatggggtagaagagacgggaaaatgcaattatttgaacaaatatgcaacaagtgtcttttttctttttcaaacaaactataaatttcttagttttcgaactttcttagttttttttctacaaaaaaaatctctttttttttgatatcttggaaagacaccgatggaacgcggcactcacatggtgagtgcatgccttaatttagaaattttgatgctcaattagtacttaatgttatttttgtacttgtaggtctgcttcctatgcatttaaacttttccgctaaaaattattaaaaatcaaatcaaaatttttgttgagctgccaaattcgaaaaaaaaattcctcaaaaaaatttcaagggaataaaaaaaattcataagggattttttcgtttatttttttctaaaatttgtttcagtaagattttacatgattaaaaaatagatattttatattttttttctttgcggtctttggcgtgcatcggtgtttcaacttctcgagaccgtgggcaaatgatttgtccggacaaaacagcacatactttttctgctgtgttccccgcactgcccccgggcgacgcactcggcgatttggccgtgttcaggtccaacaaattctgcaactccaccacattaccgggacccatgtggaccatgtgcttgaagttggacggtccgctgatcggcagctgactacgacgatcagttcgactgagggaaaattgtttcgtttacaataatagtcatttttttggtgcggttttgattactccttccttagacatgtgtatcagggatggcattcgaggccacaaaaaatttcggaaatcgggattccgaccccaaaaatgaaaaaaaatccttcgaataaaaattatctaagaattatattaatttattattacaaattttaaaaatattcaattttttggcattacgattttggctcgtcctttgcgttgcgcattgaaaatttgcgacggcgcttcatctgctgagatggcaaaacagtgccggcatcagtggggccgccactttggcgccgattggcctccgcaacaagcgatggcaaaaactgttgctcctcgtccgctaaatgtt

SEQ ID NO: 10429 - DNA, 2801 bp, Heterodera glycines
aatttttaaaatttcccccgccggcgcctatcggcaccgccggagcccttcttccccaaaagttttttggaaaagcgctccgaaaaaagtgatgtgaaaagcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaatttttttttaaatttttaaaatttttttgaatttttaaaatttcccggttcgtcccggttcccggtttttcttgcggtcccggtcccggtcccgaaaaaaaatcgaggtcccggtcccggcttctcaggtcccggcaagtcccggttttggcaaaaattcccggtcccgtggcactctagttttaagaaacgacccagcacggcccccttttaatgcatcccgccagcccctaaaaattctttttcaaaatatcattattttctcttttttggaaattttttgaaattttgaaattttttcaaaattttcaaaatcccgcaatcccgcgctcaaataaatatgggaaatgaatttttgagaaatttttcctttatcagggatgtgtatttttaaaactttcgggtcgattcttaggagtatatttttcgtttttattgcatttttgtttggtgaaaataagtttttttaaaattttttttatggtttttaggtgctaaaaataaaaacctagaaaataggtgtgaagtaaaaattttttaaataaaaataactaggtattcttgttttaatagaattttacaaataatttcttatttttttacatatccctgtaaaaagttttgaagaattaactttatattttttgaaaacttgaatatttttggtaaaaattctgtaaacatattggctaaaatcacaaaatttggtcattttttcaaaaaatctacatttgaatagtcaaaaaaaagacaaataataaagcatttatttgtaacatatttatatttcccatgatttttttaaagtacaagcttgtattttcatcaaaaaatttgaaaaaatggcttttactggattttttcaggacccggttcgacccgatacccggacccggtttaaaaccttggagccggacccggcttttctagacccggcaatacccagagccgatttttgcccaaatacccggactgtaacccttttctttgttcgcattcaccggttttatttttttattaaaatttataatattcccaattgctctgaatcatcatattccattttcattatgtaaatcgaccactattattcattttcgttgactgaaatattttcattcatttgctttttgaatgtttttctcattttatgtgcattttcattatttcttcatataaaacaattttattactttttgttttttaatttaaaaattataagctcctcagccccgccctcctttaattttcagcgaaaacattcagtgattgaaatgttaattggagttttgaatgtttttatttaccgtaaatccgctatttgaatgcccgggcattctattgttcaacgcctccaaaaaagggcatttaattggagggggcattctaccagagaggggcactgtattgttcaacccctcaaatctcggaaattttttttgcgagtcaaaaaggggtgaaaaccatttttctaaccggttttatagtgcagagcatgaatatgagtattattttacgttttacaaatttttgaattttttaaaaatttcgaaaatttttcattttggccctagggaatttggactcgtatttgaaaattcataactcatttcaaagtggatcaatttaagtacaataaagctttaaaaatagagaaaaataaggagaattttatgaatttattttaaatttctatcatcaaaatgaaaatttttttccagaaattctggaaaaattcgaatttcagacaaaaaatcagaactcggttctcaaaggatgttttcgaaaattaatatactcaaaaaacccgcaattttttgctctatagaactgtatttatttcatatttctactatttttttggaaaagattagaaaaataaaattgatttgggaatttgggaccaaaggggggagggaccacatggtttctgagtgggaaaatttttttcacccaaatttagctgaaaaatactttttataggtattttagggtgttgataacgaatctgtaatcagatttcgctttcggcatcgacaaacccccagaatccctgcggatatacttgatccctcctggaggggggcattttattggagaggggcattctaccagagaggggcattgtattgttcaacccctccaaaaaagggcatttaattggagggggcattctaccagagaggggcattcaaatggcggatttacggtattccgctttttctttaaacttcaaatttctttttttcgtgacaagttttgcgatgatgacagccccgggaagcttatctaaaagaaattcttttttgaaattcgttaccgctctcgacttgcctgcttgtacttcttgccaaggtgtgaaatcagttcacgcacgtgggcctcgcctcgtgtctcacaaatcacccggacgcatacagaataaatattggccgcaagccatgctctttcgtgaaaaatgtctttgatactcgcaccggtttttgcgatttcgtttgtcagctctgccattcctgtaaaatttggacggggccatcac

SEQ ID NO: 10430 - DNA, 953 bp, Heterodera glycines
ggggggggggggataaagtgtggattttgtaaatccattaacacaataaatatccatcaagggaattaaatatatgtttatataatggatatttttacagcgattttttgtctttggaatcgaatttttaagaatctgggccaatttttgaaaaacgaaatggtggtcaaacatttccgatgagttgtccaaaaactaaccaccatgccatgccgtccgtgcacatccctccctactttttaaagattttatttttatacgaaaatttttttgtatggatttccaattttcgggtcagctgtaagaaattctgatgccattgttcaagtattaaattttaattaaacctgagaaaccgttgcaccgaaatgctttccaaattatattaaatgaaagaattgacttttatttcaattacacattttcatttcagcaatcctcggcactttccgtctcacttttggtccattccgtttctgtttgccgacgatcattggtaaatacaattttaggcgtcttttcatcataattccttaatcatatttattttttagcttagggcattaaaaatggtattcaatttgtcataacttttttctaatatgtcctcatctcaggcccgtaggtcctcattaacttattttttcactctcttaaggcattgtgggaacattcaatgtgtttttccttcgccttatcaacatgggcggctttgcctaaagccctaattaaggtgggcaaattaatatttataatttcgattttttatatttcactccggcacttttctgattcggaacgggccaaatcagccgtcaataattataggatggcataatttaaacgctttcaatattttaaaaagatttatatcctaaattttgaacttgttttgttggcttttacttagccagcattaaaaattgaatgtgttttacgagcatttcacatga

SEQ ID NO: 10431 - DNA, 2702 bp, Heterodera glycines
  misc_feature (49)..(49): n is a, c, g, or t
  misc_feature (2621)..(2621): n is a, c, g, or t
tgaaattcatttcttaggtcccaactgtcacaattcctttttattttgncaattttaaattttgccattcaaatttttcttttttaaaggttgaagttttgcgaatgattgacgatcggatggtcccatttgtggccattttctttgttgcctatcacttattcgtcactttgattgtgctcagtctttttgttgccgtcattttggacaatttggaaatggacgaagaattgaagaaggtcaaacaactgaaggccaaggaagcggtaggaaagaaactcgaaatatgaacggcacccaaattaaaaaaaacagaaaaagacttaaaaccttaaatcacagctatatttttaagcaaatttcttttcagtaatttgattttatgtccaaaataaacgcatttttaaaaagtgctttacaaaaaatgcaaatttattcaaaaaaaaaaacattaatgtggcaaattaaaataaataattgctattaaaatgaataattttcttttcaattattggaatatggctatgtgaaatctgtgcacctaaatgcctttagatcagcagcatgcgcaccattttgccttggcgtttgcgcatttttgaaaagtttcccactcggccacaaatggtacagctgaagcgggtggacaacgaatttgcgacaccaaaagtgcgcgactcattcaccaaccaagtgggtcaaatttcgaagtttcattttcctataattttaaatttttttttgttttagtttgtatggaaacagaatgccgacgaacagcgacttccgccgattagtacggaatttgccgacaaattactaacacgattggatggtactgtagggaacagtggaaaataaaccatgaattatggcttggtgaattggtgcccacttacaaaaattgagattatgtttatctgagatctataagaattttacaatctcgagatctaagaatttaccaatatgtgtttttaaagtacccataaattaaaatggcacaatacattaagaaaaatttcggtatttttaaaaattgtcatgccgaaatgatcagaaaacccaattcagaggttggacatcgtcgaattttgtccaaatttgtcaatgtgaataagcatcgcttttctgcgcaacagcaacaactgcaacatcagagaaccaattgcatttatcaacgtcacattggccaatgtgcgatgcgattactgctcaattcgatggtcaagtgggtttaattatgaaaaaatttcaaatttcaaaaatttttcagaaattcgtccaaaaattcggccgtggccgcgttgatgggctcgttgcatcatcagccgacgagtgccaaaagtcggcgtcaaaagccgatgagtttcttcgagcacattctgaccgagaacggcgacattaaccgggcggagggaccacctcccgccggcggggcagggcaacaacaaaaacaacaacaacaacaacagactcaaactgctggtggcacaacacagcccctgcagaagcaacagtcgacggcattgcttggaggtgatcagagaaagggcagttataataaattgggtgatgatcagatgcgtgatcattgctggattggggagctgggacattatagtcgggaatatcgtatttatttaattcgaacccccggggctcaattttcaaccaccctcaaaaggggggttctaattaagagggtttctaattcaatagatgcttcggtgaaattttgaaaattcataggtataaattagcagtagaactcttttcaaaatattgcccaaatgtttgttaattgtgcaggtggcggcaccggtgccatttcggcaatcggcagcacgcgcagagacttgaaacagggccaatttgacattcgcgcactacagcacaagcagcaaatggccgaaatcactaggcacgaaaatgatctattcatttaatttgcattttttctgatcagaccagttaggaagggcaaatcacattagacattttttagatatgctttggtcatttctaagacgatagtcaggcatctaagttatccgttttattagattagatcagtgatggtattcgttatgcaaggacatccttgaattgtgccctttcacttgaaaattttaaaatatccttaaattcaagatttccttaaattgagcattaaaaaaaacttaaaacttaaattttcaatttgaattttatactaaaattttttattaacttatgtcattatttttaaaagtagacattttttagttgtgatttggtcatttttaaggtgctgatcagacgccaaaagctatctgtctaattagactagatcaactagtatcgattaattctgaataaaaaaaaaattattttttaattaaaattgtaaaatattttataaattttaggaatcggattgaggaggaaatgcgcgagaatcacccttactttgatcggcctctgttcataattgcccgtgattcgaaactgcgccggttctgtcgtcggtttgtgcacgcccgctggggcttcgatgtcggcgctgaaatgggcggcgaagcggcggcagtggcacaaatggtgccggacgaacgccgccgctggcggtggaaagcggncccaacaatacagtaagaaaatgggcattcagcagcacatcataaagatcattaattatacgctaaagtaaatacaaaagc

SEQ ID NO: 10432 - DNA, 2579 bp, Heterodera glycines
aagtaaaatacaaaaactttttccctgttgaagcagtctgatcggtctgatgccctacttggactgggccatggttgccatcactttgttgtcctgctggtccatgctgctcgagtcgccgtggccaacgacgggcgaaaatttggtgatgttcaatttctacctgcaaatcccggactacctattcgtgttggccatgagtggtacatttcaaaatatttttaaacatcagtataagaagttttttgtatccgtgtatttcatttcatgtctcatcttcctcaagaaaaaatttaaaaaatccataaaaaacaaaaacgtactaaatttttaagaattgattaaaaaaatgaacagttgattttttgattgaattgtaaatattttctttaaccaaaataatcagtttacaattttcaatgacttaaatgccaacaaaaaaaaagatttaaaaaagtctttacaaaagttttaatttccaggcttttgtgttgtgcatatttctctttaaagaataaaaattataagccgaaaatcttttttaatttcgaaggatttcactaattataaaacttataaaacaaagtccaatatcccctcatttcaacattcaaaaaaggtgaacttatggcaaaagtgatcgctgacggactgttcttcacgcccaatgcgttggtgcgcgactttggcggagtgatgaccgtattcgtctacctgaccagcttggtcttcctgttgctgatgcccaaacacgtggagatcaattcggtggaacagtttctgatgatctgccgcgcgatgcgtccgctgcgcatttacacgctcgtgccgcacattcgtcgcgttgtagtcgagctgttccgcgggtttaaagtaattaaatttgttggatcttaaattgattcaaaattatggtatttctacgtttttaggaaattttgcttgtgaccattctgatgattgtggtgatgttcatctttgccagtttcggagtacagacagtgggcggaaggtgctaatattaataatttgttatttatttattaatacgcattttaatcattctaaatttgctcatttaagattggctgcctgtaatgatgtgaacgtcacacgccaagtaattaaattgaaaatggctctaaagcaaacattcatttgggactatgaatttcacttttataggttgattgcacgggcatgttctggcagaaaatctttgtcaccagaatggaggtgtacggtaagaaataatttttgttttttagcttaaaaaccaaaacattgattcaatggcatatattttgttcaaaatttaaatgtttaaattgatgttttttattactttaaaccaaaagcattaaacttttcaaaactaaattaaatttgatttatttcaaggcaaaaacagtgacacgcttcatccaaaagtgcttgtgccacgcgtttggtccgttaacataaaggaaacaaattaataatttgggttatttttgaaggacaaacccgcgaaatttcaattttgatcacattggcgcggcaatgtaaaaataacaatatgtaattaaattaaatattgttttttatattttaaaggttagcactgttcgaaaccttgtcatacaaaggatggaatgtgatcagagacattttgtgggcacggcaaggccctgtaaaatttggcaaaaataatgcaccttaattactctcattaattgggttttgcatttttcttcagtgggccgttgtgttcatccacatttacgtgttcagcggttgtatgatcggattgacattgtttgttggcgttgtgattgccaattacaccgaaaacagggtaaatggattttatcatatttcctccgatattcacaaattttgaaaataatcttgaaacatttcgagcggctaacaataagaccaaaaaacggttgtagggtttgcccacgacaaaatattttctggtttcggtctgtatacctagaaaaccattctaacatcggcattttttcccttttcagggcacagctttgttgacagttgaccagcgacggtggcatgacctgaaggctcgtcttaaaatggcacaggtttggtgccaaggctctcattttcatttatcgcatttaaattcttcccaattttcagccccttcacatcccaccaaaaccgtccgaatccgccacatttcgtcgcaccctttacgagctgacaatgtgccggctgttcaaccaattcttcgccgccatggtggtactgaattcggcaacgctgattctgccgtggaatgttgaggaggaggaggacaaacaccgattactgtacattgtcaccgcactctctgccattctcaatatgcttttcgctgttgaggtcaaaatattctcgatcagattatttgattttaaaaaatcactttcaaaaaattttattagatcaaccaaaagagaatttttttcctgctgttcattatcaaaaaattaaagataatttgtggagaatttgaactttaattttaatttatgcttttttgaaaatattgctattttatcccttttccgaagctttgatcaatcaaa

SEQ ID NO: 10433 - DNA, 2166 bp, Heterodera glycines
  misc_feature (2137)..(2137): n is a, c, g, or t
  misc_feature (2155)..(2155): n is a, c, g, or t
tttaaaaaatcatcaatatgatttgatgaaaaattatttataacttagctcaaaagcaaccaaatttttaattttttgagttcctctagccataacttttttgaaacataacgaaatttttttattttgtagattgatagagtataattagggctatcgaaagatatcaagaataaaaatttggttgctttttggctaagtatagataattttcataaaatcatattgttttttttaataacgactccgcccccttgagtttatgtcgataatttttgtagaaccccgtcaaaaaactcgctgggccataagttgattccagaactctatctcgaacccctggcctggaaaaatctacataaattcagtactaactttatccgatcgagtcccatgcaaataatgcgcaagagaagtttgaaacgtttaattatttatcaaatggcacccatatattaaattatgcatgtaaaatcaccattttaaagcaaattcaaaattattgtgataatgtttccacatttaatgtttcttaatgcaaattaatcctttttataatacacttcgtaagagggaataataaaatctttgaaaataatataaagttttatccattactgagatacaaagaaaacaattataatatggtgtatattgcgtttttctatctattaatgttatgctagactaattcatgatcagttccgaacaagatcattcgtttgacctcataaattaattctacttccaccgtaattaattcgaacacttcccgttggcgttctatcaattgaaaaactgccaccacaattaatgcgaccactttccattttcgacttcttaatggttgcacttccaccacaattaatgccaacatttttcattggcgactccttcatatttaaacttcctccacagtttaactttagactttgcgctggcgattctacaatggttaaacttcctccacagtctaggttgccaatttccattttcgacttttcgatccgtaaagatccaccacagtcaatcccaatacttcccattggtgactcaacaatcccaatgcttccaccaacatcaatctgactgctttccattttcgatttttcgatccgcaaagatccatcacagttaagccgaatatttcccattggtgactcatcaatacttaaactcccaccacatttcatttgcgcattacgttctattggtgagtgagttacatttaaagatgcatcacattcaatgttagcacactcaagtgacgaattatggatatgtaaagttcctcggaccgaaaaattgtaaaaaacactcgtcgatcgaaaattaaagcctccacttgttgaccaaaagttctttgcagcggcatccttttttacatcaacgcataatatgcgaatacagtcatctgccgattggtcgatatataaatttccatcgcattcagcgtgaatatgtcgcgtttgcccaacggttatgttttcgcgagaaaataacgataatggcacactgacaattacatttcttatgtttttgtcttgtataatttccagatactgctctgtggccctgttttgataaactctcccattcacactcaaatcatgcccttcaacaccaacattaacattaggtccgtcaactgagtaaatttgtccatttatcgaaatgtgattgtcctcggtgcgttgttgacgcaatgcatgagtcaaatctgaaaaagttaaataataaattacagttaacaagaaattgaaaaaaatattaagcttcggctggaattacccataccagagcttattgcgtggcctattccatcatttaatttctattgctttatttcagcgggggtatatcttgggcactatttgattctgctgccaaataggccaaccatccggtgcccagaagatatttccggaaatgatactttttctcgtgagctgactgttcgatattttaaataagataagttcctatgctagatatgcccctaataatctatttattttcataactattaattttctccatttttatgatgaaaatttcatgcataaatttccttttctattcctccatcttctgagtaccaaaaaattaacaacctccagtattgctgcgattatanagcccttgtgaacttccnatctcctgagt

SEQ ID NO: 10434 - DNA, 1446 bp, Heterodera glycines
  misc_feature (36)..(36): n is a, c, g, or t
ctgagtacctccaacgtttcgattgcctccaatatntaaaccaaatgtccctcctgtcggcatctttcctatttttatgcctccaatcatctgagtaccaccaacgttgcgatttccaccagtatttaaatgaagagctcctcctggtggcattcctccaatttgtatgcgtccgatgtcttgagtaccaccaatgttttcattgttttgattgtttatatgtgtaaaatttccaccgattagctctcctctcttttgctgtttctgtttattcttctgtttttcttcccgtttggtgtctccaaaagtgggttttccatcatgcttgttatgtccagtgtttatataatcagagtttcccccaatcggaatttctggcaaggagacactccctgaaatttggtgaccaacaacattcgtatgtaaacgtgcattatttccttgatcatctcccgccgcactcagttgaatgcctaaaaaagttaaaacgaaataagattatggcaagcaaacttcgtaactgataaaacatttagcccgttaagaactcagaattaatagtggaaacctcatcgagaaaataagaaataaataaaactaacttcggcctgatgagccgagaacgggaattcgttcctcaattcgattgatataattgatataaccagtggggactgcatttttatataactttccgtcgactaaaagatccgtcccataaagaagaacatcataatcgggtccttcagttggatatttcctgccatcaatgtcagcataatagcggatatgttgttgtcgaattatgtcaacgtctcctgcttccattatcggcaaagctaaatgttattaccacaatggaaaaatctcgcatatttacgcatgtcgattttgtagtaatgccgattagttaaattaaatgatattaaatagtttgtgccaatattaaaataggttataaattggtacacctaaactaaaaaaattctccaaccctggaaagcaataaaaaacttattcataaaaaatattttatattgtctaaaaaggcagggggtaccatcagtgtattaccaaaaatgctactgatcaacgtttgcttgtgcgataaatttgggccagagaagcgaggatagagcggaaaataaactcaaaaatactaaattatttataaaatatttccgatacgtttgtcagacacttttggtcggcagctcgtttcaccacttttagaggtgagtaaacgatttccaatgtttccattaatgatgcatcccggtgcctcttaaatattgattaacattattttttgtgaatcaatttctctaccaatatcaagatgattccccggtggcagcacaccacgatcttcgtcattgataaggagatgttcctccttttccgaatcaataataagcggatgttttttaaccatctgaacttcaa

SEQ ID NO: 10435 - DNA, 4433 bp, Heterodera glycines
tttcaaaaaaaacaccccctaagaatcgactcgaaaattttcaaaaatacacccctaagatatgaaaattttttcaaaaattcatctccaaaatttatttatttattttcttaacatgaattttgatttaaaaaattatttattcaatactgatttggcataattttttgaatacattttgtaattttacaccccctaaaatgaggttttttagtgcctattttccatttttagagccaatttttaggatttttagagcctaaaatcacatctctatttttcttcttttaatacacaaacattattcttttttattttagacgaaaaatgataaaaaaaatagatgacaataaaataaaaactatcattcaaaaaatattgggagtatactcagggtgtcatagaagaatcttggaaatcagaacttcagaaaatcagatttttgctcaatatcaaaatattttgcaaaactttattatttctattttattcattcaaaaatttaccaaatataataaatattttcaaccaagcattaccaattctaacattttggagaagaaataagtatatcaaacaaaaccagacttttatttttcatttttagtgcgttttgaattaattttgttcaccaaagtccaaattttgcgattttgaggacagtttttaagggggaaaaaagtttagaggattcgacgttggggaaatttttttggaaattttggctctatttgttaataaattttcataaataattgaaaaacttgtggaaatattttttgaaaaatattaaaaaataaaattgcgggattttaagtcaatcccatccctggtattaacaaaatttttgtgaaaagtaacaaaaaatcttcgataatttctagcgagatttcatcattagggggtgtatttttaaaaaacgaaagaaaccggtatcccagttttcggtttagatttttggcccaaaaagccggttttcggttcggttaaaggaccgtgacctaccctacaaaaaaggtcatttgcggacaaaatttataaacaaatacaacgaaattttacaaaaaaattttccctggaggcgcctgttgaagcagcggaccatcaaaacctaaaaaattttactcgaaattctaaattaaacatttttgatgaaatctgccaaagaagcaggcaaaatttatagttaaaaatccttaaatggtaaattataaaatattaaaaaagtaataaaaatattattattttaaaaagctctacaaaatcacaaagtctttgtaaattcacgtgaaagcgtattataagaaaagcagcaatttccgcaaaaaaggttttttctatgtttttgtcaataaaagccacgtccattaaggaaatgaaaaatggggtatttaagcgaacagaaaaaacaaaaatgacatcacatatatttttcattcattaattaaattaaatatattttttgccatgtcttctctgctgctctccatcttcccaattgtgtttttggtctgttgcaatgcaatgccaagtaaatgcaaataaatttaaaaaaagtcatgttttaaatatctaaagcattcaatgtaataggcactttttataaaattatttaatttaaattccaaagatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctctcgcggcggatgccaaaacggaggagaagcacaaattgtggatgaaatcgatcgacagctgaagagttcaacaaattagaaaataattaaatgaattttgagagaatggtacattttaagaaagagtaattaatttaaaaatattgaccaacttatctcattaagacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaagcaattggacaagaaaagaactttgaagttacggatgtgcacattggagtcccaagcaaaggcaaataaaaataattattgaaattgagaaattaataattttctaggggtttctgcacatcaaaatgtgccgagtccgagccatgtgattgccaaccgtggccaacacagttcggttggccaaggaaagaaagaagaaccgttgtcatcggacttcgatttttgaggacaaacaaatcaggaggaaatagaatagaaaaccattttgttgacatgtcgaacatttatttaaagtaataaatatttggtaataaatagggcatagaattatatgcatatgcatatttttttcctggactgtgggaggcctgaaacgcacgaaaaacatgtttttagcttggttagaagcttctaggccgtacttccatatgcatattttgcataattatgcatatttcgcgatttatatgcatatttgcatattgtgcatattttggcatttcgtgcatattttatgtgcatatttgggcattttttcaaaatacccctattagaccggcacctatcaggtaaattggcttttttgacccctaaagaccgaaaaaatttccgaaaaagacattttttagcaaaattttgtcgatattttgtcatttttggtgcatataattctatgcccaagcaacaaaagtaattttagggtttttttttggagtcaaatatcaatgtccatataaaagcataacttttaacatgaacaacaattaaactagggttggtttcccccgaacatctgaaagaattgttacgtaaaataaatttaaattgaaattaaataaaaagaaaacaaattagaagataaaaaataaataaatgaaaaaaagttggcgactagaggtgggagagaagcgcattttatattaatgtcaacacactgcattttcgtattttataagtggaaacaaaaataaatgaaattgaaaaggcaatattgagaaaatccaggtaagagatttattgataattaaaatgttcaaaattaatgtatcaaatattatatttttcgtctcctaagcaaaaagttaatttcagtgcaatcgggatcaaaaaaatatcagtttttaacaatttttttgcggcccatttttccaaaaaaaacctttgggaagcggggggaggggggtaggcccgccggcagtgccgataggcgccgccagggaaaattttgaaaaattgagtgcaatttattaacagcttttcacgaaaaaaatgaccaactcttgagcaaaccttatatttcttgataaaatagtgtcaataaatttaaaaattatgattgtatttaagaaatcagaacaaattttggtcactaccccaaaaatcagaacatttcttataaataataacagatcacatccctgcctttacaatctcagataaatatgtaaaaatgctactaaaaactcccaattttcatttatggcgatatgttgacttaacaaaattaattaaagggccctgacttttagtgacgaaaaatctcaaaatagttaactaaaatagtgacgaaaaagagccaaaatagtgaaaaaaaaagtgcgaaatagtgaaaaatagtgacataattttcggcaaaaaattaagcaaaaaataatttttactcactgaatgcagttgcaaatgagtaggactgggatttttaagggcaaaaaaaagctaaaataagtagctaaaaaataattttttaaattaaaaattcttgtcaagaaaatgaatttttgagaaaattgtttatattccttaagagtgatttttgaaaatttttagctcgcttcttaggcgtgtatttttcattcttattgcattttttaagaaattttccaaagaatgttgaaatagtgaaaaatagtgacaaaacgccaaaatagtgaattttaacacttaagtgacgaaacaccaaaatagtgatttctagtgacgaaaaatgacgttcaaatgaaaaaatttaaacgcagaaatgcgttttttgagcacctttcttcataactagggttataagtagagtgccacgggaccgggaattttgggcaaaaccgggaccatgacttgccggggcctgagaagccgggaccgggaccttgatttttcttcgggaccggtaccaggaaccgggaccaaccgggaaattttaaaaattcaaaaaaattttaaaaatttttaaaaaattcaaattttaattatttttttttaaagtgaaaataatataaaattattatttattttttattataaaaccccaaaagttaaagctaattaaattaatgaaaatttt

SEQ ID NO: 10436 - DNA, 899 bp, Heterodera glycines
gtgaaggattggcaaaatgagtaatggccaaatggtcagagatagagatagagagcgacacaattttaggagataaatgatcgccaaatgcaaaagcaaaaatttgaataaaagccaataataaatgatttggtcggaatggtcaaaaacagagtgatcgattgttggcgctcatccttatgccgatcagtttcactgctgctgttgctggttgaccgtcaacaaatgcgctgcattcatatgcatcatgtctcaaaatgtaaattaattatttcattataggttattaatttttaaaattctaggttgcttatgaaaagccttgcatttggtatacttttaaatatagcctgtgaaatttcaaaaaaaaactagctgggacacaaaaaactgatggccaaaacctcaaaaaactgaatttttctgctattttggcactggcactcaacaatcttttttcaacctaatatactttttcgaaattttgcaggctaatatagagcatttagacctatgtgtttttttatttggtttcataagaaaaagttataattggcagagccaaaagtggccccgacccaattaatcagctttttaggccactaaaaaggttgccgaaataaccggctttttccgcaaaaaatgccattcggcgcgccagggacggccccacttacgattgcacatattgtcaaggtcagtcacagttgaggtggaagccatgcagcacaattcgacaatgttgttgcagtggagtttgagaagatcattctgtaacgaattaatgagtttgaaaaattttaatgaaaataattataccccaggaaggtaatactcgagaatcaggggctccacaaatcaaaaaaattgttcagttatgaagatcaacccgggatttt

SEQ ID NO: 10437 - DNA, 3532 bp, Heterodera glycines
aaaaaagcacaggttaatcttcataacagaaaaaacactcccactggtggagcccagattctccaattttaccagaggaaggtaattatatattttttttaaacctacgtaattcccgtcctcggctcgcaatcccatttgtcctaaattcttgaagttgggcaagcgacaatttccgtttgcgatctcggccaaagctgtaaataattatttcaaattaattcgttttggattaattattacaaaagaaatatttttaatacagatgaaatgattttaaatgcctcaaaaaggaattaggcataaaaatttttatgtgccgaaaatataatttgataaatattttaatttgttgataattaaaattttaaataaattcaaatttacaaaaaattaacaagtgaaaatattttaaatgtgtttaaagtatatttgggtgaaaatatttgaaactttatttggctaaatcaaatttaaatgtactaaaaattaatgaaaaattattcaaaggtgctgaaaaataaactgctaatttaaaactatgccaaaaataactggtaaaattattacggaaattaaagagtaaaaaatgtaaaaaaaattaaaggtgaaatatttaaaggtgctgaaattacttttgggtgaaattatgaaagcatgtaattaattcctaaaagtgatgcgccatttttggttaatgtaacttaccgttgtaaagactttcaatggcacctctgcgcacgtgctgaggaagcaaattgaagatggtgttcagaatttcttttgcggcgcccttgcattgttcttcctgaaatttgtatttttaatgctaattttttgatttttaattaccccaaaaattagcttagcattttctcacccgttttttcataattataagccattgtgccattcgcttcagtaaaggacgatcaaattttcgggacacatttaaatttgcccattttttgtggaaacgaataaaatgaacaatttcaaaaactaattcgtatggaaggaacttgtttggcatttttttttggtaatgttttggcatgtttcccttgaaagtttctttttttgagcgcagggccgagagattcatatccaattggcatgacaaaaataattgaccccaaaagttataaataatatttatggtggtgggaaagtaattatgagactgctttacaatggcatttcaaaattattaataattgaactctaaaaaaacttacatagaattttttgtccccctcctgttgcggttgttgtgccattggaaattgaaagtgcacggccaaaattggaattcaaaaattaataaattggtttccaattttcttaaaaaaaaacaaatatcccacagcaaataaaaatgactaacactcattcgttcgacatttaaatttgccatcactcctacccccgacggaatttccaccccgctcccctcctcccttcctccgcattatccatctttaaaacaacgaacaaaaatcacacttaggtaaccattacaagtaacatttcccaccgaggttggcacaactcagtctcgcaaaactcggtcccagccaaatccaatacatttggccaacgttgagaaggatcgtatgatcaatcgcctgaacttggctgggaccaaagcggccgagccgagttgtcccgcttcattcccccatttccatcccttttctcctccactttcccatcccttttgaacaacatatcacttaaacgatgtgtgcagattcttttgatcaaaaatgagataagcagacaaaaaattgttttgtgattttaaaattgaatgcttgctgaagagcaaaaatggctacgatccgccaaaatggggtttacgtggcagagacaaaatgaattattttccaaataaaataaaaatctcaggttgttcacaattacacacattttctccctctgctgctggtggggcttttcggtgccaaaccaaaggcgcggcatggaacagcggccaaaaggcttaaaaattttaaattttaatcgcacaattagttgagaataggatttaaaaatatttttcaattaaaaatttgtctttttcttcgaaaaaataaaataaaaataggggttttaaggattttttaaaagttttttctttttaaattcataaaacttagttttttggaaaatatttacattttttcgagaaaatttatttgcatcttataaacgcaaaaaaaaatatataatttattttataaaatcattaaatttaccaatgatgagcccagccatcatcaataccattcctccgccgttgccgtggcgaatggtctctaaattttttaaaaatttctgtactgcccttgaatttttttggtccttgaaaaaggttactgtgtcgtttaaaaattaattaaattatggtccgaacttttgaaaatccgggaaattttaatttcggcgtatgtccttgaaaagcccttccgcacgaccttgaataaacaatccagtgccgcatttccctcctcaactcactcggcactggcgccgacgacggcacaaacttggcattgcccatttccgtcccgttagcaccaaaacggcaccggcacttccaatcagtgccttccgccagcttagaagcgctccattcggcacgatgttcattcacggcattcggtgcttctttggcacacgcctttttcttcgcatcagccgggaagcatgaccagcggttccacaccaatgcgcctcaaaatggtgattaaaacaaatagaatttgaaaatgtaaaatttttggcattttgttgtccgagaattttcaaaaaaaaattggcataaaaaacgtggttacggcaatttttctcgagttttttttaaatttttctttttgcgaaaaaaatgatttaaatcattgttcaccatcattcgctttgcagaatgtcgcgctacatttcattgttttttcgcattcagtttcttccttcgtgttcagcttttcattgagttcgccattctccgattccgtgcgcaatttgcacttcatttttgctgaaattttgaaatttttagtccttgaagaaatgtttgcttgtccttgaaaattagttgtgttcattttgttatttttttatttctcttcgtttttagtcatcatttcgttttagaaacgatttttgggtttgttcccggcacacggcggggaacagaccccaaaaacaaaatttattctctttgtccttgaaatatgtccttgaaaacaaaattttactgtcagtttccctggaaaacgagttttactatccatgtccttgaaaacgaattttacagtccatgtccttgaacaattttacggtctgccaaagttgccattccgtctttgtccttacgtggtgctggcgtcgtcgtcgtcggcctcaatgccggatttgggttcacaacgttcgcgttgtccatctcaacataaacggcgcccaattggcacgtgcatgtccaattgcggccggtcgtgggaaggccaaattgccacgctcattgtcagtg

SEQ ID NO: 10438 - DNA, 927 bp, Heterodera glycines
caatttggtgccacttctgtcccaaatttgcttgttggcatggagaaatgtgatcacggaatagtcaatgtaactgcacaaatataaatgttttaatatattatataatacaaaagtttaaaattacgaaatctgaagttccttaaagcgaattttgttgggcagcgaatggtccggcaattgaaaatccacccaattgtcatcgatccgtacagacagtttcgattctggtccaatgccctcgcaaattttgatttttcgccaaattgtcaattcgcttttcccgtcaaaatgcgtgtccaccaaaacatcgaaacggtcagaaagcaatgccaatttgagtccgagttgagcatggtcaaaagatgggagaatgtccatccaaacgtcgctacaaaaaaatgaaaaaattagaaaaaaatggaaaattttgaaatttataaaaaaaattccttaccgtctattcattttttgctgcaattagcacactgccgttttgacaattaattggcgacacaatcagaataaatatctttgtctcaggaatccaaactgaaatggactaaaaaattgatttttattcaaaaatttaagtatttctagctttattattttttccattaccctgcataaagtacaagttagtgaaatggggcgataatttatgggattatctgtctctccttttttgaagacagggataagtaagggatgccatcaggcgatgtcgaatttcttctagggagttttttcaataaattccaaatattatagacattaaattcaatgtctgtgatctgattagggttttcatggctgagtaagtcattgtacaaaaatgacttttgaaaaacatcagccaataaaatacatttttgttcattccgaaaaataatgtgcccttgttcatcaatagggaacggattt

SEQ ID NO: 10439 - DNA, 2191 bp, Heterodera glycines
aattgttgatgatcaaaataattttatttttaattaaaaattctttgttataaattatttttattttttattttcttgctattattcgatagccctatgtgtcctctatcagcctgcaaatggccaaaaatattcgaaaacctggtctcttgggtacttttggccatgactttgctgaaacttgaccaaattttttgaaacttaggtgaactaatagagaactctttgggctatcgaattatacaaagaatgtttctaatttggttgactttgacaaaagtcatgggtagggaacggatttctaagtttttgcttattttttctgcggctttaactcgacgagaaatgcacgaaaaacacattttttgttcgaaaattttgtgttttaacgcacttattcgaacttagaaatgcttattttggcgtttcgtgcttaaaaatgcttattttagaggttcgcccttaaaataagtttttgtacttattttagcgttttatgcttattttcgttcttatttcgcgatttttgggaaatttattaacaaaaatgcaataaaaatgataaatacacccctaagaatcggccaaaaaaatttcggaaaaatacacccctgagaattgacctaaaaattttcaaaaaatacactcctaagaatccacccaaaaaatttcggaaaaatacgcccctgagaatcgacccttaaatcctgaaaatttctaaatgtacttcatttctaactgcaatcagtaaataaaattgtttgacttaattttaactaatttacatagagaaaacagcaattttaacaaatttcacctctacatttggaattttttcatgcttattttcgcacttatttcgcgcttttttcgcccttatttaagcacttattttggactttttcgcgcttaaaaatccgttccctattcattaacacaccgagtcaaaaaacgagacatgtgtcaataaagagagagtgcagagaaaaaaacatctctctttttggcgtactatttctttatctgtgttaatagagaaaaactgaatttacttcattgcttacaaaaagcttctcctcataaagagctttcgaatgataccaagatggaccaatttggttggtaaaaacctccaaaaataatttttaaaaatcgtcattttttaattttttggacaaaaataaataaaaatattcatgttgcacaacggactcgaaccaccaccctttgtccctttactatcttacaaaaaccacttcgccacacatgcaaatttttttggaactgggaggccaaaattgaaacggtgtgttaattaaatggcaaatatttttgtcgacaaatcactgtgaaaaactcgacagaaggaatatgtatgcccaaagaaaaagcaggaaaaagtgaggggagagggggactatggtgggccaatgtgtcggcgatgtttggccaatgagcgaagtcgagcggacgatggaatcagtgccaaaagtgggggaggggcggggcaacagacggacattccaacattagctccaccgataagatcctccaacccgagaacagccaaaactgggggattaacaaaggacaagccaccggattaagcagtgtttatgctacaaaatcccaatccaaaaaggattttattagattttatgtccaaacaaatttgttggagaaaatgtgttgaaaagttccaaagcttaattgatccattggatataagagaagagataaaagatttcattagattgaccagacgaagtcacaaaaagtgcataaatttatgtcacaaaaaaacgagtcgaaaaaaaatgtgaaaagccatatttccaaacttagccatttttcaatttttaaataaacattcagcaggaaaaacacccattataattttaaatggtgtgtacaaatcacagatgttatttattgtaacaaatggttgacaacaacagcaaaacaattgaaaagaaaggcatttataataaagcatggatcgacttattccgcccaagcagctccgccccatccaaaattgccatgaccaaaaccccccgcagccgcgccggcacgtctgcgcggctcctctctgaggtacggctcgtcaaagatcacttcgacttccaccgtcaccgtgtcgtccccagtgagataccatccgtgtcagcagacatcaatttctgagaat

SEQ ID NO: 10440 - DNA, 3194 bp, Heterodera glycines
ctacaaaaatccgcaattttttgctctattaaataaattttaattcatatttttatcacttttttaagaattgttataaaaataaaagtgattttggcattcggaaccaaaggggtgagcataggattattgagttgaaaatttttttcgcaaaaatcttccaaaaacatgtctttaggggttatttgggccgctgatcacgaatacgtgatcagattttacttttgacatcgttaagccctcagaatccctgtgtgattggggattctgaggcatcatttttgggggggggcgaagttcggatccgatcggtgtacattatttttctgtgcattttttgattacttttacatgttttattaattccaaatattttttataaattatttaaatttatttattttttttaattaaagaatttcattatttattttttgaatttgtaaaaaaattaatttaatttcaaattaaatgaatattcaattaataatttcaaacgttgtttttaattaataactaccatttttttcattgttttattcatttaaaatattttttattttattaataataaattacatttttttatttgaattaaattttttttataaataaatgttttggtttaaaattaattatttatttattttaattaatttaatattgtttgtttaattaaatgttttaatataaaattaatttcttatttatttttaaataaaagaaggaatttattttataatttttaaaaaattattaacacattcaatttttaattatatttttttataaaaccatttccttatttatttaattttgaaaccatgattttacccttttaaactattattgtaccattcctacaatttttgtacctactaataactgttgtactcttctaatcactgttttgcctcttctgatcactgttgtacctcttctatttcctgttgtacctcttctaatcactcttgtacctcttctaatcaccgttgtacctcttctgatcactgttgttgttggacgcgtgcggacgcttcgcgcccattttgttggactgggcgggtgcttagcgcccgtttttaaatagtgttggactgggcggcgctatacgcccgtttttaaatcagattttacttttgacatcggcaagacctcagaatccctgtgtgattggggattctgggacatgttctgaggggggggcaggttcgaatccggacggtgtaacatatttttctatttatttttgagttatttttcaatgcttttaattaatttgaagattggttgtaaattttaaatttttttttaataaataatttcattattattttttatctgtaaaaaataatatcatttcaaatttcttaaatattcaatgcattcgatttttattctttaataaaaaaacttttccttatttatataattttaaaccatgttgaacctcttcttatcactgttgtacctcttctattcactgttgtacctcttataatctctgttgtacctcttcaaatcactgttgtacctcttctaatcaccattgtacctcttctaatcactgttgtaactcttctaatcatttttataactcttctaatcacttttgacctcttttaattgctgttgtacctcttctaatcactgttgtacctcttatgatcaaacgggcgcgaagcgcccgccagagcccaacacaatttaaaaacgggcacgaagcgcccgtctaaggcagcgaagcggccgagaacacccacatttagaaaccgggcgaagcgcccgactgaggccgcgaagcggcttaacaagctaaaaaacgggcgcgaagcgcccgtatgagttcaatgaatttaaaaaacgggcgcgaaccgcccgtccaaggccaacaaaaattgaaaaaccggcgcgaagcgcccgactgaggccgcgaagtggcctaacaagctaaaaaacgggcgcgaagcgcccgtcctgaggccgcgaagcggccatacaagctaaaaaatgggcgcgaagcgcccgtatgagttcaacaaatttaaaaaacgggcgcgaagcgcccgtcttgagcctcgatgtggactaaaaacccctaataattttttaaaaattcaaaaaaacctctccaacaaattcgatcaatttaaatcacttcacagcctaggtagcgaagctcccaaagcgcgaagcgctttttcccagctaaatagccgacggttcacgcacccgctagtttatattactctacagaaaaagggggtttcgtttctaaaacaaaatctccagttctagcagagggagcgccctgaaagtagtggaagggtcttacaactttttgaggcgcatctgggaaaactataggttttcctctccggtggccaactgagtcccggcggctaatttctcacttttgcttgcgtttgaaggcccataactttttttctaaaactcgaatcaaaaaatgcccgctgcgagggcaccccgccaaagtgtcctctacatgctggtattttttattttttttatagagccaccccctggcctgcagaaaatggcaactgaagcgtgctcaaaaagtacacttcagtaccaggcgaataccgcttcggggtttgatctgagggaaaggtgcccagcagacttattgtagagttttggaagctcgattttctgaaatttaaaaatttcgaaaattttcaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcctcagcgggacatttgagtcccgggcccataactcgtcagggattggttttagccaaaaatcgtcttagaacatttttgtagagaattttaagctctatcgaacggtgtgctatatgcccggaaaatttcaaaaattttcgagctaggccccctagaaattttcgaaaatttttttaggcttgaaaagggtggtgaaacatttttttctggggtaaattaaggtgctgagctcgaatttgacctttgtttttcgtttcatgatttttgggaaattttaaaaattctttattttttggcaattttttggccc

SEQ ID NO: 10441 - DNA, 1111 bp, Heterodera glycines
  misc_feature (1084)..(1084): n is a, c, g, or t
  misc_feature (1105)..(1105): n is a, c, g, or t
ccgtcctaaggccacgaagctgccgaaaattcagaacaaattaaaaaacgggtgcgaagcgcccgtccaagcccaaaaaaattaagaaacggacgcaaaagcgcccgtctgaggccgcgaagctgcaaatgtcgcctttaaaattttgaaaaaaacataagcctattaaaattttgaattttgaagccgagcatgcactagcaacgaagtccttttgcgcgaagcgctaatctcaacatccaatgccttttcaagtacactgtctacaccgtgcaatcactgcgcgtgcaagtcaactgcctgcaccgcgcccccgtcaattcccacacgctagtttatactactatagagaaacgttgcagttcgtttcaaaaaacaaaatctcccggccgaaggccgggagcgccccgaaagtagtggaagggtcttacaactttttgaggcgcatctgggaaaaataagggttttccgctccggtggccaactgagtcccggcggctgatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttttccagttcagtccccgttgaataactcattaggctttgacctgagcgcagggtggccagcagacttattgtagagctcggtgagctcgatttttccagattttaaaatttcgaaaattttgaaaatttttcgagctaggcctaaaaaacggttttcgggtttttgaattttaggattttttaacgaattttcccagaaaaacggagaccacttccaaaacatagtttttcgagctctatcgattggtaattttttcggaaaaatttcgattttttcccggaaatagaaaaattttttggcctcagcgggacatttgagtcccgggcccataactggtcaggggggttggttttagccaaaagtgccttagacaaaattgtagagctttttagctctatcgaatgntgtactacatgatgtaaattnttcaaa

SEQ ID NO: 10442 - DNA, 5659 bp, Heterodera glycines
  misc_feature (24)..(24): n is a, c, g, or t
  misc_feature (5647)..(5648): n is a, c, g, or t
tcgctaattttactgcaggctacncaattggcaactcaattgtacatgtgctgaacgaagaaatgattaaaatgccggaagaaaaactctacctcttggcaattctcaaagtttgcgtgattcctccacgaaaatgatattcctgtcttaccagttagagttgatgacaggctcggcttccctttatctatgaattgtactaaaattcgggatacagtggatacaaaaaaatgactgtgaacaaaggaagtggttgatttctaagctaagcttgtataacaagtgcggcagattttctttacgaaattaaggccttttgcagaatttaataatggatgaaccggatttcttggggagtatttggacaatcgttcattagacgtaataaccatcgatgatttgaaggtgaagcatgttttgattacctacgaaaataagaaagtgttttaaggagcccgaatgttcaaacgttgttgtttagatgtggataacttaagctgcacgtttgttactgcttaaagctaagcagaagatggtgatatagccggggtgtcaaatactctacacagacacttatagtcttattttctcacattcatgcaatgcttgtctgctatgacgggacgacatcttggccagttcactgatgagtatccttactacgaaatcgtataattctgcagtgttgagcaaattatgtgacatctccaaaaaaaattattaaaccaaatattcttgatgatggatctataatatcaagctctatgcaaaaaaggttatcagacttatgttgggaaggattttataggagccgattataagattctaaatcttggtcattcattgtaactatttggatcaaaacatattgtaattgtcttgttcaccattcattgtatctctctctcaaatacacgcaaatgtagcctttatttctcttttatatctcaaattgtttaatcatttagtcattttattcgtttttctataaaatttacacataattaatggaatgaggatgaaattggcaaataattaaacactcgaagttgtcattttcaggtagaaaatgcataattatgcgaaataagttacaatttgtgaaaaattaaggattagaagatgcaatttttaataaattatcgaattggtcgtttttatattgaaagtgaaatttgaaaataattaatcaatgggatgtaattttaggtgtaaaatgcataatttaatagaaagaagacataattacagaaaattaggaaattgaagatacaattttaataaaaattaaggaaaaataatgagttacatcaaggaattactcaaaaaagtgtaaaaattatacatattggtgtggttgcgtgagtctagttgtttaagcatgaggataagtgtgttatagagtgtgttcgagagttctcatattattatgtaacttatataaaaattattaattgtattcttaaacacaaacaatgttcattgacaattcaacgtaaatgaaaagtttggattatcaccaaaataattcataatgttaatacaataacatttacaataagaaataattaactaaccgaaaatgaacccattcccatcctacgcgattgacaatttaataggaaagtttttaaaatatcataaataaaaatttgtgtttcaatgataccggttagcgagagattaaaaattatttaaattctaggctatgcaggaggcaaaagaatacataaaaataagtatagtaggtatgatcgttgtcgtagacagagacttttgaagtattggctactggtggaccaagcctaatggggcattggctaccggagagcctagccttatgaggtatggatactggtggaccaagcctaatgggcattggctacggagagcctagccttatgaggtattggatactagaggaccaatcctaattaggtattaactaccggagagccgagtattggctaccgaaaattcacacattttttctttttctagtttttatacatttctaaaatccttaaattccttgacttctttcacacttcccacttataatatgttcaatgcttcctcattaaattccatcaaatacccctgccttctcatccaaaatggcgggactgaaaaacaacccttggtgagtaactactaataggaaataaccaaaagacttaaaaaagtaaaattaaaaccaaaataaatatttaattaaaaaataattaactccaagtttcaacttttgataaaataaaaatatttcctagtatcctggtcccaagcctattattttgtttttaaaaggaaaaattaaaaatacaatcttattaaaagaataaaatttaaaataaatcacatatttaatagaaataaaaaacaaattatcttaaatgttaaaaaaacataaaacaatatttcaattattagcagactaaaaaattagtcgtagatattaaaaaatttataaattaaatcgaaaaattatttaatataatgcaaaaaaaataatttgtaaataaaactttacatcagttggtttaaatttgtaaaaagtgtcttcataaacaattacgacctaccttaccttcttggttttttgaatcagcataatgatggattcaattaaaaaataatgtttattgtttagagttaaattaaattactaatttcttacaaaaattttaaattaatttatgtgtatcagttgaaaaaattttaacataatactaagaaaaattgctttattttaatatttttaatttatttttttatttatcaaaaaacaataaagttttaattgcattctgtccattgaaacggggcggagtcgttatttaaaaaaccatcattatgattttatgataaattatttataacttagcttaaaagcaaccaattttttattatcatataattcgatagcactaaatatgctctacaagtttacaacaaaatttcagaaaatttcgtcaagtttcaaaaattttagggccaaaaatgctcgaaaaatactcgaaaaacaaggtttattgagttcatatagccataacgtttttgaaactgaaggaaattttctgagattttgtaaaattgtagaacatacatagagctatcgaatgatatgaaaaaataaaaatttggttgcttttaagctaagttataaataattttttataaaatcataatgatggttttttattaaccattaattttactccctttccaattcattcaaaataatgtttctttaatttatataaattatccgaattaaaataaaatgctattaatagaaaataaatttaattaaaattaatattagacatatagaaaaaatgaacaaaattctttagaataaaaataaaacattcaaaactataatttagagaagaaacaaataagataattataaatatatgaacggaaaattaaacaaaaatccaaaaccaagaatattatttatgtatttatccattatataaacattaaacgccaaatataatttttatgaaaatgttgaaaaatataatttaaattattagatttaaaagcaatttatctgcttatataaagcaataataaaaaattattttaaaaaatagaaggagaatctcacgataagtttaattcatataaaggaattttgtaataaaaatttaaaatatttcatcaattatattttttaaagcaccagttgaattttctagattataaaccacaataatgtttaggatagagtccggcgggatcgtgactcccgcgggagtttacgggattcccgctcacgactcctgctttttcggtaaacgggattttttacgggatcgggatttttacgggattcccgttcgggactcccgtcccggaaaattttgaactcccgatcccgctcccggaaatttttttaccggactctagtttaggataaaggattagcgctgttatttcctaaaattaattaaaaatcaatcctttctaaattatatgaatatgaaagttattcatttttaattcattatctaaataattaaattgcgtacttttgatgctcacccactgtatttagtctttccccattgaaaacacaagctatgtatccttgccaggagaaagttgaagtaaaattatttgaagcaaaaatgaaagaagcaattaaaacatattcttatatttttatatgagtaaaaatattcttcttttgtttctttgctctagacaatacaacattttaaaacataaaatactacaaaagcaatttaaaatataaaaaaaaataataataaaattaattcttctaggttcataatttttaaaaccatttaaatgttgtttaaaaattattatttatatttatgtaaatcgtataaattaccaaaattgaacacgaaaaatatctatttgcaaaatagtcgattttcatataaatccaaactgctgtgaaaacagcgtttgtggaaatttattgtttttcaaattgagcgtcagtcaactgagagccatgaaactacgctaatagcaaaactaattttattatattaacttttttaataaaaatgattgtattttttctaaatgatttctaaattaaatttaataatttcattataaacatatacaatcaagtgtttgattcactttttatgaatcaatgccacgaataatgcagtaactaaaaagaataaaaaatgaacttttttcaaaaattaataaaaataattatataattttattttaaaaagaatgaagtgaagcgatatataatcaaaaaatcattaatttgtaaaaaataaattttactgcgcataactaacatgaaatcggacacgtcaagaagaaaaattttaacgctttaattactgtatttgtgaaataaaaaataagaaaataataataaacatgaaaaagaatttgcgggtcaatgcttaaatattttaattcataaattcaacaaaattactcataaaggaatacaaaagtgaattgcctaaaattagtaaaaactttaattaatggcaaaataacaatttacaaatacaaaaataaaaaatatcaaattctttaaaaaattaatgatttattaaaaaaaataataaaaaattaaaagaactaaaaaataaatggttttgtaaaccgtaaataaataatttttaaaaacgatgtttataagaaataataaatgtttttaaatgataaattaacaatatttattaacatttcaattattttatttaacatatacaagtctttaaataaactcctgcttaacattgtgcgaaaagagaaaaataataaaaaaaacaattatttcgtttaaaaaatattaaaaaataaggctaaatattcagaaaaaaaaacatttcaagggaggatagattgcgaatgaactctatgtgccatttgtataaaaaaatcgagaatatttaaaaaataaaaatatagaaaaggtaaaaagggagaaatgttaatatttaaaacaaaatttaaaattaatgatgaattgtttttaacaaaaaacgagaaattaattaaaatttcaatctatttcagactttcacactcagaatttatgaagaagggaaacaagaataaaataaaaaaaaatcatagctaaaaataaataaaacttttgttaacaaaataaaanntaatattatag

SEQ ID NO: 10443 - DNA, 4693 bp, Heterodera glycines
tttgcttttcggtgcccgcatattaatcagaacaaatcccttaaacttgcgtccaattgtctgtttttgtgaccgcattttctattccgttcagtttattactaataaatgcccagaattatttttctgaaaaatatttcttagccaaaaaaaaaaatttttaatttaaattgggatcccggcaaagatggtgcgaatcggtattttgggcatggaagttcggagtctgatcagggacagtaataggtcgagaattgggaacccctcccccggggtaatgaggtatttcaaattattttccaaaccgccaaattataaatccgaaacactccaatcatcattcattttttccattattttattttattttattttttgaatttattctgacattttagttaatctcaattttatttgttttatttaattgacatggaaattgatcagctaaattttcacctttttccttcaatgttcgtcttcttcgcagttctgaccaccgcatttatgtgattaattaaaaaactattttatttactcgcaataaaaatatataaaactaattgttttatttgctcaaattaatttttagttttggcgtcggcggatatgaaccgatgaaatgtttagtaagttaatgttttccaaatgggatgttcgcttcgtttgcgcttttatttatttatttttaatttttagctttttccaccgcttcaaattttgcattttgagcattctcatcgctcttaatttattccttcttttagcattcatcaaaaagcaaaatcgaccattttgggtttaatgtgtgcgaagtgctcaacgaggacggaacaacacaatcgaatcagccaaacaattcagcaatatttttccacgaggtgaaaatgattaaaataataataaataatataatttaccaattttgatttattaatttgttcagtttttgccggtgatgctgcttatccaagcggcacttttctatctgccaaaatggacgctggacaaattgcttcaaaaatgtgagtgattttatgaaagggcaaaaaaaaaaaaattaatacaatgaatttaaatatttttaaattattgtttataaaattcagcttgtttgttggcaattgccgtggcacaatttgccgtggttaacgcattgaccggccgagggcaccgctggtggggcattgaaatgggaaaatcattgcgcagtggtgatgaaatacaggtggaaaattgaatggaatgactaatttaagaatatttaacctattttttagacaaacccggacttacaaatttaaatgtttttgtttagcaattatttcaaatatttcggaaaatttatgtttattttcaaagtgcataattttatctaaataaatttttttaattccaaagattaaattgcaaaactttatcaagttgtgagtacatagttttgctttatgtgcatttatttgttcattagttcgaccactttcggcactttggtttaaattttaattagaaagttaaaacaccgaaaaagactctcttaatcactgcacttttgcccttttaaggatttgcccattttcccccgtctgatcacttgtgactctgtccttgctccgaacgtgttcatccaatgccatctgcgcatcacctggttcaatgagaagattttctcctcatttggtaaattataaattccattttcactttttctaattaaataattaatttgttaataattcccattatcaatttgcttctgttttaataattgccattttttgctcttttgtcaggtggtcacttttgtgcgtctcccttttgactctgatcactttcgtttctgcatttattcgggtgcaattttatttaaaagattttattttatttttattttctcttttttcacagtctctctgcaattggtcaaattcgccccacaaatgcgccaatgatgaggcaaactgtgtttaattagtcggacattaataataattgaccaatttttttataatttaattcacccaaaagcgtgcatttattgttttaaattttaaattatttctactactttttagccatcatttatactaccaataaaatcgtttaaactgaattcattaaaagtttcgtttattcattagacacaaatttcttcattaaccattaagataaaaaaatataaatgtactgctcaaaaagctcggtttcgaactcgactcgtgaaatgcctagggtttttaggtgttttgttctgatcaccggaccaattttgggcgttatacttgcaaaaaaaaagtagaatttcctgcaaaatcattcgcctgactgcttaaatagttgtagagaataatgtaatcaatcgatggtgccgaaaatggatgagtcactttgagaaaatggcagtaagcgaaatgggccacggaacagcactcactctctgctgctgatcagttggagcgatcactcaccgttttactctccccaaaaaacgcatcaatcaacgtaatattcattcattttaattatcattaccattttcattttattttattttgtcaaaagaatgtccgtccgccgttatttctgcttcgttttgctgttgtttttccagcaaaatgtaaaaaatttaatgcttttttcacccgccggagttcgcactgaaattttaaaatgacatttaaaaaaagaaaggataattaaaaaggaggtcaagcatcaaaaaagctttgaaatgtattccttattcaaaatgttttataattaatttcattaatttatcgctttcccccctttcttttactcactgaacactccgcccttcctgtaattgaatggcacttgcgtgtcgcattgttttcggcaatgtttttctttgcccttcactggcaaattgccagcgcgggagggaatatcgaagaaccaacaggcacctattttatcgtgctgagtcgatccacaaaaaaactcagtgtgggcgatccacaaaaaatctcagtgtgggcgatccgaaaaaaactcagtgattattggtcattttccggaagcctatcgcaccactttcgggcaccaaaagtgcctgatccggaacccggaccggcccggttaagaacaattttttgttcagttttttaagggctatctcccaggccgggtccggttcttaatccattcacttggagcccgtcatgggtcgggcacatctgccggaggaccctcagcctcgcccccgaccctgtcgatggccaacccaagctaagcttgccggtaccagcggcttttttgtacatctcgatgagctctacaaaatggtatcaatggcgtcaggctatgtctactacaaatgaagaaaattggcgagaagtgatgtcaaaaattgaaaaatttaaaaaatttgaaaatgacttgcgtcccgccgtacattagtgttaaccgtacggcaccgtgttttgtgaattgaataattaaatttatttatttaattttatcgatcactgagtttttttgtggatcgacctagcaccctattttattaatttctttaatcataacacaacaattttatataattagtaaatatttctagcatattaaaatcccggttccggcttttccggttcgtggcaagtccggtcccatttcccaaaaagactcagtctccccatcttttgtccaaaattttgtaagaaaagtgctgtaaaaagaaaatataaaactcctaaaaaattgcacattcatagcaaaaattaaagtttagtcaaaaaattaaaaaatttttgtttaaaaaattcaaatattttcaaaatataaattttttggtgaatataatgaattaattataaataaataatcttaaaggacaaaattcttctaaacaattttaatccccaaaatttttttctccgaatatcttcagatttaatgaatgtcattcactctctgattttaccaggataaggcttaaaaagcatttttaggttggtttaaaaccattagtatgacttttgtatccccattttgccttttttggcatttgtgccgaaatgaatttttaaatttcttaacggaatacaataaaatttaatattggagcctcaaaagatgactttaaccaaaaagatgactttaaccactaaaaatgatgggtggatgactttcttaaaatcaccactaaaaccaatttttcttaagaaattttgcttttcgaggtttttctaatcaaaacaattaaattgttcctagggaaaggctttatatgtgcttttaaagagaatttgcgatgatttcaaaatttatataaatcatttttaatttcagccgatttgcagttgggaaattagttaaaaaagaattcaaaattccgaatttttgctctttcatttcgaaaaaaactatcgaatttttcttttatttttaccttatttaagtgaattctaaattctttaacaatccttgttttggttaatgataagttaaccaaagagaataaatgcattaaaaattgactatttaattgctttcaaatggagcgctttcgcttacgaccataccacgttgaaaacacgccatcccgtccgatctggcaagtgaagcaacgttgggccttcttagtacttggaacggagacgtcctgggaatcgaaggtgttgtaagcttttttcttttttaattttcatatttaaagaaaataacttat

SEQ ID NO: 10444 - DNA, 1953 bp, Heterodera glycines
tctagagtccgctcaatatccgggggaaaactttgggcatttcatcaattgatgcctaaaaatcgaatgtgatcaaatgaaagtgcaaatcgacagcccatcaaccgactccttttctctcagtccgctcgcactttctttcctcccatcatttgctgctgtttgtttttgccttcgtcgtccacggaatgcggcgctttgcctatggcaatatatatatatatataattttttttaattcaaattaaaatcgtaccccaaagggccatattaaatccgtccccgatcagatagaggaaccagaagagggcaccggcggtgctgagcaatcccacgatttgctggttggacagccgatcgaaaatcgggtacagccaatgaccgctgatcagacggacggatataattctataaaaaatgaaaaaaagcattcaggacaggataatgggaaaatgccaaattccgttagattcaaatcggctgacattccaacgtagaaaaggaaaagtgcgacgacaacagtggagccaatcttccgatcgggtgcatggtgacaagtcagcaaagtgtcaaccaatacaaaagcgacgggggccgtgtgagacactaaaaatggggggggggaatgcaaaaagaaacgaaaagggataaagcaccgtgattaagccaatcaggcaccagcttggccacccaggcgggcatcaccaactcagggtcggccacataaagagccctaatgaaaaacagaaattcaaaagagagtgaatacagaggaataggatagagcgaggaggaaacagaagagaaacagagagagagcgagatagagagagagaacggggatgagagagagcgcgagagagatcaggcaaaacgagaaagacactcaccaaaacatcagagaacttgcctgaaattaaattagctaaaaaaatggtctccctctttcatgaatctatcaactgaatcaatttcaaccacatatatcaaaaggtcagtgtttgtttccggagataaattttgccgatttccgctgaccattccgacgggaaatgcggcggtggcgtacacaaagtcgcaaatgcggtggagccgactgcgccgccaatagctgggcacgtgggtcgccttcacctttttgtgctgttcgccgtgcacaaattcttcgttccaatcgaacagcgcacagacaaaacaaagcaaagcgtaaaacgattggagagactgaaaaaggggggaaaaggcgataatccaccaaaagtattaaacgcatctgaagggaatcccgaattgataaaaatcagaaaactcatcggaaaatgaatgctgattaaaaacttaatttttggaaaagaaaaatatttgcaactctttttgcgtgtgaacaacctaaaagttagtttttccttaaacaaattcgttaaaaaatctctgaattctttatttggctataatttcatctttatccaaaaatgccaacaaaattctttacgtttttgcgttgattttttcgagttcactgcgagactcgcattattttgtccttcaatgacccccccccccccgaatttaccaaattcagcatggacaacatcaccagcttctccacccaccagacgacgcccagccgcggcataaagcggacatcgtaaaacaacgcactggcgtaaacgccgagaataatgccgtagatgagcacacggaaaaggcccatttatttgagggaaacgaaaaaaagcaaataaaaataaaaaaatagaaaggaaagtaaattatgcagaaaaaactctgtgatggagaaaagttattcgagacaaagataagtagaaatttataagtgagcaaagcaaataacgaattatttgagcaataattaaaaagaaaatatggcacattaataaaaagacatcaacaaaatgactagacaacctctttcaattagatacaccatcc

SEQ ID NO: 10445 - DNA, 1164 bp, Heterodera glycines
cccagcagctaaattagcctttttgatcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatttccatattttgagatttttgccattttatgtccatattttgcgatttttggtccatattttatggccatatttcgcgattttatatccatatttttggactccctagttattacgtacaaatgaagccgggaaaacaatggcagtagcaataaaatggaatttgggcataaaagagcgtggccgaattgagcaaattgcgacaatggcagccgtcgtgtggtaaagcaattggatgagctgaaaacagcggcatttttaataaatatctaaaatatatagataaaatagaaataaggcgataaaaccagccccataaattaattatttttaattttgaaatcaaaaataaagggaaaaggagcaatttgcccaattttaaatgatcaattaagtttttccttctactagtgcaacaacaattatgaacaaagaggaaaatgcagtgtaaaaaatgccattcggtgggtttggtgtcttcgtccctttgccttcggttgccatgtggcaggaggggaggggagggcgtgcggactttgtcacttatttatgcctttatcgattaaaacgtcattttgtccatttatcccgtcaaaaatagtgccacaccaaccgcacaggaaaaaggaaagacgtcaacaaaataagggaagggaatacgaaatgaaaagcggacagagaaattaatgggactcgcatttctattgaaaatttggatttttttgtgactc

SEQ ID NO: 10446 - DNA, 1709 bp, Heterodera glycines
aattgtgactcactggaaatgaaatgaaataagaactcaagattttctttttgttgtcaaaaaagtagtcattaaattcattcttcaaatccgtcccatcgttcttttgagagacaattcgaaaagttgcaggacatttgcaactccaattttcgtctaaatggaaattaatcatcgttgtaattagcattaattaacagttaattcgcaccttcttttggagcatcgaaaaaggttaaagcccaatcaattctgatcagtgcttccccatttccttttaatttgtgccaatattatccatggataaaaaatggaataaaatttttaaaaaattatatttcattttgaatgctctgcaaatataagaaaaatcgatattaaattcctatttgatctatttaaattaattattttaaaaagctatcggtcgtggttcaaggagtgtgtacttggttgcaatctcctggtgtatcattattgttcacctattccaagtgcgccataaaacttaatttcactaatttctaaaacacatttataggcatttgaaaatgtatgtgaaatctgtcccttaaactagacaagtaccggtttgtttttaattagctccaaaaaatctcacaaattttttttttttttttgaatgatgtgtttggctccacattcctttattcgatgtatcgcctcgattcaattcttttttggtataattgcacagatattgtctaaaaatgaccaaatttaaggattataaattatgccagaatagtcaatttttggtactttacggttatctatgtccagatttaaaaaaaaaaaatttttttagagaataatttgttttaggggttttccgggtcgggaaaaccgattctgacatccatttaaaccaattcgaaataattgctgagaatttgtgaattgaatgcgtaatactatgcatattgcattggtacttctgtgtacgaaacaggattggagtttgatatttgcctcttacagtgtggccaaatgcgttagacagcgtccgctcgggcgccttttttggacgacggacccgaagacaaacgccgggcaacggcgacaaatcggagggcgcagtgtgcaacatgcacagcgaatgcttaccaggattagcatgcaaaatgagcggaaaagcattcttcgagtatttcgaaccgcgaaaatgcaaaccgttgaacagttaaaatgggcggaacagaaaggaaattggcggaagagaagacaaaaagcgaatatagaaacagtttaaaatgatttttaaattatttatttatttgataaatatttttgagtttaattaaggcataattaaaagttatcgaataaaagtcgaatttggcaaataaaatgccgcagcattttgccgctcaccaccacggctttggcaccattcttggctcgtttcgcccctcctcctctttctttatgccgttctcttcctccgctcgttttccgggaatggcatttcgtttctcctcagtttttgtgccataaaaattgccattgtcctgcgcattgttcgttttgccgtttgcttcccatcgctttccgtccacattttcggcatttgtttctgttccgtttctacgccgtggttccattctcagcttcatcttccagtcgctctcctcccattctctttccatcagaagggatccttcccccccctgaatatttttcccctt

SEQ ID NO: 10447 - DNA, 1431 bp, Heterodera glycines
  misc_feature (28)..(28): n is a, c, g, or t
aaaaaagaaaacttgggttcctctatgncatttatttgcattttaccgcaaaattaggtcatttggacaaattctgttaataagttttcattattaaaatacttcatgtttgttaaacagctaaattttattgtttttgcgctattaagacacaaattttagagacaataaattatcagaagatgtagtcaacaaatttaagaaatgcccaaattgcaaaattccaatcgagaaaaatggaggatgccgtcatgtgaatatatcaaatattttatatattatagattagatagataattaatgcataaaatattaaataatccttttccaagatgacttgccgctgctgcaaattcgaatttttatattgctgtggcaacaaatacaatccatcatacagccacgattcatcactccaaaaacatactttattttgccgaagaaaatttgagcgccgggacaactgagaaccagaaccagtgaaagtagacatttgagaaccaaaaaaatgaaaaaacaaaattacctatagttaacattattcgatttgtctataaatcttttttatttttggtactaaacaaaattaaataaattgggtattttaactagagaccgggctctggagtcggagagactccgaatcaggattacatttcaatcctggtcccgatcaatcccgatgaatgaagaaaaaaaagcttgggacagatcccgaggttctggaccctgaattcaatattaatctgatctcgcggcatcccgatcccttccggtcgcgcattttaaccctttatatgctttcaacaatgcttacgattgaaatattgaaaacataaaaattatgtgaaaaaaaacatttttcgaaaatatataggcaaaaattttacgctattttatacaccaaaaaaatataaagctatcccataaaaatatacatatgtaaaaacatcaaatatgtctactggccattgcaaaattcgtcatcacggaataataaaaattgcgacatcttcttggattctcttctataacttcttttttcctttttgatcagctcttagcaactgagattaaaaaaaaaattaaatttaagtttaaaaaaacaataaataataaatagggttataaattatatggattaacatattttttctgctcatatgctataaagaaaggggctcaaaaaaagcattagtacgttaaagtttttcgatttagtgaaggtttttaatccatataaatctatattgttgggggttttcgggaataaatccatatttcgccattttttcgttttttgtacatattttgcctgccaattttggcaaattttcacaagacaaatgcaaaaaaaaggcgaaaatatacctctaacaaataaggatcgactttttttgaaatttagaagaatatacccccaaaaagcga

SEQ ID NO: 10448 - DNA, 1965 bp, Heterodera glycines
taggattgggcccccgaccgtcggggttggaaaagtcggggttcggcgtcgtcggggtcagcaagttcggggtcggggtcggaccaaatcgttcggttcggggtttttcaatttttaccttatgcctaatagtccaaatttttttattaatttttctgaaataatattttttaatttccataataataattgtatttgtttttatatttttttatttcttttttatcagaaattttgtatagaattaattttttttcacaaaattttaaattttttattttttcggcgacattatttttaaaattactgtttattttttccgttataaataaaaaaattactatataaaaaatattatggtagcaaaaaaggcaatttcgagaaattacatttcaaaaaataaattatatgcaataaaaaaagtgaattttattcaaaaaatgatcaaaaatttcttattacttttttgtttttcaaaacatttttttcgcggcgcgcattttctaaagacttttagggagaaaggggtccggcggtaccgataggcgcccgggaaaattttgaaaatttggatagatctgttaacagattttgtccagaaaatgctaaatttttgcggttttgagctaattttttttaataagatttacgaatttttgggcccgatgaagccgataggcagctccaggcggattttgaaatcaagctctattttctaacatttttcaccaaaaagatttatgaatttcccagaaagttttgttttttctcttgatattttgttaaaagtattttgaaaattgtagggtacattgttaaatattcaaatttacgccattttcggattactgtatttccactctatttcctttctctcgctttcataaatacccatctcttttcactcatcaattgacttcgcttttcattattctattccttgctcttcgctcgtcattactccgactttttattatttacttctgacaaataaatttattagttttaagttgtgtccacttttggacataacattttggcgcagtcagctaaagcttttttattgcttttgattttgattgacagtgcattcggtcggcaaattttcaattctttttctttatttcttttttattattattattctctaattgctataatttgggaattcgcctgcagatttattagcatttaatttctccgacctaccttctcccgtaacacatcggtttgaaacgttacggcgaaagcataaccctctgacgctaagcaaaccgagaagacttgcggcaacggtcaagccataaaaagcctctgaacgcactgttgtaaggaaagccacatttgggaaagtacaagtcattgcgaccgctgtgctcacctcatttgtgcaacttccatatcaaaggtcgtttattgattttattcactgtgcgtggcgaaccctcccagtatttgttggcgataaaacattccctctcatttattcattctcattcacaaaaacattagtccgactgaattgcacttctgctcaaaatggccgtgacattggtcaaatacttcaacatttagtcaagaatcagacggaggcttttcaagcccttctccaaaatgcccaaacaaatccaaattccgtcaatcattccactatttattcgactatcaatagccaacttggccaattcacatataatccagaattggatttaacttttcaagcatggctcgaccgttttggcccgttcattcaggtggatggcaaggaccttccagacgcaatgcaagtgcgactgctgcttggaaagctcggtcaggaggagtacgctcgtcatgcagaacgtgtacttccaagactgccgaccgactttacattggcacagacaattgataagctcaaaattttgtttggggaaaccaaaagcattttcacacgtcgatatgagtgttttcagttagttcaca

SEQ ID NO: 10449 - DNA, 1638 bp, Heterodera glycines
  misc_feature (1467)..(1467): n is a, c, g, or t
gcttgcatgggcctgcaggggtcaaattcgaaaaattaatcaattttatgaaatattagattcatgctaaataacaccgagattctctggcagtattttccttaaaattattagagaacggaccgggccgggccctgtatcggtttttaccggccccggaaaatcgacccggcgattttaggaaaaacacgggttcaggtttttgagaggccaggcccggcagattcggaaaatccggtctcttataataagtattccaaaatcccatttcttctacaccgtccgaccgtttgttcagttattcgacgtcgcggaagacccgcgtcgtgcgcgtgccctcgtcgcgcggacgcgtgccgccgcgcgaggccctcgcgcgtcgcccgtcgaccgactgatcgaactgttgcgtcagggcttcgccttgggctattcaatggcgggcggcggcaaaaacggcaccggcgaatatgacgagaaaagcctacggacactgtcaccgcgatttttgagtgtaacggcggaggatgacccgacgaagaataaaacggtgggggaaaatggccatttttgggggagggcggcaaaattaaggggattaagtgataattaaaacgtgttgagctttcaccactaatgagttagcgaatcgtcaagactctcgagttataccagcagattttaaagacgggaaaaatttggggtgggagtggaggcgtcggcgaaccgccgggcccttttggaattgtccaaggctcttaaccgatgagccagccatccaacctcatgccgccttctctgcttgaatactgtaattctcccaatatttcttactgtagattgaccttctttccccgtcactgttttcgctgcattccgacggccaaggcattgagaagttgaccagcttgcccagcctggtccaggggttcagcagcaaagaccaacagcagtggttggatctggtcaatcagttattttttaatttagggatcaccggggagaaagcctataccgctttttggggcctaagtaccgagtttcttggccaactcactgtccataattttggaaagaaatcatatgcgggtttttgggcatagataccgattctcggggccaattctctgtcccgaaaaccgggaaaatttttggcataaaatgcccacaataacggataaaatcagtgatggcaaattaggaaattttatttaaacatattaattaataattattatggacagataattgaagcagcgggcgttggggaaagtgtcgaacgcattgaggaagttggaattgaaaaagaaagctgagttaattattggaaaatgacctcaattaaggaactgttcaacggcggggtgcaaaatgtaatgcgcgatgcttggcgagaacggagcacaaatcgggaaaaatatgagcgcgagatcagagccaaggacggcacgccactgtacttcaccnagaagaacgtgacgtaaagtgatcgaggatagaatggacatgaccaagaacgggaatgactcatgggaaatgccgagaattaaaaattaggggaagcaaatccacatggacagcgagtgatcagcattgatcattggatagcgtaagaaatagggatgactgttgctgatc

SEQ ID NO: 10450 - DNA, 2640 bp, Heterodera glycines
caaatttccatccaaaaatgccgtgttttatgaaaaaatgccatattttcaatgccgatttcgaaggtgcgtgaaatgaacaacaccggctacgccctgctctccaaggaccaactgcatctgctgtatgggcccgagtcgccctataacaattcggacgtaataaaattaccccaaaattacggggcaatcgaattcccgcaattcttggattgattctcgaaactaattcactgctgcttaaaaaggctctgcaacgctttgttcggttgagtgacagcgaaatccatgccggcattgagagggatgtgcacgcgttggccgagttggagtccttcaaagttcggcaaaaggacgttgtcctgtcgcccattttgttcaccacctttctcctggtaaatgtccaaggatgaatggcataatatattcctggcaccacatatatctaaatggcaccaaaaggcggcaaaaatgggtaaaaatgaaactcgttattggccattcatatcgctatgattcgggatggggtaccagtacgaattggcttagtacgagttggatttcgtccataaaaatggtaactaatgggtgcaccccctaaggcaaaaggtaaacggaaaaaagcatttggctgtgcggccaactcagtctcgactcgatctcgggtcaagaaatgtttctgtttttgccatttaaatctgagtttttgggccaatataagccgaggattttatcggcttcttctttttggctaatccccaactttctctctgttcagactttctccgccaagtccacaattcttctgtcgcccattctgttcagtccggtcattttgtcccccaatgtgcttggtcccaccattctctccccgtggctttttgtgccggtgattttgtccccgcgagcgttgtcgccggtaagtcaaattcgagtaattgtcacttttccatttggggatggatcaaactctcgagtctctatggccgggactctcgacctgcctcaagtcatattctcgccatttttttttgatttgcttcccactcaccacagactgttctgtccccttttgtgctcgaccccatcattctgtcaccgttcgcaatacatccgatcattttgtcgccgggtgttctcaacgccatcagttcgaattttttttattgggaaaattccaatcagtcctggattctgttcacagttgaaacttgtgatccggagatgtcagttttttgctcccgggaagtcacaatcgctgaataacgaacgccctttttgttttgctgactctcccctttcagtactgaactaatttcctcgccattttacccttactttcggtgccgaagccgtttccccgccatttatcccttccaattcagtactgaacccatttccccgcgattttactccttctagtttagtaccgaagccgtttccccgccatttatccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtactgaacccgtttcctcgcaattttacccctcccaattcagtacttaacccgttcgtgctgtccccgttcattttgtccccgcaagccttcaccccggttattctgtcgccaattgcgctgtcgccgttcataatgaacccgagcatgggcagtccgactattctttcgccttttgtgctcactccgtccattctgtcgccacaatttttgtccgccctcattctgtcgccgtacgcactttcgccggtcatcgcaaggtcaaaaaaaattggaaaagccaaaaaagaagaaacccaataagccatggttggtacaagatcaaatgaacttattccagggtcggatctgtccttttatcagaaatgtcctgattttaagggtccaaatctataaaatgaaaatgtcttggtttgtcagaaacgtcctgattttgaggaagcgaccaaaatttgaaaattgttaaatcgataatctgaggcgaaaaatataattatttaatacatttttgatcgataatttaaaaaataactgacttgaaacaatttcgcaaaatgttctgattttcgacccaaaatctgatttttttaggcccggtgttctgattttgaaaaaatttcgatacaagccctgacttatgctaaaaaagttctattaggatgttccatatttatatttaacaaaagtttaattgttttcaaagatattgaaaatcggtacgatccaaatgatgataaatcccaaatgtcacgccatgtatctcccatgtaattaactaattatccctacaaattcagtccattgaccgccgtttctgtgattctgtcaccgagttggctaagctgatgtgccggaaaaagttcaaaacaaatcccatttaaacagcccaaaaaatgaatttatacattatgcatatttctatttataaatttttatttgtttcttttgcgctttaaaattcaa

SEQ ID NO: 10451 - DNA, 5050 bp, Heterodera glycines
tagtgtttatgccaggagtgtcattcgtccttggatgccaaggacgtccctgctttagggcgtcgatgattgaaaattttgcaagatgtccttggaaaacaaaattggaaaaataaaaattcagtaaaagcgttgccaattgtctcaaaatggcaaaaagcggtgaaataaaaaaactgggggcgctatatggaaagtcaccgatttgaaaatttttttcactttttatgggaaaaattttttttaaagcgtttcaagaagagacaatgttttgaaaaatgtttggctgtgtacgcaagaccaaatgatggaagaacagttgaagtatttgcaaatagaagaagacatgctttagacaacaggtgggttgttccccacaacctatacctgctgaaaatgtccaagtgccacattaatcttgaaaaggttaatagtgttagttcagtaaactatttgcataagtatgtgcataagccaccagacagagcaagattggaattagaagagaaaagtgaccatgatgaagttaaagagtttattgatgcgcggtatttgcccgcaagaagcagtgtggagaatttttgaattgcctatgtatgaccgaagtcactgtattatgtctttgactgtacatttgcaaggagaacatatttgttattttgatgagaatatggatgaagaagagattcgtgaaaaattagcgaatgggtcagagttaatgacttattttgaattgaataagacaaatgttttggcaaaaactctgctgtatcatcagataccggagaagttttgtttcaagaaagtaaaatggactgagagaaagacacattttaatacaattggccgaatggtaaaagtatcaccggctgagccggaacgatatcacctgaggctattgttattaaatgttaagggagcatgctcctatgacgatttgaaaacagttatagatgtgaatggcaatgtaagtttgtgaaactttttcatctgcatgtttggaaagaggtttgattagaaatgatgaagaatggaaaagagccttagaagaagctgagagttttgagatgccttggaaattgagagagttttttgcattgattttagtccattgcaacccggccaaaccggaggagctttggaatatgttcaaagactcaatgtctgaagattttagcaggaattttagaaaagaagtagctaatgctaaagcgtatagagaaattgcacttagcattatgaaggctggaaaaacgcttgccgattttccaaccatggaacagataaatgttgatgatgatgttgaacaaatatttgatttggccgaagaattgaatttgggacaaagaaactatgctttgatgtatgatgaacagaggaaagttagtgatgaaattttgcatagagtatggaatcctataaattaacccgcgttctactttcttagtggaccgggtggaacaggaaagaaacatgtgaacaaggcaattgtacatatgctgagaggtcagaagaagaaagtttgtacaatggcttttactggcattgcagcaactttgctacctgccgggaggacattgcacaatagatttggattagcattagacatgagcaattcaaatattgggccaagatctaaagcttggcaagagctaaaagaaacagatttatgtatttgtgatgaggcgcctatgataaataagcgcgcaatgaggactttagatgagaaattgaaagagattatgaataatggaattgcatttggtggcaaagttatgctttggacgggagactttcgtcaaactcttccaattcagaaacatgccacgagagctgaggtagttaattcaaccttaaaaagaagtgagtattggagattggctaaaagacataaattgacgaagaatatgagagctcttgaaacagagcaagaatttgcgagaaatttgttagagattggaagtggaacatagaatagtgataaatgatgagatatagttgtacggcatcaattatatttatcaggatgtgacccccccccccccggcaaatgcctttctctccgtttcactatttgcttttctgcactatttcgctgtttctgctcaaggtccaactatttggtacaacacacagctggtaataggtacactctttaatcgttcattattataatttttgttgctgtccgtgtgtaacttcgtcagcaatgttctttgccctgtgtgaacaatgtatgaggcgacacagatggagtgcctcttatttcagatccaagcactttctctatttttttcttttatttaaactttattattgttaacacttaacagtgccagtttataatttatcaatattcaatcagaatgtaaataaagaatttacctatgcaactgaaagttaaataggtatagacaaagggcaattggtattacacacaccgattcaattttgatcccctagttcaaaagtaaatgcgtgtgtggcgaagtggtttttttaagaatgtaaagagacaaagggaggtggagggcggaggttcgagtccgttgtgcaacatgaatatttttttatttatttttgtctaaaaaatttaaaaaatacaatttttgaattggatgtttttttgccaaccaaattggacaatcttggtttcattcgaaagttcttgataagaagaagatttttctaagcaaatgctaagcaattgatgagttagaaaaaagaataagcgttcgattttaaaatctgtctgaggaaaaaagttatgctgttcgaagtaaattcggtttttctctattaacagagacaaagaaatagtacgccaaaacgagagatgttttttttctctgcactctcttttcaactcgactagccttactttttggatttatcgccgccaagcgaacatagccaatatggaagtaaaagaaaatcccttcccggttcgtatcaatgcattttggtcaacttttcatcaccggtgcttgttctgttgccaagtcgcgaaatagatatatttttcaatgattttttttaattaatatttatttttgttccggatttttaattatactgtatatgaaattttagaaataatttatgtagacctatattctaggtttttattttttagatcctaaaaaaatttaaaaatcggttttaacctatattttggcgttttgcccaaaataattaagaaaaatataagaaaaaaaatgcaattcaaagttgcaaaaaactgccaaaatacctagttagttccctaacccgaactcgaactcgaataaaaatcgaaattttgaatttttcaaattatgattttttgttcaaatttagattaggaaatcggaattgatcaaaatagttgaaagattcgtgatcggggaccccaaaaaccccagagaataaatttttatgactatcacaaaaaaattttgcaaaacaaaagggtcccgccttttgaaaaaatttccaaaaacggccacttttaaagtagcgcccattttcttttgatacctattttcattttgtccatattgcgatttttagtccatattttatgtcaaatttcgtgattttatttccatttttgggaattcttgttataactttagctattccgaaattctttaccaaaatgtaaaaatatttcaattataattataatttcttcactacatttattgaaacaaattacaggtttaatgtctaatcaacaaattattagtcctagctgccaagctcttccttccagagagcaagctcttttcaagaaattaattgtatgggttttccatttcttttcatgtagaaaaatttcagaagtgctatgaacaaaaacagtacaaggttggcttaagatgtgcaaaacagattatgtcgaatccaatttatgcggagcatggaggttatttaagcgaaaggagggagtcgaacaaaacagtacgaatttaagaaacacttgcgatgaaaggattgattctaaattgtatggggaagcacgaagaagcgcaagaaatagtgaagaagggactgacggctgatctgaagtcgcacatttgttggcacgtctttggactgacccaacgcaccgacaaaaagtacgacgaagcaatgaaagcatataaaatggccttgaggatagagccggaaaatatgcaaattcttcgggatttgtcagttcttcaagtgcaaatgagggatttcgaaggatatcgagtcagttgggtgccttttcaacccatttttgttcccatttaaggactcccgctacaaattgctcgagttgcgaccttcaaacaaaatgggatggattggttatgcttcggcgtatcatttgcagggcgaatatgccatggcgttggggatcatcaaggagttcaagaaaaacaacaaggtgattgtccttatttttataatattcccttaatcttagaaggaaaaaattatttgcacttaatgatgtttttagccaacgtctaatgtcgattatgagaacagcgaaattttgctttacgaagtgatggtcctaacggaggccgggagaatagaagacgcattgaacaaactcgaggagaattccgagctgcataattgaccgactcgcttaccttgaacaccggggtatcccgatttccactgataaatctttaattttattacgagagatttttaacttaaaggattttaagatacttgtactgcttacgttcgttgcgtattaatttaggttctcttttggtgaggttgggtcggtttgaggacgccgagaaggagcttaccacacgattgcttgacgggaaccgagactgtgtgcactgattacggagcgagattgaaagagtgtcgatcgagttggcgtgaattttttcttgaagattaacgagaattgatcggctctgagtgcactttgatggagcgacctttgatgagtccgaatcggattgacgatacctgggtttttatagaataactttgttcgtgttcaaacgaaccctatctttttggtatccattcgagaagccccaaaaagtgacctcgaagaagg

SEQ ID NO: 10452 - DNA, 3883 bp, Heterodera glycines
  misc_feature (3193)..(3193): n is a, c, g, or t
tggtgccaccgtctgcggtcgtgacgatgtcacagcacgtcccaactgctgactgctcatctgccgttatggctttggctattggcaactccacaggacaaggccgcagatgctttgaacaaaactcaaaaatccatccgaaggtttcaagacattgtggtcagcaaagcggcagtcatcagcagcagattaacgaatccagcacgaaccagattgtgtggtcagtttaaactcgctcacttcaatgtgctggcagctgtcctatgtgctcttctctgtgtcatcataagccaaactgcttggtttttcacgttaccagcgccgcctccgccagaccgacgatcggcaacgccatcagcgaaaacaacaaccggctggagcagttgtgaattaacatgcaataaaactggagtggacattttcataccgaacggaattgttaaatttctcttgtgctgtgccgatggaactagtgccttactcaaatcggcgtaaaaaggactgtccatcatttacccaaggagcatcttctctttgactacgactgcgaaattggtggagcaagctttctcgttttcttcatcatcgttcgagttgtgacactgatgtgccatgtttccctgctttggttcctccagcatttcctctccttgctcattcgcccattttgctgttttcggacaaaggagccaacatgaagagaaagacgtcaaagaagccgtagccatcctcgactttttctgaaacttcagacagcaatacttcttttaaccctttgcgcctcaaatcaatgcattaaagcattagttgcctccatcactgcctctgctgagaagtccaaaaggtttgactcagtgtgccattccgagagcccaacaaaagccactcttccctcattgggtctactagtacgccttcgactttatcaccctgaccagagagcacttgtcacattggaaatcggcattcgctcgctgactttgccttatctgtctccaaccgcagttatggcgcacaagtgtcatcagggcggcaacaacaaggcgttccgtaatgtcattccgaacgaaatacaatttacaaatcgcgccgatgccaaccacttcgattgcctctcggacgacacgtatgttcaatgtgcctgcctgactatgactcagcaaaaaataaccgccaatgccgaaattcgaaactcgcatcagcatttataaacccagagaagtgcctaatctgctgcaccgattatagttttgacctttcttggcaccttggacgtctctcgccatgccatttgtgaggggagggctgatcagtcagcacaattttcgccaatcttttacgtcgctttttgatccttcgaccttttatacactcgttcattttcaaagaaattggaatttgcaaattattctgccattggaggacaattcacctttcggcggttgctcattctcagtgactcgttacatccgatcattccgccaccttcgaccttttcgcataatccgttcaaacattctccccaccaattatgagtttgcctgagaaaaaagcggcgcttaaacgagcaaaagacgatttggcgcaagccgaaagacgacactctcgccgccctactcccgccgtgcccaaccgccctcgtccccaactcgttctgccagccaaccgctctccgattcgccgtccaactcgacctgccccgcctttgtcctttgtcgccccaccgccgccgtcagctttcaccctcgccagcgccggtctgtcccgtcatgcgctcgtcaacgccgtcaccgcaaaatcggccgctcgcccgtcgccgtctgctgtccccctcgccagttcgttccgccaggcgccagtcaactccgtctcctcatcgtcctccgtccgtttcgcctcgtcgcccagccgtgcctccgccttctgtcgatccaccgccccccaaaaaacggttttcgtccggtcaactgcgcacattgctttgtcaacaatcggccaatatgccattgagcaaaaggcgttgatcgggtggactgaacagagaaagagagaaattggagaagctctggaccaggctttatttttgatagttaaaaattaacgatttgaagcaagttgcaaaatatttgattttcgctttaaatctgatttgttgagctctggtttctaattttgtgaaattttcaatcgaagccctgacaaaggagaggtacccaagtgaccgtgggacttccgaatgaaactttcagggtaggtagattaccccccccccccttttgtattataaaattttttttatttttgctaaatgaagcttctggccgagatatgaagcttttcctttttgccttttcatatcattttcaaagaatgtaaagccagtgtgagcgtcgtggcctggtggttatgtcttccatcctttttttcttcttctaaagttcaattccccaaccctgcaaataattattttcacatgtgataattttggtagaaatgagtgaagcaaaggaatttgtcacaccatgcacatctgatcattataaattccgaacaaaaagtgatttgacagtgatcaggaaaaattgttgggaataaatatttaatgggatgagaaaagttggaaaattcatcattttgtgattcaatgtacccccccccccttatgccaagaatatcgatgaaatgaccgaaattttggagcacaaagttggaaatggattaaactttgaaatttaacaatttcatcaccatggtaaagatttacatgcagatagatcatcaaggacaatgcgatccgaaatttttctgacaattgacttcatgttctttaaataaattaaaagtcagatctgtttttgggacccagttggacatttctaccaaaactatcacatgtgtcaaaattaatgtgaataaaaatgaaaaaaaaataatgcaaaattattaatgttaaaaagattaaaaactattttggatatgaaaaaaaacaaaaataattatttgcagggttgggtaattgaactttagaagaagaaaaaaaggatggaaggcataactaccaggccaccgacgctcacactggctttacattctttgaaaatgatattgaaaaggcaaaaaggaaaagcttcatatctcggccagaagcttcatttagcaaaaataaaaataattttataatacaaaagggggngggggggggggtaatctacctaccctgaaagtttcattcggaagtcccacggtcacttgggtacctctcctttgtgaggtaatatcctcccctcccgacttaaatggttaatttctttacccagtccatatcttttttgcccagtattttaaaacattgtcgatttaaatggtttacattagagactcggtgtgggactggatcccgcgcgggattttgcgagatccccagtcaacaatgccgcattttttgaaaaatgcgggacttgaggttttagtccatgcgggatcccgtcccgcagtcctgcaaagttttgaattaataataaaaaagaattcatttcattttccaattcatcttcattagagaatgtcgggtgtatgaataaataatcaaatcaaaagcgattatcttagcgttttgcagggcttcgatctctgttctagtcagaaatgttctgttttttggtatagtgacaattttttgtctttataaatccatcacaaattttgatttttttattggtatagttcacaaaactatcctgcgttttaaaatttaacccaaaaattggcaatttgtgatgtaaatgtgtttaaaaatgagctaaaatttcaaaaaatttgctgccgccgcctccgggccacctattcaaaaaatcttttaaatatagcgggcagaaaacaaaaa

SEQ ID NO: 10453 - DNA, 896 bp, Heterodera glycines
aattaggccgcgacgtacagaaaaatgccatcacagaccctttgcggatgagctggactgattgatgtgtggtaaaaatgaaggatctattagtaaaataaaatttgcatccaaaaatactaaaattcaaaatttcgccacttgaaatttattgatgcacaagtaaatttttgttattttgacgcacatacgtaggaaaatgaaacgactttaaaattattatcagaaaattcataacggcacaatttaaaataaatatataaatttcaacaaaactgttaactgatgtagtataaattcatatttcattttctatgcacattatataaaaaataaaatatctacaaaaaataattaagcaattccaaatttgaaaagggattcgaaagtataatataaaaaaaaattctcagaaatacacttatatatttcttttcgttagatgcagtcaaataattcaacataaatatgatcccactttaaaaagaataattatattaaatattcttttgaatttttaatatttcttattgttggaatgcagtcaaataattcaacataaatatggtcccacttaaagagaataaaccaacgatttaaaaagtcaaaattatcaccctatttaaattattaaaaaattttatctggaagcgccatctccaagccaatgccaatgcaggagccggagatagcagcaacgatcgaaaaataaataaaattaaaaacattaaaatccaatttatcgataaagccaaaatgagagaaaattaagccaaatgataaagggcacgtaaaaaacattagttaaaaggttaagaaattgataagccgaagaatgaaatagtctttaaaaaatgacaacaatttgtcaaaagggccaatgttggccctcgaat

SEQ ID NO: 10454 - DNA, 2182 bp, Heterodera glycines
atcgattccttacttaatcggtaaaacgggagtgcgcccgtaagggtgtccattttggtgttaagtcgggccacccggtggcccggcgacccgcaccgatgacagtgtcaggcggggagtttgactggggcggtacatctgtcaaagcgtaacgcaggtgtcctaaggcgagctcagagaggacggaaacctctcgtagagcaaaaaggcaaatgcttacttgatcctgattttcagtacgaatacggaccgcaaaagcgtggcttatcgatccttttgaatgtgtaaagtttccagcaagaggtgtcagaaaagttaccacagggataactggcttgtggcggccaagcgtccatagcgacgtcgctttttgatccttcgatgtcggctcttcctatcattgcgaagcagaattcgccaagcgttggattgttcacccaccaatagggaacgtgagctgggtttagaccgtcgtgagacaggttagttttaccctactaaagacctgttgctatgatagtaatcctgcttagtacgagaggaaccgcaggttcagacatttggttcatgtgcttggtcgatagaccaatggtgcgaagctaccatctgagggattatgactgaacgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtaaaggtacatgagaagagaagggtctctcttaagggagtcaaatgcctcgttaccaccgttaagtcaggtaggcaaatgcctcgtcaccattaagtcaggtagccaaatgcctcgttgccaccattaagtcaggtaggcaaatgcctcgtcaccattaagtcaggtagccaaatacctcgttgccaccgttaagtcaggtaggcaaatgcctcttcaccatttagtcaggtagccaaatgcctcgtcaccctgaaattaggtaggcaaatgcctcgtaaccatgaaattaggtaggataagttcttgactttgctttttttccatttattccaatcgactagtgctttaaggttttgtctttaactttgctttttttccatttattccaatcgactagtgctttaaggttttgtctttaactttgcttttttccatttattccaatcgactagtgctttaaggttttgtctttaactttgctttttttccatttattccaatcgaccacgttaatcattctctatacatttagtgccttatttcatgaaattatatataatttaattttaaataaagaggctaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttgggccgtttttgcgatattgtggctggaaaaaaaaatgcgatttcactgtggggagcgcggccgtctgggttcaagtgcttgcttgcgcttgtgctcggcattgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatggttgacaagccctatgagttcgtggatcggaactccttgcctgtggaccagtgtgcttgcattcgaaaaaacacgagggataagcgcccgaaggccttttggcctgaggaagtgtcctaaccggaaa

SEQ ID NO: 10455 - DNA, 4176 bp, Heterodera glycines
ccattttctcaaaaaaaatttcccaaccccctagggattttgaaaattttcccgattctcagtgtattttaggtgttccggtcactaggaaggagtgatctgattaagttagtgtaagattataaaataaacgcattaattaaatagatgataataataataataataattattattattattatttaaaataattatttgcttttaattttttaaataattattttgctttaatttgatcactttgcactttttcgtgcttcgcccaaccttgcacttttcgtgcttcgactcagcacggtttctttttggtagttattgagattttgttcgtttttcataagtgtctttatatttatttaacaccccaattttggaaaattcgtaaaaattttttccgttgccatttcgtcttgtcactgttagaatcttaatattttcagatttgctacgtacagttaaaatttcaactcgatcggttcatgggaagtggtcaaactaacaaaaaataggttgtccttatattaaattaacacagtgtataatcataactttttatgctgatcaaaaaagtccattgtttttgtgggtttgaaattaactggtaattaattctccgagcacagaagtcatagcgacattaggtttttgcattccgtagcaaattttatgctctttgtgttcctcatattcgtcttacattaaaattttttccagcccccttagaatttttttctgaaaatttctggtttcaagcaattaatttttcatttcagatcatcatgcaggagtgatctgatcacttttgtgcaatatacatttttgattcataaaaagttatgcttacatgacattttgagatttttaaatagtttctagaaagttgtagatagtgcgctataattttattggcaaagataatagtttgaatatttttttctttcctcaaaattatgaggaagttaatctaagaattaatttatataataagaaaaaaacagtttttagccagtttcaattttttattgcatcataaattcgaatttaacaatttttagtgcaaagaatatccaacagaaaatgatttcttgcaaatcaaaaagacatgttttacatttatgttttaataaagattaaatataaataactcagcaccatcactcatccaaatacattcccgaacatttttacgaataaaatttcttcccagatttagcgtaatctaaaaaatcaaaatttaaaataggtttatatgacaaatcgcaccgatcaacagttggcacggtttgaattgtacggtcgagtaaatgttcccgtagcgctccatttgcttgatcaaattttgcgccccgtacaaatcgacgaagcggaacggaccaccccaaaacggggggaagccgaggccaaacacgctggccacatcaccgtctgactaaaacaaatgttgctttgaaaattatttttaaatgcaaatattttaaaattcctttaaaaaactaaaaaattttatgcaatcaattaaaaagtgatcagcacaaaattccaaacttttggaccaataaaaataaatgcattttctgcaattgaaatccattttttaatttaattgtagttttaacaattgcccaccggtgatgaaatgatgccctcctccagacaaatcagcgcctcgttgacgaaacgcgacaccacccgaatttgttgatactccaccgacgaagcgccctcggacgagctcagtttgtagcgtgccactatttcctgcgccttcgaatttggcactttcttcgactttttgccaccatcggcagaataggtgtaaatgcctgaggaaattgaaaaattaattattggcaatgcattcgaatttcatttgtatttgcaatgaggatttgatgaatttgaatatcttagcgagattgaaacattgaaaatattttgattgatcacttaatttttagagtgaatatgattttgttttggctatttaaattgtttgttttgcgaaataaaggcaagaaatccaaaaaagcactttgagtgggaaaaggaagaaattgagtgttactatataaagcaattaaatatccatccaatttttaaataaatcaaatctccaaattaaaaaattcaaaattaagaatttgttccaaaattcaagctttttttaagcttttcaaggagggcggtggaatgaatggccttttattttccatatctcccagtgaataagggcattgtgcaagcatcgaaaaaatgcagctctcacctgcacccgactttttgcccttgaagccggcctttgtcaggtcagcaagcagttcggaggagccgccttgcacacgggggccaagcgctttgcccaaaaaggtggtcagatattcgctataatcaagtccaatctaaaaaaaattgtttttttttttcaaaaaacaaattggtatgtgcctcgtccgccagggtggccatgccgacggagaagccgaattgggtggtgattttgtccacttgttgcggcgacacgccctcctggaacagacggactacctcattaagcattgggctaagacagcgggcaacgaaaaagccagggccatcctgaaaagaaaatttttaaaaaaatgaaaattacatatttttttcaagattaagtatttaatgtaaaaagtctatttttaaaaaataatttttcaaatcatgcaacccgccttgaccacaacaatcatcttcttttggtccaaaccgagtttggcggccacggcaagcgtttcatgggatgttttgtcagcgatgatcacttccagcatttgcattttgtctacaggcgaaaactgaaaaagggaaaccaattcactatttcctaaaatatatccctcgcattaaatagagcccgcctttgaggtaggttgaaaaataaagtcatggctctattttaggaaataaggtaattactattttaataatctgtgtaaaaaaattgactgtgatgcatggaaattgatggaagtgaataagaaaatttataaaatttaagataaagaaaatttaattgagttgttctaaatttgattttgaatttttcaaataaaaattaataaaaggatatttgtgatttgcttcacacacatagttcatgccgatgacccgctcggggcattgtgcgaccgctacgatgtcgtggatgggcagtactgaagtgtttgtggcgatgatgcaatggttgggcacaaccttttcaagctgaaaaagcaattcggtagaaaaaaaagactaaaaaaattattttatttggtaaattgattagaataagaaaattaatttataagaaataataaaaacacatggacattccaaataaataacacttgccttctttatgatttcgtgctttgattcaatctcctcagattctgtctcgacaacaaaatccgcatttcgcaatttctcataatcatccaattcctgacaaaaaatgtcatcagaaaacgaaaaattttcagaaaatttgacaaaaaattgagccaaaaataataaaaggaaattaagttttttctctatattaaaaataactttaaagggtatcaaaaaactaaattcatacaatgtgtcatattttttcatcttaccggtttcagattggcgagaaaaatttttttttcagcagcggtgatcaatttgcactttatctgaccctccatttgggaggtgatttgcttcagtccgccgtccaatgtctcctggtttgtgtcgatcagaatctgtaattgcataattttcagcgcgtataggtgccatatttgggatgtgttcttttatggatattttcatgatttataatttaaaattttattaattacgatcaatttataattttacgtggattatacgagaaattgttttggttaaaaaatgattttaaataagtttttggttaatttaatatattattttcaaaaatgaatttgatctttttataaattctgtgcaagtgtgcgaaaaccaaaaaataatttttgaaaacgaaaacaaaaatgtttttttcacgaaaacgaaacacgtaaaacgaaaaaagggtaacacgaaacacccctgattctgtgtgtgacttaccgttttgatatccttgtcaatgctcacatttgcgatgccagcgcccgtcaggccggcacctatgat

SEQ ID NO: 10456 - DNA, 1176 bp, Heterodera glycines
  misc_feature (15)..(15): n is a, c, g, or t
  misc_feature (36)..(37): n is a, c, g, or t
  misc_feature (295)..(296): n is a, c, g, or t
atcaataaaaaattnttccctctatcatttcatgtnntaatattaattttaagacgctgctgaaacttaccccgtttttgcgcgcctcaccgtatttgtcacttttgcactcagtttgcccttcagcaccaaatctcattaatattgtaaatgaaaaaactaatgacaataccttttgaaagtccgatgagcgcctccgactgtgtcgtttgggtgagatagccaaacgcctagaagcgggataagtatctagttatgcctttttggcctgattgagggccccccccggcccccnncccccgctcagctaacaatgagccctaattatcatatattcgcatacttaaattatgaacccacctttgtttcctcctcgtagccctcctgtgtgccgtccacgagcccggtgcggacaacgtccaaaatgcgcaatggggccgggtaattgccatgtgttttcttcatcactttgtcacgtgccattcgcatcacctgttatgtaaagaagtaatttgtaattagaagttggttagaattattttttaacaaggaaatattcccaaatttgattcggcagcgcctgttcggcactgatggtcctatgccttaaaaaactcaaaaattaattaaaaaagtcaaatgaatcactaaaattgtataatgtgtaacattagaaattgaagaaataatatgggttagggaatgtgtaaaaaaaaattaattatttttattttaaatagatttatttatacattgcccagcaacggtttgcgggtcagcaatgcgttctgcactcggcccattaagggtggccctctggtgattttcattgtgccggctgtgagctgttcacaggttgaaatagcaatctgaaaaaatgattagggtgttcattactctatgtgagaaatattgcgcataaacattaaaatatgaaaaaacacagcaattattaaaacccttaaaaatgtacaaaattggttaaaataaatatttatatatatgttcattttttagcaaattggcatgtaaatcactaaaaaaaatttcccagcggcgcttatgggcaccgctggactcctcccccagttcccaaaatctttttttgaataaagcgcgccgcaaaaaaacgtgtaatggtcccgaaaaaaatccaacaatgctgtataaaaatat

SEQ ID NO: 10457 - DNA, 4094 bp, Heterodera glycines
agtgagtgaccgaccctgtgctccactgtgaatggatttgccatttctgcgttgatcccctctttcccttcagtgccattcgtccgatccctgcggcaatgccattggcaccgtttcctcttcttttgccgactctaccgacaaaacgctgtccgtcgacagcttcagaagtgtgccgtctggcgccgttctcgctcttccttccccttctctgccttgctccactctcttcaacgtgctcagcttcgtctcttcccctcaccaactctcttccctccgtgccgcctttcgatcttctctcttccgctcagtcgcattttcctttgcttttcgcctttggggatggctgatcaaaatggccacttctgatcaaaggtgcgacaaatgcgatattagtcattgctttgctcgacggatgatggcttccccacacaaatttacttctcctccactctcgctttctctctctcctccactctcgctttctctctctctcctccactctcgctttctccccccccccctccccaccccctctctccccttcactctctcattgtccctttctctttgatttacagtgtttccgatgtgatttggcactttctatccgcccttccgccttcttcgccccgctttccgcttcgtcctcaccctacgcagctttgtccgctcgccggccctctccccattcatcggatggtctctctcttccatgaactgctccgttccctcgccgtcctttttcactcttcggcggagggatcggagccgcgctttaagtgccatcgaacatctcaaatgagtgggaatttggcattttgcctttttttggcatttcgcatttttcagcggcgctttgtttccgcgcttggacctttcagttgaccgaccatgaacaggtcaaaaagtggcattgcttttttgatgtccgatgtttaaagccattattttcttctttaggaccttttgccggtcattcgttcgcttctttccgtcgttagcaatgccctcagcacttcttctgacactcttttgaccacagaatctgtcaattcgagggcaaaagagtcgcatgacgagcagaatttgtgccaattcaaatttgacgatttgagctcagaggcgcaattggacgcgtcaagccgcgcgcaaatggtcggctgtttggtggacggaaattgtgacactttttgggagagtggggaggaggagagggggcgcacggagcggcgactgagggcggcaaactttggcccgggggcgctgctgttggcacttttcattgacaatgccaaggacgaggggttcagagtgggacgactgagcatcaccagcccagggaggcgagaagatgaagcagcccggggggatgaagcagttcagcgaggggacgatgaagcaaaacacttgctggacacttcgttggacaaagttcgaatgcattgccgattagtgctaattaccaatgatggcctacaattaaggaattttccggatgggtcaaatgtgccatcgatggacgaaaaagcgtcgaaatttgcctttgggtattttatcggtttattttatgcatttaaaattcctttgttggccagggcgatgagcttggctgccgtgtccgccaacttcgcattctcggctttcgtcatggtccgtccgccgttccccccgccgcccctccgccaaaatccgtctcccaacaaatgcttttcaccagcggcgctcaaagcgacgcattcgctctgttccaactgttggctactcaagtgctttgtgaccgaattgcgcccgaggggacggaggacaacgcacttagggagacggtgttggacatggtcacggcacgggggcagctgatgcatcccctgcagcaatttgttggcactcacctcgccaacggtattcaaaggtgcgaattttaaattacattaataattataagtaattgctttagggaagtccaaagccttcgcatccgccgcaggcgcaatttctcatatgtcaacgctttgctccaattgctcatgcgaatgaattcagccgctgctcagccaattgttcacgcgtatgatcatcatctgctgatggcactttctgatttgtggctgttcgcttccgaagccgtgcaggaaaaagcattgaaagcattcgaatgtttaatcaccgccggcgacggagggcaaagggaaggaaaagtgccggaagggactgaaatgggcgtgttggccgaacgattgttggttacggtagtcaaagtgttgcaaatacaagtgaaggaacagcgagcagcagcatttgggactaatcgaggcagacagcaactgaccaaacacacaattggggtgagcaattagacagtgccaattggccatcagtccgatcattttctgatcggtccttttccattggtcaagactctcgcctgcgatgtgccaccgcactgggccatttctgaccatccgagtgccgagtccgcccgctttgtcattcgtttccttcgctcacttcgcccttctccctggcgtgccgccctccgtgcccaactcgcgcatttcgtgctcagtctgtgctcctccttccacgattcgctttccaagagcaattcgcttacgcattgtgtctgtcgcgcctctttttggttgtctgtcgccgctttagccgcaattggcggcatcgattggctggaggaagtgcccgagtatcagagactgaaggtggcatctgcggaattgcgctttcgttttcccaatgcttttcacagtcagctgcgactgatcgcactccgtcgcccctctgcgacaaccatgacgacggacgcacgcgcgcgcagttgcgctgtcagacatgcgccctttcgctgtgccgtgactgtttttccgttttgcatttgagccgacgaaaccaatgccatcgcgcacaaccgattggtgtcggcattttgggagtgttgacaccgcgaatggacttccacgagggctgcaacagactccggctgatcagcaccgaccagcatcatccgctgctgctcattctgatcaacccgaacagtctgatcggacttgtcgaattgggcgctggcacaggcaaaatcagtggcagggcaagcggccaaatggtccccggagggtttttgagaagcgatgaaacaatggaggaggaggacgaatgcccgagcggagatcacaaattggccgactaaaagtgccgattttgtggggctacgctggcaactgctgaacaggtgccaagccaagccaatggcaacttatctcccctttgattatgccgccttttactcctttagcggcttaatggtctctgcgagttggaggagtgccatcagaaggacactttggcttgtcagtcggtgttaagctgtggccatttatgccacggcattcgggaagaaattcaatgtccgccttgccttttatgctcttccggtcggtcatttgcaaaattgcttcgtttggttccatgttcaaatgccttttcagaccaattccatcaggacgcggacgacctttgctccatttgtttctctgaacgccttggcgaggcgccatgcgtacagctgaagtgtgtgcacttttttcactggcaatgtgtgcgcaccgcacttgaaaagcggtggccggggccacggatcagttttcgcttcatgcagtgccccctctgcaaggaaaatgtgaagggaaagcggcgggggcggggggggggggggcgaaattggcacagaaaatgggacggaatttgggacagactttttagtattgaaaatatcccatcagatcgatcatccggcctttgctgacttactgaaacccttgaaagaactcgagagtgacgtgaagcggaaggcacggatgcgtttggaatacgaatgcggcggcggttggggcgcattgcccggcacatcggcggagagcactcggaatgacaggtcgacaattatcgaatcattgtgcatttttgatttaacgcaactgatgattgctcattagcgcccttttggagaccgccttggataaatacgtttacgtgcaatgctcgcgctgtctgaaggcgtatttcgggggagaaagtcgctg

SEQ ID NO: 10458 - DNA, 1340 bp, Heterodera glycines
ccctttcagttacccgatccggagccgtgccctcttcgcattgcttcgcatccgccaacgggcgaaggtccgttcattctttggcatttggtgccatttttggtttttcataaattccaattggcacattattattatgtttatttatgttttaatttaattaatttcctttcttttctctcagaatttgctttgggctgtggcatttgtcgcaatttgcgcagtttctgacacttcgtttggcaaaattccctgcatttcgtttgccggttttccataatttttctatggcattcctccaatttgtcgatgatttccatatttctgcattttaatttattttatatttctttaataaaaataaatatatgttgttttggttaattaatttttaattttcttcgtcatttgcttttttcccttcattattcgttaattaatcttccgttttgcactttgaattttaattcttttgaacaaatattctgtgtaaacaggcctaattgataccatttttttaatccgtcaattttgtattttgtgccaattcttttggcattttcaccgtctttgggtgtcaatagacaattggcccctttttagccattcttttgccatctttcgcctaattctgctaaatttttgttccaataattcgctttgtcgtcgatggtttttctttggcttttcccagtatttctgaactttctaagcccataaacactgaaatccgccgtggtccgccacctccgcgcgcggatttatcacgtcttacggctaataaataaattcgccaaatccgtccaaatgcctttggcttttcctcccgctggttccggcttttccttgccgacccatcgccgtaatggcactttgccccgctccgcgtccctccgtttttcttctctgcgcactccgtgccgtcctttcccgttaatccttcttaatccaatgtcctttcctctcatgcattccaatcatttcgttcattcattcattgctccatccgacgaatgtttggcatggacaacgcttccgccgcctttccgttcgcttcttcctccgctgaccaaattcagttcgacttttccgactccgttttcgacctgtccgtcctccatttgccttcggatgtctttctccgtcaacacaatctttccgattcgcatcatcttgcagttgcgcatcaaaatacgcgtgcccagcaaatgtacaacatggaggcgggcttggacccctttttggtgatgaagggcggcgtggagagggccgtggtgttggcctacttcttgccactgatgcttatcggcatcatcggtatttgtgtttgattcccctcc

SEQ ID NO: 10459 - DNA, 1415 bp, Heterodera glycines
agagaaaaagacaaagtgacgcggcatttgccaattcagaaccattacatggctatattccggacgaaaagcgtggagatggaagacgccacttgcggctcgcaactgcccgaccgccttttggtgggttacactttaatcaactaattggatttgtaattagcgaattatacacctgatcgctcgctctaacactacccctagcctttggtttgccatattcacccctttctctccttcacttgtatttccaaactctctcttctccccgttcctctctgtccctctcttctctctctctcccttcctcttccatattctactctctctctctctctctctcctctctctctctctctctctctctcctctctctcttctctttctctctctctctctctgcgccctctctttctctccctctctctctccctcttccaaattcccattccctctctctcttcacctcttctcctcctctctgtctctctcccattctctctcttactctccctccctcttaagcccttcttcatctcctatatgcttttgttcggcttcatcgtgcctctccctctgatcgccgtctgctatttcttcattattcgtcaccttcgtcgcaaaccgcgaggtaaaaaacagtcaaaaaatgagtagccagccattcgctgctgttttgcttgctgccttttacatttactaattagctagttaattagcctttcgctaattgccctttacattttaggttccgtcacttacactgcacgcgctgtccgctccattctccgcgttgtcattttccattttatctgtatgtttttattaattattttcctaattaccccctttctttttcccattcattccattcttttgcccctttttaggttggacccctttttggttgttcgttttgctccctcttttgtcccatctgaagttcgtccaaatggacacttttctcaattctcatggtgctcgcattggccgaatgctcacctgctttttgccctatttgaacagctcaatgaattgggttttctatgggtaattaataataattaattatactaattaataattagtgcctaattgcttatttgatttccatggcattttttgtagaatgatgaaccgccaattgcgcgagaccggtgccgtcaccgggcgtcgttcgtgcatgccgttgtccgccacccttcggtccacccgtacgacttcgaccgcctcaaaacggtccattcgatcactgatcgcctcaagcagagtttgacggacgaaagacagcagggaattgttgagaaagagaatgaatatattaatttttgttgtatatttctgcttcaatatttgtttaaatcggcttaaattataaatgatttattttattatttaatttaaaaagcataaaa

SEQ ID NO: 10460 - DNA, 3822 bp, Heterodera glycines
atttgatcagtcactctcaggatggactataagtgatcgatgtgtggtgctctgatcagaaaaaaaacgaataatcatttgcttttatcagttaacgagattgaaatattgagcaatatgattagagacgaagcattgctcttacaaattaggaagggttagaaatatttaactgattaataggattattagagatatatgataaaaatgatcaggggctaatgaacacatgaatgaagaaatgaacttgaactgggcatctaatcaacattttgtgattggaatgacataaacaagcaatgaaatcataatgatccgaaataaattaaactggacaatgtgatcaaagatggaaacggttggttcaatgtgatcagttacaagcatggatctccgcgattaaaaaagttttctcactggataagatggtgatctgagccttcagagaaacgcaaccgaaatgagaccattactgatcgggaattatttgaaaccaatcaatgttgattagaagtggataaaaatcaataatacagatcagctgaagaataaatttacattaacaaaaccgaccggaaaaatctcaagattttgcggcactggcgctaacggcacacattcgatgatcgcttccaattgttccatgccctgaaatttgtcagaaactcaaaaaccggcaaaatgccattgttccccaatgccaccttttgttccctgtcaattgcctttctcaaaatcagctgtttgctgaacgcgtttaggcgcacaaactcgcggccttccacaatgtttagcttcattgtcggcttcggcccgccactgcgcccaatgattggcaaagtgcccaaaatggcacctacacaaaagtgggaaaggaatgccattggatttgaaaccaaatcggctaaacaaaaatttaaaacttttttggatgtacggaagaaactaatcattgggaaattgacattgcaaggccatcaaaaatttctgaaatcgcatttcaaattttttcgaggtccattatgggcgaaatttctgaaaatttgagaaaaaatgaatttttttttgtcttcatttcgaacattttgaagacaaacaaaaaacataaatattaaaaagcatcgaaattcgaatcgaatggacttggagaaaacctttcttggcattctccaccattgacatgtaaatggcacttcgatcgcgctcgagcagacaaacgggctgagcagcacgttcatcgtcttgatgaccaaaattgtggcgacttagacccgattgatcaattccatccgctgtttttgcttcttgggaatgtgatcggtgccatttgatcgccagggactcatccgacgacacatttatttgcccaaatgaagacgaagcgaaaattggccaaatgaaaaacaaaacggggaaagttagcagcagatggaaccggtgaaggagaagaagcttcatccgcttaattggtgtgttaattaatattttggacagtaaaatgagaaaggacagtggcgaccgatggtttttgttaattaattagtggtaaatgctcgagattccctaattatatcacttttttgaccagagtgttgactttatctgagtaaagaatcttgacactaatcattagggctgctcaagagtcatttggtccatttacaatctctgctggttggattatctaaggtgacaatgctcataatagggatgagattttcgtggctaaaaagcccaaaacataattaacgaaaagtggcaaaaaatgccgtaatggcaaaaatagtggtgaaaatgattgacaatttgttaaaatttggaaatttatgctttcctttcattattcatagagagctgtaagtacattttcgaatttgttttacgctatttcgaatttggagtgatttctggtcgaaattttttaggtatcgaaatcccaaatgatttttaggagactaatttagatcgagtttttgcccgatcattgatcataaatcaatctgccgatcaacggacggtcaatttgttgagtgtccccaatggtatcactttctgctgttgctttgatcatcgacctcccatttgtcccactttcttatgttaagagcaggaatgtatgatatttacaatatctttcaactgatcagtcagagtcgcgctttcttctcgagtgtttttgttcgttgaattcggcgatgagtggcgaaacaatggaaaatgaaaacggagaaaacggagagggcgggggggaaaggaggaaagtgatcaaagagagagcagtgatcagagtgggacaaaaaggggaaaagtgatcaaaatgggagagagtgatcagagtgggacagaaaatgggaggtgatcagaatgcgggataatgagagtgatcagagtagggcttaaatggataaagtgatcagagggggacagagtaaggatcagatgttggaaaataaagatggaaagtgataaatgatcggacatacgcacttaaagtcactacattaattttaaattattgtacacaataaatcagtgatcattaaaagcaaaagaccgagactcggaatttgattaagaaaatggtcatggagatcccggcttaatccccggcagaagatacccggaggtacggcacgggatcgtagttgtgaacaaagcttaaatctttgattaaaagttagaagcatcaagcaacacacttttgctgcttccatttttcaattttaatttactaaatttcaaatccccctccatccccgctcaatttcgcccctttccccgccgtttctgtccctccattaactccgatgggattatttacagccatggcactctcccccccctttcccggcggggttttgatgatggccactttttaccgtttgccgctttgctctgtccgccgttgccattggcgccgtcgtccactcaatcggtgcaaaaagtgccgcggggaaatgcgcaaaagggggcaaatgccggcacaaacagtgggaactccaaagtggagatttgtttttgtgcgtcctcagcagatgaattgggattttcaacagggaaataaataaaaacacattttggcacggcacaattttagccttttttggagaaatgtgcgaacttttacggcagaccaatggaaaacagccaaatgcgcggaccattcattctatttagagaaagaaatttcttgaaaaataagatttttcatactaaaataattaaaataatgtaataactaagtaaataatataaaatatgatttaaatgatgctataatgggtataaaataatccgattttttcggtataaaaccgaaaaaaaccgaaaaactcaaaaaattttcggtcggtcggtttcggttaaaaaaccgaaaccgaaaaccgaaaaaaccgaaaaaaaccgaccggtccgatctctagtaataattaaagaaaaaaaattcttaaaattcattaaatgtaaattattaacaaactgttaaatacgcttattatttgtaggaattttgtatatagatttgcaaattttggaagtaaaaagtttaaatttaaaaaattatttaatgctcatattattttttaatatttaaattttgctattttatttttaatcatttcgttttttgtttcgctgcgtcatttccccgccggcgttaatttctcgtccatttttaatttattacctttgcgcttttccattattattttctcaaatgccaattttatgtcttttttccctcatttaaaaaaatttattggctttttgttctgccattttaatgcctttttcattaattttgtcgtcccattggactctaga

SEQ ID NO: 10461 - DNA, 2121 bp, Heterodera glycines
  misc_feature (40)..(40): n is a, c, g, or t
  misc_feature (49)..(49): n is a, c, g, or t
  misc_feature (117)..(117): n is a, c, g, or t
  misc_feature (125)..(125): n is a, c, g, or t
  misc_feature (2100)..(2100): n is a, c, g, or t
  misc_feature (2108)..(2108): n is a, c, g, or t
aaattaagattatttttataattaattttaaagcatttcnaattttatntagttaaataaaaaatgacaaaaatgttgaagcaaaacggtggcggcgaaagtgccattctgttgccncatcagcncaattcctcgactttgatcggctccagcgacgagtgcgacatcgtaatcaaagtccgttggatgttaatttaaaaatattttattttatttaaatttattttttccttttttagagtcccggccttcgtccaaaacacgcggtgatcgaattctatccgaaaacaaaatcattttggctacgccaattggacgcgaaaaacgaacagcaacagcagcaacagcaacagaaaaggcgcatggacagcggtgagaaaaagaaaatcattcggttactgtattttgggggttttgtaccccctaattactgtaacagtaaaataattttaaaaatttcataaatgcccgaaaacccttactttaagaatagaaaaaatcgttcataaaaagttctgtcctttttacagtaccgcctcctccaccatacccctacgaggacactgtggggccacaaaacctgtcggacaacaccagacagcaagtgttgagagatggtaggcagagaaaaaaagggcaagggcagacacacggaaacatttattattaaatgttgaaaaaataatcttttaaaaggttcactgattgaactccatccgatggacacactgcgcttcggcaaaggcgcaaatgcggtggaatttgtcttcaaaatgccgcccctccatcacaaaacggtggcacaacaatttttgaaattatgccttaattgggtaattatttgggcaattaaggcacctcgatcaaaatggtcatgatctgtgataaggtttaattgatcccgcggctcaaaaatttttcagaaataggaaatcaaaatttttttacgacccccaaaagcgtcggaaaccacaagtcggaaatcggaactccgtgccatcccaagccgtgactcgaacgcgcgggattcacgagcattcattaaatgaaaggcatcaacatttaagcgcttcgatccacatccgccgccggtgcgcaagaaatgctcgttggaccgcgaagacatttcgcttcccatcgtcggagtaaaaaattcggggaaggggcagggggcaattaaacttttaaattaattaattttttaatttttagagtcgcattcagccgaaggcacacgccgaccgttttgtccgccccaaacagcagtcaaaccacagactttgccaactcggtggccaccaaacgcagaagcaatcgcaaaatgtacagcagcagcaattatcaaatggagtaaatttaataaaaaattaaatgaaaaaattaataatcaattaggttgattaactgagttatgatttaattgcctaattacaaaggtaataaaatcaattggataattataaataataataattatctttatgtttttaattaatttttatttaattaattatttatttattaattagttttttaaaattatttgtttatttcgagatttacttttaatgcctaatgaacttgaattaataaattaatgatgtggtaattgcccctcaatttgaggtcgctttgatgcgccgaagtgtttccgcgtgccgactgatttctgtggccgattcgcccacaaataattcgctgccgcgcgtggacacaccgtggaaaacggaggcaaatggtgggacgagaagcccaagtggatacggtaatacgaacatatttttattttaagcggatacggtaatgataatttcaaaaggcatactgtagtgaagaataaagatgaaaattaggtaactgaatgaatcatttgaaggaatgattaaatgattatggtaaagaattaatgcaaattcgaaagacaagaaaatctatcgatctgagaaccgtctaattccaggctccatcttactttattaatataaaattttttgtttgcttttatataaaaataaaagaaaagaaaagatgaattattgaattagtttttaaaaaataaaaagttttaaatttttaaaatggcaaatttaagaagcaaanttacactnatttgactctaga

SEQ ID NO: 10462 - DNA, 4116 bp, Heterodera glycines
tccttctcccggaattcgttcatggtttttacgacctctgacgaaacaaaaaaaattggtagaaattaaaaagctttttaattattaatgtttgatttcccatatatttaagtgatgtaccaaaggaatattttggacgatccggtggaactatcgcgactcttgcgtcaggctgagagagaccacttcagggctgccgaacaaatgcgcacattaagaaaaatcgtgtgagtttgttttaccaaggcttcggggagaccgattcacctgaccgcctatccctctttattttcattaaataattacgccaccgaaattttaatattataattttttaacatttagtgaaaaaattgcggctgccaaaaagagcgtttcgtttcgggacgacaaggctgcagcaaatacagtgagcacgtacatgtcggatctgatcagtaatcggggaggcgggtgcctttgcaatgatacctccatcttcattcaggaagtgggttctatttattatttaaatgcttttgtaatagcaactggcatttaatttttacaaatcgaacagggattgcgcaacagtttcattggcgggtcacttgggataaaagtcatgtgcaatacgcttatggagtcacccctgacgcccgcagaatgcaccagcatggttgagaccatatttcaaggcgccatttccatttcaatggaattaacttcggaggacgtcctgtgtaacttagtggacaaaaactggtattttcatgcactgatttggcaatgcactaattatttctttgatttaattaaaacgtttattttcaaacaatttttagctcggaaaagacatacaataagacgggcccgataagttgcgagtactgcaagataatgcacgcgaaggccaaaacggtaaattaaatcaaataaaaatgcgtatctcaattaaatagtttcgaacaaatttttgtttatagcacaataaaacaatatttaaaaacaatattaattagacattttttcactgcgctccttttcgtcccaaggtagcggaatatttcgacgcgatgtttttaggcctcagtgtcatgtgtgcgcgaatcgatacaccggaaggaaagatcactgtgaagaccatgtttacgtgatcacaaatggaatcaaacaaaccattaaactttatttggatgaaaaagtagcaaaaaagcgatgtaaatatactttcatgtgcaagaaatgaatggcaaatgccatccgttctttaccaataaactgaaaatctgaaacaaaaataacataattcttgcatatgggttttttaaattgccgtttatgttgtaattcacaccattttgaaccaattgatgaaaaacaaagagatgataagaaaaatacttttatgcttttttctagggtttctaccacatggttgcgtttttgtctttcctatattttcgagtttatatgcatatttttggattccctacttattatcaaaaaagctaattaatatttgactaatttaaaagctctatttctatggacaaaattttacaatataatttattttataaaaaagaaacaattactaaataatgcagtaaaagttaaataataaaaatatgaaaaagcattctcgtcaaaagtgcaaaaaaaaaaacaatgaataaaaataatgatgaatgacatttttctgtaacatttcttattgaagcaaaaggacggcaaaacgaaggcatttgaattcgaaatgaggaaacgaagagtaaaattattttattattggaaaaattgttaaattatttttgtattacaggaatggagaagtgaatttcgaaaattaaaggagagtcgtttaattttctaaaattccaaataaaatttctgggtttttcattgatttgacattaacttaaaggcaaaaaacgccatcgaaatgtgtactgacggattgtgggatggaaaatcggatggattttataaatttagttaatttaaaaaatatatgaattttacattgttttattttctaatttttttaacgggcttcgttacaaatttcaaattgtgttttttttattataaccgaaccaaaaactttttattaaatgcgaaattgttaaaattgcccatatcatcaacaaaaaactttttgtacagcattttttaaacgaatcttttttgtaataattcatacgcaatttattcttgaccttgccctaacggttacaaaaacggatgagaatgataaatgagggcggatgaatgtttatgcaaatgtctcagtcttcattatcacaataataaatctcttcatcgaaaatcctcttgataagcaatgttccttttaccgaaatgtcacagacgtaaaaaaaccataataattccaccgtttcattctgctttttaaacaaataatcattttttccccttttttgacttttctgaattgacatttcgtcgtccttttgtgaatgcgtcaaatgccagctgaattgcacagtcatttctgtattcaaaaagcgacattttaaaatatcagtcaccaattatttggctaaaattaagcattaaaccaacgctttttgaaataaggtttttattctctgaaaattaaatgtttcgctttgttgtttgtgtgctccttctcccggaattcgttcatggtttttacgaccttgaacaaaaagaaagatttggtaaaaatgaaaaagctttttatttttgatttcccttatttcagtgattgacaaaatgaatgtgtttgatgacccggccaaacttttgcgccttttgcgtcaggccgagagagggcaccaaaaggctgccgagcaaatgcgcacactcagaaaaatcgtgtgagtttgttttaccaaggcttcggggagaccgattcacctgaccgcctatccctctttattttcatatttatttcttagccgccataatttcaatgagacatgattaggccaattttgaatttataaacgcaaaaaatatatactataatttaaaaatttcctttaattttcttataaaaaattatttaacatttagtgaagcggaagttgctgtcgataagggcgtttcgtttcgggaagaagtggttgcaacaaacgcactggacctgtatctgttgaatgtgttaaacaaaacggggaacggatgcctctgcaacggcacgtctatttttatccaacaggtgggtttttatatgtcatttttaaatgctttcataatagcaactggcatttttactgggaaaaatcatttttacaaattaaacagggactaacgagcagtttcatcggcggatctctcggaatgcaaataatgtgtagttcgttaaccgcgtcaccaatcaccccggcggaatgcagcacgatggttaacacagtatttcaaggagctgttttgattgcattggaattgagttcggcagacgtcttctgtaatttggtagacaaaaaatggtaagcaacaataactttttagtttgtacttatttcacaattgccataatcacttcaattattcaattaaacatttttccagtaatacgatgacatacaacaatactagcccgatcagttgcgcctattgtcggctaattcacgccaaagcaaaaaaggtaaattaaataaagcaaataaaaaagcatatctcaaagaatatatgcgagaaaaattaaatgaaacgtttttcattcatgctccatttcaacccaggtggcagagcatttcgattcgatgttctccggactgaaagtgatgtgctcccgtttggaaaaacagacgttaaacgaaagctgcaaaagccaagtcaagctacttacaaggaagattaaacaaatcatcgaagcttttttggatgtggatgaggccgaattgaggtgcctgcacatattcatgtgcaaggaataaaatggcgaatgcaagttaccaatttcttacaaatgaatttttgatttactgttgcaatcaacataatttgtaccatcggaaataaacggagaaccatttgaagaaattgtaaagtcaagcaatgaaatagttaagctcatttttttgactgacagaattgcaattttcttaataatttctcgcaataatttctcttaaacgggaa

SEQ ID NO: 10463 - DNA, 3257 bp, Heterodera glycines
gaaaaatgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagggaacgtgtcattgaacacgcatcatgcactttcacgactgcgcaacaaaattacagccaaatcgaaaaagaggctttaggattggtgtttgcggtacaaaaattccaccgcatgctatacggcagaagattcactctgctgactgatcacaagcccctactggcaatcttcggatcaacaaaaggcatcccaatttattcagccagccgacttcaacgctgggcgttaattttgtcaaattacgaatttgatattaaatacgtcaacacaaaggcattcggaaatgccgacgtactttcgaggctcatcgcaaattatccgaggccatcggaagacattctcatcgcaaacatctgcaatgacactgattgctgtgttaattttgtttttgaggccaaaattgagcaacttccgatcaccgcaaaaataatagcggaggaatcagcaaaagacgaaattctacaacaaatcagtgccttcaccaaacaaggatggccgcaaaaattggacgacattaaattgtctccttttcttccaaaaaaggcacaaatatccgaaatcgaaggatgtctcgcctacggtgaacgaattatcatcccttcgtcactccggaacaacatcctcaaatcattgcattttgcacatcccggcattgtgcgaatgaaagccattgccaggaaccacgtttactggcccggaatcgactccgaaatcgaacgagtggtcaaacaatgcgaggaatgccactcagcggccaaaaatcctacaaaagcgacccttcagccatggaaggcagcaaacggagtttttgagcggattcacattgatttcgccggcccgtgcgctgacggccaaacatacctggtattggtcgacgcctactcaaaatggccagaagtatggcaaatggaaagaacatccagccaactcaccatttcaatgctcaaatcattcgtgcatcggcttggaattcccaaagaaattgtctccgacaatggaagccaatttcgatccgccgaatttgcacaattctgcaaagaattcgacataaaacacaccttcacgccgccgttccacccaatgtcgaatggggccgctgaacggtttgtcgacatttttaaaaggtcaatgaaaaagtgccgtcaagaaggcaaagattggcttcaaaaagtgcttttggcgtatcgcacgacaccaaacacggcactcaacggtcattcgccagacgaacttttccttggccgacgcatgcgcacaagaatgacacttgtccatcccgaaaaacaaaaactccagccaacaaatttggaaaattttcaacaattccaagggcaatacatcaaaaagatggaaaatcaattcaacacaaaacatggagccaaatcaaccattttccaaaatgaggaaccaatttatttttggaatttgaaaaacaataaagccatttggctcccgggaaaaattatagagaaattcggcacatctccgacgtatcgcatcttggcaccgacgcttggccgagccattcatcgtcatgccaaccaaatcaggcgacgtttcccaattgaattggaggacaatgatcaagttgaagaaaatgatcagacacaggcacaaaatccgccgcactcgccgatcgcgcataaaccgcagacgaatcgccagcaaacgcccgccgctgagcccgtgcatttgcgccgatcaggaagagccaaacaagcacctcaacgactggacctggacccgtcaaagcctaaatacggcttaatccgatcatgaatcccaaatcgagggacattcgacttaaggagggaggtgttggatagggatcaaagatcactttcccatcattgttatcgactattctctctccccctttctctgtccaacactatttccattctctctctctctgcctatctcctccacatttctctgaccccacgtctttataagtgcgtccattccctcactcatggctctccgctccattcattcgcattggacatttttattattttattctcctccgtcgctgcactcctccgacctcatcaatttgtgcatttatttttattggtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcacttcaaaagcctgggcggctttcatcggacatcgacaaaaactgatcacctgggtggtgtaagttccgctgggtgcggtttctcatcgacaaaaactgatcacctgggtggtgtaaagtaccgctgggtgcggtttaatcaacaatcaaaatggacgcacaacaacttcagcaaattttggacgcggctctaaaaaaatcagcagaagtttttgccgccgcactcaacattcaaaatcaaaacctaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttagtcggaaaattaaacgaggaggaatacaaacggtatgttgacagcattgcaccaaaagccacagaacaattcaactggctcgaaaccgtggcaaatctgaaaaagatttttggtgagacgaggtcgctcttcctccgccgtttcgattgttttcaaattcgccaatgccaaaaccaagacctttcgagtctaggggcacaaatcaattcatcgtgtgaaaacgccgaaggtttggggaagaaagaagagctaaagtgcatgattctcatcatct

SEQ ID NO: 10464 - DNA, 1226 bp, Heterodera glycines
tgaagatcgttatgctgatcgggcaggtcctcaccctccctttaaagcctctttttatagtcaaaaatactgcggatgcccccctaaaagaaatgcttcgtttggcccacctttacagtaaccgattcgctgcccttttcagagataccgtaggcgaacactgtgccgtcgtcggagaagctttccagggtcactgcagttgtgccgtccttggaaagcgtgttcgggtccaggaacacttttcccgtactgttcagggatttagtttggtagagcactctttggtcttaagttggagaagcattttccaagggcacgaaagaggcgaaattaattaaaaagaatttaaggaccccaaattcgaaaacgaaaatttcggaacgtactttgtaagccgctgttgtgataataatagaataaaccgccacaaaattctggcgtgaagaatatttcgtagttccacattttagtaagcctaaaactcgaaaagaaaaaagctattaattaattcatcagcatcgacaatggcattgtccacaccagggatggcattccgaggtcccataaattttcggaaatcggaattccgtactatccttggtccacaccgtaattagaaatgtaaccaaatttaattaatttaaaaatctacgaatggtttagcttctggcgcactgtggtcgcattgagataaggctgtgaaatgttgttgatttcttcgacaaattgcttagtggcattcgctgttgcgttctccaagccgcggtagggatcggggacagagatctgacaaatgaggagtaggaaaagcaaacaatggcagaaaaatgtaacaacaataatgaatttgaacggttagatttaatcgaagacaaattatgaagcaattggtgccaagactgcggaggaaaagccacggaggatcgaattgattgggacaaaatcagattccactggtctgatcagtagaaaagtcaaggaggatcgaattgattgtggacagatttcacggccgatcagatttaaaagtgccgccctatcagtgggaagtgccaatgctaaacattcacttttttcacttctttgccactttgacttttgtaagtgtccgtgacattgcctcgtggcgcctgcggataaaactttgggtcgatcgtcctcatatttgggttaaactttccttctaccactgatgatttggtggacaattttcgctggtcgtgaaa

SEQ ID NO: 10465 - DNA, 2938 bp, Heterodera glycines
atttgccaagggcacgaaaggaggcgaaattaattaaccattatttaaggaccccaaattcgaaaatttcggaacgtactttgtaagccgctgttgtgataataatagaataaaccgccacaaaattctggcgtgaagaatatttcgtagttccacattttagtaagcctaaaactcgaaaagaaagctattaattaattcatcagcatcgacaatggcattgtccacaccagggatggtattccgaggccccataaattttcggaaatcggaattccgtactatccttggtccacaccgtaattagaaatgtaaccaaatttaattaatttaaaaatctacgaatggtttagcttctggcgcactgtggtcgcattgagataaggctgtgaaatgttgttgatttcttcgacaaattgcttagtggcattcgctgttgcgttctccaagccgcggtagggatcggggacagagatctgacaaatgaggagtaggaaaagcaaacaatggcagaaaaatgtaacaacaataatgaatttgaacggttagatttaatcgaagacaaattatgaagcaattggtgccaagactgcggaggaaaagccacggaggatcgaattgattgggacaaaatcagattccactggtctgatcagtagaaaagtcacggaggatcgaattgattgtggacagatttctcggccgatcagatttaaaagtgccgccctatcagtgggaagtgccaatgctaaacattcacttttttcacttctttgccactttgacttttgtaagtgtccgtgacattgcctcgtggcgcctgcggataaaactttgggtcgatcgtcctcatatttgggttaaactttccttctgccactgatgatttggtggacaattttcgctggtcgtgaaagtgtgccgccatttctgtatgattaaaataattaattaattggcaaaaatgagcattcattcaaccgttttccatttgcccatgttttgccaattcgatgccattgcccaatggatttgcatgcagctcttttaatgctgggattttgaccgcattctcgtgtacattcggcataacttggcattttgattttattaatagaatttttgatattttcaaataatttccaatattttttacatttttggtattggtacgttggttgaacatcggcggtgctttcacttgttgaggaggatggcaatcttattgctgaacccgtaatgaaggggctttgctaaatattatttttttcatgaaacaatgccaattaatttaattaattcttgcataatttagtcataatttaaactacgtttttgcccctccctggcccattaaaatcagaaatgatcgaataaatatgtttctaaatcatctctagccaaatgattaatgaagccatagtgccgaaaacaatttcagaccagagcgagtgccacagctgtcttttttaaaatattggacattaagccggtgccgttgtcctccgtttgacttggaacttcgccttctttgtcatcatcactctctgtatttaaattttaatttctttaaataaattatgtttaaaatatgcaccttttttccctttttgtggcttttgtgaaattgaatattttaataagacagcaaaaaagaggcataaaattagaaatttcattttcaatttagaaatggttatttctttttcaacattgccatttatgcagaaaatgaattgacgcgcgcaattagagttatgactatttcatgtgactttttacgttggcaaagccacccattgaaatgccgtggcaaaaaacaacgcaaataaaattatttttcatttcgtattgattaactttaaaaaatatattatattaaaataataataataataataatgaggtaaaagccgaatgttgctttacaacttttcatgccaactgaatgtgtcccctcgaagaagccgacatttagggccagtaaatttctgcgcagtgatgccaactgttagcttttaaaatgccatagtaaatcgccgccggtcgatgtttgtcattgctttggttctggcggcggtgctaagtgacgatatgatgtcgtatctgagatatgacatcatatcggagatacgacgggaattgaaataggcccctgggggagagaattcaattaatctttatttactatctatgaacgcggacatttcggacgatcatatatagtccaaaaaataaaataatactaaatgaattctctaaataattaatgattaataaataattttaaaaatctcaattttttcaattttattagtttttcttttgtacagtggcgggtcaacggctgggcgaaattaaattattttaagttttctctgcttctttatgattttttaaaattaaaaaaacttaatttttataagcttaattataacttggtttgctttgcctgtttatggtaaaggccgaaacacattttgaaataattgaaaattatttttatcacaagaactgtactgatatggccgctctcttttgttcaaattgcatttttcgcgaaacgccctttttgtgcggtaggggtcagttgcatctgagccaagcttaaaacatcataactttttagttgccgttcactcatcttttttcttttagtacataattagtatagtcttttttattttgctatcaattaatgaaagtttccgttacaaaaatggaaataatccaactaaaaatggatgactgttgtgtgatgagtgggtgtgcgtattattgcccatgtccccccccttcactttctctcccatatttccatttcctttgttccgctatttcttatccatccgcccatttcacaccctcccaaatgtatctcttctcccatccatcatcaatgtgttgtggtgttgctttgccatgcctctcttcctaa

SEQ ID NO: 10466 - DNA, 1175 bp, Heterodera glycines
atgccgttgaccgatggatttgcatgcagctcttttaatgctgggattttgaccgcattctcgtgtacattcggcataacttggcattttgattttattaatagaatttttgatattttcaaataatttccaatattttttacatttttggtattggtacgttggttgaacatcggcggtgctttcacttgttgaggaggatggcaatcttattgctgaacccgtaatgaaggggctttgctaaatattatttttttcatgaaacaatgccaattaatttaattaattcttgcataatttagtcataatttaaactacgtttttgcccctccctggcccattaaaatcagaaatgatcgaataaatatgtttctaaatcatctctagccaaatgattaatgaagccatagtgccgaaaacaatttcagaccagggcgagtgccacagctgtcttttttaaaatattggacattaagccggtgccgttgtcctccgtttgacttggaacttcgtcttctttgtcatcatcactctctgtatttaaattttaatttctttaaataaattatgtttaaaatatgcaccttttttccctttttgtggcttttgtgaaattgaatattttaataagacagcaaaaaagaggcataaaattagaaatttcattttcaatttagaaatggttatttctttttcaacattgccatttatgcagaaaatgaattgacgcgcgcaattagagttatgactatttcatgtgactttttacgttggcaaagccatccattgaaatgccgtggcaaaaaacaacgcaaataaaattatttttcatttcgtattgattaactttaaaaaatatattatattaaaataataataataataataataatgaggtaaaagccgaatgttgctttacaacttttcatgccaactgaatgcgtcccctcgaagaagccgacatttagggccagtaaatttctgcgcagtgatgccaactgttagcttttaaaatgccatagtaaatcgccgccggtcgatgtttgtcattgctttggttctggcggcggtgctaagtgacgatatgatgtcgtatctgagatatgacatcatatcggagatacgacgggaattgaaataggcccctgggggagagaattcaattaatctttatt

SEQ ID NO: 10467 - DNA, 4941 bp, Heterodera glycines
gaagagttgtgccaatgcgcgccattcctgctgatcagcgccttcctcatcagacgccatgccgacaaacagtgcaaacattggctcgttgtcctgatcatgcggacaactgaacagccagcggagtttgtcgctgctcagccacaaaaggaagcgagataaatctacactttattaatgaaaaaataatttaataaaaaagaaaatttgattagagaaaataataactgtatttgatgcctgagacctttttttcactctctaattaatctgttcgatcacttttccaatctcaaattatattctttcactcctcaaccactcactgtctgatcatttttcattcttaaattactgtcgatcagttttcaattttcatgtactttttgaattattcgatcactttcaccatccctaattatttcccgcgactttttcactctccaattacaatcacactgatttatttatttatttttttacccgaaatgctccggacccaaatggcagtgaaagcctgccatctgtgaagcacaaaaattggcatgatatggtcgcgcatcaactcaaatttatggttcagaaaatttcactgtctgattacttttgactctccaagcactgtctttggcgcgaagtcaaaaattaaaaaaggtaaaaatttgatcaaaaattttacaaaaaaagtgaaaaacttttaccttccaatgggtttttcctgttgcggttgttgaccccagtactggccattggacggcggtggcatcaaatagtaatgtccgggaaatgattgggcggggtaggacgggaaagcactgttcatttttaatttgttgaaacaacggctaataatcaagggcatattacacaaatgctgcgccagcatattgaaagcgaaagaaataaaagggtaacgaggggaaaaggagggaaaaggagtgaagaagggacaaatcacattgttcgcgcactgtaacggcggttttgtaccgtatctggtcggcttctcaccccttccggcgcagctgttaccgcctgttccgttccggccattactgaacaacagcaagtttgcctggcccctaggggcacacttggtgacccatagagtcacatccgcgcattcaatgctggcaaatgcttcaccccttgaggacgtacatgaatagttgaaccgtcctcccgtcctacagctatggaaccccaccaggcgacccggggtaatggtgcatttggacggggagtgctgtatggccaaatgggtgccctccatttttacaataagattaactggggagtaaggaaacgcacaccaaatcctccccttacggaaccaaaattgcagttggccaaatgagttagggagtcgtgcctgtgggtcattcatcactttttctaagtcatggtgtcggcactgacacttaacgactgccgattcgtggtgtacgttgcatgaatgacacacctcatgagacagagtgcagtttagctttttggctgcaaattcagaatcacagtggaggtgggagtgccattcggggaccaatgccgcatgtgaacggttagcaataaaatcgtttcccaaaattggtaagggtggcaaaccgctgggggtaaaggtgacagacaacttagctaacggccaatggtgggtaatccctggagacatagttatttcttcggcttttgtggacccattaagctgcaaaataatcccgagtctcaattggaattgccaaacagggcacttgtacagctcataggggtagggggaaagaggcgccgcaaacaatctgtaaaataagcacgcataagaaggcgaaagacatccctggcggataaaaccggatgcttccttgcaaaaattgacccctggaaaagcatcacttaaatctggtactgattgatagggctctaaatcagaacaaaaggagcccgtacaagaccctgctgcaggacaacgcagcactccactaccgtgttttgggcatgaggggagaggaaatccacggtagggagtggcaaggggccgtccgctaagtcagagacaaaggtaaatggaccgattatttaaatggcttcaatttcacaagtcagagtgtacaaaacggtttggattgtttgcatccattcggggcgagattggacgggaaaactcctcgggaccggcgacttccgaccgattgggtgggtccgctccccctattaagttccgatggcgtatgacaacctcgccttcattgtccgaagttgaagttatttcccttataattggccctcgactccattggaccctcggttcccggttgtgtccccgtctattactccgacaaaaatttgggcatcctctccactgatagtgcacaccatgtcggcgcagccaacacaacaaacaaagacaaataaccaatgccgccccaattgagccggcaagtgtgccgaccgcaaaggcaagaaggaacggggagcaatggggattaaggactctttcccaacacaaatagcatttgatgaggctacacccctccacgggctcgcactgaatttgtgatgagattttttcccctgcaattgaataggagatgtggcactcaaaagcgcttgccaacaggtccgggggaaggggcagtagatagggtgaagggtttcccctactgctgcatatgccctcacagcacactatgctattctccgcctgtgggttcaaaaatacccaaattccctgttcgtcgcaggagagagcccgggtggcagcatccgtaccacaaaaaagggttaaaaaaaatgttcctgtgcaccggaacgagccgccggctcaattattcccctttgcaaatgctccgtgattatagcctgatatcgttcccggaattctgaattgacccgcaatttgtgagacaaagccactaggcgggaaaaaaagacaggtaccggcatcggagagggtccattagggttaaaaacaggaatttttttgattttttgaaaaaaataaaaaataaaaaaagtcgtgtagaacactttcccctggaggtttagagaccggctatcacgaatctgacatccatttatattaaaaaccgaatcccgaacccgaatttgaacaaaaagttgaaaattcaaatttttaaaattttttattattgctctaaaattgattaaaactggataaaaattaatcacaaatcaatgaaacatcaaaactggtcattctgtacagattctaacataaaattaaatttttaaaaatttaaatttcgactttttgttcgaattcaggtccgagttcggaatagtcttgaaaccattcgctagctctaaaaattctctattagcctaaaaatttcaacaaattttgtttaatttgaacaaagttatagacaaaagtacacaagcaagcaggttagttgattttgggcaaatatgaataattttttattaaaaaattttttataattctgttattgatgatttttatataagtttaagcatcgatttaacagccaatttacgttgcaaattttcactgttgaaattgtttaattgacttccaagggaaataactaacaaaagtgaagaatttggagaaaggagaattttttctttgtttttaaattaaaatttttttttattttatggcaaaatgttacatatcaaaattttttaaaaaaattattatgttacaaaaaatatgaattgataaaaatcaattctaatcaccgagggtcatatgagaagggggtctggggttcgagtccgcttggctgcggtttattttttcatgacacttgatgacaaatcatagactaaatgaaggtcatgcataatcaaagctcagatttgtcaccagtgtattttttaacaccaaattcattacttttttaaaaataatttaaaaaataaaaaaaatcaagtagttgatgaaaagtcatggacaaaaatcaatgatttttaaaatctgagtagttcagattcgtgatcagcgcattttttagcatagaaaaaatacatgaaaaatttttaacatttttttgtcgggacaccaattcttgaccattgcccacttcccgacattttgctcctcaagggttaggggagcaaccttgtaatggtcgaattgtgtagaaatatgtcaaaaccaaaattcgtctttgtttgtaaaacataacttttcttgatcatgtaaatggaatttgtagaaaacaattaaggcagtctcgtccgaaagtctcacttttaattccctttcaacaggtggaggaaattgtaaaggccgcagaaaataccaatgataattgtcgtgagtgcgacagtcaatccgccaagtgcatacacaaaggataaattcactccatatagatccgccttgactttgttttccaaagcaatttcctgagcaaagaaaagaaatttttattgttaagttttaaaaagggagcagctcattcccccccccctccccccgcatcgtttccccttgagaattttttaaaatttactatcatagaatttaaaaaaaaaatttaaaaaatttttttataataaatattagaagaaattgccaataaatttctgcgaatatgcgaggggaaatggaaatgaaatacacccgtttaaaactccctacatactcgaaagtcgaaatcggcagaagaaacagtagtaacacaacaaaacaggatgaaaaaaagagcaacttaaaaggaaaaacaaacttgttcataacttttggtacattgtaaatcattgtgcacaaactttgtcaacacgcaaagtataagttgaagcggaaaagcgatgaataggagatgaagcgggtggaaaaactgagtcgggcgcaagcgcggaaaggtgtgccaaaaacggatgcccgcgccgtaaagaaggaagcaagcggaacaatgcgcggaaatgcgagagcggacgcaccgcggacgacag

SEQ ID NO: 10468 - DNA, 809 bp, Heterodera glycines
ggaggtgggcgatggaagcggagcagaagcagcagcatttgttgtggaacctgtcactgttcgatgagtggggaggtccctcccccgccccctttttttgttgctttttctccccgccattggctaaggaatgttgcgtgcttactgctgctttgcttcatcttctgccgccggttgcttcttgcgactcattttttgtgtgtctgtaatttatgcacagacagcggcgtatatttgagggggggggggggggggggggggacggacggcgcccgaggggcggggggggggagggacgaggggccggttgcctaatgaatgaaggggggactcatgccgaacacttatgaccatttatatacgggggattctgtctgattgcttatcaaacatttgttggattaacaaatgaaaaacttacttacgagggtttttcgctctttgttaatttattttgcattggttttgatgcttttcgccctttgcccattttgttatggacaaagggatttacaaatatattactttttaaaaattattattaaataaattttccaaatttattttcctttaaatccgacaaaattttttaaatatttatctcttagaaaacaatcacatttttggcagatcagcgttaattgatattcataatgaaggggaaatcggaggccagggaggcggcctatcgttttggggaaataaataaatcaaaataaataattatttaaataatattttacattaaaatacaattgattcctcctaaaaaggtatgcacagcagggactttctcattggctgccatt

SEQ ID NO: 10469 - DNA, 4375 bp, Heterodera glycines
  misc_feature (4356)..(4356): n is a, c, g, or t
atgtgttcagctctccgtcaaagaggtgatgttggagatgagtgagctgcaaagcgccgaggggacagcagaagctgaacagtcgacaacctttggcgagctgcactccctcctgcagctgccggagattgacggcacaagcggcacatcgaatggcactcgtttccgacgtcaggcgccgttgccgggccgggcgcaatgcgaaggtgggggggggatttatttaaaataagaatttaaaaattgtattttaaatgttttaggttgttgcatcccgggactgcccggcccgccgggcccaccgggccgcagcggagtgcccggccgtccgggagctcccggggctcccggatttcctggacgccctccagcgtaaaacagccatctgatggcttggaaaagctgcctgctcatttccgccccatttagcatttgcgaagaagtgacccctccgccgtgcattccgtgccctccgggccaacccggccctccggggtcgcccggcgaagtgggcagcccgggcccggttggccatcccggacgacccggcaatgatggaccaccgggtgaacaaataaaatatacccaacaaattttactccatttgcgttcaggcccccagggacccccgggcattcagggcgaacacggcgacatcggccgagagggaacgcggggggagccgggccgaccagcgatttcgacacccgccctccccggcgactcgggcccatccggggaaccggtgagtgtgccaaagaaatgatcccctcccaaccccaaattgcagggccctcccggcttccccggtgaaattggcgagcccggccgtcccggcagcgaagggctgcccggaccgcagggaccgtccggcgccccgggtcctcccggaccgccgggccgacccggcgaagacggcacgacggggcaccaggtggagccaaatgggagacaaatcgggcaaaagtgtgtttagggaccaccgggagaacggggaatatgcccaaaatattgcgcattggacggcggcgtcttcttcgaggatgggacgagacgatgagggaaaacggaggaagaaaaagtttttgaaaaagaaattgcaatttttgggcaatgacccagaatttatttgtaaaaacttgtaatatacagaataaaatttatataaaatataagccagggaatatttagaatcatattcaaaaaagttcgataattaatcgctaaatttaaaatattgttttgttatttttaaaatttcgtcattaaacaaaaacggaacaataacaaaagggaaacaaacaaattgacatcacacatcacaaaaatggtcagagggaagcgtcaaacagtatccactggttactgtaccatcgcattcatttactgtctgttctacccctcttcctcctcccgcatttcgacatcgtccagctccaaatcgtccaacatttccgcgagtgtcggcgctccgtcaatgtgctcctcctccccgccttcgctaagtgctgaatcagccgcggcggatgccattcgctgtcggtggtgccgttgttgggctgctgttcggtttgcactcgtcgccgtctgtttcaccgactgctttccgcctcccttcttgtaaatgttgatccgttcgcgcaatgccggatcctcctcaatgtcgtccatgaattccttaaataatgtaataatttttttaaataaattcctaaaattccattgttccctttaccaataaaatttttgcaaaaattccgggtctatcgttccggctaacaaaacaataagcggttggttcaaattcaaactgtgctcacattgaactccctctccacgctggcagtctcttcctggtcgagcagtctcttcagtcgccactgtctcttgcgcagtcggcgactccgatcgtacgcttttctgatcaaaacctaaacaagcgaaaaacataaatacaaatagaaatgacgaatcagcattaagtaaaactgactgaccacatccggcacattttcctctttcaccgcgtcaaatgtccgattgttcaaattcgtctgacaaacattgtaacccgaaaaaggaaaaacaataagaaaattatttcgttggaaatcaaggaacgagtagactttagagacccatttgaaaataaagccgaaaaaactaaatctaaagccagggaatattttttgcattatgcacccaaaacggtgtcgccggcattgagcagatggccaagatgagaacggcaacaaacggatttggcatcggaatgtccgacttggtcactgtagtaggtagaaatatgcattaaaaagtacaggaaaattaaaaaaattgaatcgaatgagattcaaattggggggggggcgggaggcgcacctgcgcaccacccaaacatcggccagtcggtgctttgtggacacggacccatgaccgtgtgggagaacggcgtaagggtcgtcgacctcctccacgtcgaccacaaaaaactcgacaagcgatttaggatgaaccaaaatgtcgaaagggttcttccaataggtggtactgaaattggaaacaaaaaacggtataaacgaaaaaagggataaattatatttaaaaaaccacttacgcgttgagctcgtacaattgcaatgtttgcgggttgatcagtgagacaacgtcggtgacgcgaagacagaggacgaattggccaatgtttgcgaaggattgggccaaagtgcgcggcagacaaatgagcgcgtccttcgtgatcggcacaatgtccacacagaaagtgtgcttgtaatcgtagaaattgctgcgcacgtcatgcgtaaccaattgctgtaaaattggggggagacaataaaacaaatgcaaaacccaaagccaaacagaacggtgtttgaagttactcaaaaaaccatcaaaataaaaattttgctaaaaaactcgagcatatttttaattattttgacccattcgaagccctaaaaattctctattacctgccaatttaaaaaaaatttccaagaagttcttacaattagggcaacccaattatatcaagaatcaaattttgatttatttagcaacgttaatttttgtcaaaaattcaccattttattgttttttgagtaacgtcctttttagactcagcatcaacagaacctgggactgatggaatttggaaggcaaggccgagctgatgaaatccaccaatttgcgtgcctcttgctgccgggcgaagaaaaagtcgatgccggtgggcaccggctttatgccacttgcctgggcctaaagaaagtttaaagtctaatataaaaaagtgatagcccaattctttcgttcaaattcctaacccaaaaatcctaatggaattttctgcgtaaaattgtgttaaaagagtcggttttaataagcggtcaccttttttatgaaatttatataaattgttttacttttctatgccatccctaacctaataatgttttaaaaatgcgcgacctgcgcattgtgtttgattaacaattgctccaaatagaaaagtgtctttttgtagtcgcatctctgccgcacctgcacacacgcgcgccaatagtctttggcctcgaaacggcggcagtcatcgcacatctcaaattttttttggggggggggggaaattattcatttccctaattagtgcctaatacattattcccactcgtaaaataatgtcgaaaaagcaatgcaaaacctggttgagaagcacaaattcgacgaccatcgactgctgcagcacggcacgggagaacacctccttttggatggtcagcttcactttgacacgttttgagtgcggttcggtccacacaaacgcagcgtccaccagccgcactttggccatcgccggcttcagacgggccaagcaaagagccatcaactccttggactcgggctttgccgcattccatgcgttgggaggcacgaaaaaccgttcgcagttgcggcacgattgaagctgagctaaaaaggggggggggggttggagagcattagatttttaagaaaaagtaaagagaatggacattgcttgggaatcccttcggtgatgtcagccctcgcgcgaacacagcccaagcacatgttggccgggttcggcgctatcggagtgccacagtcacagcaggcaattgtaccctcggagaaagtgccaggttgaatttccagctgctccataatgagaatatgaatttgcagttttgatgcctaaaaaatgctattttgaagatatgattttcagaaaaaattttgttcgttttcccgggcaaccgttacaaaataagcgaaaaatgcagagcgagcggcttatttttttgttcaaanttattcgttggcatagtgt

SEQ ID NO: 10470 - DNA, 4001 bp, Heterodera glycines
cgtcatgtgcaccggtgacccgtcgatggtcctcagaatcgcacgcactgtgcaagctgttctcgttgacttggacgtggtccaactgaaaccgcaaaaaagttttttggcgatttgaatttaaattctcaaaaaacaaaaacgcacgtgcaaaagtctcagctttttcagctccaagtccttcaccgccaattggtaaaagtccatcactttcggcccctgcgactttttgccgtcgtccgattcgctgtccgtttggccattcgttgccccgccgcccgtggcggtcgccgcggttggcagtcgtttggccacccaaaccatcacatggaagtcatggtaaatgatcgggattttgtccttggtcaaatggacgtcaaactcgacgaggtcggcaccgtttttgtacgccgagctcagcgagtgcagcgtattttccctcgcgaccgcacatctgatgaaatattgcgggtttttggaggttcgggacagagttggggacggatggtcgacgacttttaagggaagagagtggggagggagagaatgtaaggaaaacttggatttctcaggcaaaggttcggggacaccctacaatccggccaccctcactttgtgtacgagttgcccatgccgcggtggcccacttccaaagtgctgcgcttcttccaatgtttggcgtaacagttgtgcatggtcgggttggggtggggcagtcgaagcggacggatgaacaaataagagactgaggaagagcaaagggaatagataaagcacacatggacagatggaaaagcacgcacagtaaactttgccgacggggacacccaatttggtcaggagagggaccgaagtgcggccgaaagtgtcgtggagcgtggagggaagggcgtagcccagggccaccagcttatccgacttggccaagtacacttcgaggcggaaactctgccaattcaaaggaattttcaattaacccaatgcatcattaatgagttattagcaaaacgtgccaaaaattcgacggccaccgactgagtcctgaacatgaagtagtccactttgttgtgaaaaggctctccaaactcttcttggtcgcgaaatttgggcgcgtccaatgagagagactgaaatgtgcggagaaatgagttaggaaaattaatatttgggcaaattaagaaaaatggatgaaaaagacaccaacagaaataagggaagtgggacaaaaggaaggaagggaaaagtttaatcggaatttaccaaaaaaaacgaagggggtaattaggtaaaactaattagctaataataaaaaaagcaaatgggcacaataactgcagaaacaaattattgctagagcctcatttgattcgattaggacaaacaaataatagtaaaggctatcaattaaatagcaattagtgatcaaacaatctaatgttaagcctaattaggttaattgcctagggaccaggcccaaaaagtcctcgagccaacaatacaattggctgccaacaacaacagacagcgcccggcacaacaaaaacggacggccgttggattcgctcactgaacagtgcctggagcgagtgaatggatgagagaaaacgaagaagaaaaggacggaacggaggcaaaagtctcgattttgaagcggtaattataaaagggcacaaaaagcaaaggaagggacggaggacgaaaatggcacaatgttcctcaaagattttgctcaaagcaaaatttattttattttttgaattcaaaagcaccgaagggaatgaatttgccagaaattcttggttttttgtcaaaattgagacttgacaagcgaaaaaattggcatggaaatgacgagagaaagcagaaagagacgaatttaaagaagacaaagcgcaaatgttcacctttcttcaattgcgaagtgcaacagtgccgtttcttcatctcttctcacatccctccgatttgttgtgtttcgtacggttagtgaattgaagaaatggccaaaaggccaaaaaacgccggagggaaaatgcaaaaagagaaagagggaaagatgtggagagagacaaccaaacggaggacactcaacgattgtcagacgaaaaaggcaatggggagagagcggagcgaccggacgacaaagacaagttcgggaggaaagtgaccgagacggaggaacaaagtcagcttgagagtcccggtcgacgggactggcgagtaatttgatcttacggcaatctcagtcggagaatggctcggcaaagccggatgggtcagcggcggcaattcgtccatggcagtcacggtcggctcttcgtcatcctcggcattggaagcgtcctgaaaaatatcccccatatccaaacgaatttcccccgaggcaaaatttaggcaaaaatggtcgtaaatagaattttggcacgaaaaaagcctgctgaaaccaattttggaagttgccaaatgaccctcctcccctctctattttcgatcatttcgtcccaatttgattttgtgccctttccaatcgctcacatttctgttccttcgcaagtcaaacggcaccattttgagcctgtactcctccctgatgtgcttctgcttgtagaatttgagtgcctcgccggaaacggtcatcaaaatttggtgcatttcgtccgtcagcacccatccgtcgctaaagaattcgcgtccgccgctgaagccgaaaatgtcgcgcaaattggcacggcaaatgcccgcagtgctcgcctctaccggtggcatcacacagcgctaaaaagacggcaacaaatgattaattcgatatgttttgtcttggctgaaaattacgggcgtcgaatgcgtctcccatttggagacggccaaaacggggcctttgtcctcctccgactgcaagtaatagccgatgaagtaacggaatttgagcacgtccgcgccaaggttcacaaggccaacccaacggctgaaagacaaactttgaaaattcactaagaaaatccctcagtttgaaaatctcgacgagttcattaattaattaattaattacccattctctcttttgtccaatttcaatgctttccccgtctcccaatttccgaggtgctcatgggaacccgtgacaaaaacaaattggtcgtcatggagagcaaaaggaacggagacatcgaagctgggagagacaaaacgccaaaaagtaaataaacgcaaattcaaataataaaaactcactggacagtgaacatcagctgaattctctcaattggaaataagtgttgtttgttttctttgttggaattaataatgtttatttgggtctaaaaataataattctctgaagcgaaatagcggcgaatgtttgggttagattcaaagtttcaatgcaaatcatttttgtttgtgcaaaaatttgccataaagaaaagatggaaaaaggtttttggatagtagcggcatcccctttgaactttcgctgaaacaaatgttaagctaagacgaaacataaaaaatgtctatcgataaatgaatgaatgaattaattaattaatctacggaggaagaagagagggacatttatgaggcacatttatcaaatgaaagtgggcgtatccattagggattaaattagtgcaaataaagcaaaaaaaaagggggggggtgcactttaaatgatttgatggaatgatcaaaggtctctccatcaaaatcagtgcaaacaaagcaaaaattggaggatgagaagagaaaaactctgaatatgcaatggaagtgaaattaaagataccgtatttgctctaattatagcccatgggggattatttttcaacctcctcagaatagaggggataattagagactgcgaaattaatagagactgggggattatttttcgaactcctcagaaagggggggataattggagactgcgaaattaatagagactgggctataattagagcaaatacggtaagcggagttgaagaagagcagctcaattaaaa

SEQ ID NO: 10471 - DNA, 5944 bp, Heterodera glycines
  misc_feature (43)..(44): n is a, c, g, or t
cagcagaaagcaccagtcagcgatgaaaatcaccgtcttgccnncctccctctctgttccgccaatctgcatttctccactgcacatccatcgcttcatctctgctcccccactgcttgaccttccgctgtcccatctgccgtctcattcgcccccactccctctccatcgcacatcattcgcatcatctccgcctgaccccaccgcttggacaatgccattgaagaacgacggacggaagacatttcacatcgtttaaactgttgcgacccttcgatccgccccctcccccaccgatggacgattttcttttccccttttcattctattaattttgcttcgctcatctcaactgacaataaaatttgctccgtcaaattgtcaaacaaggggaaaaagtcggctttttctaatcctgaataaacatcagattcggggttccctttctaaattaaatcccggaagggaatcgtcttttagaaaagggcctaaaaactgtaagcagggaattcccaacgctgggaccaagaacggtaccgtaagacacttggtatggtaaaagtgatttggatcacttgtgatttccattcaccgattgctgtttagcgcattgtcccctcacatcaagcactggtgcttgaaatccccggttaatcatttgatcggtcctttgcccgatcagtctcgctccatcgtttggcatttttgtccactgtgttatttatttccaaaataattgttttctcccccttttgttgctctccattcttcactccgctgatcgccgcttggacctttctctgctgaccaattgatcacacttggaccgttcttcgttgaccaactgatcaccacttggacctctcttcgcctctgtccgagcatcaccaggtccggtgttcaccaatcgctgtcgccaactgatcgctgcacacacaagtcgaggaccaattgacgccgttggatcaggtcaagcacagccaactggccaattagccggttatttaaccggctatccctcgcgtgtcaattagtcgattgtttaatcggctaacaatctggtctcaaactcctactcccaacggcctattcattcacagttgcgcaggcaaccgccgcttaagtccaattctaagcggtttgcgttaacgctaaaaatattagaaaatagagataattctaataaaaataaaattgaaatgaataaaaaaaaatgtgaacagaaaaaagtattgtatgattcttcaaggaaaaagaatggacagtttaaatgacttgaaatttgaaaatacgaaatgataatatttaaaatataatttaaaagcagcaaatgatttataaaatacgaaataatgaataaattacaataaaattatataaatttttctttcaaaaatttaaatcttttttagaaattctttttcttctaaaaatttttataaaaatttgacaggcttcttactaaaaccaaaatttaaattaaaataaaagatatattaaaaaatgttaatcagttcttaagctctatagaataatgagagtgcaatagaagaatttaaaaattattaaaaatttaaatacaaaataaatagtaattatttgacaagaaccgagttcgaaagtttaaacaaataaattttatacaattaagtattttaattgtaggcagtacgataccgcgatgcgatcctgagtgaatagcttatgaaaatttattaggcaaaaataaaattacaataaaggatagaataataatatgcatgatgataaatagagcaatttattaataaatattttactttgaatccaaacttatttattaaataaaatataatctttaaataaacttttctactcaattaattttattaattaatttaattaatttttatcaaaatggcattggtttatttttttaattaagaaatacacttaaataataatgcttcaatttaaacagcaaaaatttagagttataaaaataaagaaaatattttaaatagcctaaaacggaattgcatattatttacaaacaaattattaaaaaaatctttatatctggtaatctacttaataatggtttaaaatttaataaatagttagaaatataaaaaatcatgaaaattcttcattagtttttgaaatttctattcaattaattttaccaattaactcaattaatattttataaaaatggaatttttattttttttttattaaaaaacctaaagaaaatacattttaataataatgattaagtttagttcattacaagcaaaactcagttggtaaatttaattgtttaaattaaatttaattataattcataataaaaataagaaacgacctagcacccatcgcgacaagcaattttaatatattaaaaataaggacatataaataaaaattagtcagttaaaaattaaaagaaaattattaggtaaaattttataatttttcgttaataaatgtattatggaatttaatcctcaattttttatgaaaatttgaaagtaaagtttttaaaacaatatgtaaaaatgaatttttgaaaaaacctacttatttaattatttattaattagacataatattattttgaatttaaaggaaccaagcaagtttatgtgcggatattaattaaataattcagcacttaatgaattgaaaagcaaatatttattaatgaaagtcaaaatattatcttatcaaataaaactgcataatgaactcaataaaatatatttatttcagttatgtaaatgtttataatttttcaatacattaaacagcaataaatattatttaaaaattaaatagaaaaatgtacatttatttttcataaatttttaatattgaattaaaagatattctttataaatttaataaaataaataaattgatttaaataaatgcatttttaacagcactaatttctattaataaataattgtattaaagtttaaaaggattcttggcagcgtaccaaaaagtaaaacccgtgcaagaaaaaaagcaatagttaattattaatcaaagcccataacaagaaataaattagattaatcgaagccttatagaaaaacgaataaataaaaaaatattattttaaataaactaaaatcgaggctgtcaatatcattatttttcagttaatttatttaaataaataaataaacttaatatataaagaataaaactttactgataaatgttatccaaaagtagccgtgcaatttaaaatcaaaaatttgacgtaattagcggattttatttaatcaatttttttagtaattataaaagtaaaaatttttgaatttaataactacaattattcccacccacaaaataaaacaattaaatatatttctttacttttaaaacaaagccaaattgcattcaaattattttaaaaaatttcccccggcggcgcctagcggcattgccagccccaaaaaacgcacatttttttctaaaaaaacagattaaaaatgactaaaaatatatattattatattatttctggccaagaaaaatccaaaacatattctaactaattttacattttgataaatgttacaataaattgtgattaaagaataaatgaaatagagacaatttatgtaattttaacaacatttcatttacaatattaattaagttgaaaagtaaaatttacaaatagtttttactgttcacaaaaaaaaattaaataaaaaatctaggtatccgaagcaatgcttcaaagcaaaatttttttaataaaattttcagacaaatattacttggctgaataaatttaaataattcacaattaaaaatttttaattcaaaaatttgagaaaaaataataaaaattgtttaacatctaaatttttattaaagagatttatttaaaataaataagtacaaattttaatttatcagcaaaaaatacaacgataaatacacaataaaatgaaacaataatatgtactgaaataatgaattaattttttaattaatttcaaattacattagatataatttatttatttaattaaacaaactgatgacaataaatttttatattcaagcatattattcaaatagtattataatttggtatgctcttataagttaactaaaaaagattattgattacaaataataaaaaaccaataaacaaaaacagatatatcaacacatttctaattaaccaatattttcgtaaagttacttaaaagattgaagtgttaaatccaaaaagttacagttttaatcttttcttcaacatttatcttaaaaatattatttaattattatttattgtatttacgttacacagatgagaaataaacttaaaatctataattagaaaagtaaatgaatacaaataaattaaactatctttgccaaagattgcaaaattaaatacatgaaatgaattaatagatgattcataagaacatcaaaaaatgataaacaccaaaaaataaaataaaaataattttatataaaaatccaaatatgggataacctaattagctacagtcatggtcatatgtttagactcacttagtgcttttttattgaatgcatgataaaagcttaatttttggccaaacggctaacatgtttagtgttttttgtagcattttatgtgggctttccaatgatatcactacatcccaattgcttcgcataattaataattacaaaataaaagtcaacttcacccccaattttgggtggtcatatgtttagactcactctttagttcttcaataaaatcaatattttgtaggccaaaaattctgaaaaaattcctgctaagctagcttttgatgctgatcaaaaaagtctcttacagcaacttgatcagatcactccttcatagtgatcggcacaccacaaaatacagtgaaaatcggggaaattttcgaaaaaaattcctagggggttgtgaaaatttttttggaaaattttatcaagcccattagaaagaacagtgaattctctaccggtttgccttttgaatggtgactttacgacttacacccgctgagatatgggcaatccaatttcagtgtctacaaaaagtactgtatttcgtaagtaaatagtgcattttacagtaaaatgatcatgactgaaattgaagtggccataccatagcgattttaagtcgtagagattttcggttttttacatattttagaaaattttgtcccctttctaatgggcttgataaaattttccaaaaaaattttcacaaccccctaggaatttttttcgaaaatttccccgattttcactgtattttgtggtgtgccgatcactatgaaggagtgatctgatcaagttgctgtaagagacttttttgatcagcatcaaaagctagcttagcaggaattttttcagaatttttggcctacaaaatattgattttattgaagaactaaagagtgagtctaaacatatgaccacccaaaattgggggtgaagttgacttttattttgtaattattaattatgcgaagcaattgggatgtagtgatatcattggaaagcccacataaaatgctacaaaaaacactaaacatgttagccgtttggccaaaaattaagcttttatcatgcattcaataaaaaagcactaagtgagtctaaacatatgaccatgactgtatttaagcaattgctttttaatttttccccttacatggaaacatattaaactgtgagttttgcattacaggcaagtactcatgctaaaatgaccacacttaaacgaacgcagaccgtccgtaacgggacccgaaaaatatgtaattaccgtccaggtctcataattttttgacacttgcggaagaatttgtcgatggaaatttttattgcaatttcttagactattcaacacggaatgggagcccgttgaacagagcaataaaatgactaaatt

SEQ ID NO: 10472 - DNA, 892 bp, Heterodera glycines
attttaatgtaggaaattatttatttatgaaatattcaaaatggaaaattcgctaattaaattattatactaattttttaattaattaattaggatactaattttaataattgaggcaatcacaataaaatattttattaaaattaaaaaattaacaatgaagagattctctttttcattcaattatcacattaagcgcaatgttgctttgatcagcagcataaacaattgggttattgtttatcatccggatttgaaacagaccgtaagtaattagggatgccatgccagttttcaattagacttaattagggatgccacttttcaattcgacttaattggggatgccacttttcaattcgacttaattaagggtgccacttttcaattcgacctaattagggataccacttttcaattcgatctaattagggataccacttttcaattcgatctaattagggatgccacttttcaattcgacttaattagggatgccacttttcaattcgacttaattaagggtgccacttttcaattcgacctaattagggataccacttttcaattcgatctaattagggataccacttttcaattcgacttaattggggatgccacttttcaattcgacttaattaagggtgccacttttcaattcgacctaattagggataccacttttcaattcgacctaattagggataccacttttcagttcgatctaattagggataccacttttcaattcgatctaattaggggtactcattcagtttgtatccgccttttgggtcaaatttttcagaagcgtagccagacagtcagacagtgcacttatttccttctttataatgtcacctcttcccttttcccacacacaatgctgcca

SEQ ID NO: 10473 - DNA, 4186 bp, Heterodera glycines
  misc_feature (2342)..(2342): n is a, c, g, or t
tagtcaaattacggatcaaaattgcggataaatccaaaaatccgcaacccgcaatccgcaattacgggggtccaaaaaccccgcaatttccgtaatccgcaatccgcaattgcgtccagccctgatacaaactgaatgagtaccctaaattagggataccacttttcaattcgacttaattagggatgccacttttcaattcgaatttattttagattagccctttgtgaaaattttttagtctaatttaaaaaaagttcatacaataaattttttacaaaaattgccaaaataaaaaatgaccttcatgtttaacgaattttataaaatgtttttatttaatatattaatttgaaggtacacaaaaatattcccagagaaaaatatgcagaaatttggaagttagtggaaaatccaattgtgattttacatgatggttttattcatttcaacagtgtgcaattggtaaaaatatttataaatttagtaaaataaaattttcaaagtaattataaaaaatttcaatcattgttaaagcaacttgacgaagaggtgaggttcacatgccaacttttgggtgctgaattggcattgccaaagaaagaggtatttttttacagaatgcagttgaatggcaggcagtactgcccttaaaaaattgcaaattttaacattttttgcccttatatctgataaaatactttaaattatccaattaaaaaattggtgaaatagtcaaaaattgggcattttattaaaaaattaattgaaaaatttgaaggatcggaagtcggaaggggttggaaattcagacatgtctaagacaaaatccagggtatttagaacggaaatttcgtcttaaaaatattgctgaatcataattataccataatctcatgcgtttatggcttattacagttgtacgatgcgattgaaaaagtactgtacgggctcattaagcaaaatgatgatgtgcagcagtcgttgagcgcctccataacactttttcacacattttgtcttaattatgaacggcgaaaagctgcgctggaaaccattgacaaatatgtgaggaatctcattgagcaaccaaatgagcaaaaattcttgaaaattcggatgagcaacaaagtgtttgaagtgagaaagcaaaaaaaaaaaaaattaaaattaatttttatttaaattttattgcattttgcgccgcaaatggaaaagagtagtagagaagtttgaaaaattgttaaaaaaccaagagggaggagaaccttttagttttccaaaatctaacccgaacgcactaggctttttctcgagtttgagttatgatggtttctttcactaaagtcaaaaatttttacaaagaattaaatctatatatttaatattatgtttataattgggaattataaatttttcgtgaaatgaaaactaattttctaaattctgagttttttgaatatccattttacccggtacccgaacccaagttctttcaaacccggtgtttcggtatcatgtcagatttttagcttgttttttttgccattttccaggaaaaagtgcggccagtaaagggggcactcgaatttttgggtgcaattggatttcgcatgcaaaaaagtgttcctactgtggtgcaacagccggacggtacctccgctaccgtaatcagcaatgaaccgtatctggtgatgacaccgccaaacgaagcgtatgtaaaagccttatgcaaacaattgggtgaagcattggtgcaattgaaaaccggcgaaccaattcagctcaaactgttccgagacgcgaaggtaaaatttttaatttatgaaaattttcaaggaaaatgcgattattgaaatcgcaaggcttttgatttttttaagtataaatttttgaaaaccctataggtttttagtttattttaacaaccttatgattagtgactcgttaacatggtggcataatcaaaattctacattcttggtacctttcgatagcgcagttttttctctattagcctgcaaaatgtaaaaatttttgttcaacttttgaaaaagttgtatgaaaataagtactatttctgccattttctgccataacttatgttaaatttgataattttatttgaagttttgcaagttaatagagaaaaagcttggctatcgaatgataccaaaaatgtaaaatttgattgcttttaagcaaagttataacatattttgtcatcgctaaaatggcaggattttacgaaacgcacaaggtggcgcgacccagcacgaattttgaattgcaaaaacttttctcctcattttgatttaaaaaactaggaatacagttttatntaattctcacccaaccgtaaccccaaaatacagctcttcaaaccggatcaaaacgttcaccaacagcagagcgttacaaaaggatactgtaggatccgtgtcaaattccctggcggttatgtggcccaggcaagttatttagctacaactaagcttcatttaatttaaaaaaacaggaaacataatctaaatctaaactggtctgctgtcctattctaaaaagacaagaaacatctttttttcgtcaatttgcaatgaaagagtccttttttccaaggatgtccttggaaatcagcattagaaaaaaatattaaaaattttacaaaaattcgttaaaaatccttaaaaaattttcaaaatgtaacataaaaattgtcatattcatattcggtgaaaatttgtaaaaaattggccaaaaatcgcaaaatttggtattttttatttacagcaatttttttttaaattttaagggcattttccgtgagacagaaaaattttcaagtgtccgtgcgtttgttgctgagcacatttcatttaaacatggcatgttcaatctgattcctgctgttcctcctcaaaaacatggcagaaaacaattgagagaggaaaacaacacgctgaaagaatatgggttagatcagtctggagtggtcaattttagctgggactcggagactcaggtgggcggcaggcatcaatcagggccggagggtctgcgtttaatgttagacatgggtctaaatttctgcaaaaatcccgggccctgaaaaaccggggcttcctgtgccttgggagtggtcaatttttgctggcacgcggagactcaggtgggcggcaggcaccaatcaggggggccatttgggtatatgaattcgagagtctgcgatctctcacccatttttaattttaaatcatttaaaagttcataaagaggacccgaattttgagacacatggcccttttctgctttttggcgttttcctgcctttttatggattttcagaagatttattcataaaaacaaagaaaaattttatgccgcaaagcttaattttttcttggtcatttttttttctttttttttgtcatgttataatttgcttccatttttttaaaaattttttgtacctcattagtcaacctgaattttcaaattccaggaaattattactcaacttccggatgatcagcaaccagtgtttatacttcaataaacttgacaaatctacacaaaacgccaattacccatgccgatcaatgaaactaaaaaatgagtagagagattttaacccaatgatccccgataaataaacaacaaaatcccttctgctggatgatggctataaagtgtttagtaattattttttgcctgatttatttatggtaaaaggttaaaatatttttggtgatttctcatcatttcattcagcaaaattttactcaaccattccctgttttttattttattatattaattaggagaatcatatttaattattacattatttaaagtgagaatttatttcaatagttaagtagcctgaaaaaaaattttttttttcttgaaaattgttttttgttttccgtttaaaatattaaaaaataatgtttaatgtttgtttttctatgtttttttgtaccatttttaatggatgataatagccactattccaagcaaaatagagaaaaaaaattgatttcgaaatagtggttatcagagaggattatccatactcctatttgttacatcaatatatacaatatgtacattatcttaaaataacgatgcaaatttaagatgatcataaatacaatagaagggggttcttatggcattttcgttc

SEQ ID NO: 10474 - DNA, 2846 bp, Heterodera glycines
  misc_feature (270)..(270): n is a, c, g, or t
aaaattaaaaaatgtagcgggggcaaagtcctcatcaggaaatcgaaaaagactttaatcacttaagagaccagcagcatcttactttgaccattgaaatgaatattagaagttggaagatttttgctcatataaaaaagggaaatgacggaataaaaaattatacgtgaaggaattattaaaaatgaaagttcaaagttcaaagacgggaggcataataaatgaatttgaaaatataatctgtgactgaaattatatgtaaatggcatntaatctatcactctgctggccaatgaagagttgaaatttgattttgagtgctgaaaaaggcacaaaatacttttgtaaggaacatttgttaattctccaatcaatgactaatttttttcgagtaataagaataatttttttttgttccctttagcccagaatttaagtaaacaaaaacttatatagactttaagcttccatacagttaatgctagagaaatttttgttttatgcgtgtctttttcctagtcttgggaaagtcctccgatttaaaaatttttccgtttttaaattttaaatttttttagaaaattaacaccttttaacaccctttttttaaacgatgtcgcgttcaaatgattcaataaatgacgaaataacgcctgaccaacaacggcaggaaggtggcacgaatggaaatgaattaaacgcacaattaatattttttaaaaaattttcagcttcggaagaacatcgtgtgccaatgccttcaaatttgagtccgtccgaagaatggcgtcttttgagtgcccgaatggaagagttgaagcgaatgaacgcgagtgggaccgtcaagtggaagcccggcgagttgatatgtcgggacggcggggcggaaacggtgtgaattttttaaaattacgtaacagaaaattaattcactcaaaatattttacctcttaacttctttttactcaactatccaataagcatggtaagtcattcgatagctctacatgtttaggagctagccaggcccgtagccaggagaaaaggggggggggggggaagaagaggaaggaaaagcgcaagggaagcggtgaaatcaaagaaagcgttactaaccccgaggggcatttgtctgacgcaagagggagttggggggggggtaatccgaattttggaatttcttaacaattccgttaaatccaattgtagcgttcaacaccctttctcttgcggatgaggcaaggaaagtaaattttttattggttaaaatttagtgaatggcgaagctggacagaatgagcagcctgaccatggaccagacgaagctgatcagcctcagcaacagcagcagaaagtggttgagtgtggaatgcgaacaaaacgtccttttttcaaattttttccccatttttagcaccgtaacaatgacagttttgcccgtatggaagtggaattgagggagacgaaacatttgtgcacagtcaccaaattggaacttgaaaatgtaagttttttaaacaaaaaaacgattgaaaaagggcatttggcctttcccttcagaaggcacttcaaagtgagatgaagcagcagcaaatgatggatgagctgagctcagtgaagacgcaggtcgataagattggccaggaacaacaacagcaaaagaaggagcagcaggaaaagcaggaggaggacgcaaagggaaaatacggtaatatcaagggaatactacggtaatataggaattcagcactaggaaatatggtaatggaggaaggggaaatacagtaatagagggaatatcaagggaaatatggtaatggaggaagagagaatacggtaatgggccctatttaaaacgaccagaaatattctgaaaataattttaattatttaagcttccatcgaccaattcacgcagctgcaaaatgaacagaagacactttttgaaaaagtggaacaaatggtgaaagaatgggagagggaggggaagcgcaaaaggacaattaagacagggctcgggtcgggcaacttccctttccaaggatgggtataccggtttccaagtaaggggaaagttctattaaattttttgaaaattagagtgccatttttaacagattttcagcaaaaaaaggcggattttgcgattttgagataatggggatgaccattttttacttttcacaacacttcttgcgggcgctttttccgaaagactttttgggaatgaggggggggggggagaaattgttaataggtttttccaaaattgatcattttttaacgattttctgggtgtatttttgaatcaaattaaaaaaaacatcttgaattcaaggatactttcaaattttcaagtgagagggtccaatttccaggacgtccttgccattcaaggacgaacccgagccctgaattaagacaatgtcaaaaaaatgaaaaagtatttttttataattacttaaattttttataagtttaaaaaagaaaagcaaattttcttaatttccttttttgtctctgcgcagggaccgaaaaatgactacgatttggtcgattccatcatggaaagtttcactgccacattggaggaacagcaaaagaaaattgatgtgttggagaattttgttggcattgtgaaggagcgattcggaaatggtaaaaaagaataattttgaattttgttaattaattattcgatcattaacctgtctatcattgaactttaattggctattaattaattgattgattctttgtttgtctgtttgtttagagctgtcaaagtctgtccatcccgaatttccgttcggactttactgaggtggaaaaatatatatatataa

SEQ ID NO: 10475 - DNA, 4626 bp, Heterodera glycines
  misc_feature (4480)..(4480): n is a, c, g, or t
  misc_feature (4486)..(4486): n is a, c, g, or t
ggaaatatggtaatggaggaaggggaaatacagtaatagagggaatatcaagggaaatatggtaatggaggaagagggaatacggtaatgggccctatttaaaacgaccagaaatattctgaaaataattttaattatttaagcttccatcgaccaattcacgcagctgcaaaatgaacagaagacacttttggaaaaagtggaacaaatggtgaaagaatgggagaggaagggcaaaatgccaattaagacaatgccaaaaaatgaaaaaatgttttttttataacactttgtcttagactttttgtaattttagtaaagaaaatccaattttcttatatttccttttttgtctctgcgcagggatcgaaaaatgactccgatttggtcaatttaatcatggaaaatttcactgctgcgttggaggaacagcaaaagaaaattggtgtgttggagaattttgttggcgttgtgaaggagcgattcggaaatggtaaaaaagaataattttgaattttgttaattaattattcgatcattaacctgtctatcattgaactttaattggctattaattaattgattgattctttgtttgtctgtttgtttagagctgtcaaagtctgtccatccgaatttccgttcggactttactgaggtggaaaaaaaaaatatatataatggtgaaagttaatttagaagctttcaattccacctcaaaattgttgggatgcaaatgcttgtcacaaaaatctcacaattagcggacccaacagaacgacggtcctttacaaggaaaacaccaacagcagcagcggaagaagtgaatggaaccttattttatttctccgtttttttcctttttccagccggctttctgctctctgatatgatgggagcaatcttatcatcggaccccgactgttctctgtttgcgaaaaatccgattccgcaagaaaattcgggcattttctactacgaattggagattttgaatgtcagagggtatatctcaatgggactcgccaccaaagcaatgccattgaacgaatttgtcggacgttcgaatggctgtgggtatcgaagtgatggccttttttacattgacactttctgctgggattataaaaaagcggcttgttctcgtggcgatgtcatcggacttggcattaatttggccactcgacgtctcattttcacgaaaaatggacagcgattgggtcggtagaataaagaattaatggcctttttaatttaatttattcatttgcaaatgtatttccagatccatccgatttgttcttccctccctcggctgatcgtttgttcccttgcgtttctttgggttcgccgggtgataaaattgaagcaaattttggcccgaatttcaaattcgcatttttggtgaattatttatttggaatgataaagcatttgataataaatggtgtgtgacttctccgtttttctacactcaaaatttaaaaaacgaacaaagaacgtcaattttgggaccatttgattaaaaattggttcgaaataaggcatttttttcaaaataatggcacgcactgaactgctcggctcttagtttacttttttcaaacttttgagtgtatgaaaaaacgattgagtaactaaatgataattgatttatttcaaaattgaatttagaccattccaaagactgtttcaattccaccgcaaaagaattcttgggattcctccgcttgtcacagtgacctcgaaattacgggtgccgaacaattgatggtcaattacaagaaggagggagacagtaattttgtttttattaaaaaactcatctttttatccacgttgcaactaagcccgaaaagtttattgtattccttttatgctctctctctctcgctctctctcttcttaatgtcggcaaaccaattccagctcttcctatcataattgctaacttttctatataaaatgcttttaatttttctttaagaatggcgcactgtctttgcaaaatgcgctgttccgaccaccggttctgctgtcattttttactttgaaataaaagtgataaatgagaaacagtaagtggtccaattattgtgctcacgtacaaaataaagcgaacttgctaatagattaacgaccatcggattggccaccaaacagcagacgccattagctggaagaattgcaaaacgccgtggcatttttgcatatgagagcgacggtgattgttcaacggaaggacgcaacagacgcaatcgaagaaggcaattcggtgacggagacacggtcggatgtggcatcaatttggcaaatcgccatttgttcttcaccaaaaatggacagcaaatgggtcaaaaaaaatattatttatttaaaactaattgccaattttatgtgtgtttaagatctcacttttgtggtggattcgttgccttctgatccgccgttattcccttttgtttctttgggtgattccggcgacaaaattgaggcaaactttgggccgaacttcaaattcgacctcgccacccttctctgatctgataaaggaagaagaaatttgttggaagatggcgtattttgtgttttaattgacattttacaaatattcatttttctttttttaaaatttattcgatttttattcttttttaaatttatgcacattcgaaaagataaacaatttttatttttgaatacaaccaaaacatgcatccatctttccaaatacggtcgaatgttaagcgattctgctgttggtcggttttacgtgttccatatttatgccatctcgtcggatttattagatttttaactgtttttagcggatagcattttaactatttctgccctttagtgttcaacccaattgcaaaccatgccctatcgtataaataagcatgctttaccttctgttgtttgcaaattctgtcttttcacccgagaggtttttttgaaattatatttcatagccaaaattaatcacgaaaattaccgagttaaattcattcaaatggagacaattataaaatttaagagaatgtataatcttttgatcttcaaggtttttgtgaaagtaataaaaccaataataaatcccacagaaaacaattaaaaaaacatataaaaagtaaaataaaattgtttgaatgaatattattctgtctaaaccatctctcacaaatcagccttaaaaacgaaaaacaaaatgtaaattaaggcaaaagggaaaataaaattataagcaaaaatattcataaaatatggcgatgaataataatttggcaataaaatgaaaaaaaacccacacaaaaaaaattaggcataaaaagtggaaaggtataaataaaggagcccaagaaagagagcgagaacagaagtaatgtcagggttgccagatgaaaattttaaaaagcctcatttggcaggcaaaaaggcctcatttttacaaaatttattcaaaacacgtttaaaatgttcaaatgttatatttttgattgtatgatcgatttgagtaatttttttttgttcgaaataagcattttgtgagattctaagcatgaaaaatcgaagttgatttttttgcggcgctttttccaaaaaacttggggaattgaggggccggcggtgccgataggcgccgccgggaaaatttttgtaatttttaatgtgatttgttaacagatttgtccacaaaatggccaaattttgcaattttgagtaaaattgaaaaaaaaagaaaagggatttttaggggccggcggggggaaaattgagaattttgaccatattttaaaagcagattttcatttaaaaattcataattttgtggattttcgaaaaaattgtaattttctggctaaatttaggtgagatttccgtttgatactctattaaaaaccaaaattcaaattaaataattgccaaacattatgccaatttatcaaaatttaaaagcttttgaggattttccccaaaagcctcaaaaatcctcaaaatttctcaaaaagccacaaaaatcctcaaatcctcattttccaaaaaaaaatcctcattgacctatcaaaaagccacaaaatgaggataaatcctcagatctggcaaccctggttaaaaaggttaccccagtaggagaaattttattaaaaatcccgtacaggctatcgtaaaaatgcgaactttttgcgggattaattcagcgagatcccgtcccccacaaaaagttttgagttccaatcccgcggctagatccgtaaatttgaaatttccggtctctaatttaaattttattcactaaaaagcgtacgctgatcagtcccgtcggtgtgcgttcctttttttctgctactttgcccataaaccatttcaaaaagattttcatccaacaaattcgccgccttttttcgtcgtcatcgctcggcaatgaattcagcttcaactcggccactttcacttttaacttggccaattcgttgcncaattnttccagtttctttttgtcctctccatttccctgatcagtcccaaaatgatcgttttatgatggaaatacaacgcattgatgcccaattgttttttgacactttctcccgccattgccattccgtccaccataatgggctc

SEQ ID NO: 10476 - DNA, 1640 bp, Heterodera glycines
  misc_feature (1558)..(1558): n is a, c, g, or t
tccgcttctcgccaaacccctgaggccttctgtgaaagaagggaggtgtttgagaggtataatttgaatttggagcgcatcgattattgattaattttgtgacgtgtcatccctcccccttattcatttgtttatttaagcactccttccttccccacattgttccttctcccattcatttaaacattggaaagaatggaagagaatagtttttcaaaaaaatcgctaaaataaataaacaattatagacttccttatgaaatttttttgtttttgtagcaacattatctaagagagacaataaaattaagaaataatgaagttgaaaataaaagggtttttctttaaaaaataaaacggaagatttattaaaatcaaccaaaaaaaattaatttcctttctctccctctccctcctttctatctctttctcaatttcttctctatcttttcctttctctctatctctcttcctttctccctctctcatttccctctctctttctctctcgctctgtcaatctctctctctctctttctttctctctcaatttctctctctcaatttttctctcccccccccatctctctctccttcctttcttctcacatcaatctctttctttcttctttcctctatctcctcatatcacttctttctctctctctctctccctcatcacctcacactctctctctcatttcctccttttctctctttactctctctcgcttctcttctctctcctcattatctctctctccttcctttcttcttacatcaatatctttctttctttcctcttaaaataaattacccagattttgtctaaagaattaccaaattttagagatttttggctaattttttaagaaaaaataggtttttggggggcccgcggtgccgataggccgccaggcagattttgaaatttaagctcgatttctaacagatgtttacaaaaaaaaataagatttttacgataaatttttgtttttttaatatattaaattatcatgatttacttaagcaaaattggaactcagatttgtaacatattttcttgtggcacatttttccaaaaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaatttttttaataagatttacgaatttttgggccctgcgatgccgataggcagcgccaggcgaattttaaaattaaaaaaaataaattaaaaaagaaacactcaacctgaatcgaactcacgacagaaagtaatgtcaaggttgattccctaaccactacaccacactacacatcaataactaataataaaattaactttaattcataaaaaatttgtcaaaattgttaaaaaaatcaaaattgtataaattttttgccttttatccatgaatatgtcattcttaggggtgtattttcacccccgcgcccccgcgggggtgaaaggtcgtggggccgggnggatggcgggggtcagagtcacggggggcggggacggggggtgaggccaaaaaacctgtccgcccccgccggggggcggggg

SEQ ID NO: 10477 - DNA, 2956 bp, Heterodera glycines
  misc_feature (2943)..(2943): n is a, c, g, or t
ccccccccccccccccccccccccaccaaaaaaaaaaaaaaaaaaaaaaaaaaaaaaaaaccccccccccccccccggggggggggggggggggggggggggggggggggtccccccccttcttttcttattataagcaggtcatacagaccagtccatcacatgtgattttggtgtcgcccatttgtgggcggtcattacccgccacttcagtctccgtcagcaaggggtgtatcctccgggtcacccaatgctgaccggctccagccccctttgatcgttatttcgccgacgccgccgatatctaaaatcctatatattaaagttgagtgtttgtatgtatgtgtccgtggtttgaattggtgtggcgttttgtttgaattttgcgttaaaaaatgctttgaaaaaaaagaaatatttggtttttgttttctgcgttgcaaaaaagcattctattaaaaatgaaaattcccacttttttgtgctgtcaaattttttatttcttatttatttatgttaaattgatttattttttgatatgaatggttatgttttgattatgtaaatgattttggagaattgtttgattagaaaactgaattagaattggtttgatatgaaaattgtttgtttcttaaaaagctattggtacttttttgattataatacatacgaaaaaaaatctgatttgatttttgatatttgtttgaatgaaaaaaatgttttgtatagtaaaaagagaatgaacaagcctttaatggattgaaagaaagcaatgtaaatctacatctcaaatttttctgttcgggtggataattatatgcagttgggatatattacgtgccgcttgctgaatgaaatttatgtggaatattttaaattaacgtttacaggtcagtttttgttttgaatttgggggtgggtgcaataacgattctcttttatatgtttttaaaaaaaaaacccctccccatctgcaaactattaacttaattactgctttttttgagcgaaaaaagaaaaagttgaaatgcttcttttttttgtttttgtgtacattcttttattctcaaagtttgtttcaaggtttaaaatatctaccgctgatttttgtaatgaatttaagacctagaattggaatttagatttgattgtgtttgtaaatgctaatgaattgtttgtgaaaaaagtcacatttaatttttttaaatatgaatttaattgtttggttatcagcagaaatttttgtttatgttatgattaattgaaaacgaattgttagtaaatgaaagttttgttgtttgatatgtatcatgttgtgctgattcaagttgcaattttttttacaaatggatgttttacgatatcgaagccaatctacaaaatgtgatgtttttgaaaattttaaaaattaacgggataacaggtcagtttgattttttctctttttattgagagataatttgaccttgcattatttttgacccactcatttttttttaattattttattaaattaaataataaatattcacatttgcttgaatatgttgtttggttcacatttatatatttgttattttgtaaatgcttttgttatgtaatgttctttcaggtttaaactttctactgcctcctttgttataatgaatttagaccgagtatttgtgaatgatagaagtaatgataatgaacagaatttgttatatgcttatgtttttgataatgattatgaagtagttgagagcagttatgatatattggaagagcataattatagtaaacggtcaagaatggatgttgttggtggcgaaagccaggtatctctgaattcagatattggtattgctggaccgtcacgtatgagtgatagtcaatttgaagaaaggagaagaactgagtatttgaaaagaaagagagaacgtgagagaatgagaagagaaaacgaatcacaaaaccagagagttttgcgtttagaacagatgcgagatagaaataatagtcaaagatcggaagagaatgcatatgagagacagttacgtctagaacagcaaagaattagacagagagtgattagacaaggtgaaattaatgtttatgcagcagggtcttatgtgaatgctcatgaacatggacttggtcttatgaatgttagatgtgaattttgtgatgcattgcattttgttggagagaaaataagtggccgaggcaattctttcaaggattgctgccattatggaaaagtttttgttcctgagattcctgagcaggatttccctgaggaattgagggatttgtttatgaaatttgacgcgaggcatgtgaatttttttgaaaatgttagacatttgaatagcagcgtttcatttgcttcaatgaatccgctgaggtatagatatccgaataaccgaggaccgtattgctttcgcatttacggtcaggtttatcacagaatgaatttggctttgaatcccgaaagtggcgatgagcctgcttacgggcagattttcatcgtagatactgaacaggcaatgcgggcaatgagacaaagcaatgtcggtgttgaccctcaattgttgagaaccgtttatgaagtgataaggaatgcgaatccatttgctgaggcttatgtgatgatgaaagaggaagaagatgatgaagttgagagagcgagaaacgagaatagagagcctgccgagatcaagcttttgtttgagaccggaaggcaattggacagacgtttggggtataatgtgccacgagcgaatgaagttgctgcggtttatgtgcctggagcagatggtgaagtaccggatgcaaagattgttatcagagaatgtggaaaagagttaaagattttgaatagcattgacccgatggtaacaccgatgacgtacccgctgttttatccgcgtggtacactcggttggcgcccgggaatgnaagcagagaaata

SEQ ID NO: 10478 - DNA, 4565 bp, Heterodera glycines
tagagcataaagtaccaagataaagttgcgtcaatctgtgatgattcctttttaaaaatatacgtccattttacatataattggtcaaaaacctaaaaattcaattgttttcgactttaggagggcaaatttttatgaaatcgcttgaaattaattgaaaaggttcattcgttttattcgaagaattggctctcccgacaaatcgatgaccccaaattgggagaaggacagacaatttaaatgggcaaaattctgaactaaaaacaataggtacagtagagtaaattaaaatggcatttatttgcggtctatgtcagttgggtccatacgtatgggccccagtatgtttttggactacaacttttttctttgtcaacaaaatccaacatttgacatcacttgaaagtttctaagctggtgattctcgattaaacgattggtaaaaaaaagttgtacatgaaaagtacgaaaaagccgaaatttttaaattttttcttaataactttttcacaagccaaagaattttgtttgatttttattaggctaatacaaattaaattgatttttttttaattttggcttaaatttataatcatttattaacaccatctttcacttcttttttctcaaattccgactcgaacctgcacaaatacagaaataaacaaatagtacagcatcataaaaaattatgcctcaaatgatgaaaaaataaatacgcagtttttgattgattgtttatttggtttaaaaatataaaaagaatatgataaattagttagacaaaaacaaaacttaagagagattaggtataaatgagacaaaattagacaaaataaggcaaaactataaattttttaaattgtgccaaaaaacggctgaaaattctttcgagaaacgaataaaagccaaaattcaacggaggggatcgaggatgaatgtagctgaatgcacagcagacaaaactgatcagatcaagccggcggaggtccccgaacataatgcaacgtcacggcattttgaattgtccgaatttggtacaaaatgatgcaacagacggcgaaagtgccgaacagaacgatcattaaaatgactgaaaagtgtgatcaaatgagagcagaaaaaaggcaggggaccgactctcaaggggagcaataaattttgcagacaaatgccatttctaggggatcatgtcttcttaaatctcgaaataacagcaaaaatagacacttttgggcctgaatttcagagaaggaaactttttgtacccatcgaacagcctttggcatgaggacataatttgacaatttttaaacattcatttccctcaccgaatgtccatgagtttgacgctctgacttcagttgtttgtgttctaaaagttattatgttttagggtaattagacattaattagaacatttagcacatttactcaaacagaatcccctcggggctcgttttcaagcacccgtcccccatttaggctttattacagagtacactaatagaatgagagtggagggatctgttggagtaaaaggtaataaaagcataaacattcctcacccaatgtgacggtatgttttggtgctcgcgtttgtcccgccagtgctgaaatttttcaaaaatatgaatgaaagtgattaattcaattcacccttcaaactcgtgcttgagacaaattcgacactttgcctccgcttctttttccataattctctcttccaactgtttgatcgtttggtcctgaaaattaatatgtcaattcgtgaattaatgacgaatcctttttgaatttattatcccctcttcaggaatgttttttatttgcttaggatattttagctgtcgtttcgaaactgagattggaccatagacaactcaaacctgagctcgggccttgagactaagactttttttatgtgaggattgtgccaaacttaccgcttccgcttgttcccgtccaaattgattgaaaatagtgacaagttcttgttccgcttccgttatgcaactgttgtaatgctcgacaagtgagttcggctgtaactcataatcggcgaaaatgttcttctgaaccgacagaatttgaactgatgaggaggagggcaaagctgacaacgaaacaccggccacggcactgtccaaaaactgtaaaacggtgagaataattcgattgcaacgagtttcgagattcttaatgcgcaactacaccttcactggcacacgttgtagttcagccaatttgcgtttaagcaaatcgttttcttcttccttctggcgaagagcggcttttgtctgattgagttcggattttgtctgattgagttcggattttgtctgactgagctcggctttctaaaaaatgcacagaaaatataagacataataaatccatattccattagggaagtgcgagaaatgcctttttaattgagaaaccgagaatacccccctagagtcgagactctcgcacatcccaccctcggcagttttttccaccgtttctttgttggtcgtttccatttctttgatcgttttgtctttctcttcaaacaatttctccctaattgcatcttcttcccaaagttcttccacgtgtgcagttattcctatgcgatcttttcttaatttggcaagttgttcatctttagtgggttccgacatttttatagtgtgcttaaaaaagacaaagagttgagagagatcgctaaaataagacacgcatagaaatgttgggaattttgaccgagggtgcccaatgagcggaaaaactttctgctttttgagaaatttaaattaaaaaatgataaacatttgttaataaagcaaagcatttccctcgcccgcatttattcgtaaaaacgaaaatgaattatgaaaaagtgaattttttggatgaaataagtccagcatttgagaacatttgatctgcgttcaaatatacatttaagaaatggtacattttcatcccattaatgagtgcgtaatgtgtgccggggatttaattgttttgccttttgatttgttttttgaattttttcgtcaggcaaaatgccggattaacggaaacacccaatttgtttgttcctaacagttcttttatttctgtgtgcaatttgagaaaaggactcaatttactacactaaaccttgtggcataacaaaaaggaaattttattttttaaggaaaattcaaaatcccaaggaaacagaggtcaaacaaatggcgtgcaaaggagcgccgcctaatgatatttttcgaaaattttggtgcattttgcttaaatgatgagatgttatcagaatagaacatatagatgtcataacaactcgtaaaaaggcgactcgtacaatggcttaagctttaggctaggcctatgcttaagcttagactttgtaaatttttaattgaatgagttgcccgcttgtatgtacgagtttccattgaccacatcatatagtaacatccagttcccatcattaatcattgtttctgtgtttttgaaaatattttgccgggaactcacattaaagcaaaggtcgctctccagccgttttattatctcatccttttccgcaagttgtttctcctgcttaattctccgttcgtaaagttggctaatttgctcctccatctcggcacactccttgatcaattgtcgtttaatgctgtcagactgatcagcagattggtggcggcggtccattggggcggcaacttttggggacaatagcaacggaaaatgaaaatgcccgatagcgagtgggacactctcgacttgggctttggggataattgatctgtttctagacaaatggtttctgattataataatttgtcctcattttgctaatcattccatgggaaacgcatagaatattctcccaatttaagagaagaatcttggtaatttatcctttacatatttcttgagaccgaacgaggcatttaagtaaaaatcgattagtcattacattaaaaatcgattgtgccggcggcctcttttgtaagcaaagaaattttgaaaatttggtcggaatttagaatagaggcgattgtacataaaacacaggagaaacgacactaatagacaagcaaatgatgggtcaatcacaagtgaaagatgaaggaagagaaatgcgtacaacgaacggaagagaagcagaaaagcatcgccagcagggcagagacgcagagtggccccgcggggcatttttggactttgaatgtgcttcgaatactttggttttaaaatttaaattaactgtaagaaaagtaaattcatttattttttatatattgttttgggtacattacctatgtatatgctaatttgtctccgatttcaaatacgaccttccaagaatagaggggaggaacaatttatttaaaacaaaataataaaatgataatatttagggcttccttttttaggcacaaaaaatcgcgaaataggcacctaaaaaggcataaaaaatcgcaaaataggcataattaggcacaaaaatcctcaaataggcactaaaataggcaaataaaattttttattaacgtttttag

SEQ ID NO: 10479 - DNA, 2208 bp, Heterodera glycines
aaaactcctccccttttcttgtgttattttggtgctcctcacgcggtaaaaaaagggaatgaaagggcagtcattttgctttttttaaatttattttttcttttctttttgtctcattaatttatgggtgagaaagcaaaggcacatgtaatttcgttgagtccgcgccatttttgcgccatccccggggcgactttcaatccaccaaccaattaatttattattatgattaattagttgattagccggattagtcaaaagaaaacattcaaaattacacatttaaataaacagaacaccatttaagtatgattttacaaaaagaataaaatggtgcccattctaaatgtttttgttgtgtcgttgtttggtgccgtcgacctttgctcccccccccccccccatgcccacggcgtcccccgcccccccccccaaccgacggacccgtcattaaattgtgaaaagcgcgggcaaaggatgcgcagagggctaaaagaatgaataccccgcggggagaagacaacataataaatattcgaacgaacagagaaagagaggggcaaatcaaatggaatcaaacgccccccccccccctcagggcaaccacaacagcgcaataaataatgggcgactcttaaataaaggcggcggttattgtgcagtcaaatccactttggcgccactttgctctttctgctgaactgctgaagagtcccacctcaccacaaatgccaatcatttgactatttgcaaaagtcaactccatccgtttgcattgtttttgttttttctcctcccctttcaaaagtttaattacttaacaaactcctttattaattagggcagagttttttcttcggttttcagactatttttaccttttaaccttctaaaatggaaataataatttttggggattctgtggcgacagttgggcaatcaaaatgaaccttggcattgcacttttggggatataattggagggaggagggcaattagcgggggggggggggggttcgattcgtccggcacaaccaattgcccaattgcgtctgtccccctgactgatgagaaggtggcacagcatcagttgctgttgccatactctcaactcgccctccctccccccctttcccttccccctctaacgctgcaatacctttgactttcgtttgattacttccgtactcaattttccttcccccaatttcgtactcaattctcccgccccaaaatggcatttttctttcctctgctttctcggcacccccacaaagtgtccaagccacgaaatgtccaaaagagtaaaaacccacgaaatgtccaaaatttttcaaaatttataaaaacaaaatgagtctaatttaggatttttcggttttcggggtcgctgaatacgaatataccctttatattaccccttgcctaaccttaagcccatctgaatacccaaaatgcgtttctttctgtttgtctgtttctctgccccaatttcgtctcacagatggccatagaatgagaaaaggacattttgtcatctgatttgccaatgcctctgatcagagaagggattaattagttggctaattggatttcgtttttggagagcaaatttatttatttttttggctttggtggccaattccgtgattcgaattttctctcatttttatttgtttattttgtttttttttgcttttcgattctcaaaagtccaacgcgtgtgcttttccttacctctgccatttctaaggatatattttttcaaaggtaactcaactgatcaatcttcgtcgttaattgttcattaattattgttttatatttatacaaattgttttccttttttggtgatcattttaatttattcttcccattttaaatcgaattcgaaaaattattatttttatttatttattttactttaatttattaaattgaattgtttcttctctcctccaaatttctcatttttgtttttcaaagggcgaaattcgtgcaaaatgtacagaggccaacatttgtcgcaaatgtttttctttttttccatttcatttcatttgtttttcttcagaaggccgagttaatgtaataagttttgtatcaaaattgttttaatttaattaattattaatttaaatgttatttttatttgtccgttaattttttctattttcgtcaaaaaaatcatctcaataattgctttaa

SEQ ID NO: 10480 - DNA, 1158 bp, Heterodera glycines
  misc_feature (1087)..(1087): n is a, c, g, or t
  misc_feature (1100)..(1100): n is a, c, g, or t
ttcgattctcaaagtccaacgcgtgtgcttttccttacctctgccatttctaaggatatattttttcaaaggtaactcaactgatcaatcttcgtcgttaattgttcattaattattgttttatatttatacaaattgttttccttttttggtgatcattttaatttattcttcccattttaaatcgaattcgaaaaattattatttttatttatttatttttatttaatttattaaattgaattgtttcttctctcctccaaatttctcatttttgtttttcaaagggcgaaattcgtgcaaaatgtacagaggccaacatttgtcgcaaatgtttttcttttttttccatttcatttcatttgtttttcttcaggggccgtagcaaaagaaggtggttatttgacgaggtcatttaaccatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatatatattttgcttcttttcatggaaaacaagaagtcaataagttgttttgcaaatttgcagctgaaaggatgaatggatcaatagaaaatgatcatgaaatatatttttattttttgttggtcgctaatattgttcgcctatttttcattataaataaaccaatataattttgcatcgttttcttcgtccaaatgttaatatatccttccgagtaaaaatattcagaataaacttaataattttatataaaaattattaaagaattaatacatattcgcttaatttactaaaaatgtctttgttctccaaacaaatgtctgagcaaattgcatcttcaattaaagacaattacgcaacattcttcccaaacagcaaagaagctaaatttgcccataagtcaaatactgcctgggacgacttaacaaatgagcttaatgccaactttggttcgtcggtcactgtgaaacaagtcaaagaaaaatggcacaatatganaaaagattcgaanaggcgctttgtcgaccgaaagcggtcataaattcataatatttatttgtactaattga

SEQ ID NO: 10481 - DNA, 2469 bp, Heterodera glycines
cgaaatcatgtttcccactcccttctcccaggggtattattttttaaaaagtctttttttcaccaataaatccttaataaaaagattttaaatgcctttttcacaattttttggtgcctattaatgtgcctttttcacgatttttggtgcctttttagtcggtcactagttattatgaaaaaaaaaaattttttttttcaaattataattctttataccaacattcatattttttggatcaaacaaaaaaataatatcaccgaggcgcaaaagcctataaatatcagcatctaaaaagaggcaggcaaaatctaattcaaaattttaaggaaatttccatcactatgacacctaattttcttgtaatcgaaacgctaattgacttttctaattggtcatttcgtctctatttgcctccagcgcaatttgtcatcggtaaatttgggcaaaattcgtcgcaattgttcgtcttttcactgcactgttgatggtggtggttctgttgctgttgctgatgattttgtgcgtgcatcggaatgccataaacttgcacatatgtctgtcaaaatcaaaaatcaaatcaccaaatcgatcggacaatttagccgaattcctgaatctatttttgaattggtaatattttcagtcaaatcagtgcctaatcaataattaaaaatgagagaaactaataacattttgatcactataaactgtttgctcgtctttaaatcctcctattttctgattagaaaacgaagatttgattactagagcagctacagggatttgatcatgtaccagaacgggcaaaacgtaattaaaattcccgtctttatggaaatcccgaggttgtggtgatttactgggaatctcggcggatggcgccgatcagatcagtgactaattttaaaatgaggactatttccaggattgaatgctctttgttcgagtttggtcaatgatcactgatggattcattaaaaaaaattataagtctcgctattttcgacttcatttttctgatattcctccatgaaaatttgatcagaccaccgcttatcagcggattttaaatttgtctccgatcactgaccatcagttgcgcacggcgcatatcgagccccgcttggctaagccgtacatgtgccgaatatggtgatggccctctgatggcatgtcgcgcatccgacggcggattgatcagctcttgccacagtgctggccaattgtggggcccatttgtggccaaaaagagcgcaattgctgtcacaatcactggcacaatggacgggacgagcacaatttggggctgtacatccaacattttggctaaataagactcaaaaaatacttagtacggattagaatttcgaaattggatgaatggcacatgtcagggccgggattgtgtgggggacaactgggcgacatttcgattttttaaaaattattaaaaaattgattaaaaaaatataattaaatatttgtataaactccgttcatagttatgcgaaatgaaataatttggtatcatttcaaaaatgtctgcttttcgttttttgagtctcgaaatattccccgttatttgcgtccaccataaaatatattatatagaagaaatttttttataaatatattaacctaaaatattaatcataaaattatattaaaaaatatttttgtgagacctgaaattattaatattgattaaaattgtcgattttttttacaattttggccattttcttctgctgaaataggaatagacggctaaattttaatattattattataattttgggcaagtatgcaaatgtaaaaagtaataaatttatatttataacaaattcattatttaatatagataagtaatatggattgaaatttcgaaaattattaaaattttaatttaaaaaaaaaaaataatttcagaacaaaaaacttatttcgaatgttcaatagatttgggccagttttaccttctcccgtccaaaattataatgttttctgatttttatagagatatgtttttttattccttaccagggaattgagtgtttatgttgaattttccaaaaatgtataaaaaaggtaacaaaaatatgtgtgtttaaatcaaatttatgaataaaattaattggggaaattcacaaaaattgcaaaatttcaaaattatttgctgcttaatcgattgcaaaaaaaaggaaactaatgacggtcataacaattttttttttcattgatgcgtcataaaatttttatgcaggaaaatagtttacaaaaaatttcacgtgaatttctgctgtttttcctaagtggtcagaacacactggacaaatgggaaagctggctggaaatgccaccttctccatggagaatgccaatgccaatgccatgcaaatgtaaacacacgtaaggtaatggcaacggacaaatacgccaccttgaaaagcttccccgggaaaagat

SEQ ID NO: 10482 - DNA, 2205 bp, Heterodera glycines
  misc_feature (21)..(21): n is a, c, g, or t
  misc_feature (32)..(32): n is a, c, g, or t
ggcaacaaatagtcggcattntcataattttntattttccttaattaatttagcaatttcaaaaaaaatgtttttctcattgcttttcacttttgtctcatttcttgctcttccatgctgtggtttggctggccattctctgcttggcaatgccgccgccagcagcagttcgccaagtgccaccatcgttcataaaactgcatttggtcggcattcatcagtgccaatgatgccaaataatggtactaccactttgccccacattttaatttttttttgattttggcatattgtccttttaggcattgtgccaatgcgaaaattgtcatcttccaaatcacttaaaatttcggcaaagcttgacggagaaaggaagaatgcatttttgacaaaaccaattaaaagcttgacggatggagtccaaccaaatgttggtggccctgttttttcgccaaatgtttttcatgaacaaaatgaagaagataaagaatatgagaagcaggtgaagttgatcaaactgtaatacaattagtttttgatcacaagatatttaaaacactgaaaaattcaaatggctagcaaatttaaagaaaaattttccaaattttcgttttgcttgtgtaataaatttttggggaatttttcccacctaattacagcggaaatttcctgtaagtcttcaaatatattaacttcagcattgctgttaatttgtaagctctctacaaattttaattcaaaatttaattaattttctcaatataatttaaaattcaaaaaattaatttgtttttatattaatccagggaatctatttgaaatcaaattttgaaattattaaatttgtaaatttataagtttatctacactattatacaactaattttttgtaaagactgataattatgtgccgttcccgctctactggcatgccgtgttggaacattttgatggaaaagtgccggccaaaattattgccaatattttgggccgtctgatcactgccttaaaactttgcaaaggcaaccatgactatgacgtgatcacttcagtaattgattttgacggcattttgacggctgaacattttttggccctcaaaaaaactgatgggccaatttttcaagagaccgaactccgtggagacatcgctttcattgtcaagaaaattgatgtgccagcaaacacacgtctggcctacatgagtccggaacaagtgatggtaagtatggcaaaaatatgaaaagttaaatgtccgaatcgatcgaaaccgggcgatcggaatgttacaaattaaaatttggacgagatcttcgatcatgtgcctctaggctacggcacaaaccgatattttcgattttgatccaacagattccgaatgatcagggacatcccgtgaaggacaagtgccacctaattagcaaaatttaaattcgatgagtgccctcattaacggttcccgcgggacacggatttccttatttttaattcttgcaaagccaaataagtaaccgtacctaaacacttggattaatgccaatgctaacatatacaattttatgcctaatgcctgtttaacagcacaattcctacaaccactccacggaggaggacattgtgtggtcattgggcgtgatactgttcaccatgctcatcaaccggcatccattgcaagggatggcaaatgagcatttcaatttggcacaacaaaatgccaacaataacaaccgaaccgttgacattggcacattcttggccaattcttcagaagacatgttgccaaaatggcgcaaaatgattacattttatgtgcgatcagaacaggaattgccgttggaatacctcaaatcgtcggtcggtgttggtaatgatcatgttctactaatcccggtgattgaggtcggtttatatgaaaggcgcgatcgatgattttcgatttggtaccgaaaaccgatcgaaagaattttaaaatcaaaaatttttgatagaaatacccaaccccaaaattcccaagaatttaaatataacattttgtggctaatcaacaaaatgccaaaattacggtttttagcgctgccttcaaatgcaaaagcagcaaaggatttcgttgtgccgtttgcgcaaaactttggaagaaattgtggagaaaattgaaaatgctaaataaaaaaagaacggataatgagattggatttggtcattttt

SEQ ID NO: 10483 - DNA, 2218 bp, Heterodera glycines
caaccgctcttttttctcaaatttattttttatatttaatataaatttttgccaattaaattttttatttgctttggttttagcttcggcttgttagcctactaacgatacccgcggcgagaacgcaccaaagctttaggtaccaaaggagcctaaggagttctctgatggttaaaggaacacattgttccgccccatcacacgccacaccctcctcatttaatgtggcgattaacttacctgaattcggctccttttaatttgtatttttaatttaaactaaataagaatttataaaatatatttttaaagtatattttaatttatgtcgatgtattttttcttaattcacagtaaaacaattgactcaatctcataaaaataatttttgtgtgtgatgtcataaataagtttattccaatgcttctttccaaactatatttttaattaaatttgttttggtttcttcagataatttaattttaatatcgttccaagatttcgctcttgataaagcaacgtatgtttggccatgtgaaaaaggatcatcattgaaatcaagaccaattttcgaaaatgtttgagactgacttttgtttatagtaaatgcaaaagcaagctttattggaaattgatgtctactcagtagaaaaggaaattttttttcttcaattaaggtaattcttggaataaaagtttgttctccaattcgatctccacttttaatgatacagtttattacatgtttgcccaaatcagtcacttgcaaccttgttccattacacaatccctcctttacatttaaattgcgtaataacattatcatcgccccttttttaagcttaatttcatgatctggtatactggaacatttcaatgaattaagaatttctggagttactgggttatttttacttaaatctgtttcatcaatacttaaatatgaatttgttcaccaggtaataaatccaaaatctcttcattatatttatccactacggtattatacggtgacaaaattgcgcacttgcttaattcatcataattatggttttttaaatggcaagacgcttcaataagcgatttggaaccaaattaagggagttttcgatcggaaacaaggtctttgcccgccacagaatttcccaaaattggcaacagggcaagatttcaaagcgaactggtgtgatttacgacgtgacattcgccgatggtaagtcagggcgataccacgccaaccagcttcgtcctcgcagcacatctgactccgacgaacagctctcggtgatgctcgaagtcttcgacatcccaagaccggttgctgttgaggagcagagggcaatcccagtggaaatgccattggaggacccgcatggcgaacaggaaaatttgggaggtcaaattgaccagggacagcaacgacggtaccctcagcgaaatcgccgtccgccgcagcgcttctcaccgtaacctgggaaccgcgcttaaggggggtggtgttcggggtattgccgccgatgatttgaatgtccgtgacataatgccaatccaatcgattccccttattttatgttgttccctcgcccataaatatgctcccattctcctctcagattgtcttcccttctttcattttgcatttatatatttgttcccccaaattattgtgacttttattttccttctccaataaataaatatttaattggacttcaacaaatccctcggaccgaacaattgggcgcagtcagctaaaaagcatacgacataaagcgcatttgttattcatttattacattctccagacgagagtaatttttggattttaacatttctggcggcggtcttcaagtgggacgaaaacaaaccgtccacattttcgaccgccgacttttcattcgcgtcaaaaaactaataaaccccaggaggggtggggttccgccagggtggggttttcaacgcttcaaaaaaaaccaatagaacctaaaaagggggaggttccgctagggcgcggttttcaatcgccgaaaaacctatgaccctaaggggggttggcggttcgaaataacgcggttttcatcgtccaatttcaacactctcaattgaaaagcgatcgataaccaccgacaagggcacaagccaatattcaacaattggtgggacgcaattagtcaactcgtcaccgcacagcagcagcaacaaaacaatcaaccgaatc

SEQ ID NO: 10484 - DNA, 3265 bp, Heterodera glycines
  misc_feature (3126)..(3126): n is a, c, g, or t
taaatttgaaaccgattttaagcatattcgaaaatctcctcttaagataagcaattagaaaatttgattgaattgttgttttttatttaaaattaaaaaaattagattttaaactaattttaagcatatccgaaaatctcttttaccgtaccctccttcgtcacactttccacccttttttggcaggcgaaattcgatgccaaatgttttcaattcctcgtgcggtaagcattgatccatgaaggcaatcggaatggagaacaatgaattattgccattgatcaaacgaacgctaatttaaaaataaatttaattcatcattattattttatttaatgtcttacggttttgtttgcatttgtgccttgccaccactgagaagcaccaacagaccaataaagctcctcattaaataattgaacatttcgcttatttttctggcaaattttagcatttaataaaaataatattccgcttttagaataaatgttttgctgtgcttttgatgggcaaatgattaacataataaatttatggctgtgaaaggaatcgctcaatgggcggacgaaatgacttttggagattcatttttatttagaaaagagatgctttttcacatatttgttttttttcttcatatattttgcagaataagcatccaatgctaatgtgtggtgacgaagcagtgatagttaaagtaataaatgttagagccgtacggaggggggagggggggggggaatttaatggtctcaaatcactcaaaaattaatacaagtaaacaaaatattgaggaaaaaagaagtatcgatgctaaaatgaaataaaattgcgcccaaggcaaaaataagcaaattttctttaaaaatttttgtctttgttttaaagaatttttttataaaactgttttaatcttttatttgggggccctcttttgaccaaattttcttcaaaaaattacattaaccatacttatttctttgaagtatttgagataagctaatcacgaatttaaaaccgagaatgattgtgacagcttcggtgtgtgttggcttaagcctgttttttgcaccataggagggcttttttttaaattttaaaaaattgttaaactccgctctgattcatgccccaagctgcgcataaaaatttatctttacttgaaactttaatatggaagcctgtcaatcttattattaatcatttctgacagcagttttagataaattttaagcgcagcttgggtcgtttatttaaggatgaaatcacagcctaatttaagaataattttagtttttttttaataattaaagtgcaaaactttccgatgcccaatctttccactgtgaatccttaaatgtcgcccattgtcttgcaccaatttttttgtaaatatttttggtcccactgatttaaatttatataatttagagcacatttaattctctataacgaacctaattattaacttttaatggagcatggatatttcggcacgttgttcttaataccaatataatgcctgtttttagttaaactcatgaaatcaaattacattaaaggatttttttcttaatttaaatttgtttaaaacgattttctatatcttgcttttacatttttaatttacaaaatttttgcatacatggattataattttatataaattaataaagccttcattttttgctgacgtaagttgcttttgccacttttgcaaatgtcacatgatgttccatgcaaaattggcagttctttctttttacaaatatcattttgaaaataaaattattatttttattatttttctttaaaaatgattcaaaatgcttttattttttcttttatttgctttttcaacaaaatattttttgccaaaaatgtcaaaccggccatcaatctgatcaaatattcggctatcatttctccgccgggtttttataaaattgcaatttgggacagatttgaaaagaaaaaagcacaacaatgcaaaaatctttttgaagaagttgaacaagaagtaagaaattaaaagcatttttataaatattcaattttggctaactttgccctgaaactttgagagtgatttttcattatgccaatattctgccaattcgggaatagtaattcataaattaaatattctaatattttaaataaaaattctttcagtaatttttaaagtttcaatttcaaaaaacgattattttcaaaatattttctttttttcatgggtcaattgtccgaattttgaaattttgtgctttttctcccaatttaattgtctaaatttttacttttaatagttcaatggtaaatttcatgctgttcgtcgcttcaagtattatgatggcattgaattagaatattttgctgaatgttttgaaaactttttcattgctcagacaaatgaagacggtgaatttgatgtgaatttaatgggtaacattggagaaacaatctttttccaaatatttccactctataataataaggtaattaattagaaaatattaaatgcaattaaaatatgacattgatactaatattcaaaacctatttatagctaaacgaagtgaaatttgcatattttgttaatttctttaaattaaattttcattaattccttcttcaggctccaatccgttccgattctttcccctccacttttctccaaagcatacacagaaaacccgattggaggttatgtgtgcattttgagcaacatttttattttctaattcataaggaaaaaaagactaaaatcggcacaatgttggacaattggcagagaagtgccaatgccaacccatcggatgaagaagcctttttcctcaaggcatgtttacaggaaatagcgtcaagaattgttgacacattcaccaagggcatcaagctgaccaataatgaaatcagcatccagcgcaaatattggagtgcatttcaacagatgaaagggcatggaattttggccggaaaattggcacaaattgatggaatgccaaagttaatgaaagatttatgcagatttacggttgctgattatgaggcaaactccgccgatggattcgaatttaatgacaaattattgcctttggctttcttttgtgcggaatttataanaaatggcaatgaaaagcatgagagcatattggagagaatgaagcttgtgaagtttgaaaaaagtggagaggaaatgaacaaatgtagacattatttattttatcacttttattttttgtggaatgggattaattagttt

SEQ ID NO: 10485 - DNA, 1718 bp, Heterodera glycines
  misc_feature (1661)..(1662): n is a, c, g, or t
aaaaataataaaatacagaatttcattttcaagatttcccccctggttcttcaattaaatggaaattcattttttgacgcattaaaatgatttttttctgattaaaaaactgaataaatcattattttacttaataaaataaggaaatcctgtttaattgcaaagaaataataataataattttatcttaatgacaaaataattgccaattggtaaattaatgattaaataaaattttattactttctactggagctcatttgaaaataataaacatattttcaataaaaataaaataaattcacaatgtaaagagattttagaaaaattaaagagattttatgaaatttcattatatcagaaaattggtgtaaaattccaaaaatgaaattttagcgccaaaaatgtgctgttcacgaaaataatagaaacttgaatatttgaatgctttgaacacctgtgggtttccacaacggttagccgacttttgcgccgcagacatttgcgccgcgccatttgcgccgcgacacttcccaattcttataagcgaggacggaggctgtccatgcgccgctattatgggactgattttatggattttatcagcgagcaaggagaggaagaggaaattggtcttaatttcaaacagggaattgtccgagtggggcacgtccaattgcccatgattgcagccattaatattgagtgccgaccgatcgaagtacgacttttgcaaacacacactctcccaccgctctcggattccgttgggtggggacggataaacagaaatttgagtcctgaggaaacattcatcaccgctgagagagaacacgactattttccaatacgtgtggggaagtgtctaacaagtcccggggcgacccgaattgtaccactccgcttgttaaactttggaaattgtgacataaaagtgcacgggggatcccgcttggctgtacttgaaccgctttcagctgacacgcatattaattggttgcgaaagtgtacagaaaccgaagaaagcatgctgatgaacgacgaggaatggcataaattcaaagcagaaagtgatcaaataccaccggaagccgattggacagatgaaactctggcgttcccaaaaaatggcgaggccaccaagccaattttggaaagaatctcgctgaaggaatcaattttgagtccgggaggaatgataaaattgaggcaaatcatcgaaacaaacgaatttgtatttgtgaagccgggcgaagtcggtctctttaaggggaagacaattcatcgaattgatctgactgaggtagccagaccatgtcaacaaaggccgtatcgttatcccgtggcactccaaccagaaatagagaggcaagtaaaagaattactgcgacagaatgtaatccgcccctcttcctccgcttgggcttctcctattgtgcttgtacgaaaaccggacgggtcctacagcttttgtgtcgattatcgaaaattaaatcaattgacaaagcgatcaacatattatttgccgagaatccaatcgattcttgacgaagtgacgggaaagaagtatttttcggttgctgactggctccagtggattcttccacataaaattggctaaagagacatgaggaaaggagtgcctttatctgtcacatggnngctgtttgagtggctacgctgtccatttggcctagcgggagcaccacaacttttca

SEQ ID NO: 10486 - DNA, 1978 bp, Heterodera glycines
  misc_feature (17)..(17): n is a, c, g, or t
gccctgaaattaatatntgcgaaaaattttccatttgagattgaacgatgtctcaaacaccacgaagaaatgcaacatttcgaggacctagtttttgatgaaaatgctgattacgttaaagataaagatatttgcaaaaaatttaattgtgaaaatattattttattgagatgtgcctattgcaaaatgtatttgtgttttaaacatttttttgacgattatcacatatgtgaaaatgaataaattttaaaaggaatgaaaaaaattttccgctgtgttgggatcgattccttggccattcatttgcataaaaggcaaatataaaatgaggaaaataaaattacataagagggattcaaacctatggggcaaaaacaaaagtaaggagcacaacctccgcaccaccgaacaacacaaaacagtgtaaatgtttatttgatttattgggataaaaaaaagtttggcacgtcataactcggcactcgggctcattccgcaaaaaataaaaccacttttcttaagaacccaggggtgctctaaccacccaccaaatttcattcggaaatcccacggacacctggggaccttcctttgtcagcaaataaagaggacagcgaaaagcggatttggggcttggtgtttagggccattttggcccgcccggagctgcgacgaggggccccattttgggtgtccccgagtcccaacagtctccagagtagggctttgtcactcccaatccttgaattgactgttttcacttattttcactaagaaaaatttcaaaacttagggtatttaaaataattttttttaatacaaatacaaaaaatttgaaaaaaaaaactagaaattatcatagtttttctgataatttttctgcaaatttatccaatttttcttataatcatcctttcaatcttcaacgattcttttatccaaacagtttcttccattttgaaatgttagttctatcacttttcaacatctttgcaatttctttctcactcatttctggatattctctttttgtttgccaataaattttcattttttccattttttctttctccgttattttactgcgaatgccaaaatgtttcttccatttgtaaattgttccatggcctactccaattttcttacaaatttcggcataattttgttgccattcttttctcgtatattttcttttttgcttatattcatttatcatttcaataaaattctgtacaatttctaacttttcttcatcagtttttgatttatagtttttatgaatttgtttttgaagaccaaattctttgatccattcagcaatatattgacgatttgtccccaattttttcgctattttcgtattaattttattccattcttttgttgagtattttcttcctttttcctttattttctcttttattttatagaaattgctaattatttcccttttcttctcttcatttcgtttttcttcttcttttcttcccatttttctccaaatatttcatcaaatgattttagttccaactttttcttttctgttccgatttgattaatttgagtgatcaaaaatataaataaaacgattaataggtggagtttcattttatttaaaaattctcagaaaaaattgtatttatttaaaaataataataattttaaaattaatatgtttttttacataacaaaaatcgcaactctattgatttcatagagatcagaaaaacctttttattaaattttattctactgaacaaatattggaaaaaataaataaaataatcattacatttaaatataatttttccttctcaaataacaaattaaaaatttataatacaagtattgtaaagattagttttcattatcctttaaaatttatttatttattttcttgacaattttcattttaaaaattattttatctcaactgttgatttggcttaagtttgttgtaacctttttggataaaatt

SEQ ID NO: 10487 - DNA, 3376 bp, Heterodera glycines
  misc_feature (49)..(50): n is a, c, g, or t
  misc_feature (89)..(89): n is a, c, g, or t
aaagaaaggaaattttcagattcggcgtttcattgtcagaattttgttnnaaagggaatagagttacgcataaagggcattgtatttgnaaaaataataaattaggtgggaccagcttcactgcttttgtttctttgcagttgtcttggctaacccaaatcattcatcatccagatgtgttcagcgttacagactatccgcagtaaattcttttcaaaaccttagaaaattcatttattctcgcttccttttcttcagtcatccggtcaacctcagctgtctcaaggttttccctgacgaacgaaatgtcagcgtttggaagtgtttggatcttgttgaggtttcccaattttaaatatttttttttgaaatacaacaaatttttgctaatttgtcagatactcttccgactcggcgaagtgcctgctctcgacacacatgtattgtttgattacattttctctcttattggttttaccacgagactttcttttgcaggtcattggtctgtttcgaagccctggtcccatgctgttgtgtcccgatttgctctttctgggcactgtacaaatcaatgttggttttatacgatgatattggtttatcaaaaatgaagttacagagttacactgtctttgggcttttgaaaacattgacaaaaacgttgggttccatagtcgaaattaattaattaccgcggataatttgggactaagtttttgtttctatatactaacagctttcgaatgttccagaaatgtaggcttttttccaacatgaaaaacttttaaaagatgtttagttttgagccggacgcataaaatatatcccaataatagagccataccccaatactccaatactagagccatttctatctttttatagatgccactgactcaattgcgcgtctatgtgctgaagtgtctcatcgccactttgttgtccgggcatgcgaacaccgtggcggttcttcaatttgcattgaattcggagaaaaacaaaatgcaaatgcatgaaatcctccggaattcgatggtcggttactactcgcaaaaccttgaggtatgtgcaaaactgcccttttttgttgccgaataacaaattcaattgaatttgtcccgttttcaaggaccagggtcgactgacgcgcattctcgaaattgcgcacgagctcaaaattcttggagaactgctcaacatgacccaatttgcgttcgtcatcgacttggccacacttgccgcccgacgggactatctgaagttggacaaattcattggggacaaactgagcgagcatggcgaacgctttgcgcaagacctgtgtcattacttacgacgtcgatgccccgtgttgaccaccataaacccgttggccaacgacactttccactccatgttctccactttgcaacagcgggcagcctcttggccagtgatcacggccgatttgaaccaactgattgcgcagatcagccgaggaaaggtcggttgcaaggctttgtagccgttttttgccaaaaaaaggaatatttttgccattttgtgatccattttttgaagaatattgcaaaattggggtccggtttatgccgttaggcgccgtcgggagagtttttgggaattttaatccaatttgttaagagaattcctttttcctgttcaggcaacgcctgcatcagcacagcaatttggaggcattggcagtgctggtagcgttggcgctggtgtcaatccgtttgtgccattaaaaggacagggggagccgcggatgttcggcgcttcgtcaagcgcagcggcatcgggcattgccaacgccttcacaatgttccgccatcagcacgccgaccagcagcagcaaatgctgcgaagcctgcgctccacgcccggcgcctcggacttccacgacttccgtctgaccgcgcaaataccgccaagtccgagcaatcaacagcaggccgagtttggaggtaattaataaacgcgcgtttcattggtcatgcccgcattattatcaaatcgctcccataaaccatatttaaagggtccggatcatatgttactgatagaaacttaagtcgattaaaaatttcccaaagttttaattccgaaataatcatttttttataaaatttttagcaaccctttcaaaatttttcatttcccttcgaaagggggagggctgggggcccatccaaatgcatatgctcatgatatttatgactttagtattccaattttgcttacagatgacttggccaccgcagtgttcagtgaagacatacaggaagaagcgaactcatattttcagcaggtttcatttgtcctcaacttaacaattactattttccattgtcgtccatagatttatgctccaaatggtcgcatgtctgtcaatgatttcatcgcaaaactcaaaggttttcggcattctggaaacatcaaagagcgcgtgagtatttattttgtccaccaacgaacaataaatctacctcccccttctgatcgaaattttttaaaaactagttttttttcatttaaaaaaactttttcaaacaaaaatttccgtctctttctaggaattgctgctgtgtgtggtgaagaacttgtttgatgagtatcgcttctttcgcgagtatccggagagggaactgcgcaccacggccgaagtttacgggggaatcattcgggaagagataattttgtatgctttttttttttacttttttgaattcatcgcttttaggcagccattatttaaccgttcattgtttaggaacatccaatttgcgactgccattcgacgtgtgattgaatcactgaatgacgagccgggcagcatgctatggacttttggcattgtggcactgagtgcgtgtcgcgcatgcctctacaaataccccaaagtgtgccatatgatcatcaacacgaacagctatggccggtttccgcccggcttgaaggactacgtcagtgccggtgcgttaggccaactgccgatgaatcactctgcggcacatgatgtcagcctgttttcgtctaaccaacaactacaaccgttctttccgcctgccaccggtgaattcagcgtcccaattgtgccgatgccgaaaatgtccatgccgggccttggcgccacagcagcgaacatgcgatttgccgcgcccactgtggggacgagcacggtcctccgaacgaaaaacatggattaatttaatatttatttagggaaattccattttgaatgtgaccaacgtggacacgctgatctcggccaccgaacgcgaaggcacccaagtgaaacagccgccacaacaagtgctcgagaaagttgcattcacctgcaacaatttgtgcacgaacaattactcgacaa

SEQ ID NO: 10488 - DNA, 2219 bp, Heterodera glycines
  misc_feature (9)..(9): n is a, c, g, or t
  misc_feature (19)..(19): n is a, c, g, or t
  misc_feature (31)..(31): n is a, c, g, or t
  misc_feature (59)..(59): n is a, c, g, or t
  misc_feature (72)..(72): n is a, c, g, or t
tgttcgtcnagactcaagnaattgactcacntgatccgagaaaacggtgacgaattctnggaatggtttgcncagtatttggtgatgaagcgtgtcactgtggagcataataccaccaactgtacaacagcttcctggtgttgatcaacaacaccgcactggacaactacgtgaagaaggagacgtaccgcaacatcaacattctgctcaagagtgacaagcaacagtcggtgtcgaattttggcgatcgccaactgctgaaaaatttgggccattggcttggcattatcaccatcggaagagatcgaccaattttgaacaaagacttggacatgaaatatctgctctttgaggccttctacaaagggcaacaagaactgctgtacattgtgccgttcgtggtcaaatgcatcaccgccagtgccaagagtcagctgttcggtcctcactgtggttgggtgtacgccattctgaaggtgctcgccgaaatacacaacgagccggacctgaagctgaacttgcgctttgaaattgaagtgctctgcaaggagttgaacgtcgatctgcgaagcattgaagttggcagctacctgaaggagcagcgacgtttggtgagtgtgaaacaaaaaaaattttccgatgattgtgcaaaacttttttaagcccaaattggtgccgccctccaaactcggcacaaccgccgcatctccaacattggcacaatgtcagttgccgcccatccaacaaccaccacaaattggcgctgggatttcagcacaaagcacggcggattatacacccactgacatggcgaacatcctcactgaaatgagcatctccaggaaatattcgccggccagttatacgcccggcggatcgcaacaacaagttccatcaataacagcccatcaaactctgcccaccttcaactacgcggacattgctttgcaatctggtacacatttatacataaattaatttgtagcaaattttgcctgttttaaggcattttgcaaataatcgtcattcctccacatttgatgcttttccaagttcatccgcagcttaaagcgacatgcaaaattgccattaatcatgcaatcaaagatgtctatggtaatactaattcattatagttcattgaaaaatttacaaattttttgtttgtttttaggtggcgtcgccgaccgcgcaattagcgttgcaatcgccgccactgaacaaatctgtcgcaaggacttcggcctggactcggctgagcaaaatttgcgtcgtggagctcaccaaatgatgcgttcaatgactgcagctatcgcatcaattacgtgccgtgaaccgttgtcacagcaaatgaacagcattctgaaaatgtatttgaccgacgcaatgggaaatgttttgcccggaagtgaccaggccaaaatggtggaagaagcggccaccgctgtgaccgacacgaacatcaacatcgccacaaatttcgtcgtgaaaaacgcgtgcgaaaaatcggttgccgacattgagaaacggcttgagccggagtacgtggcgcgcaaaaccgcctcagacgaccgtccgttccaagttgacgccgacatggcggaaatgagtgaaaaagtgccggaaatgatcagactgaaggaggggccgatcagtgaggcgatgctgaaggtgtacgacgacttctcatcgtatgtgaaattttgattggtttacttgtccccattttttaaaattttattggaaaattttgtaggaaaatctgtggcttcaaaccgctcgcgcccgaggacagatttatcgagtttaccaagcctggtctgatgaacacaccaactgctgcttcttctcgaacgccgacaaatgtgctcgccacaccgttcatcccttccagtcaaatgtccatgaccgatgttcgtactccgaccaccactctccatggcgtcatcccttcccatcatccgccgcccattgttggtcatcccgccgcgcccattatgtccgcagaacgaatggcacttccgcccggcattttctctgaaggccgcggcgccttctgcccggcgccaggcaacgaattgggcgttcggactgaggaccaaattctgcagagcaaagtggagaacatcttgcgcgaatggatttccatctgttacactccgatggcgcaaaaagacccgcaacatgcgctcgcttatatcgtccaaatggtactttcg

SEQ ID NO: 10489 - DNA, 2706 bp, Heterodera glycines
cgatcagggttctcaattagtgatcactcactttatttcttcctttcaaacagccttttaatggttggccagatcaatgtgcccgggactgtgtacaaaaacggcaaaatttgttacaattttacgttgcttaaagtattacggtattattgtcgtaaaatatgtttaaacacagttcttggcaaagatatatttgtttttcttttcatttataaacaatatttgaaatgtttaaataaaaaaatattaattaattaattactgtaattaatattaaatattattatttttgccataaataaatttaatttcattattaatgtacgcatttgaaaatggtgtgaataaaaaatgtgaaaaatgaaatggcactttgtttttctcctacacttgttgtggcatgttcacaggtggcggcttcggatgtggcatcagcaattgcaccaaattcacataagtggtggagggcggctgatcatcttttgaataagaaaatttgttgaaacgaaaacattttcggcggtaaaaaaacgtttgaaaaaattccaggcaaaaaatggggttaaaattcaagaaaattttgcttcaataaagaactcggtaaatctcatgatactaatggcgctgcggtttagtcgagtcttgaagacaataaaatgtcaaaatgttcgcttgggccaagagaattccaggccagggaattaccgaacaaaaggggacccaaagtgcccaaatttcctcaaaacccaattctcgaaagcatcgccaattttggcacctttgccgaactgactgctctccttccaatgccgtcggctgctggacatcattgaagatgatggtattgcttggtggtgctgctgttttttgaatccggcgccgactaagccggcgccgctgcgccgggttcgaatccgaatcagaaacagtccgagcgccatcagcgcacatgcaacgccgcaggcaccgaacaccgccctggagggaaaaaagagagaattattagccctaattaccccagcaattatggtggtttaattaacgtttcattagctcaaattaggtcgcattaggcgatgagttaattaacggttcattaaccttaattacttctgatcaggggatttgtgtaattaatgtgcttttaacagataaaaatgttttcaacatttttatgcctaaaaatttcgaccccccccaaaaattgaattggcaaattctcatatttctcgggctccaaaccgagacaaatattctcaaaactaagttcgagtcttgactattcccttcgtgttttggccaaaatttggtcacgaatttttgggccaaaatttcaattctcgaattttctgggtttgggccaatcgcatctctcgctgctcaagaaccgggcctcaattcttgaggcccccgagtttctgccatagtgaattgccaaattaaattctaaattcctggaccatgcccatggcggtatgtgactgcgtgacggcaccgtcggcccatcggcataactgtgccggtgccgcgcgtgcggtgtggacacaaaggaggacggtgccgtgccaacgcccgctgaaaattctgccggtgccaacgctccaaacacttcggcgtccatgcgcagcaacatttcgttgagcacctgtgagaaaaaataaaatacagtattccctaaaataaaacccccgtgggctttatttttcaacccctctcaaaaggggaaaaaattctcaaaaaaccgaaaattttttgcgctcctggccttacaattaaaaagcccgtcctcagtatcagggaacccgtcccggtccaatctgacgattcaacacaactctcgggacccaattctcgagtcttggaaatttcgaacagccccattaagcttggtcatggattaataacaatatttgtgtgcgcactttgaagagagggcgtgcgtcgtgttggagttgcgcattagcatcaaacaaaatgtgccgaagcgcgtggccggcaaagtcggggtgaagccgactagtgatcagtgggccaagcgagaggaaaagcatctgaacacatataactttgaaatagaaggtacaagcatttgatcgactcagtcgggaaaaggggttaaaaaattattgatcggaaacgcatagtgatcggtgatcaaagaattggtcagagcgatccaaagttcggggaattggtcgggagttgaccgggataaaaaatcaaaattcaaaaaggattcgtctgaagtgatcagggtttgcgataacagtggaatggaaacaatttttcgatgatcagacaatcacaagacagattagtttgtctgccgttcaatttgaaagtgattatgggatcaatttgtcggtgatcagtcagttaatttttgcaaaattttagagtgatcagggtttaggattaaagtagaacgagatcatttgtcggtgattaggccaattaacttttccacaggacagagtttatatgctcatttttcaccggaaatgggccgttgggccgcgagtgcgcggacgactgaggcccatcggtggactgctgaaaaaattaaatttaaaatttcaatttggtttgattttcgaaacgaaaccatttgtggcggtgttttgacaatcaaaatcagaatgtcttcgccacattcgcccaaatgccatcgttcgcgcaacacttgcgcataattatccgcaaaag

SEQ ID NO: 10490 - DNA, 2365 bp, Heterodera glycines
aacaaaatgtgctcaatcgggtggcggccaaagtcgtggtgaatcggagttagcgatcagtggcccaagcggagaggaaaagcatctgaactcatataactttgaaatagaaggtacaagcattttgatcgactcagtcgggaaaaggggttaaaaaattattgatcggaaacacatagtgatcggtgatcaaagaattggtcagagcgatccaaagttcggggaattggtcgggagttgaccgggataaaaaatcaaaattcaaaaaggattcgtctgaagtgatcagggtttgcgatcacagtggaatggaagcaatttttcgatgatcagacaatcacaagacagattagtttgtctgccgttcaatttgaaagtgattatgggatcaatttgtcggtgatcagtcagttaatttttgcaaaattttagagtgatcagggtttaggattaaagtagaacgagatcatttgtcggtgattaggccaattaacttttccacaggacagagtttatatgctcttaatttttcaccggaaatgggccgttgggccgcgagtgcgcggacgactgaggcccatcggtgggctgctgaaaaataaatttaaaatttcaatttggtttgattttcgaaacgaaaccatttgtggcggtgtttggacaatcaaaatcagaatgtcttcgccacattcgcccaaatgccatcgttcgcgcaacacttgcgcataattatccgcaaaagcggtgaatgagtcgaacagattactgaattactcacttagtttattttaaaaaaaactaccgaagaaaatttagtaaaaatgccaatttttggtaaaatgccttttttagaaaatttaaatatttagagaaaggcgttttctctgaatgtaccaattaaattaaatgaaatgtcagctaatgatgaaaatggataatttaaattttaaaagaattgccatttttaaataaatgccacgccattttaattttaatgcattttccattttggcacggaatgccaattttaattttagacgaatgcctcctcaaatgaaaaaccaaatttagaagccttataagcaaacccaaaaatagcaatggcatttgcttaaaatctaaaaatgccaaatttagagaaaaaaaattaaattcaaatttaaaaaaaggcactcacttaatactcaaaaatgtcaaactcaggaaattacaattaaaatttcaaaaaaaataataatttgccaaattggtaaaaaaaaaagaagattttaccccttttcaggtggtaagaataatctgttgaatggaagctgttcattggattcattttctgcttccaaactgctgtttgttgtgccaatttcaaaattattgttggcacaatgttcggcactaaattattaatttttataaaaatttttttttttttttttgaaaatttacgaggccgaatcgggcccaggactaagctcaggcacaaaggcaaacccaaaacggaaccagcaaatgtcgggagaaagaagctgatcttttggagcagaattatctgaaaataaaaaagaaataaaaatatttgaataattaattataaattttaaaatttaaatacaaaaaaaataaaaatgatataaataaattaaataatttactcatcaccaatttccagtctttgaacattatcttcatttctacagatgcaattgtgccgattttgttcataaattcgtcgcaatgtttcgtcaatggcaaaaacttgacaataaaaaaataaataattgtttattataaaatttaataaatcaaaatattaaaggctctattttcattaaaacattttaatgaaaaattaatgaatattaaatttataatcataaaataaattttgcttcaaccaattttattttaattatacaaaaattcgtacaaaaatacgatttaattgctatttaatgcaattaaaatgattttaattctgatatattacgcaaaacaattaattaattaattatttttgttatttttaattatattttaaatcattttttattcttccattaatcaccttccgacatggacattgtggagcccgggtcgcaaaaccatccgttaagcaattggccatcctccaaatcggcgccgccgccgtttccgcgtcctaagccgcccctctgacagccgttggcatcgtccaaactaaaatatgaaaaaatgggaaattgacagccgatttatggacaatagactatatcattatagagaaattttcaaagaaacgggaaaactcttgaataccccatgattttttggaaacattggttagaaaaataacccccagaaatttaaagtttccagaaagacggcaaag

SEQ ID NO: 10491 - DNA, 1882 bp, Heterodera glycines
aagggatcgctcctccgccggagacggcaaagacaacctccgatttgaattgtttcgactgaatgatttgcaaaatgtgcgactgagggaaaagttacggtgggaagcggtggacacttttggaaagggcgcggcggaggaaaagcggcgatccgatcagccgaaggtgggggcacctctgataagtcagtaccatcattcgccatgttcctcagaatgttcgtccttcgtccgtctttcgccccgcggtgactgttcagtccgctgacattgtccgcgtccgcgccgatgccatcgtcgacccgctgaagggatcactgttcgccgcactgctccaatcgccagcggaggaaacgacggaaaaagtgttggaagcaaagtccattttggacgtattggaaatggaggacgatgaggaggaggaggagaagggaatgtcactgatcagcagggccaatgtgaggagacagctgagagggatggcacaactgctggaggaggaaagtgccaaagggaacggaacggaagagaaaaggagcgccggaaagagagccgcgagggcaaagcaacgtcagcggagggggggggaattccaaatgaattaaacatcggcattttgttttcaaattgcccttcctttaaaaatagtttgtgccaaatccagtccgttgcagaattggagcattggctgcaggcattgaaagtgccgcaaacattcgccgcccttcgggcagaagccgaacgatggcgacagacgaaaagcgccatggcgggcgccgaccagcgaattttggcacagggaggggccgctttgaaggaaaagctgcgcgagttggcgcagcgacgcggcgcgggcgacgctttggtggcgggggacgcaatcgcaacggacgcattcgaaatcagcgacaaatattatgccaaaggtaaaaaaatatttggttatttctcaaaaaaaaaatctttctcagcgattattcacaccgttccgcccaccgatttgctcactcaaagagacttcgaaaagttggccgactgttttcggcgctctttggaaatcgcttcttcccgtggcttttcctccgtcgtaacgttccgtcggcttttgacctttgattcgttgaagcaaatttaggcttttcctgagatgttagcaaaaaatgcaagcgaaagggacaaagagcgggcggcacaaattggcgtcgaagcggtggccaaatggatggccaaacatccgaagggaaaggtaaggccaaattatcacccaattgcaattaattagtcattccctaatgtcaaggtcaattccgtccttttcgtcatccagcaggacaacaaacacatgttggagcagtaccagcagttggtcgagcagaaatttgggaataaaaactgacactttccacagttgttgttttattttgagcctttttcttaaaataaattaaatggtgacttttggtcttttgcgctattttgtcgtttcgtacatatcaatttcattaatttttaaaaatcacttctctcattccctttccaatcaccaccctttgatcatttattgtcaatttcttccccctctttgtccgctttgatcactttctcacagttcccctttgatcttttctgatcactctctccccctcccttttgatcacttactttgtcctccctttccgtcggtcatttgcccttttcgctggcccatcactttgccattttacgctcttcctctgctcatttaacttgggagtcctctgattttgcctgtgcttttcccgaatgattgatgggtctcggggggggggggggggggtcgtaggatcagctgaggatcgctacctctaatggaacaatcgtcgaaatctctcgcctaatcaat

SEQ ID NO: 10492 - DNA, 826 bp, Heterodera glycines
cgcccggggcgatgtttgtactgtccattggtaaatggtttggccattttgcgcaccggagacgcgaggaaacggccgaaagggaaaaggagaggaggccgaacgaagtgggaagagagaaggaagagataaggaagaacagggaagaggaagaggaagagcagaatgagaaaggaccagctgaggaggaagagaatgaggaggagggacaaagcgaacaaaaaacaatggaagcggaaaagagacaaaaggaggatgaggaggaggaagaggaagaggtaattgctttcgattagtggaacttttgtccaattgttttgcttttcatttgccctttttcgctttttcagtccgaagaccgatcatcgacggatgagaatgactcttttgcgcttgaggacggcacttcctccaccgatcctttggactcggcggatgagctgttccttgaggcgtccgcctttgccgagttcacggtcagcgaagacggctcaatttgggaagggaccggcggatggggcgaagcggacgacgcgacagacgcggagtacgagacgagcgtggaggaaatgctgatgttacggcacgggacggtggagggaaagcgcagtccaacgccaccctcaaaaattggcacgatttgctcatcggcggaagacgaaggtaagccggaggaaagggcaggacagaatgccaaaagattaaaaaggcacacattgaatgtggactgatcagtcgatgctttgctgtgatggataagtcggccctcccaactcagtacttacgtctttatgggtcggtcctccgcccaactcagtccctcgtc

SEQ ID NO: 10493 - DNA, 3129 bp, Heterodera glycines
  misc_feature (38)..(38): n is a, c, g, or t
  misc_feature (3021)..(3021): n is a, c, g, or t
  misc_feature (3085)..(3085): n is a, c, g, or t
aaaaggcttaagcatcgtgcacagaaaagaaaagaatncctgcaaagcaaaaggttggttttgctttccctcccctccccctcaactcataattagcattattagactcatttccgtgtttaaatttaagacggaggggtcgtattaccatcgaagtggacaatggccgccggggtgaagacgataatcggaggggcggtggaagcagtgatcgccacaataattaggacgaccaaagtggaagtgattcgtgtgaagcttgaggaggaccaatggatgggccaaaacggactaaaaggagaagaggaggaggaaaaggaaaagggagagcagaaaggagtgggaggaagggaaggggaaaaggaggaggaaaaggaagaggaagagcaattagaagagcagaaaggagtgagaggaaaggaagaggaagagcaattagaagagcagaaaggagtgagaggaaaggaagaggaagagcaattagaagtgcagaaaggagtcggaggaagggaagggaccgaaatgcataaaaatggcaaaaaagagcagcaacagcagcaaaaagagcaaatggaacccaagcagtacctggcggtgtacacagcacaaacatgcatcaaaagagcagcaggtggacggattagcaattgcttaaacaatttattcaacaaaagccaaccacaatttaagagaaaggcggaaaatggcaaaaggaacaaaatggaacagcaaaagcgggggaggaagacgaattgtcaatttacagcgacgcattggaagagcaatcggcggaagaagcagacgaaccgaagaaggaagagagaagggagatggaggagggtgggaaagagaaagaggaagagagggaaagagaggaagagaaggagagagatgaaggaaaagatatgaagaaaagggaggggaaagaactaaaagaacgaatggaagaggagaaaaagggcaaagaaagaaggccaagcaaagaaatggccgaagaacagctcgtaaacagtgagacatcggacgacgaatgcgaagaagaggaagaggaggaagaagaggaggaggaagacgatgaggaagtggaggaatacacggacgaagaggaagaattgtgctcggagatgtcccaagtggagagggaaattgagcggatgagaagggaaagtgtggcaatggtggaggaaagagaagtgaagacgaacacgccaatgaaaatggcaaatccgaggaacaattcacccgaaaaagcagcaggtgaagaagccgcgggaagggtggcggataaagagcggacgccggtggacgtgggcgtatactccgggtggaggagtacggtaatggacgggaaggatacggtggaggaggaaaacgacgcggaagacagaacggaaacgccgaaaccgcctaagaaggagcagcaacagcagcagcagaagtacgccaagacaaacgacttccaatggccgtcagaggcgcgacgaatgacggcggcggaagaaaagccgaaacaaaggggcaacgaaaaggaggagggggtcagttgagggaatcggagggggggggcaactcattagagagggagcggactcattagagagggacgggggttcatttgaagagacgtaattggaaaacagatgagcaattcgaacgggtggccaatttaatttatattttaaatatatgttatgtttttttccttcagctgttacaggaaagtgatcagagttcagcccctctctctgctgtccgaattgggactgatcagctgccgagctcctccgcttcttcggccttcgcccacgggactgatcaaaatcggaatgtccctttttctctgccgtcagtttcggttgctccttccatttgcagcgggtccaaaccaatgccgagccaaatcagcgacaaggcgatcagcagtttggaggtgggcaatggcaaagggatgctcgaaccattgattaactgataaattggtcagtccctccccctttccccccgtattttttggtgtcctaattttgcataaagttacttttgcccattctgtgctgtgtcaattaatcaatccatctgcgatggttatttttgtgactttttctgtttgtcaaaaggaaaacttttggccattcttttttttctttttcattgtaagacaattctctttttttggggggcaatgaataattttggcgttttctttcttttcttcgctatcattccatcaacgaattgaactgactctgctgctcatttgtcagtccatttgcatttttcgggctgtcttttttcttattttaatttttccgtttttttctaaactccgtttttatggattttctttatttaattcctttttttttggtttttcgttttcctcctttctggcacttttccaattcgtttgtctcccttttcttcgcccccccccaattcgttcacttttcgccctttctttttctcagttcactcactttggcatccgtccttcttctgccactcaaattctccaacagagcgatcactttcggcacgtgccctcgtggaacaacggaatggtcagcagaagcaatcgccagtctctgatcagatctgatcacccgctgatcagcaaatattgctcggaagtggcgacaacggcgaaatttggcgcggaaaaacggagttggcaacggacggagaggacagaagaagcggcaaagaagccgaggaatctgctggagatggagacgaccatcgccatgggcggctccaactttctcagggtaaggcagggaaaacacttctcgagagtgcctttccgagaatggctttcctgttgccttccttaggatccctattcgcacattgtgctgtcggatgccaacggagaccacgaggaccccggcagaatcgccggcggggggttaccaccccgcgcggattggcgaactgttcaacagacggtaacattttgctgtcaatggcacctccaatttgcatcatagcttcctctttcagttacatggtgttgcgaanattgggctggggccattctccaccgtttggatgtgttcggacgcggcgacaacgaccgaatcgnaacgatacgtggcgcttaaattgtcaatcccacgggactctctg

SEQ ID NO: 10494 - DNA, 4184 bp, Heterodera glycines
acaaaatttgattaaatttttgttttgcttttttcttacattttcttaaagtcccggtcccgctctactctatttttactaaatgaaattatttaggaaacttcattggagttacggttttttgttggccatttgttcactttgtgacatactctccgaattggccactccattggctaccggtaaaaataattaaattttatttcaattttttttattttttcaaacattttttagttctcgtttttcttcgtaaaaggattcctctgttggcttgtgtttatgcccaatttttgcctatcgctgcaggcagtaattcatacataaatctgttttggataagcattgaccgatttgtggcattggcattccctgttttgtataaattaataattaattagagtgtaattatgcccttactattattctacattaaaaatatttagtgttattcttttttttacgaacttttttttataaatattttcaattttagaaaatttaattcattttttcttctttttattcttaatcggtggatttaagaaaatctaagaatatttccgaccatgattattattagaatcagaattttactaattaaattttatactttaagagataaaatttatttaaagtgatttaaattaaagaaataattattatttaatttttaataaaaaatatattgctttagaaccttaaaataattgttttgaacatttcttcctcctttgatttaggttctggaccatatatttttctggtttctgtatttttctgtctttttatactgaaaaaacagatacaggtccatatgggaatacagtagtacaggcactctcgaaaacaccgaacatattttttattttcttatgaccagaaaattttttgaaaaatgcattcgcacgctataaaaattaataataaaaaataataaatcgactaatattatattaaaaaattaaaacttttcatctttagtttccgcaacatctcaagattatctggcaaatacgtgataattgctaatgtcttgtctttgtcaattattttttatgttgtttatttgtcgtttatatttgctctacaacatcccgaaatgtaactaattaattaattaactaattgaaaataatattttttatatttaaatagtatggtctattgtgagcctggtgatatgatgcaaggtgaagtgtatttgctcgctactcttatcgtggttatttttactttggctacaactgtaatttatattatcattggaattatgctgaagggtaaatttaattacataattaaaatacataaatttaaatgacaattttacaattcgttgtaaaaataataagttttcatttctcagtgattagaagtgatcagaacaacagcaacaattcttctcagtcccaaatcgaaatcactcgtcgcattttcaaatcgttggctgtgatcatggcagtgatcttttgcttttggtttttgtttgcactgatcgccaacattttggcacgaggactgatcaccagcgatccggcactgcaatttcttatcattcgattagtgacgcaattgcccttaatcgctcgagcgattaacgcacctgtgctttacttttgcaggtaaaaaaatgaaaaaattaattaaaaaatacaaatatatcatttaaaacttatatgtaatgatttttagaatggtaaagaattattttaagcttaacttctttttatttaaaatttattcaaattttcaaaagttcataatagcaaaaaagaaaatttattaatagagcttcgtttttgaggtacaaaaaatcgcgaaatcgacacataaaatgcctaaaaaatcgaaaaaggtagccattaattttagttttatttcatttgtaaataaaattatgaattattaaaaaaataatttcgaataaggacaaatttttaagccaaaaattttatcaagaaaaaaataatgattttgggaccattcttgagaaaattttcaatttttaaatccttgttaaataattaatattatttcattttcagttctgaatatcgtgaaataataaaaagtgaatttccatgggttaaatttttgctgtgttcaaacaatcataatcccccagtcgttgttgtatctgccgggccacaaattctcaattcttcgaacatacaacaaatgcatcataactgatgaattgtgaaaaattttaatttgtcataataaatttcataatattttgatttatatacgtataaaattaattaaattattattagatggccggatttggatttatatgtgctaaaaacccaataatgtgagaaattatgtgttaaaacgaaaaccataaagttttaaaataggccatttcattccgtcaaatattattttgcttttttgtgccaagtaaagaaaaattgaaaattttttagtcgatgaaaatttttttaaaaattaatttttcttaacaaattttaaattttttggccatatgcaaaaaatgcgataaaacttacaaaatataattatatgtgcaaaatgcataaaatatgctttttttattcggtaaaaggggattcgtaaaccggtaacagtttttcattgtggttttgcgaaaaaacaaaatttgtatatcctaaaaatggtaaagatattgatgcaacaatttcggaaataatgacaaaaatccataagaaatattgtgaagagattggaagagggcaaaatatagagaatacattaaataaaatggaaaatgaaacggaaaatttaatcaaaaatttgaaaaaagacccgaaattgcaagaaaaggttcaaaatatggttgaaatggagctgagcaagaaccgaaaactgaatgaaaaaattcaaaacgcaatggaacgcagaaaagttaattccttctacgatttgcttaacggtaaaatttaaatttttattaatttatttactctttttagccgcttttcaaacattttttggaaactgcaaaaactgttccatcatgccacaaaaagaactgtcaggaagaaggaaacgacggatggcaaaacatgaaatgggaaacacttcaaatacagcgaatgagcaaaataatttctctattgctggacaaaatttggtgactcaaccaacggatgtgcacaattcaaatgagacaggtctcgagctcgtcactcattcatctgatgacaatgaccatcaaaatggtggtacaaaccgagtttttttgaatgccgaactcccaccacaaaatcggaatttgtctccgactcgtcaaattttgccggaagatagagccacaccaactcaaactgttgaccatcatccagccaatgatcaccatgttgacataccacctgtagcacatgcaaatgttcatgaactgtccgctgagcagggacatggagccattccaattgctcaaccggcaagacaaaatcaagcggtgaatgagcaaatcagaggattacttaaccaaacttataacgcacgccaaggagatcgaatattcgtttgtaaatttagcaaatttattttttctttgataattggcctttgggtgatgttgtggatgagtatttttaaagaacagcttcagttcgatatttctctaagtggtccaatcgcttttttcatcctctatttgtttattttgctttcttttttcccttgcttgttttatcacgttgaggtacatcaaccaactcataaccaagatgtatgaagcaagaatcacgcaagcaacaacagatcagcttctcatgtttctctttaattatcttttttagtttttagatcatttcctttctattgctcacctcactataattgtaaatttatattggtaaacttatactgtcggtttatttctttgaaactattaacctttgagtaaaagaagctgtcaccttttttatgtgcaaaattgagagaaaaattatataacttaaaactgacaaattatgttcgaaagtaccgaccatcatgcttaaaactataactaaggattatgtatgggtttgacagacaaaattcaataaatttattgattaaagatccctgttgttatgcgaatttcgcgcaggattaatttggacaaagatttcagacaaaatctgattgtaaaaatctgctagtaagaaaaacaggtatatatcaaaaaaaataaataaatt

SEQ ID NO: 10495 - DNA, 1642 bp, Heterodera glycines
gtaggaaacagaaaagaataaaaattttcaaaattctacgccaaggataatgattctttcaaaaattaccgctaaataaatacaattaaattaattaattatttaaatactttatgttcacactttgcgcataatcacggctactcccggtcgcggcatctgaagaaaattccaaaaaatatatccaattattaattaaatttattaattacgcacataaaatttcatcaccacagccaactttaaagtgttcaccgcccgctttttcgatggcattggccatttcatttccaactctttgctaattgtaaaaaatattatatttttaaataagaatatttaatgcaaatattaatagtaaattttcaaataggattttttggaaactttttaaagttatttttttttcaattcaaattattgggcttcaattagaaataaattgccaaaatctttcaaattaataccaataacaaattaatttttttaatttcaaacgaacccattccgttatcaaactgtggttacagccatgcatcagcacattacttacgaatgcagcgtcaaataggcatcaatttgtggcgaatgctgatgcataaagccggctaaatttgcacattccggctccgaaagcggattatccccgtgaaaaacttcgctttaaaagtaaattataattataaatttaattttaattttaataattacaaaaaaataaataacccaaccatttaaagaacgcggaataaaatttaaaagaaacactcaaattttacaaagtaaaagcaataaaaatttatatcccttttaatttttcgaaaaaaaatatcccaacaattttaggaaattgcatttttataataacattgatttaacaaagtgccgcttcgtcactgtcggcacaggcattgttggacgaccttcttggcccagaacgcgtttttcgccaaagtcctatggaaatataatttgaaaaaataattttataattttgaaaaaattacattaaaagcatattaattactcattgtaattaaaattaaggttaagtcgtaaagctcagcctgaaccctcggagacgaatttttatagatttcactcaaatataaaaatatgatttaaattttaaatattttttacaaaataaattttcatattcaaaaaaataaattataaaaaatatactttgcaatatttgaataagtatttaaatagtagtttactttaataaaataaaaaattatttatatattaaaacaaaactgacgatcgcttgtccaagtgtgctcatagccgtcagggtttacagctggaatcacataaatatcaagttggtcgagaattgaattgtatttattgtcgcttgcaagctaaaaaacgtaattaattaattaaaataattaattaagcactaattaatagcgcaataattacactgtcaatgaatttgagtgcaactgctggtgctatccattctcgagcgtgaatgccagcatcgaccaacataattggcttcttttggccattctttgcgcttttgccaaactgaaattttgttatcattacttttttaattaaaaatttaatatttatttatgcgaaaaaattggtgttatttgatgagaatttgctaaatatt

SEQ ID NO: 10496 - DNA, 1575 bp, Heterodera glycines
  misc_feature (8)..(8): n is a, c, g, or t
ataatttnacggctaccgtatcatattgatgatatttgtccgaatcaaaatcagaggctttttccaacttttctggacttcttgcgatcagttcactcgcggtcgattttaatttactaaattaattggtttttttaatttttcaacatttatttatttataaataattaaattacttttttaataatagtgtttccaaacttactcgccataatttgccacaattgtgtcgcgccaaatccaattcttgtccaaaaagtcgagaacctttattagtaaaattaaattattagttgttatttaattagaatttagaattctcacaatgaattacactatttatttgtgtgttttgttacattcctaattttttataaaataatttaataattaaaagtaaatataaccaaatttttgattaaaatttaaattcaatatatatattttaatagtatatcaaattaaaatttaagttccttaaagttcgtaaattttaataagggcgggaacgaaaactttcgattcatttggttatgactctttcggcactcacctttttggcactgtcagaatcggcaaaaatgtccgcatttgaatgcaacgtgtgtgcatgttgccagaattggacagtgcctttgcgactgtttgacgactccatcaaatttgcgaaatgacgcaatgccagcacttgagagtcattcgttgggattgcgcgaatcactttataactgagaacgaaaatttaggcgtaaaaaattttcgcgttttaatagagcgccgaccctcactcaacccccgccctcttcacaaattccttgaaaatttcaaaattttaagcaaaaatccctgaagaaattggcaatttcaggtgtgaactgttaacaacaaatcaagccaattccccaaattatccgaggctccgccggactcaaatccccctttatttgtatataaaaaatcaaaatcaaaaaatggcccattttttagacaaattgttaagtcaaaacctcatcaaaaacgcccaacatggtgagtttattttttgaaaaaaagattgtttctattgaatgaaaatgcaaaattatcggttgaattgttttttttaatttaattatttttggcacagaattctatttttcgcgagtgatatgtttttggaaaaattatatttatccaatttatcatcaatgcgtgaatttcattaaaacaaaaaaaatatttttgtaatctcaaaatttatatttgatctcatggttagcataattaaaaaatgattttagattttgttaattattataaaatttgaataataaatttggacattttaaaataatttttttttttgtctgtgaaaatattataaaatttctattatttttataataatgttataaacattacccatcatatgtgttatatgtgttataagcatttgctgggaatagcaagaaaaatacaaaaagaaaattaataaaaataatcatttgaaataagtaatttaaaagaatgctttcatcttcattagagtttacaaaaaattgtgcgttatgcttaatgatattgtagcttttgtaa

SEQ ID NO: 10497 - DNA, 2804 bp, Heterodera glycines
tccaaataatctgcataaaatgcaaaaacaaaaggggaaaaataaatgattgatggctttttgcttcgctgcgcggcgcgagaggatgcaaaaaaaacatatccacggattagggaaaatgcccatccgaagggattttaattagggcggcaacttcataagggagtcgaataggttttggttcaaaggactcccttcctattggcttggtcttttgcggtaaaccaggtttggggttggggcggctacttcaaagactgtactccttcataggcacgggatgggcgagcagtacccacaaccttttgacagtctgtgcaattttatatagggtatatatatttcactgataattaggtatttcttttcacatcagctctaatttaatgaattcatcatgtcattttgctcacttcttccgccaaaatttgaagggcgggcaaaatcttaaaaatttataattttaattgttaattagttcgtccttaattacttgtttggccaatttgtttatgcccttttccgggtacacaaactactcccggtcgcggcatctgaagaaaaatccaaaaaatatatccaattattaattaaattaattaattacgcacataaatttcatcaccgtgtgctcatagtcgtcagggtttacagatggaatcacataaatatcaagttggtcgagatttgaatgtaatattgtcggttgcgagctaaaaaatataattacttgattaaactaattaattaaacagaatcaaaatcataggctttttccaacttttctggacttcttgcgatcagttcgtggtgagttgaagtgtcaaaagtatcgatgtgggtgatcagaagaggcgggggtcatttcagtacggaacaaatgattttaattaattaataattattttaaatatattatttttaaatatttttaaatattatttggaggcaaaaaatccatcaatatattttacccatttcgcgcaatcccaacgaatgactctcaagtgctggcattgcgtcatttcgcaaatttgatggagtcgtcaaacagtcgcaaaggcactgtccaattctggcaacatgcacacacgttgcattcaaatgcggacatttttgccgattctgacagtgccaaaaaggtgagtgccgaaagagtcataaccaaatgaatcgaaagttttcgttcccgcccttattaaaatttacgaactttaaggaacttaaattttaatttgatatactattaaaatatatatattgaatttaaattttaatcaaaaatttggttatatttacttttaattattaaattattttataaaaaattaggaatgtaacaaaacacacaaataaatagtgtaattcattgtgagaattctaaattctaattaaataacaactaataatttaattttactaataaaggttctcgactttttggacaagaattggatttggcgcgacataattgtgacaaattatggcgagtaagtttggacagacactattaattaaactaattaatttaattattttaaataattaaaaattgttgtaaaattaaaaaaaaataattagtaaattaaaatcgaccgcgagtgaactgatcgcaagaagcccagaaaagttggaaaaagcctctgattttgattcggataaatatcatcaatatgatacggtagccgtaatttattttaaattataaaattcattttttcagattgtctcatatttacgacttttggccgaaaataattctgactttatttcatttaattccatcggaaaatcgtatgaaggccgcgaaatttcgtatttaaaggtaaaaaaagatattttaattcgttattaataattttcttgggtctgtttccaagtccggcaaaatttttaagaaaaaactgaaaatttttaaaattgaagcaaattttattaatagattttattcaaaatttctccggcttcatctatttggacaactaactcaaatcgacttagacaaaagattaaaaaatcctcaaaagtatagaatatttaacaaaactctcatcacatcacaccaattttttcgccagaaataataaataaatttttaattaaaaattttaataataacaaaatttcagtttggcaaaagcgcaaagaatggccaaaagaagccaattatgttggtcgatgctggcattcacgctcgagaatggatagcaccagcagttgcactcaaattcattgacagtgtaattatagcgatattaattagtgcttaatcaattaatttttaattaattaattactttttttagcttgcaagcgacaataaatacaattcaattctcgaccaacttgacatttatgtgattccatctgtaaaccctgacggctatgagcacacttggacaagcgatcgtcagttttcttttaatatataaataattttttattttattaaatgaaactactatttaaacacttattcaaatattgcaaagtatattttttataatttatttttttgaataggaaaatttattttgtaaaaaatatttaaaatttaaattatatttttatatttgagtgaaatctataaaaattcgtctccgagggttcaggctgagcattacgacttaaccttaattttaattacaatgagtaattaatatgcttttaatgtaattttttcaaaattataaaattattttttcaaattatatttccataggactttggcgaaaaacgcgttctgggccaagaaggtcgtccaacaatgcctgtgccgacagtgacgaagcggcactttgtta

SEQ ID NO: 10498 - DNA, 2074 bp, Heterodera glycines
  misc_feature (2022)..(2022): n is a, c, g, or t
tccatttgtgccgtacccgcgtttttttggtgccattgtgttctcccccaccgccatccttttggcgcctcccgcccccattttgcaattccatttgctccatttgccagtccacccccgcccctaagtttatcaatgcccgtgaggcaaccaacggacggacattgggacaacaaaacggcacttttggacggatgggaggggcacaaagtcaattggcatgggccaacaaaattcagccgcccccttttttaattcaaatataatagtgacaaggccgagagtctcggcccaagagactctcgtcattcatttcggtataaatcagaatggcaccacccgttcaatttggcactgtttgattctcgaggataaagacatcctcattaatcgtaaaatatttaatttcaattccttaagactttttccactctcgtatctcgattccgacaaaagtcagtttcgcccaccatttaacataccctaaaataatgccatccccacccaatgacccgctcccccttcccccggcactctctcgcccgtgccgcacctatttttttgctcttttgtgccttccggcatttccccatcctccgccaattttgccatcgattttccgcggcaccgctttcttcctgaaagtaatacacataaaaatgtccagtccactctcccccccccctcttttcccccttttttcattttaatttccacatgatggaagaaaaactgcttccccccccttttttttctctgtccactttaattgtccctgaataaattgagccaaaattgaggacaaaaaccctgggggactattttaatttcgaaaatttaattattttgcggtaaagccaaaccctttttcagcattaaatgaaattgcaaatagcgtgggttttgaccatttctgaccttgtctttattggcactcgagaagatctctctctctctgcctcaccatttgcctgttttcttaatttgtctatttttttcaatgaatcagcatacgcaatccaagccgttctttgacactgtaactattgttttttgatcatcacttcgctgttgtgtcgatgttagcctctaatcactttgccgtcgtcagccttttgtctgcccattttgctgcactttttcttcttctgatcagtgactgacctcccaaactgatcatccttctgctgctgatcagtccttcctccccctccccaactcttccgccgtcgtttgtcgaggaatgcttttccgcctcacattgttcgtccttcttccatttgtcccatccatcgctgacgaatttcgacaccgaaagttcgaaaagacgggccgtgagattcgaatggccacgaaagtttacgcctggggctatcagcaccttcaggtcagaactcgggacacacagaatagctcttagccactacctttgatttcctctgaaaagtcggactgtcggaagaatgatcggctaattatgctcaattgatagtaattaccgattcaaatgccaaatcacacaggaggaaattgcatccagcagtgccatcgacgacatccggcttcgatcgatggcactgaggacgggtcggctgccgaacagttcaggcatttggaaaaggaagtcgaaaatgggcacggtgagaaaatggaaaaggaattaagaggaaatggaaaattaggaaaatttgaaaaaaagaattggcaaattgcataagataagggggattgggcaaaaagggaaaactttgtgaaaaattagtgaaaatgaaaaaatgatggacttcgggcattggaggattggcaaagcttttcagaaaaacgattccaacgcaaatgaacagtcggtggaaggacagcatcagaaagaaacaatgacagcacacgcgcgactgatcgaagatttggtgaaccggcgattttatgagccgacgggtaaatgaacaaatgcaaatggacgatcggagagaaaaaaaggacaaatgatcagaatcaaagggagtgattgtgattagggatcanccaccccatcgaagagaacggtagggcaatttgatcaaaaccaaaaaactga

SEQ ID NO: 10499 - DNA, 2649 bp, Heterodera glycines
attaaaagatcggagaaagccatcgcaatcgtttttcggggaaataacccgactgttccatttgatgtcgttttgaaattccaaaaaaaggtcaaattcgtaaggccgattaaaatcaattataactccgacggtatccgttttggtcagatctttaaacaatatttttgcatttagtggcaacactaatttggcacttttcacagaatatgagcttctcaacagaaccattgtgccatacgaagtctgctctttgacttttagcatttattttaggcattttggccaattatttttgttcatttttcaaaaaaaaaggacatttggattccggacacggtgctttacaactcgggcaatatggacaagaagaacagcgaggcggtgatgaatgccattgtcgagacgggacattggcgggtgggagaaaagggggggggggcaattagaggacaatgacaaagggataatggaaaaagggaccaattatgataataacaaagggataatgacaaaaatgtgggactaattgggacaatgacaaaagtataatgggaaaagttgcattttaatgatggggtgtttttgaagtttgagtataaaaaaaaatgctcaataaaaggacgggggacggtcaattaatttaccataattggaagagggagaagggagggggataattagtggagtaattagttaccgagggtagagagggatgacatgatacctaggacaattatatattaatggtacttaattaaaaattggttactacagaatgatggacgtggtgccgccatccagctgatgttccccgccatttacaagttgagctgcaaaatgaacgtgtaagaggccgtggggctcctaaaaataattttcaaattcgtttaaattgaattgctttaggcgtttcttcccttacgaccagcaggtggcagaagacagttaatgagggtgatcagtggtcaggctggccaaattggcgttgatcagtgatcacttcgactggcattctgatcactttaattaccccctccccctttcccatagaattgctcgtttattatttcctcttggacccacgacatggccaccattgactaccattacacacggcccaaagtgaacatgaagaattttgttgaggacgacgaatggaccgtcatttcgtttgactttcggcgcgaagaagtgagtacagacaaaagaggacagacaaatgggcacagacaaatgggcacagacaaatgagcagcagaagaggggaggggagtgaaattttcacggcactttgagttttggtcatgatctttgctctttaacttaatgtttttgttctttgtgctcccggcttggttcgatcagcaatctttgagctttaatggttctttgaattgtgtgcttaaatatcgcgcactttgagtctccaatttcgttctctgattcattcatttcgcgcactttgagttttggtcatgatctttgctctttgatttttccgtggttttgttctttgtgttatctttttgcgttctgcgctttaagaagggcacttctgcttgttttattctctgagtgccgccattggtcgcgcgcactttgcattttggtcataatctttgctctcattttggggcttttattgagtgatcctttgctctttgtgctctgatctgatctgtatgcttacatatgtgttctttaggtcttttatttcgttctttgtttttgcttttcatcattctctgatcctccttctcttgcttcttctctctgatcatttctttgatcttttgcgcctttctccagtgatttgtccattttcattttgttgttttatctccattcaatacaatgctcatttgtcaatgcttttccaattccacttgaatacatataatttccccgttttgttcattagttaaaattcaaatgctgcgcgaggccctgggccatgctttacgcccatttggtgatccgccgtaagccgttgtattacattgtcaatttggtggtgcccacttcgatcatcactgtggtggcggtgatcggctttttcacgccatcctcaagcacttcggaacgggacgagaagctgtatttgggcatcaacacggtcagtggcattgtgccatcctctgagagaaaagcccccccccaaaaaaaaagaaagtgtctttattttgccaaagttccatctgctggaaaacatcctgactttcaaggataaattgttgggaatatggcctttttccaaggacatctttgaactcaattaacggtctcgagtctcggttctctccgttcagttgctgaccatggtctctgatgcttctgatggtgaccaaccaaatgccgaacacttccaattacgtgcctttgatgggatggtcagtttgtctcctctcctccgtatttcagcagaatgaatccatccatccaaaaaaggtattacatgggcatcattttcgtcatcgttttcggcaccattcttgccaccgttgtgcttttcattcactctagaaaggcgcgccttcagccactccctcgcccattgctcaaggcaagttgagcaaaaaaaaaatgtttttaactgtattttttagagagatttaaatcagaaaaatatttaaaatgccttttttg

SEQ ID NO: 10500 - DNA, 851 bp, Heterodera glycines
ttcccttttgggtttgccattcgccgcttttcctccgtctccgttggcttttcgccattttccggcaccctttcgacaacgaattgcttcggcgcgaacgccaattggcggaacggacgcgcaaagcggcggaggaggcgagccgagcggtgggcagagaacgacgccggagggagaccatcattgaggcggccgattttttggcacaggtctaaaagagagtgatcaagcagggataatgactatctcattacagggcgtgtacggacaacgcaaggccgaactgcaccaattgcaacggaaaatgcgccagtcgcggcattcgctgttcggcagtggagccaacgcacggctggtgaagcggcaaaagctgatgaggaggtaggcgaagcgaacgatggcactacccaaactgatcaaccagagcaaaaaatcttgaacttgacatgccctaaattgctcaaagtggggggattagttcaagtttgatcattctcttggcatagtccgatcaatgattaatcaatgaatatggactgatcagtccgttgtttccgtccctgtctgatcagttctcccctccccctctccgctccctgtctgatcagttctcccctcccctctccgcttcctgtctgatcagttctcccctccccctctccgctccctgtctgatcagttctcccctccccctcttcgctccctgtctgatcagttctcccctccccctctccgcttcatgtctgatcagttctcccctccccctctccgctccctgtctgatcagttctcccctcccctctccgcttcctgtctgatcagttctcccctcccctctccgcttcatgtct

SEQ ID NO: 10501 - DNA, 1925 bp, Heterodera glycines
aaaatttcgaatttaccttttttggttcaaaattgatttaaatatacggaaaaaattgaaagccaccaatcctgcaataagaaatcatttaagccctttttgaagcaaaaatctcaaattcgaaaatttggactttcgacttttttgttcgaattcgagtccggggttctgaattaaccgaaatagatgtcggattcattatgtgcgacctcaaaacccaaggaacttgtttttatggcattaatttttatcactgccgcattttccactgacgcatttttccgggagtctattttttgtacacgataccgtattccctcttttagatccccagggtggctctatttttcaatctcgtccaaacggggaacttttggacggggccactaatgctaaaaaatacaataaaacgataaattcacccctaagagtcgatctaaaattttttcaaaaataccccgatgaaatgaattttctaaaaattagtcttcaaaatttatttataattcgtcttcaaaaaatttttttcattacaaaattttcaattttcaaaattatgtttatatcaatattggtttggcataatttaaaaacttttttgaataactttgtcatttacaatcctaaatttgaaacgttttggcactattttccatttttagcacctaaaaatcgtagccctagagtaatgatcatttttaataaggaaaaacaaatttggcatataaatgccatcaaagtaaacaatcaaaaaaccattttaaatattgttccaacatccacttttttttgcttcattttgcagcaaataaatgttggcaaattcaattaattcattctttctaatttgaatgtgcagccgaaacgaccggccaattaatgtaaatttttatcaaaaatattttttatttaaattttgaaattatttatttaaaaacctcatgcaatttttcacgaaatgtgtggcacaaatttattactgttaaatatggttaagcatatattaaggattgatctactaatagcccggtttctattaacgctcgttaagaagtttttaaattagttgaaaaacggggtacattctttttattaccaacggaatttgaaataaaaaaaattagataaattctgatcggcaatttttcataaaaatatcagacacaaatttgtcaatattaaaataaataaggatcagttgataatgatttctaggctcgaattttttatgatcgaaaaccgagaattgatcccgagggtcggatgccggaaaatccgagaaatttgtcgacccgaattccgggaaaaagtaccaaaacagagtttggcaaaagatgaagaaaaatgtatgactttgactaattgttaattaataattcattaattaatgaagtgagctcaatttttgaccaaaacaataaaacacagttgatcacattggaaaaaagaagacatagaaaagtgaaatagacaacggaaaagaaagagacaaatagaaatagtgcatacatttcattgtttctcttccctccatttgaacccatacaaaaattgccccgatttttcttttcttttttataaattctcacgtttttgcaaaggtcgagagcccagtgaatcggtccggtgcgattcgtgcggagaacgaagtgcgaccgttcgcagacggaccggcattttaaatggttcctacagagcatcatcatcatcatcatcatcggcactgtgccaggaggcataatttccccgctaattagtgtggtaattgcggagggacgtgggcacttaaaatatacgcgtcgagtagttgatctccaatggcatggccttccattggaggatggagcacagcactgaattgtccgatccctctgtgaacaaaaaaaggtcgtttcctttggtcgatgaagcggctgggctcccaa

SEQ ID NO: 10502 - DNA, 2091 bp, Heterodera glycines
  misc_feature (2047)..(2047): n is a, c, g, or t
taggtccaaataaataaaaatgagcatggcgcccattggccagaaatgttccagttttgcgcaagactggtgccaaaatgggcggttccataaaaattatacgaccgcgccagaattagtcagccgatttccaatcaacaatagtttattttaattgataaatatttttctataaataattttaatttcttaattatgcatatttttaaatgtattttacacaacgcgccataattaataagccgatttcctaccaaaaatgtgtcctaattgttaaatgtttttttaattttaattatttcgcaattatgcataataaaaatgaatttgtcaatttgttgattcattcattgttcgcagtatttaatgatcattaatacgtaaaacaaatttggcttataataaaaaggacaaaaaagtgcgccaaagcaattaatcaaaaaacaactgcataattattcatgcacttccccgttataacaatcaatttagcatcccgcacattaattcgcctaattacttcattaattagcaaaatgtgtcaccttatttgataccttgaggcagcaaattaaaaaaaatttttggcaaaaaaattaaatgacaaatttgcgcaaaaaattaaacgttggccttttggaccggtcccttcttgagtttaattatgatggtgaacattttgggtgggttgagccatttgtgctggaaaaataaaaaatacaatttactaatgtacagcggagcaattttttcgtctttcaaagtggcaaacaatttaattttaaaaatcataaaaattcaagtttaataaagcaatttgaattaaaaaaatttgccggataattccattatattaggcccagctttttctaattgattatgtttttcccattgacttcacaaagttatggccaagtgattacgcacgcatgcaaaatctgcgattttttgaaatttcttgaatcaattaaagttccgagattcagtaaaaataaataaaccaattatggcaaatattgtaagggctttttgttggttatctcatggcatattcggatatttttgttttttctgtgagtgatcataaattgttaatctggcaaagtttgattaaaattgctttattacttaaattgttatgcttttttaaataaaaccacatattaatttgaaaattgaaaaacatatcttttagaaacaaatttgttttttcttgttttcatttacaaattaatttaaaaaataattaattctcaaaaaaacaataaaattattctgttgtttagcatgatttttaaaattgtttttctgcttttcgcttcggtttttcttgggccgacgatggcacatacacccactgaaacggcggacgcatcgctaaacacgacatcattaacaggcattatttaatttaaaaatagttgttttaatttaaaaaaaaacatttcttttcccaaggcacaaatggtacggcatcggaaaagctgatcaacggtgtggtgcaaagcttctatgcgccaaacccgaactcgacggtgccgccgcatgtgttgcgccgtgccatgcggtaagacacgacgaaatatggacgaaatatggcgttttgcatagggcccggaaattttaaatttgcgaattctgctgtgattggaactcaaaatttttgtgaaagggaatcccgcgcattaatcccgcatatcccaaggaattaatctcgctattttcaaaaaatgcgggattgcggactgggatcccgcaatacatatttcccgtgccgggctctaatctgcatgaatgtttttttttgtttgaaatttgttctttttcctaaaatagttgaagcagattgaaaaagagataatcgcaaaaatgttgcattttgcattaaatttcataaaaaaattttgaatttttccatattaataaagcacccacagagctaccggattaatacccaaaataatgtatattcatcattactaattaatttaggtattgcaccaaaaatccagaagatgcccgatgcaggtaaaaaaaatttaaattntaaaataatataaaatgataaattttttagggcacatcccgaat

SEQ ID NO: 10503 - DNA, 1469 bp, Heterodera glycines
  misc_feature (1338)..(1338): n is a, c, g, or t
  misc_feature (1404)..(1404): n is a, c, g, or t
  misc_feature (1421)..(1421): n is a, c, g, or t
ttcgaagttgtatgcactgaaaaatgccaaatatgcgcatataatatgcactaaaaacccccaaaatatgcctaaaaactcgaaaaatgatgccgaaaaatgcactaaaatatgctttaaaattgccaaaattgcttctaacccttttttacaaaaattttttataacacattattatgtttatctttcatatatttgaagtatgtttttttaaaatttatttaatagatgggatgcatttcacgactttttaagatttaattttgacaatttgctggtccggcctttttttattggacgaaattaattttcaatataattgcatttttttttaattttaattttaattattgtaaaaaaataaataatacattataaatttttcaaattttatcactttgacactaacgcccaacactttctttaaaaaaatttcgtttttttgaacttaaaacactaacccttttttatgtgtttcttctgacctgtcaatgttttgaattgttaaatttataaattgaaaatatttaaataaattttagtgataaaatcgcattttatttttttaatttttcccccagaaacgctgtgaacatgtcaattgcattgagcagaagccaaaggcattggcattacgtgccacgcttggtgaagtcgaggcggcatcactcaaattgggagagtaagcgaatatatatatttgtttagttttaaatttaatttaaacagaccggacatgccaatgaatgagattgaccgtgccgtggaagtacgtcttgagcgagtgcaggaggtcaaaaagtcgatgctcaaggaagccggactggaaacagacgtatgttcattatgttatattataaatgcataaatacttttttacaagcgtttattttatttattaaattaattataatttttaaattaggtttactccccgtccccgaattccgacttttcttggcctattctccgtcacccaatctccgattttttgggcctattcttgaccccgatccctgaattttctgggcctattctccgatcttccgacttttctgggcccgtttccccgtccctaatccctgaattttttgggcctattccccgcgtccgttttgggccaattttttcgactccgagctcttcgctcccatccctgatccctgaacctcatttccgactttctgggcctatttctcgaacctgagctcctcgctccccgttcccgatccctgaattttttgggcctattccccgcgtccgttttgggccaattttttcgactccgagctcttcgctcccatccctgatccctgaacctcatttccgactttctgngactatttcccgcccctggtccctgttttgggcctatttctcgaccttgagctcctcgctccccgntcccgatccctgaattntctggggctattccccatcctgatcccccgcctattctcctcgctccc

SEQ ID NO: 10504 - DNA, 1422 bp, Heterodera glycines
tacctttctctaggaggtgaaaaagtgagggctcaataccgaagatcaacaacatgtttcctgcttatagtgccagtcggtgagcttcaagtcgcaaactttttttgaattattttaaagatacccgctcattctgatcagtgatcaggggattttcatgcagaaacaggcactgagggacatggtgtgcaccatgcgtgaacgcccggacatcgctttggtcactcagccgccgtattgtcgggacaggggcggcacctttggcgccgctttggagcaggtgatcgacagtcagtgtcctacacaattgggaactcaactttcccacattttggaggtgtattttggtggtgctcattctcgcatttatttggccagccacgcctttggcttcgtttgttccacggggatgagtgcgttgatggtcaaagacattgtggagcagtgcggcggtttcagacagttcggtgcctacttggcagaagattactttcttggccaggcctttgtcaaagggttggcgcttcaattacaaatgcttttcttttaggccattcttcattttcagtggcttccgcaatgtcatttctcatctgcccgcacttcaaaacacagccaggcccaccgttcgttctttccatgaacgcatttgtcggtaaatgtccattaaaaaacttactttaaacaaatacatgaaaatgggggggggggggggggtcagagcggtgagtgaggggattaaatgcaatttttttctcgaggcagaaaaggaattgggccaaaatcggcaaaattaaaatttttaggccggacgcatattgggcattgacgcggggcaataccgaccatacgaaataccactgcttagccaaggggcacgcttctttggacgcagaaaatgattaagcaaacggacaaaaattaattgcatatacctaatacattaaaaggactgaatttcaaattaaaattaattaaattatttttcatttactcacaccgtttcaattttggcctctcagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgaagggttttcccaaccaaattggaaaaacttgatatcattcgaaagctctttatgaggagaagctttttctaaggaaatgttaagcgatttaacgatttagaaaaaagataagagcgttcgaaaatctaaattaacaatttagcaatgttctaggccgaaattcttaaccaaatcactgaattttgttaattttctttttctctatcgatatgcaaaatttggtgcagattggaatggattgaaaaaaa

SEQ ID NO: 10505 - DNA, 2665 bp, Heterodera glycines
atggatcaacttcgtattgccatgcttcctccacctttttgctggagcctgcccaggagtgtgtggtcgcttcgcttatcggcgttttctccgttttccaaattttcggttcttcctcggtccctttgtttctcttcgttcattttgcctattggtgcctctgtgactttctgcttctgctcattcttcaggtcttccaattaacccttaatcatcgtcttcctaatttgttgattttcagaatggtcccttgcctttttccgtcattacttttcttctttgttggctctttcgcgaatcgatgacatttccaagtgttttctcatatatattatgctcaaaacacgggaacagtcatttttcttggtttgaccacttaacgtggaccgttctgatcgttttgccttttctcttgtcgaatttcaatttcagccagcggttcacgggaataagtcaaaccaggaaaaaagtgactgtccctgtttttgcaacttaatgttttcttttattttcgagctaatggatttgatttagcatttatcaaggccatattgaaccctcacatcggatggcgttttggcacttatcggctttgttggggaggacggataaaaccgccgccaaaggtaacgtaacggcgtgctacggaacattaacaacggcgagacttgccttctgcaacattcctcaaagctgtgactctcattcattttcccattttttcttgtttgttaaaaattgttatttttaacccaaaaggaattaattagtttaattgcttagctcaaccttaaattgaactccatttctctcgtctaattcgtttttccctttctttttattctcttctctccattcctttttgtcgtgcttttccaagtcatttattacttttaatcgattacaaatgaaagtcattcaataattgttgtatcaaacggataaatcgttttggattcgtcatcctcaaagcaatacaatccacggcgtgaatcttcacagtttcaacagataatcgcttagtctgtcgcctccgttaccatgtttttccactgaaattgcgattgtttttttttattagaacgcaaacccactaatcggcgatttcatttttgtttccgattcctctgaactgacaagtggcatcattaaagccatgaagagaaatgagaaaagaacaacgagaataaacgatttcatttatgaaaataaaagaaattttgtcaaaagaacgttgttgttggtgaaatgattaaaggaccgatcgatgggagaaggaaattcattcgccaaatgcaattggcgtttgaaaattcacagagaaataaaataaaacattccgtttattcttcgcataattcaatttcaactgataataaagcattaaccaaaaaacgtaaataagccaaatggcggttttaaattgcgtgggacaaaagggggaaagattagacaaacaatttaatttaataaaattctaattattcttcaaattacgctcaattttactgattgttttctccgtccactagtaaatccgacagcacttcgtcaattgttttgtggtcaaaggcggggcgaatgaaaagggactcaattcggtgtgaattgaccatcgcccgaagggacggcagaaagaggagaatacggccaaatctgaaaaagtcggccaatcgaatgtatatttggcactaaggctcccccccccccaccgggcgggggagggcgggtgccgcgcggagtgctgctggagcatggcctgggactggtcctgaagctgctccatcagtgcaccgttttcggcagtgaccgccgattctaaagggaaacgaaggatttaacgcaaaataagccttggagaaaagcaattgctttgtattttaattgacgatcattttgacctggtctgaagagaatgatcgctttcagacagccaatttcggcatgattcatccccaaacgcttgaactgttcgtacaaatggaggattgaccggtgaatgtcggtggggattagcaaattggccggagacattgccaaaacgcattcatccgcacaccattcaaaagcggtcagcatgaacagctcagcaattccgtgctccaacaatataatctgaaggcgagagattgcataagggaaagacagagagagagagagagagagcattttgtaagatggagagggtgagagacaaaaagagagcggagggaggcgagagacagaaagtgagagaattggtgagagaaggaaagattgaggcggaaggggagagaggacagaaagagtgagggaagaggagagggtgagagtgagagggagtgagggggaggggagaagggtacggtacagaaacatttctttctctgctttaaaaaagaaaaaagtttcgcctagcatccccacctgatcactgatcgaaaatgactcaaaagaaggcattgcccgtgctctgctaacagtcattttcaatatccgagcgcatgtctccataaagtccttccgttgctccgaactgatggagttttcgttgccattttccgcaaaaatttcgtcattttcatccgttgggactgagatggaattgcttcgtttttgtttgaattttgcaaactcaattttttcgggtgaaaagccgctgtatttctttcggattctgcccata

SEQ ID NO: 10506 - DNA, 1109 bp, Heterodera glycines
aattattaaaaacctgggaaaattaatttttattcgtaaattaagaaatgaaaaattattaacttttctaaaaaaaaatcgttgaattgcattttaatgacttgaaatttaatttctttttggagtttaaaaccttttgtataatctattaaacactagaatttcaaaaactaaaaattttgaaattttaatacaaacttttttatatactttgtaaaaaatttaagtattaatattttgatagaaaataattaaagctattgaatgataccataaaatattggttgcagttgagtaaagttatgaattttttacattttttattttagaaatatttcttcaaaaattctaattttatcttagaatttttcgttgaaaattttcattaagtttttaaaaaaaaaaaaattaatttttgaaaattttttgaacaattttcaaggatggcagttttaagaaacgcgccagcacgttttaaaaagcccgtttgcgctcagttgacaaaaacgggctttttggcatgccttttctcgccggcattttccttcaaattaattgtaggccaggagtggaaaaactttaggatacttttaataattttttcaaaaattttattttgagaattttttgggtcagagaagaaatcactgtttaagtagcagtgagcccgtttgagctctattagtattctgttgttttttagggatgtgaaaattaaattttatttatctttttcggtaaagaattttggcagcattttctttccatgaatttaatttgtaaatttaaatcagacacccgtgtctcctatatttacgtgttcgagccggacaccgttttggagcgcggcattcgtccggcattcatttcaaatgcggcacgctttccggacgtgcgcgaggggtaccattttcgtccgccgttgggatggatgaacgacccgaatgggttcagcaaatttggtaaaatcattaacgcattttgttttcattcaatattatttttactaaatttcatttattatttatttgattaattttatcattttattttagtagctcaaattaattaaaccaattaatgaactcattttttaaatatttttttca

SEQ ID NO: 10507 - DNA, 2768 bp, Heterodera glycines
  misc_feature (12)..(12): n is a, c, g, or t
tttattttaaangaattattatatttttgcaaaaattaaatattttaaatttttatataaattggggcgttttttcctggattaaaaaattctcataaaaatgacattatcacaaaaattactacattcaagattttttttttggtttttgttgttcggaaaataaaatattaatttcaaaaaaataacaaaaaattattattattattaataaatataattgaaaaaatacggcaaaatattttctagttaaaaccttctaaaaaaccgatttataaattgtaaaatgtgagtaaatttatcggaaatacatacccattcggcataacccggatggctggtgtcaaattaacgcaattttatcggtgtaaaagaaaaatttgaaaattggatataatcgacgattagaaaattttggacattggaatttttacatttaaaaaatacattaattttttggaatcaattaaaatccatcatcatacatagctttttaaaaaaatttaaatttttcctaattaatcttccattatttcatcttttccaaattgtttcttccaattgcaaattgttccatagttaactccaattttcttacaaatttcggcataattttgtttccattctttcgatgaatattttcttttttgtttgtattcatttttattgcaataaatttttgaacaatttcaattttttcttcatcagtttttgatttgtgacttctttgtatttcttgattaagccctaattctttaatccatttataaatataattactatttgtgcccaacttcttcgctatttttgaatttattttattccattcttttgttgaatattttccttctttttgctttattttctcttttattttataatatttttgaattatttctcttttattctgctcatttagttgtttttcttctttctcttcccatttttctccaaatatttcatcaaatgttttttgttgcaattttttcttttctgcaccgacataattaatattaattaagacgattaaaagcacaattaaatggaatattaggcccaatttcatctctttttaatgatattttgtctacagttgttattaagtaattataagtatatgtattattttatttaaattaaaaaaaagatttatttaattaaaatatttattaattgacaaatttaagaaaattatttaaataatattataactaaattcccccatatcatttgccatatttttttatgatttataagatgatcattttggaattgattatattttaaagaaaaatttactttattagcgtcacaacatatctttcgttaatattttcgttattttgcattatttttatggaaaatgaattaagtttatgaaaattatgataaaattaaaaacatttcctttatttaaaattctgaaaaattaaaaataattaaaaagaaattataattatgtaaaatattattaatttttaattctttttgctttttttattattgtccagtcatttactaatttttcccatttttttgaactgggaatgggattgagctggaccagatttcaacttctttaaagtttttttaataatgaaaaaaaattgccaattcgttgatttggtcttttaattagggcatttatgtaaaatacatggcatttttaaagatcaattgggtgcatcagccaatctttttgctgcccgaccccgcagtggcacttgagcatgatggcatcggcggcatttattccggctctgcggtggtggtgattgatgccgtttcgggacggcccaaaatgaatgtgtactacacggactcattgaatggtatttattttaatgcctgattatgcttgctgtgggaggacattggtgtgtcacccaaattataccgtaacgaaatttaccgtaaaccagggatggcattccgaggaaccaaaaattttttggaaaattatttagtgcaacagaattttttttttcatatcaatttacattgttttagtacgtttttttggaaggtcttttacaccactttttttgcggcgcacttttggtttttatttgggagtccaaattacatacctaaattaactatttcgaaatttaaaataaaccattttgtaatttagcaaaaattcaaaaaaagaatttccgaaaatttccgatttttttcaaaaatctcaaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttctttatttcgggttattaaatcaaaatcttctaggatttggattattttgtacaaaacttatgttagaccgttattggaatatgctcctgaggtttggaatccatctcttctaaaaaatatttaaaaaattgaaaaatgtcaaaaatatttcaccaaaagagttcttttcaaatgcagccttccacccattccataccaacaaagattagaataccttcaactgccaacacttgaaagcaggcgaaagctgtctgatctgttcatggctcataaaataatttatggccgaacagatctgaatccctttgaaatacttaaaccttctttaacattcccttttatagacttaactcgaaatataaattaggcaaaaaatttatacctattgcggggcgggtaacaaaaattggaaccaactcgataaa

SEQ ID NO: 10508 - DNA, 5060 bp, Heterodera glycines
aatcgctacgaaattttcggggatccggcattttgggactaatttccccagtaaatccttcgtctgaattattgtacaaactctttcaatttgatgaaggattgcttgtttccattcatgtccccctcccattaatttgaaaaaaacacaggcctggagttgcggctgaccgccctggaggcggtgggcaaatacgcggaagccatccagctgatccgactgcattttggcgaccagctgcagcagtaccagtccaagctgagcatgcgcattttgcaacgactgcgccggctgtaccaattgggcggatgccatgccgaactgttccaactgtgcatggacagcgtggacaacaacgagtcagtcagtccaagaaaaaattttggaatttaacgaaatttaaatgaaatcattttttgaatctttttaaaacgacgacaaatttgtcatcacatttggagttatttactgtgtttgtcctcttttgaacagtcccaacgattggagcaattgggcgctgatgatcgactcttttttccatttgcaggacaccgatggaaggtaagaaaaatttgggaggaatttggacacggataatgcactttcctggccaatgattgattaaacatatttataattcctgatttaattattcatctgaatttcatttcactcaaattctgaaatttaaaatttgaaatgtttttgatgacttttcaatctattttcttcttcgatagtgactctaataataggtcactgaactgaaaagcccaggtttttatttttggctctttaaatctttaattttagtcttttgtccgttatgctccaaaagtgtcactttttggctgatcaaagcgacagaaatgcgtcggatgatcgccgtagtgagtgcattttcagcatttgtggttcccatttcattttgcgcatttttaaagcattccttttggtcaaacttttgttcatccaaagactgtcgtccgaaaaccgtggctcacaaagggaattggtggaacaactgtttggtcggtaaaatgtgttcattttggcatttaaataaacaaaaaatataaaataaatatgcaatttttgatttaaaaatttaggttctccattttcgttacaccaagaagtgatccgagcgtaccatgatcggccatccacttttatggacttgaaaattttgtaagttttccattttttaagttattttcgaaattggccaatttaattggaaaatgatgacaattttcagcctccatttgctcactgctgatgaacaacgggctttgcttgacttcatttcctcaattttggtaccaattctttttcgcgctaatcggttggatcccatttgggctttccccatgcatttgttgggtactttacgtgaccctcttctggaagttttcaaaaaacagaaattccaaaaaatttttagagaatttttgtttattttttagactaacaataaattttagcagaattttttttcaaaatgctaattactgggtcgagaaaggatttgcatccgcttcatttgccaccaattatttgcccatttttccgccagaatgaccctaatgttggtgttcatcctgcgcttgttgaccattgttttgcttcttcctccgatgaatccgctgctgctcccttttccgtttggacttttctgttggccgaaatgatctcttccttttgcttccaaccgcacactttgtccgaccaatccctgaagggtctgtctgtgtttgaccgatcatttagcattcatccgttcatgccatttctttttgccactgacgggacggactatcccatgaaaatgcgaaaaaaacattttttagaatttttttaagaaaattccggggggggggggacgacctgctcccgccgttattgagtggatgacccgacccaataatgtaaaaaatagcatggcattctccatttttcagactccgtccgtcgactgttgagcagaattttgcaaattaacgccaacggcagtgacctggccattgctatgcatgcccaaatggtcgcaaattattgttgggaattttttctcagaaccggtaatatatatatatgcatatgcatcccctctttttacagtaacttttacaaaaacacagtgcatttgtcgtaataaaaatactttcactaatcccccccccccaatattttcattaatttcagatgattacaatgtgttggccttgctactttcttttctggaagtcttgaacaaacaaacccaatgcaacccgctcattcctgtccttttgtgcagaatttacggtaaaatatttattgtacagcacagtatttttttttatttaaaatatgatttggcccaaaatttcaaaaaatttaaatgccaattattttcagcaattttcggcatcacttggcgcatcaatgagctggtcagacaaatggacatcaaatttattcagcgcgttaattttgccttcttccaatgctttgttgccgaaaattttggacaatttcggacggccggaaattattacgcatcgatgggtaagtgaagaatatattagttttatataaaacaaatgcaattttaattttcccattttagtgaatttgcagaaatccaatactaaagaggtgaggaggcaaaaaagggacgaaattattttaaaatcatttaagaatgaattattaaatttattttaataaaagtttactctccactgatacataccatcgaattttcttccatgtcacagctctctgttttaaattgaatgataatttgttcagatcagtgaatgcattgtctctgcgtttcggaaggaaaaatactttcaaatcgccaatttgtacgattttatgcaaatttggtaatgtttttttatccgagtgcatggattaatgttggtaaaatattaattttgactaactttagtcagaattccgtctattcccaatgctccgttgtccaaatggccgttttctcagcctttttcgattcacagtctgtggaaatcgcttcaaatcatttgacaatggacgaagatgattttggtaaaagcggcacaaaaaatttacagtattacattgatattttaaaatgatgttcttttgaaatataaatatgtcagaaatccccctttccggaattatttttagtaaatttccggcactttttctctcctgcaactcccaattccctgataattttgaggggaacctcgatcaccagttttcttgcacattttttcttgtaggatgatgtcctgaaaaacggattaataaatgtttaatttgttggacattcaaacatttaccataaataaacacgtatttcagatttaaagcgcaccatcgacaacagggagttcagtgctgtgaaggtttttctgtccgaagcgacgcttggcgaaatgcgcgatgggacacttaaagaaattgtgcgcagagagagagcgaaatgtgcaattgcaattttaaactatttcagaagtcctatctgaggttgcgcgtcactctgtgccgggccatttgctcaattggcaaacagtcgttagcacagaatgccgccaccttttttgccacattggacgagtgccggacggaatatgcggaagtgccaaaaattgtgggacgaccgacacatttcaaaaaaatttaaaataaataattttttagcggaatatgctggaaaacttcacggacaccggcctggagcagctgtttttgtgcatcggtgatccccaggagcaacaacatgaacagcaaaaggatcagtccatgttggttcaactgcccgtgttggtactgaacgcggcggcgattggcacaccggattctgccgaagtgcaaagcaaacagcaaaatgatgatgaacagcaacaggaggagaagcagcgaatgattgcaacggcgaaccaatttgcaacgcttttgaatggtaattagtgaagtaatcaaacccttcgtgaagtccccccccccctcctgccacgcccaaaagtgaaaattcaaatgaaattaaacgacatattaaaaccaaaacggggtatccaacggcacaaattgcaaatttaaatccttagaaataaaaaaatggaagagaagtggaggagggcgcaaatgattatgtggttcaaaatttgacactttcgttttcaacattaaaactgtggccacattcccttccattgtcttaatttgttcctttactttggcatttctttttttctgtagatttcctcgtttactttggccaacagtcgccaactttcgtcacgctcaaaggccgaaccgtcgctgtccgaatggtggccaaactaatcgaaatggtcgctttggcactgatcggtgccaaacgattggaacggattttgcccgtcgcttcgctgctgccaacagcgacgacgacagcgtcaaccaaaggcaccgacggcgacggaggaagcgggaaaaaggaggcacggcgaagtgatcggaagagcagcaacaaaaaacagggggacagacagcagcacaaccaccaccaccaccaccaacatggcgatgcacaatgctgtcagcacggtccatggaaacaaagcgacgagcaaaaggtgtactaagagagtgtgaaccccgagtaaagtttaaaaaaatagtttcctactaaaaaatccctaagcatttagaaaatcaaaaattttttcacttttttgaggacaactaccttgagtccgtcagggggtactaattgggctacccggatccgacatttggggattttaataaagcaaaaaaaatattacaacaaatgccgagatctcttttctgtttcgttaaattaatttttttttgtgactcacttgaaaaacaaatctcagtccgaaaacagagttaatttaaaaaatattattttgttttttcttgcaatggaattaactctggctaaatcagacgtaatttatttatttttttgggcataaaattaaatttttaaatatattttttgttttattaaaatccccaaatgtcgggtccccaagttgcaaatccccaaaagtcgcgccacg

SEQ ID NO: 10509 - DNA, 4381 bp, Heterodera glycines
gggcggcgcaactgtcgcggcgcaagtgtcggcggcgcaaatggcagcggcgcaagtgtctgcggcgcaagtgtcgcggcgcaagtgtcggcggcgcaaatggcagcggcgcaagtgtctgcggcgcaagcgtcgcggcgcaagtgtcggcggcgcaagtgtcactttggctgggcggcgcaagtgtcactttggctgggcggcgcaactgtcgcggcgcaagtgtcggcggcgcaaatggcagcggcgcaagtgtctgcggcgcaagtgtcggcggcgcaaatggcagcggcgcaagtgtcgcggcgcaagtgtctgcggcgcaagtgtcgcggcgcaagtgtcggcagcgcaagtgtcactttggctgggcggcgcaagtgtcggcggcgcaaatgtcacatcaccattatttgtttaagaaaaaaaacaaattttgagaaattatatctatttcaatttacttatttgtaggataatttattattattattatcaatttgagaaaattggtgaaaaatacccgaagaaacaaagtgacttatgaaaataaacgcaatgataattcattatgtaattcaacacaattaaagcaaagcaaaatgtaaagctaaatatagtttaacaagatcaaatcttaaattgatacaattatatttaaactaaaccaaaatatcgttttgcggacaaaaacaaatgatacacacgcacatcagctcagcgtaaattgtattaaaatataattaaacattaaatgaacttaaattcaactgatcaataattgaattttgtttgatccaataatccttacaccgatatattacataaaaacaaaaagttacaaatattttggcatattaagactgaataataagtaatttttgcgctttgcggtccaatcgaacgactcctttgtacgtgactttcgtggtggcgggcggcgagcttctggtcgaacgtgataattttgagatgaattatctttttgagttgtttgagaaactcactgaacggagaaatttggaaaaaatttgcttttatggcacggatgaagaactgaagtagctgcataaaacggaaaaaaatctttctctcctattaatgtatgcattagccaacggcaaacgactcaacctttatctttgtgattaggttacaagattattgttaaattaggcattcttaaaaaataaactattaaaataacaattctgttaactttaataaattgttgaaatatttttggggtcgttgaattttgcgccgccgcaaatgtccttttgactgggcgccgcaagtgtcggcgccgcaagtgtccttttgactgggcgccgcaagtgtcggcgccgcaagtgtcgcgccgcaagtgtcgctttgactgggcgccgcaaatgtcagcgccgcaaatgtcagcgccgcaagtgtcagcgccgcaaatgtcggccaatcgtcttcttgactttcccttcttctttcccatggttcaattcctctaagtaattaaaatattttgtttctttttgtataatcatgagtttcctatcgacaaaatatgattactcatagttttttaattaacacatttttattattttttgaagaaaattcgaacaaattgagcatagtaatcctaaaaatcagcattttttgttgaaaatctattaaaaaattacactcaaattttcaaaatttcccccggcggcgcctatcggcaccgctgctggcgccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcgtgaaattgaaaaataattaatattaaaaaaaatataattaaattattataataattattttttgtttgtattatcaatattagcatagattttttaaaaagctattttagcggtttgggcgtgtgcaaatttttttgatgaaataacactaatccgtcaataatttatatcatagacaaaaataaaagtcagattctttttctgcatgtaaaattaccctagaaaaaatttatttattattttactatttaaattattaaataaatttacgttaaccacaactcgagttgtggttaagattccttttatatattatttttactttaaaaaaaaaattaaaatttgaatttttaaaatacggattacggactacggatccgtaaaaatccgtgtacggatcccgtccgtatccgatctctaattaaaatctaattatttttgctgaacagtcaccaattcttttatttttaaaatttaattattcttaaatttcatgcgttttataattcaaattcaataaaatacataattagatatgataaataaaaataattatttaaatttaatccaaatgtgaaaatgtggtggaaaatttaaaataaatacatatataaaacaataaaataagcaacaaacatataaaatttatatatgttataaaaacaggaggaaacgcaaaattcaagcgccatttttgtaatgaaaatctcaacaatagtacaaaaaaattgaaattttcattcttttacaaaatcaaaattgggcaagctaattttgcgcaaaaattaccaaataattttcatataaattcagatattcccattaagcgagttaatggaataagtaattttttaaattattatgatatacgaacgagaacaaaagttactcaataatttaaaattataatcaaaaaataataaataaataaatcccgctaaaataagaaataaaaatcaaaaacgaacaacattataacaaattgacttaaataatatataatacattgattttatattaaaacgattagacattggcatttaaattaaaaggaaagtgcatcatattatggaattattaataccatacactgatagtattttaagctttttgaattaattttatctataatatgctttaatttttatttaatttcataagtgttatgtcaaaaaaaataataaaaacaataaagtatttgtatttgtatggtgagaacaacatataaataaattaaatactacaaactaggccaatataaataagtaaattgaatttattttttttaattttaatttctattagctttgtactgcatgaatttaatgtgaacattttgacataagcaatttgataactaataaataaaaatatttaaaatatcataaacaacaatcgaacaatataacatgtaaaaatatttttatttaaatttttatatttgattactttacgaatacaaaaatcaattgaacatatctttcgctctctcctctctttctcttcctctctctctctagtatttatttttctctaatttctcattttcattttttccattttctcttactcaaaagaacaaaaaacaatcaaagaaactaaataaataaacggcaataacataatgcaagtgaagggcactctaataattcggcataatattttgattgaaattttttcctaataccccaaacgtttttttcctttataagtatatttcaggattttcagaaattccttaacacaaatacagtaataagttgtcttcttacaaattttaagaaacttatttttttaaaatttcatattaaaatcacttcaaattttacttttattaacttttttatttttcgtgcctttaagcatttgctaattgtaagttatttaggaaatgactgaccaaaacagcgaagcaacttttgccgaggaaaccagagagctcaaggccgagattggtcccgtctttaaccgcgagaaactcgacaaggcgtacaagaaacttgcaaagaaataccatcctgacaaacacaagaattctgctgagaagacagcaaaatttcagcgcttacaaaaggcaaacgatgagctcaagaaagagctgcttaaaccggaggcaattttattttaagcacataagcagggcaccctttaaatttgttattgaaaccattttaagtacaaagtttctttttttctcaaaatgatgggatcgccaaatgcagctcggacgcttgatgagctcaacaaagtgggccatgacgaattgaagaaaatggcaactgctcaacgtggcggtgattggaccggaacagtgacaattgggggacaacaatttggtgggttacaaattattaattaattaataattatttttgcatgtgcaattgaatgtagttttggttttattacacgttaataattgtttattttgactaattaataaaaaaatatattagtggagttaaatttaattattcgaataatttttccgactgaaacg

SEQ ID NO: 10510 - DNA, 2223 bp, Heterodera glycines
acattcgtccatatttgttgaaggtgtgcgtgtactgttccaacatggagaagtgaaagatgggcaacaacattcggcgctgaattcaaatgagtgtattttgatacggtagtaatttgaaggggaaggatacggtaatttcatttaagaaacgattaaaacactttcaaatgatgattaaaaaagtatttcaaaatcatatttgcattgtgtgttgctgtattttactgtatttattctggaacagtcccagcaggaggggaggtgtaaaggatactgtaccaccaccctagccaagatggtaaaaattcgtttgcaaaaggtggaaaaaataaaattggccggatatgataattatcatttttctaacatattccccacccaagccccgaaaatcctaaatcttagtaatcctcggctgatttatgaatttatgggactcacttggcgaagccaatggtccccgtcgctgaccaaaacgccgttgcccaaccattggtgaaagaatttgtactcaggtccttttttgatttcaacagtgctttccaataggacctaatgcgcgagaaattttttgggaaatttaaaatttaattaattaaatttttgggcaattgcccacaaaaaaaacccacttttgccgtttctccgtccaacgtgacaaccataaacttatttgcgatccacctgaaagaaatttgatagatgttcattattctttaaaattatttttttcgatttttaattcaattatttttttcaattttatgttgttataattaaaaataataatacaattatttgttaatcaaaccatctcatcaaatggtgtccttttctgaccgcgtctgtaattatgaattaattatctcctaattatgttttttttattagtgttaatacaatattattaccatttgattgttccacaataaagctggaccatgctggaataaagaattttagaagtgattattcaaaaagatgaaactcaaatcaatttggatcactgatgagaaaaagggtttggtcaattgttcaaataaattcaaaataacttaattcatcttatttctgagaatttttttagggtttttcgatatttttttgaattttaattcactttaaatccagaaatacaatattaaaaatctcaaatttaaaacaaattttactgcctccgggatgccataaaaaagctattttttagcacccaaataatttttaaaatttttatgtaaatattaccgaacgagttttgagggaacacgtgggcctggccgaggaacggaattgtctccggaatattgtaaatgccattggaagtgcggatgaagcgcaaatgggtggaagaaatggcaaaaatacgccaaacaacgaaaacgagcagcacaaccgcaacgaagaacagaagcatttataataatgataattataatataaataaaaatcgaaattattaaatttttaaatgtgaaaaatcattaaaatcatattcaatttatttaaaactgatcaaaaattaaatcgaatttaataacattaaaatcctcgtcggtaaataattttaccctttttacagaatgttcattttgaatttaaataagaattagtttattaaattaaaaaaaaaaattttttttatctataaattggcatttaaaatatttttaataatttttcccctcatattaatgaatgtgtcttaaaataaggcctaacgaaaattgaattaacgttattttggcgttgtactgtttttttgggttaaatccattaaaaattgttgtaaaaatggcattgcccttccccaagcaacaaacaaatttttgcgcagagaatatgtacgtcaattttaaaaaaaattaaaaacggaaaatgattgtgtaattggcgaatggtgggcgaaacttgctccccattttttgttgcaacaaaattatgaaaaagaaaaatgtgtaaaatttgttgaaaaaaaactatttatatcataataattatattttatatttagggcgtccttgaaggacaatgtgctttttgaccttaaatggtagtgctcttaaaatgtcgttgaacaatttttgaaaattttgtgtgccccgcggcgacccaaaaaccttgaaaaaaaaagcagcagcagcaaaaatgggcaaaaacaattaaaagattgtgcgcgaaattgagccaaaaattggccaatttgaaaaaaatgggtgaaca

SEQ ID NO: 10511 - DNA, 2044 bp, Heterodera glycines
taaaacagggttggtatcgtccaaggtcggcttccaaggacgggtatgccgatttgcaaggacatagtggggaaaattcatgaaatccaaggacatttaaaatttttattatatgcaatgcaaaatggttaatatttattcaaatggcttgtattttcaccggaattgtttttttccaacatttttttgttttcacttatcattttcttcatttacgacgacttttttctgctttaaaaacgctttttttgtggcgcgctttttccaaaaattttgtgggacagaggggggggggggtccggcggtgccgataggcgctgccggggaaaaattttgaaaatttgaatgcaatttgttaacagattttcaccaaaagctgcctaatttttgcgattttaagccatgcaaggactttttttgtttataaaatgggtttttttacggcgcgctttttaaaaaattttttgaggataggggggtccggaaaaatttgtaatttttaatacgagttgtttacagatttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatattgttgaaaattacaaagatttctcaaatttctttgattttttttaaacttttccaaatgctcattttcaaggacgtccttgcatacaaggacattttttattttcaagaaagagggcccaatttcaaggacgtccttgccattcaaggacggatggcagccctgtattattttaagtaattcatatttggtttaatgagtgttaatttttaggaaaagcttttcctcatcttgttagaatccatgctcaatttattgcagtactgatcactttttgaaaagttataaaggataaattttgcggaaaatttaaaaaaataatggaaaaaaagtttctttttttaatatttttctcaaggccaaaaatagtgaaaaattcagcacaagttagttcttttttttgaattacccctttaaaattcgatgaaaatcgaatcatttttaaaagaatgagtgatttctaaaaaaagaagccaaaacaaaattatttaaaattgaaaaattcattttgcattttagcattctatttttccaataaattggatgcaatttctgagcttttttaaaggaattctttaattaaaataaattttttatttattttaataaattaaataaattcttcagtttatttatttttatgtatatattttctttgttattggcaataaaaatgactagcatttaagggaaatgctccaattaatcaaattgatcatctgagtggagaatttgaaaaaaaacaaaaaaatctaaaaaataataggaccaaaaatcaactgaattataaaaaatcgcatatttagcgtataattaattgctgtctttagtaataaatgttagggttttattttattttgaaaaaacgatttatcaaaaaatgccaaatttttgggaaataatctcatccgaatgcattgaatgattaaaatatttaattattcaattaaattattccaaattttgcccaatccaattgatttatcccatcaacgaaaagttaaatgtcgttaaagtttgaaatcaaaaacatgatcaggcaggaaggagaacactgatcttatcaaccccaaggcaaaatatgctgatcaaaaaacaaaacaaacaaataataaaaaaatgtttgagaaaaaaatgctttcaaaaggctcccggtaaattggacactattggataaaaaataaataagtttaaaataaataaacaaaaattttaattgaataaatttttttggcacattaatcaaacatcgtgcatataaaatgtttgatccactctaagtgccttaatccattttatccatacaaattatttttcaatctaatgcctgggcttattttttaaaaagaggaatttggtgcccagttttccggtgtccaa

SEQ ID NO: 10512 - DNA, 2450 bp, Heterodera glycines
  misc_feature (69)..(69): n is a, c, g, or t
  misc_feature (105)..(105): n is a, c, g, or t
  misc_feature (143)..(143): n is a, c, g, or t
  misc_feature (931)..(931): n is a, c, g, or t
  misc_feature (940)..(940): n is a, c, g, or t
aagttgttagagtactaatagttcaaatacatatcattaaaattcacaaactgccgttgtggctttttntaatgttttgtttttctcatttttgtaatttcgctntacggatttcactttttgtttttagattttcttttttntagtttttaaaatatgttataaattatgtcttatatttatctaataattagtcttttcttaatttttttttgattaagataatgattttttgttgacattgcacaaatgcacaactcatacgtgggtcaaatcggtgaaaaagggaagtacgtaaaatatttatatattatatttatatataagatttttcatgagattcatttgattataaatgccttgaagtaattaaaattattttttcagtatttttgttttagaaataattaactttttaaaatgagtaaggaattaaggtatacattttttaaaatctattttccattaaatttattcatttgctgactttacgaaatattgatggttattgaagaaccagaaccacattttatttttatgaagacttcattttcctctattattcgatttaaatcattttttaatattcatgttatttcacctaaaataaacgtataaaaacttcaaattatttattttaaacaattttttaaataattaactaattgtcgttattttggtcaagaatatttataaaaattgcttatttttataatagtctttgaattttacttttatgttttttataggatgttaatttaattttgatttttacttagaatttttatgttactgttcttaaagaaaaatgaaaaaggtaaaactttcataaaatttccttgtccatgtttacgtgttgcaaaacatccttttcgaatagagttcatatgactagttcaaaattaataaatattaaaactaaaaatggatntaaaacatnttttatttattttgtttcttacttaagcatttgttttttcgaaatgttatatttattaatttattattttatgtttatactaaatattcttacttatgtttttcaaaggttttgcgacagttaaaaaatatttattatcttttcttgtgtttaacgatgtctgtctcattaacgtataacagtttatgttttacttatttgttaatgtggataaatttattctaactttttaattaatctgtatttgagtatttcctttttagatgtctattgattttacttttagtgtttttgtttttatatttataattctatggttgtaaagaataagaatgtttattacattattttaacatatgttatatttaatttgaggtttgatttattattaagaattttattacgaagacaagttaaataaattaatttagtatcaaagcttatcataagactcaaatgaaattctgatttattttatataattaaaaatttaagtgataatttctcaatgtttgtttatttctttgtacttttttattgctttctttttctagttatatttaattctatttttaatgtagcataatctttatttatttattcttctctttttctattaaaatgaaaataaaagcaatgccctcttttatactcgctcttttttactctgtaatttaaagaatttttttaaattattatttttttattttttatctacttttggagattttagaaattgattaatatttagttatttttattaattttattacttctttttataaaaatagtaaacctattctgattgccattcatggtacttaaatgaattaaataaaacgaactagaattatgcaaatacatactgtgagacacaaccatagtttatttgatattgcaaaaactgaataaagtttttgataaaaaaggaaacaaattgcaaaataccttaaagaattagaaggatttaggatatgaaagcaaagaggaattaaacgggtgttgaaaactcgtttttgctaattattttcatgatttatatttcttattatttcacgaaataatttttatattttgtacattaatttacgtttcgtttatttaaccttttcaccaatctctgacagatttggtaatattgtaaacgatttcttgtataattatactgtttagatatagttttattttaaatttttggcaaatatctgtcatagcgacttggagagtgaataacttttgatgggtgagtaaacgttgaggtgggataacgcgcgcgcgctcattgatttgcaaggctgcagttgtgttgtgcgtcgaatgttcatattatgtttagaaaatgtaagaattaaatttcttgtatatttgctattgtttattatatacactgaatatatttattcaatattctatataataagtaatttttctttttttaaagtttccttaactttgctttaatttattcttaaaattgaagttatcatctatattaaattatacttactag

SEQ ID NO: 10513 - DNA, 3698 bp, Heterodera glycines
  misc_feature (3667)..(3667): n is a, c, g, or t
cgacctagtagtttttatgtcttggatgaattaaaattcatttttaattcagatcatgtaaaattacataataagcataatcacaaattattgataaaaacaaataaagttaaatattattattcattaaattatccggtcttacaaattttttaattaattgaaattattttgtgttgaagatttaatttattataaaattttttaattgtttttagcttatcattaattgatttaaatttttaattttattttgcaattttttgccggtactttatgcttaagtatctttgaaaaagaattttatattaaagtttaaatgatttttgggccatcgtttgtatgaataaaattgaatttgacgaaatttattttagttaataattatagtaataagggatagcaataacaatattctaaactaatttattcattagcattttattttttatatttataaattaaatcaaatcacaaatttaattaaatatatcaataaaacttggttaaatttcatttacgtttattttcagagctgacgagagcaattttcgctttttcggttcagatgaagatgatgataattgttgcggcgatgccgatacccttgtccgctttaaagatgaaattgcagtctgaataacggtcacctccttcctttaattaagtctatcaaccgagtggtatcatgccgcataattaaatttatctcgaactcttattataaagaaatttttttcttgttgtttatataatgatatctttaattcatccatgaattggtattataggttaattcgaatgagattatcatattcaaaatcggacgagcccaatgttctatcaatatcacaagtagtatttttattcttagtttaattataatgaatataatattgaaagtttgttgggatgacgcacataaaagcacggtgagcgtaaggtctgcagaaagcgtatttataagaataatttatttgaattttaattcctaaataattggttatcgttttttaataagtgaaaattatggctttattttttaaaattcgtatttcatttctgttctgtttttttactttaatattaattacttaacaaatcgatgtcatctacttagaatatgttgaattttttttgtttaataaatgtactgaaggtacattcactgccgttttatttattctcagccctgtcttatatattttttaaattttaaattgttttaatatagatataatttatgtgccggatgttaggcatggctgtggcaccataatataggatatctttatttttttaaatttattactatttcattcaaataatctatatttacttttagatttataatgacttgttaagtaggttcgctatttcatttctgttgtcttcacctgaatttttttcaattttttgaagaaaattttattaaatcatatttattctataattatttaaattcttgtttgctaacatagggtgcgtgccaatttcttcttcagatctggattcttttttcgtatttttttccttaaatttctgtatgatttgcgaaagtataaatttttagtattgaatttattaaatatatttataattttggtaattaattcttaatttgcaaataatttaatttttctattatcaatattttacctagaaatattttcatccttcatgagaattaattgactttaattttaaatagtttggtatttatgccatttattttatattttcttcatgtataagtttataaatatttgtctttttaattattctatctttgtttttcttttttcatgttttttttgtttatccgttaaatgattaattattcaattatataacactcgatcaatattggctttttaaaatgacattagtcaagctaaaatttatttagcaatcattcctgaaaataattattaaaatattaattcgcgtaaattaattttggtgttaaaaggatttataatcgactcattagttttttaaatgccattactctatttaaaatgatctattcactgatcaaagaactttcatttttatttttgttgattcttatttttttttaaataggttcttcaaataatatacttttgcgtcgattattttaactaatcgtcagagattttcttatcttttatttccttaattttatactgttaaagtaatttttgcatgtgttacttactatgtgcctcatttaaatcttcaattaaaacatttacctttttatcttttaacaggaaaattatataatttatacaaattgataaaattactttttgatgattctttttgttaatataataaaaaatagtttattatttaataaattgtgttttgagaatttttcatttcgcaatttaaatgaaacaatttcagtaaatgcttcccttcgaccctggggagttctttgccgttatacacagggcttctattgattttcaaaatcagaacatcgggctcaaaatataagattttggtttcgaaaatcagaacattttgcaaaattgcatcaaaacagttatttttaatttattcgatcaaaaatgtattaatattatatttattttcacctctccataatcgattttaataactttggggaggaaataaacaaatagtatatttcagtgcattcggaatcaaaaaaatgagattttaaaaaatttttgcggctcattttacaaaaaactttttgtaagtgggcgaggtgagagtgtccggcggcgccgattggcgccgcaggaaaaattttgtaatttcgttattatttgttaacagattttcacaataaaacgccaatttttgcatttaaacccagtgacgacttttttcggccaaaaatcttattttcttgataaaatagtgacattatgccataaaatttcaaaaattataagtttatttaaaaattttgctagctacaccaaaatcagaacatttcttagcaattttaactcaaattttcaccgtcggaaccatggaaattttcgggtatttttatttaataaattttggcagatattttagttttttaaatttttttcatttcatttaagcatgcttttatctttgtgtgttaattacttcctaatcgacataattaaaaataatttaaatttctcaaacgatttgagcattattatatttatacaaaatttgatactaaatgacagacgatatgtgctcgatttttccgcccaaatacatttataactacataaataagctagttaaaagttaaatagtttaatttattaacaactttttgattgatacaaacttattttctaatagtatacaataatggacaatagcttttacctttttgctaattaattttttaaagggaattatttattttttattcaaaagtttaaataaaagattgaaaaggcatagagataaaacgagagtttaagatgtttaaccatttttatgcatagttactgctcttaagtcttaaaaaatcatcttaagcaaccaatagaatcaaaaaatatttttgtagatatttggccattttaaatttatgttataattttaatgatcattttttaattagtaacaaattaactaatttaaattaggccacttattatttaattgattttcccttttctcgaaggcaaatttgtagttacccgangttttaaattatttaattagtacaaattaat

SEQ ID NO: 10514 - DNA, 2440 bp, Heterodera glycines
  misc_feature (5)..(6): n is a, c, g, or t
ctctnnagagtcaaatgaaggaaaaaaagaaaaaatttatttttatttaaatatttaataaaattttagttttttgtttcaatcaaatgaaattcaaaaatacaataatttgtgttaattgatcgaccaattaatttccaaatggtcatacatttaattaatggccggcagacgcaattaattcacagaattccaacaattaaattattataatttgttgagcattcccacacaacacaccacgtcaaagcccttctcacaacaaatgctgccttcgtatttgtcatccaatcgctgtgcacatttggcactttcgcaagggcaatatttttgcacagtgtccgagcaaatttcatttttagccatttctttcaatacaggcaatcgatgctcatcttggccatgatttgcgatcaaattctcttccaattcctaaatttgttgaaaatttgtttattgttttctttttcttataaatataatttttgttaatcagaaatattgatgctttttattccatttataaaaaattattaattaattcttttaaaattaatttttcaaaaaatattaaatgaaattatttcattaaactttaaatattttctcttaagaaaggaactttgcttgatagaaaaacttgccagttgttgaatagttccagttgtaatgtcaagagtatcctataaatggtaaaaattgaagtccaaattaaataaatatttatttaataaaaaataaaaaactagtttagtttttggtgcattttttaaaattatcttttacaaaattattttacgaaaaattgtgattttggcaaaaaaaaaattgaaaatttcatggttaaatttaaaccattttgcaggcaaatttcgaacaattatttggcatttttcgtccagtttagctcatatttggacatttattgatttagcttatatttctagttttttggcacgtattaatcagggccctgaattattttttttgtaagaatttctgaaaatgtcgaaccaatgtacagcacaccaagtcgtacccggcctggcaacacaaactcgcattccatcccctcctctcatggcatcgtgcccaaccgcatttgcaatgttttttcaccatcatctggcacgtttcattgtcacgctgcatttccatggtctctttctaaagaaaagactttttaaatcgttaatttattttttttcttttaattaaacattaatttttacattattaaataaaaacaattgtaataataattaataattggaacacttaattttgcacacagagcagccatttcttcgccgcaacattcgcaggtcaatgcgcgattggaaccatctaacaaaataaagcgcaactacagtaaggaatttgtcaagcttttagttatcataacactggacttgcttataattagcaaatgtatatgtaattttaaacaggattgttgttgtgtccccgagtttaaggctttaagcctttcaaattaccattattttaatgaaaggatttattgtaaggaaatcattgaaaaaaatttgtaaattaaaaatggatataagtttggatcaaaaaatctcagagcatttttgatgagtcagtgcaattatgttccgttccaaaattataaactcaaaacttgaagacatgtaatttttctatagggtaagaaaaaatctaaaaaattcatttaagcctaacttttcatgctgatcaaaaaagtcctttgttctaccgtgatcagatcactccttcggggtgatctgaaaacctcaaaatggcttgaaatgggtccccggatttaatgctttaagcattacgaattacctttattttaatagagggtttagaattagatggggagaaaataggaaaatttacattatgcaaaaaatttggaatttggcaaaatgtaatttcaattttcttattttattaatttttttgaccttttagatgatttttttctcatttaaaggcaaaaattgaattttttttttgtgaaatgaagaaaattccgaaaaatatgtcaatcttagagagcgagaaaaaaatgtatccaaaaaacattgaaatacttttgattagcattgtgctagcgaaatggataaaaagagattttttaagaaattaactactatttttgattaatttaatgtttttgcacgtactttggcttttggagttttagcacatttaaatccgttccatgttaatataatatagatattttttagaagtttacctatccgagcacagcattcccatggacatttggggttcagaattgggtgtgcgacacaatcctttttagatttagtaaaaatttatattgctttaaatatattaatacatttttagtatatatttcataattttaaagtattatatttttaattgttaattttaaaacataattatgtaactgatg

SEQ ID NO: 10515 - DNA, 1870 bp, Heterodera glycines
ataaataaaagaattgaacaaatagaataattaatcaattatttagcaaaacatacgacttcgagatactgtgtctctggaccctgttacattgtattggattttttttgttatattaaaaacttcaggtaacaaaaccacgcacctcgaaggaacccttaaataaaaaaataactaaatagtttctaataaaatattttgagttatttctttttattgtttttttatttaatttttttccttttttttgaaatttgtgtatttgataaatattgaatattgcatgacttttgttgtctatcttgtttattaggctgtttctgtttgaatttgttaatttattaaagtttattaacagatttacttcaataattatattgtaaaatttgagaaatttccggatatcttcgggattttcattaaatctggcacaaaagtttgggatttcttaattggaaactggcatttcggtctacccgctttcatcccaatacaacttatgtttgcacataattttgtttgtacggcttgccttggtacagcatcgccactcatagccgtccatgcagcacgggtggctgttcacgcgtacatcgttttcaacgcatgaaccccatacaaatgggtggcatacattcatcgccttgtaggaacagttggtcttgctcaattcggggatccatgttgacagataggcaccaatgccaggccgggaaaaggtgccaagaatgccgatgccggcgactgaccgattttggccaaaaaatgatgatgttggcattttactaaaatgttaaaggattcactcacttattcgctcggcatccgatgatttaaattaattaataaatgaatttacgtctccaggggatcagcagatttttaatcatattctatcatcaaaaaattacgtgatcaaaacgctcaaaattatttggcgctatgatgttactcaaaaccaaatttaatttttgttatcattcgatggctacgccaatattgttctaaatgttttcaattagcctgcaaaatttcaaatgagttattttttgaaattttattatctaatagagaaacacactttacaatttgtgctatcgaactaaatcaaaaaattaaaaattatggttgctgaggaacaaagtgatgaattaatatttattgaaaagctttgaaatttgaattgctgaaaaacaaatctgatcatgaatatgtaaataatataaacaacaatcagtgtaaaacctgctgttgttgttcgatggtgctaatgcgtaggacaccaatggacagatgagcacgagaacaacaaataattgagaaaatgagaagcaaatcattttgcacatttttaaattgaagaaaaactaaaagtaacaaaaataaaaggaaatacataaattttcaatgctaaaataatttggttaataaaataatttatttctatcctttattgaaaaaaatatttgggcaataaaaaaatgattaacgtttttcattcccatccaaaaatctgaacaacaaaatgcatatgatgaatcatttgctggtaaattatgcataattatcttctaaaatgaatattaaatatttataaattacacaatatttaagctatattgttgtggattgtcgattttcatttttgaaaaagtaaatataattttttacagcaattaaagaaaaatataatggaataactttttgcacacattaaaattttgaaaatttttagggacttaaaaccttttatttaataaaatcagattttggtaaataaaaaaattttgtggatttcgacatcatttttgtgttttactcaccttcggggtgccggaaattttctgcaattttatgttatgtattatta

SEQ ID NO: 10516 - DNA, 1653 bp, Heterodera glycines
ctttaaaaaatttaacaaattatttttatctaaaataactgtatttttaaggaatttctgattaattacccagccttatcttattgaattatttacctttattgggtgggtctaattttttcctaaattaatcattttattttggtgaattcccacttctttagcaattaagaagtttatttttcattattttactaggcctcttaatcaatgagcaaattttcaaggaacatcagcagttaatcataccgattctgaagtattttttattttgttacaaaggcttgactgactcattgagattattattatgataattagagacgggttttgtttttcgtcagaaaatcccccaccggtcctattagaggcagagcttctttttttcttcaattataacaaagccaagcacttaatcattttttttaatttattcaattaacaaattgtttggtcaaacaagaaaatactattttgttttgtgaatgggaaattaataaattctccagcattattttccgcttttttaattgtcattatatgaacatttctccacgcattttcccgtctttgtgttgcggaagattcccggcttacagtcgcatgagcatggacatgcaattttggtgcaaatctccggtttcagcttgtcacaactcggctcacatccgttgcactttttgtagccgaattcctcatttgcagggcatggaacctaaaatgctttttttaaacattaaaatgttaaaaaatatttttttaaatacataattttatactcacaaagcaagttggcggattggttccttgtgagagaatttgcacaatgagaaggaaaaataagaaaagaacgttgaacaacattatattttattttctaattaacttaaaatttatatccaaaatttaacaaaataaaatcgattaaatttcagcaaatggcgtttttttttagcactgaaatacaaaatgaaaacccatctaattatactaggattattcatttttgcgttaaaataaacacacaatttatttacacaagggttggagaagggatttaaatgttattaaataaatatttgattaaatagtatatgttgtttttcataaatatttgcctatttaccaatgagaaatgttatgggattttcatcaaaacaaaaatagaattggatgggcgaacctgcacaattagggcaaaaatgcacaaacaatgggctaatatgcgaaaaagaattaaactctctaatctgatgaatgaatgaaaattcgtgaattaattgaaaagaaaaattctgaatttgttattgccattgccattttcaatttttttttaatgcttaaattgccgtttttttacacagctggcttaattaaaaaattgactaaaatattaattttttttatgtaaagtgaaataattgaataaacatttaaaaatatcaaaaaatttacaaatcacaattaagtaatattaatgaattttattagtaatattaatgaattttatatggatgcacgcaattgaattttgtaattttggttaattattgctaaaacatttttgtgcaaaaacattcataatgaatgttatgtttggtttgaagaagggaggaaaatttattgaaaatttggaaaatttaattttgattg

SEQ ID NO: 10517 - DNA, 2998 bp, Heterodera glycines
agagtaattgcatttgggcggcaccgacagagaaatgagtgaccaaatggcgggggaaggcaatggcaccaaatttggactgaaattaccaatggcaattcgaaattagcaaaatgaaaagtgaaaagataatgggacagatagccaaagggaaagcagcagagggaaagggagccgaaggcgttcggaagagcagcagcaacaataattaatcacattctgtggggaaaagcgccaagggaagcgaaagggaagggaccgcccgattagaatctctcctctcttccggcggagggaaagaagagtcaatctgctggattatccactcggaaaaagaggcattagcaaatttatggatattcataaactgtacaatataaaaatattattattttcactttgtggggaaagcaattgtaaaaagtgaacggaagggaagggaaggcacagattgcgtgagtaaaacaacagacgaatgaatggccgaacaatccaatttcgaaaacaaatggcactttatcagcgagttcgtgggcataaaatgtccaaaatttcggcgaaggacggcctcgaggcgggcgacaactgccaacagtcgtccatgagggaaaggatcagcgggggagtgccctcgggcgggtccatccgatatcccttttcgacatgcctcagcacatcctggatgggctgaagggacacaaaatggatgatcagcaatggtcaattaattagtgccttaatgagccgtgcacttacaattcgggggtagggcactctgccaaaggaatacacttcccaaagcaaaatgccaaaggaccaaacatcgcttttgttggtgaacagctaaaaatggagcatcaaaatgccaccatgccaatgaatgccaccgatcgctcacattctgtcggagtgcctccggcgcactccatttgatcggaaactttcccttcgccgactcttttgacggctgattggccaattgagcgagtccgaagtcaccgattttggccaccaatcggtcgtccaacagcacattgcgggcggccaaatctctgtggacaaaattgcgcgactccaaaaatgccattccttccgccacgtccctgaaaagaagggggaggcaaagatggcgcggcattttctcacacgaagtcacttcaaaaaaaactaactgcgcaaattgaacaagtcgcggtcggtccacgtggtgacggccgcgggaacggagaaaatccaccaaattgccattggccatgaactcggtcagcatgtacacttcactttcgcgcgggtcctcaatgacaacgccgaccaaaaagaccaatttttcatggtgaaggccactgaaaaagtgtcaaaatggaagggatttgattaacgccaaaagattgttctcacatcataaaacgcgcttcggccagcaaatcctggaccattccgttcttcagcgttttcactgcaacttttctgcctcggtatgtgcccgaaagaacgtctgacaatgaacagaattcttttttgtattgtatttgtaatggtgaccatcatggatacgtggtttttaaatatttttcgaaaaaaatattttaaaaatgataattctttgaaaaattccctttctagagtaggaaaagagttgcttccaagaaattaaatagacattgaacgcgtttctttaaatgtgttttgagtaattcttgaaacctttcaaaaaaagcggttggagtaaaccgcgtaaaagacacacctccgaattcgccgtgtccaatgacagtgccaagccgaagatggtcaacggagagtaacagcgccgcttgctcgaactcctttttgcgctcctcaactaacaccaaatcgatgtgagttcgctgcctttggcattcctcggaaatgtaagggcacaccaaacgatggcacagtccgtcggcatcccttttgtagtgctcaaaagcgacgggaatgagtgcgtgaaacaaaactcattagcttttttttttggttgtggctgaaaaagtcgcccgttttgcatttcttaaaaatttttctggacaattcgtctaatggaatagcaatcggaaaaccaaccgaccgatacgagctgagtgagcgtgtcgaacagctcctctttgtcacacgtaaagtggtcattcaccatgtaaatcctggagattcgaagcattgttcaagccattttcttgcgatgtgtgccgacctgtaatgctcgacccgcaaattgcaagcaacgcaaagtgtgaaatcgcctgaaaattacagtcttagagattataactaaaaccaaaaataatgagaaatatgtaagtaaacaacgacttaaagcccaagcaaaacttcttccaaaaaggttttttcaatttcgaaatgaatattcttaaattacccggatagtttgttgaatttctgatcaggaaagtcccatctgcgcatgactgtaagcaccttaaaatcaaaaatttattgctcttccaaaatgaattcggctcacttctcagttttctcgcgggaaagtgacccgtaaaaccaaggagctgaaaaatgtaaaaatgatggataaagaagacaaatgggaatttgaccgtgaaaatctgcctccattctgcataagtgctctaattaatttatacaacaacaacaaacacggagttattaagtcataaaaaattaattacaaaaaatggaaagatttgaaaatttttctgtatgaagaaaataacaaatatttgaataccatttccaataggaaaagaatgcaaaaaaattcactaggactacgaatgtttgatttttttcagctccttggaaaatcaaaatgcttaatttaataatttctcaaattctaataaaatggacaaaccgtctaaggattaaactttcagcatttttgagcatttagtttatacacgtaaaaagagagagcagagcgtaacatttgatccgtgatcatcaattttaacaataatttgaccatatatatataact

SEQ ID NO: 10518 - DNA, 3238 bp, Heterodera glycines
actttgcacatgcgcagtccttccattggcacgttcgcttgtgtcctaaaaaagccattgaaatacaaaaatggaaaaagtgccgttctttgcgcatggactcacctttcagtgctgagacggcgccgtgattgcggcactgaaacgtttttgataattttgccattccttgcctttattcgcaccaacccgcgcgcactttggcgttcgttgcgtgcgttctgcgcgcatgcgcagcaatctttccaactcagcaccactcagaggcactttgccgggaatggcactattcgaagcagaatttgttgccaggggcaaagtgtcgattgattcgttggcattcgttgagctcatcggcgcgcgttaattgggctgagaatttgcaatttttatttgcacaatcattaactgttttttatgcttttccttttcccgtctcttctgtttggctttggtactgtgcccaaagggtcatttgcactgattggccaaagggaagagaaaaagggccgtggggcaattggaagaaatggcaaaacggcgaaggattgggcggaggcgggggggggggagaagggcaaccgaaggggcgggacgggcaattgtcgcctccgccgcccccggggccactcaagcgaagtgttggacaaacttttggatgtgttttgctgctgctgattttctcatcaaattcattggtccatttttttaatttagccacaaagataaattgaaaataaaagacaaattaattaatttgtcagttaaggaggagaaatcggtcaattgagcaaaggttaaaaggggaacggcacacaaaatgaattcggcaaaagataaaagaaagtgaaaacaaagaaaaagagagaaaatttggcagaatgagagagggacaatcattgactgatcagtgaatggcaaaatatcaatcgaaaagcaatgtttggcattcattggctgtcttcggccgtcgccgtttccatttcctcttctttttggtccaaccaattgaaaatgcgtgaacgaacctaaaagggaaacttccaaagaatagtcattaattccttcaccgactcaccgccctccgttccttcgtgccaaactttttcagccgtgccactacaaggcgcgcgaacaatgcgtcttcgtcctcattgttagccgttccgttggcatttgccgttccattgcctcgaccgtccgcccattccatggcatcggtccagcaatttgtgacgttgttcgctttgccactgtttgcttcttcctctatttttgtgtcaccgtccccacaaatttccgtcggtgacgaacacatagaaacgatgtcaaatttacgaacagaaattgccgagtctattaaaaatcaatcaattgttttcatcaatcggacgaacccggaggcgggagagtgccgctggcaaggcgaccccgggattttgaaacgccaaacccttgaaggttttttaaaattaatttagcactttctgcgcttttttatcgtataaacaagggtacttctcggttatgcacgtttgaagtcttagcgccaaaggaattcgcacaatgcgctgggaacatttacaaatgctaggatgtgcgagagtctcggtaaaaatcatttctcgcacatccctaacacatacgcgcgttttttcttttttaaaacgcgcgttttttcttttttagaaatttgaaggtgcgcccgcataaccaaaaagtacctaaacaagttccggtgtcacagtattcacctcgacggatgaggtacggtggctgaccgttgccactgccgttgtttcgaagtgatgtgccattgccattgggagtgctgacaaagcgatggtgacgcgtcggataagtgacgggcgatttggacgcgggtgcgaaagcggacaacgcacgacgctgatcggagtgatcattgtcaatggaagaagttgttggtgcgatcgggttgagcagtgtcgagccgagcagacggaatggcgaagatcgagcaaaaagtgaattcagaacgaattccgtggaaggttcggcggaggcggggcccaagggactcgaagccgaagcggagcgacggagcagcgaaagttcggcggcaaagtcggtatggcactgacaaatgaggagggcatgacgatgaatggcaaggcaaactaatgccatggcaagtgttgagcccacctttgctgatgggtcggcactgtgccctctctccgtgccctcctcgtcgtcgtctttgctatcgacaggtccttcttccgtctcctcctcctcctgttccattccaacatcctttggtgatgctgattgtgaacatctctgttccccagtggtggtgttcggctgttccgttccgacccctcccattaaaatgctggacgatgcgcggatcagcagttcgttgtgcagcgattggctgtgctgcggctccgccgcccctccgtcgccttcgctcgtcgacgcttcggcgctgtccgttgagaagtcgccgttcgtatcggctgaaccattttatataattgagaaaccatcgaacatcacaaattgaacttttgtgttgctgctgctgcaaaagtgcgctgctggcggccatcagagattcgagaaaagaaacggtgttgccgagttgggagagacgaagctgttctgaagagaagcgaaccatcaccaatcgacaaataatgccgaaaagtaccggcaaaatcgcctctaaaaatgccaatttggtggttggcattagcggaaaagtccgccaaagcgttttgttgttgatgagaagcgccagcggagacggatttgatgttcctgtcaatttagtcaaattaggcaagaaaattgccaagtttcactttgcgtccttcaaatagggatcgagccatgccaatttggtgaaatagggccatttcggttggatggaagtgcgcagtgccattttcaactcctttcggtaacggtcgcgcatttgcagccatcgctttttcgcaaattcgccttaaaagaacgatcaacgaaattcaaaaccaattattttatctaattttctctgaccattaacggaatcgtcaatccgtgaggcaattacttccttaaaaacgaaagaaattaatttaaacaataaaattgaatgcgcattcacccaaattgcattccgttcgccattgtcagtgcacaccttaacatcgttttgattaacattgatcatttagcggggagggcggggggagaggggtcg

SEQ ID NO: 10519 - DNA, 2115 bp, Heterodera glycines
tcattcatccgaccgtccacattcatcatcttcacggttcgttccattcccttcagttggtccttttgcgacatggtttcttgaaatcggagtttctcgtcagttatttattggtaatccgccgggggatcactcccccctcccctccctcccttttcttcaatcatcgcttcttcaactgatcaggacctgtccgtcctctcttttcttctttcctcccgggtcgcattatgtgcattttttggtaagtgcctaagagacttggatcagaaaaaacgcagcgcaccaaatttaacggcgcgcaatgcgacgcgaaatgaaacaaaagggggggggggggaaggaaccggattgcccactcattgccttccctttgcccctgtcactcccgttagctttgtggctcggtcggacaagttggatttgaccaacgaaccgaatgaggggctaacaaaacggcggataatggcacttttgcaacaaaacaaataacaatattttgaaaaataataaaggcggtggcgcacgccaccaaagtgccgaaaacaacgcgataaagcctgggggaggggaaggaacaatgccattgcgggagggagggagggaagggattagtgcttatttacaaacaatccatctaattatgtaaattattattattcagtgaaattggtttcgcaattttgtatcaaaataccatagcttttttgtgtccttccgtatttttgggcatattttgacactctctcacccaattaacaactcagccatcagtcagacttccatcctttcactatcacttccttttgattattttctccaactgaatgcgtttcgcgggccgcctcaaacggagactcaacctgacttgacagaacgaaccctttttcggcttggccttcccttctccgctaaatttccatcacattttaaagtgtcagtcgcacacactccgatcgacagaaaagggcattgaaaccggagaaaagaaagaacgaagggaaatggaaagaatgaaaacaaaacgaaacgaagggagggaaaggaggggggggggggggaattattattttgtaaagggaagggaagggaaagggatgagttgatgaaatacagtacgaacacgttcaattgcgagtgaacttttattagtaactgttgttaatgcaatgcaattgcaacaaaataagtgaaggaatgttcccaatttgtccagtgatttggcacaaatttaaattcaacgcattataaaacaaaaagctgcacaacttcgtcgaattcgtatgtccgtttgctcaatgtgtcggttaaccgaatgccagaaatagtctaaaagggagaaaagttgcttattttaatgtttcctgagagtttatgcgaacaaatggcctaagaattgcctgacgaaagtacctgcaacccgggcacaattggcaaaacgttcaatgaaagtttaaagcattggtttggcagaatgagcggaagcctccgaccactcagcgacaaatgaatgaaagtgccgaattgggggtgggagacggacgacgggggacgattgaatgggggagcgaattcatcgacggaagggacggacggagggggcgaaggcgcacttagcaaagtgagaagcaaatccaacgaacggtcactgaaaaggaggggagttttgctgaatttcgagtcatgttttggttggaattttcaacattaattttatattattccattaattaaaataacaattagggatgacaatttgtaaaaaaagatgaatatatgaaaaatgaaatcgcaaataattgaatttaatcaaatgtttttggattccccccccccctttttttttgcgcgtttcaccatttattttgcagttcaaattccgccgtgaatgcttcgttcagccgaatttccttcggactttgtaccaaagtcagttgcaaatcgtcacaatgagattcctaaccaaatttacaatttaaaaaatacccaaaaatagtctaaccgtttgttgtgccaccgtttcccaccgaatttggcccctttcgcccattgcgctgcgccatcgaatttccaatggtccgacattatttgcatttttatttttttcaaataaca

SEQ ID NO: 10520 - DNA, 2862 bp, Heterodera glycines
gattttaaataaatgattttaaaaaatttgattaaaaaagtcacaaaatttatttattttttaaacaaaaatgatttttaatgtttatttaaaaaatcaaaaagaatattaaaaattatcttttaataaaaagaactaattgtcagaaaaactatatcgcgggataaaaaaatagaataattattaataaggatgaaatttttaagttctaaaaactgccaaaataagcaggtcttatgcctaaaaaactccaaaaataaagaaaaattcttcttcttttttttctaaggtgtatattttttgtttttattgcattttgttaacaaattgctctctaattttcaaatttttcccctcagcgcctatcggcaccgccagaccccttaactcaacaattgtagtaaaaaatgatgtgccaaaaatagttctgatcataagtaagtaattttaaaataaaatttaaataaatctatttctcatttttgataaaataaaagtggattttattttagtttttttttttttgttttctaaaattacagaaaaattgttttattttactataattttttcacttggaaaaaatatattaatttttatttcacttctttgaatatatagtaattaccaaatagttttgaaattatatttttgtttatacatctctacaacatttatctttataaatttttttaaaaattatgctaaagactaaaatcattataaaaattgtcaccttattgcaacgataattaaagaaatgatttctaattaaggatcttaaaagaaataataaaaaattaataaaattataaataaaaggtttcaaaatgaaaaaatgatcaccataaaaaaacaattttgaactttattaattattgttaataatattgtaaataataaatgaccaaattaaaaatgagaaaaacttttattaaataaattcaaaatatttttttgttaataatacttttttctttaacatttctttgaatattatagtaattatttaaaaatttgaattttatttatcttaaagaaaataataaaataatcataatgttgaaaaaatataaaataaaacaaaatcaaaattgaaaaataaattatctataaatttacaaaattaatgattaaaaaaagaacagagactaattgtagtaaaaaaaaaattaatatcttttttaagcagtaaatattatgtgaaaatatttttattttatatataaaaaaatttgcattaaaaacaatattaattttttaacaattatgctatataataaaaaatatatattaaggtaaaatatataagtgtttcgggcttcgagctttgtgttaattactcaaattttggggaaaatacactctaattcttttattattatagggaagtaattaagcaaaacaaaattaaaactttttcattttacaaaaacaaaaaagaaataaataaataagccgtggcaacaagaagataattgtggtcgtattccacaagaaaaattataataatctggaatgaaaatgcacataagcaaaaatcttaaataagacaaaaagaaaatgaatagaaaaccaactatgaataaagtatgaatacaaaataaatatgtaattgtaaaatatagtataattaatatataaaaatcatcattattatactatagaattattatgaattttcagttttagtttaaaaaactaaacacagatattattcacaaagcgaagttacggcaaagtaaataactaaagtctaattcatttatctattattattattttaaataacaaattaaaaaacgggcgcgaagggcccgtttggccccaacaaaatttaaaacgggcgcgaggcgcccgtccaagcccaacaaaattaaaaaagggaaacgaagcacccgttacccctatttgatcaatcccaaattgctcggatccaacaatctcttcacaacgcaatagcatatctatttcgaaacgggcgcgaagcgcccgtccaaggccaacaaaaattgaaaaacgggcgcgaagcgcccgactgaggccgcgaagcggcctaacaagctaaaaaacgggcgcgaagcgcccgtcttgagcctcgatgtggactaaaaacccctaataattttttttaattcaaaaaatctctccaaccaattctatcaatttgaatcgcttcacagcctaggtagcgaagctcaagaagcgcgaagggaagcttctggtttgcaaaaaaaaaatttaagtaaccaagtcttgatcacggatcagacatttactaaatttgataaaaacaaaattaaataaattgaattttttaatttttttttgtttgaattcgggttagggattacgaattaatcaaaactatttttaatccaaacatttattgtattagcaaaaatcactaccatcttaaatatgactttggacaggtgacatgaaattagataaaataaaagaattaaaacacatggaaaattgtatttaaaaaaaaagaaaaaataataaaatattatacaaaaaataatattataaatgataaactggttgataattaaataattaaatgttttaaaaacgagataattaaataattaaatgttttaaaaacgagataaatatttaacaaattcaaaagaaaaaaaataccttaaacccatatttaaatttaaaataattaaaaatcgttaaaaataaaattcaaaaataatattgtaaaatataaaataataatatattttctaataatatttttttatcaaatttcgatttattttaaaattttaattaaaccgcacatgccaatggcttcgcagcgatgaagacatgagatattaagagcagcataaataacagtta

SEQ ID NO: 10521 - DNA, 1346 bp, Heterodera glycines
  misc_feature (1337)..(1338): n is a, c, g, or t
aaaaccccttataaattttttttaattcaaaaaattctctccacccaattctatcaatttgaatcgcttcacagcctaggtagcgaagctcaagaagcgcgaagggaagcttctggtttgcaaaaaaaaaatttaagtaaccaagtcttgatcacggatcagacatttactaaatttgataaaaacaaaattaaataaattgaattttttaatttttttttgtttgaattcgggttagggattacgaattaataaaaactatttttaatccaaacatttattgtattagcaaaaatcactaccatcttaaatatgactttggacaggtgacatgaaattagatgaaataaaagaattaaaacacatggaaaattgtattttaaaaaaagaaaaaataataaaatattatacaaaaaataatattataaatgataaactggttgataattaaataattaaatgttttaaaaacgagataaatatttaacaaattcaaaagaaaaaaaataccttaaacccatatttaaatttaaaataattaaaaatcgttaaaaataaaattcaaaaataatattgtaaaatataaaataataatatattttctaataatatttttttatcaaatttcgatttattttaaaattttaattaaaccgcacatgccaatggcttcgcagcgatgaagacatgagatattaagagcagcataaataacagttaagaatttactgttttcaaattaaaaaataaaagtaaatcttctaatatcattttaaaaaccaaaaagagattaagcaaaaaataaatgaactagctaaataaaattattttatgaaattagtaaaaaaaaatcctttatgatcaaaatcatacttatatgcatattaaattcaatatattaatataaataaaaaggaatactgactcatgaataaagaatgattgatcaaaatgtttaaaggaatttaaaagaagaaaaaaacaattttcacatattaacttggtgcaaaatcattaatcaattattttgtaaattttgcaattcaatgtcaaaaatttatgatactcacagaaatttttttaaacaaatctaaatatcccacgagataaaaatagcacttacaatttattcataattgtgttttttctttctcaccctaaaatttcgagaaaatccctttttggaagttcatttgaaaaaatcataaaaattcataaattcaaaataaaaatcagaaatatgactttatttttaaaaaaagtagaaatttttgtgaaagggaaaaagtcaacgatattttttcaaattattaagagaaaatgttttaaccggcagnnactctaga

SEQ ID NO: 10522 - DNA, 4194 bp, Heterodera glycines
ttatcttcccatttaaattgcttaaaatttttttttatataggcctcattagtacttaattaccccacttactggaccgtatagcggaggatttcttcaccggcgattccggtttctcaacaaacaagcgcgggccggaaagtgacggatatggcccagccgcgttggctggcgcgccggtgccgccctcgtccggcgccggctccgccatcggtgtgggcggtgcagcggctggcattccgccaccgttcatgccgccagtgatgccagcgcaaccgcagccgccgcctccaccgccgccgcagcttccgcaaatgccaatcgcgcctccgttgaggtgggtgagcgtgcggagatccgggcactatagggggacggaacaaaatttcgccgccgaaatctcgtcgagacaaaatctcgccgcgaattttcaaaaaatttcaaaccaaaaatttttcaagaaaaaatcttagaaaatttgtttataagaaaattctattaaaaatgattccatcaacaccgtaggccgttgccgaatgcgatcggtggcgccgccggcgttgcgcaaccgccgcagccgcccccgggcaatgcggcgccggagccggtgcgcccgtccgcgctgcttggactgatcaacaaagcggacgaaggcttcaaccaagtgatcacccactttgagcagggcacgcccatcgaagcggcggccatcgacataatggaggtgggcgcgtgagaaattttagcggatttaaaaaatttattcgataaaaaattttttgctacaaattttaatttaaaaaacccagcaatttaaaaaaaagctttttcaataatagaaatatttattaataggccttaattacaatttggaaatttgagaatgatgtgtgcttattgaggtttaagctaatgaaattgtcaaaaaaaagtttcaatatgaaaaaataacgaaatttttctgaatcataaaatatttggcgccactgtaaaagtggccgtttttggaaattttttcaacaggggggacccttttgttttgcaaaatttttttgtgatagtcataaaaatttattctctgggttttttggggtccccgatcacgaatctttcaattattttgatcaattccgatttcctaatctaaatttgaacaaaaaatcataatttgaaaaattcaaaatttcgatttttattcgagttcgggttagggcttagaaattagtcaaaatacatgtcagattcgtgattagcgacatattgatgggcattaattcaatggaattttttctttcaaatttaccgtaatcccaaaaattggttttaaaatttttcaaaattctgagtttttaatgaaaatttaatcactcatcatttttcgaatagtgatcagcagaagctcaccaaattttgtaggggtactaaaatgaagagaattaacctattttaaactttttcatctattattggttttaaatttttttttcaaaattttgagttttccattattttattttttaaaattttttgcaagttttaattctccatattttttaagaaagtgctttgaaacccaccaaattttattgccatgttattcataaactctaatgcttatattctaaaaatggctcataaattctttaaacaattttttacgaactttttaattatccctattattttaggattatattttaaaaagttttatcgaatttaaccccttctataattaatataatctcaccaaattttataagcatactctccggtacaggactaaaacttaatctgaaaatatctcaacgcttattcgttttaaaaaaattttcgaaattctgagatttcccattatttttttttccaaaataaattaataaatattttttcagagaatgctctgaaacccaccaaattttattgtcatgttattcatgatgaactctaatgcttatgtagtgaaaatggctcataaattctttaaaaaaaattttttttacgaaattctgagttttttcttaaattttgtcccacaagaactgatcagaatcgtaccatatttttaagggtatttttaattatatataattattttattcatattttaatgccccgggagggctctattttagggaatacggtaaattaaattttatacaacaggtggccttgggcagtcaaaagttggacagtcaagctaaactgctctcccacgtggaccgcgcatttggactggacaatttgcagaggttacagcgttgggcaaacactggtggagcattggatttgctcaaggaacaggtgggaattaattaattaattaaaaatttttgaaatttttggtttaataattcaaaatttaaattcgcgcccttttacagttcgccaaaattgccaaaaactacaaaccccctccggcactggccgccatcacattgccaccgcagttggactatttgttgcaaaacccaagcggcggtggcggaggcggtggacttggcggcattggaagaaaatgaaaaaaataaataaacccccagggcaaaatatttaaatttaattaaaatttatttttatttttgcaaaatgccaaaggagtaataattccacaatatacaaaccaccacaaaactgattatgaatgaatgaactgttgttgttccggttccaatgcttttgtcgtgctgttccagcgcttaatttccaaattttaaaaccacgaaatatcataattcattttggcatcggtgccaaaatctgctaaagggcaaaaaaatgccaaaaacactttgttctagagctcggcctggacctggatccaggcctggatttttcctggacccaggtccaggtcatttttcggcaacctggatttttcctggacctggattttcctggattttgtccaggaaatccaggtccaggtccaatgtgaaaaaaaatccaggtccaggtccaggcttttttcaaaataccgagctctactttgttcatttggcatcggtgccaaaatcggcaaaaaaaagaaaggtaaaccaataatgccaaacaatttttagacatagtcccaaaattttccaggtccagaaaatcaatgccaaaaaattaatttgttattttatttgaacaagattaattaatttatttttaattaaattttctgactatccgacaattaaatcataaaattaaaattttaaattgaccaaattagtggaaatgcacgacaaaatgaccactttttttcttcacttctcttcaatttatgcatttctgcacccaatcatttttctttcacattttatttgggcttactgtggcgcttacagtatacgcaatgcatacccacgcctaccgtagtaattcccctctctttaccacagtaatctcgcttcatatttttttttcttttaaatgttgctcttctcgaaatgctgaaaatttattttcgaaatcagaattttgaaaacggcattcttgagcagcaacagtaacctctatgtacaagtcgtttgagtaccgtacattttagtacactgtatattgtcctaaaaatgctattccatccacgcaggatccaaaaatgacacggcactaaaacgtcttgcaccatttttattatgcttcattcattattaattactaattaatttatgccttcattaatgttgtattgtaccaaaaatggcgctacagtatccacgcactttgtgttttatacattttcattccctcttccttcgctgttccattgcatgagattatgtactgtatttgcgcgcttttgttctttcccatttcttggttactgtgcaatttatttccatttttaatatgcaattttcagatttcttttttttaaataattttaatgattttttaattttgttttaaatataatttttccgataaaatatttgtttttccaattttttccctccctcctacggggacaagtgtcgatttcagcagaagaatctccaaatgaatatgtatcatgttcagtataaacaaaaaatttggtggtaactgatggttatatgggataaataaaattaaaattttcaggaaaattttttttatgtttaaaaatatttacagattgacgaaaacaaattttataatttttattaaaaaataaaatttcaacatgtccaatgaaattcctttttaagaattaatttttttttttaa

SEQ ID NO: 10523 - DNA, 1391 bp, Heterodera glycines
ctgattgatcagaatcctgtgcaaaatgccaccgaccattgaatgatttggtgggggagtggctgccgggaagtctgcagcagatcactcatcccatctcacctcaatccgtccatcagtccgtccaaatcacccaaaattctcgggagacaattgtctcgagaatatgtccgtccgtccagccagcacttaaacgcccacacaacacatccgccacccaacatttttccagctcattgcaaccagctaactcatccttcttctgccgctgtcgctggccattccgatcaccaaattaaacacttaaccaaccaaatctaagggccaatcgctcaaaaatactcaaaaaattagtggttttcttgatagaaatgaaaaaaagaataattttttattttgtaatgaaaaacggcaattaatgcaattcaacacatatatttgttcttactattttttttcttctttttcccaactttggttaaaaatttccgtgtcagccccccttcattcgtagcaatgcttttattttttggacccgctttttcttgaacgtggcgctcattggtccgaaaaacactctaatagcctcacaattttcaaaaaatttagcttatcaaaaaattgttcatttttattttcatagaatccattaaataggaattttttttttaaatttatacaacactatcccgtatataatatgtacaaataaattaacgaactcaaagttttcgaaattttaaaagaaaattagcacctaaactgtgccattcattctctccccccttttctgtgccattgtttgaccacccgtgccgtgccgtctttccaaaaccctctcattttttggggatcacttttcgcctaaaccaaacgcatacattcggcggcaaattcaacaagcacatataaatgaaagaaagaatgaatggttggttttgtgttgaaagcccacccccgtccaatccctggtgttgtacaaatggaataaaatgtgcaaaattgagaatttgtgcaaacaaatgaatgaagaaagggcaaacggtgggccccgcggggagagaattggggcattaatgggcatgggaaagcgatggacaaattttgagaataattttttttagtgggggggaggtgggaattattattaattctactgatcaagaccggaataaatagagcagctattttcttttttacatggcttcttggccgagcaaatcaaaaaatggttaaaaaattttatttccgatagaaaacattttttttggaaatttttattcaaaatgataaaaaactttttacaaaaaaatattttacgaaaaaaaagattttactgaaatagaggccccggggtctttttttttcaccctcctcaaaaggggggcttt

SEQ ID NO: 10524 - DNA, 1552 bp, Heterodera glycines
cgcttcgcaacaatagccatttttagtcgagcctattttttcacgcaaagttttacaattacatttttatttgttcattttttggttctcccaattttaaatagtatttaatttttggaatttttactaattaattatttatttgctatattccccatttattttttaatgaaatttttcatatttttttttataattttattcccttttcaattgattacaattataaataagatttaactcctttccccccccccccaaattgacatgccaaattggaatttgatactaatttaagggccataatttatgtaaatccaattacctttccatgtacaattgtacttttttgacctcatttgttcttttcttttcatttttatcctccacattttcattattttttatttattcattaattctttctaaagattttttcgaaaaatcttttttaactttattttatgaccaaatttgccataaaaaattctgatttgccattatctaaaaataatttgtttaagctattgaaaaatatcatttcgagaaaaaaaattttagcagtcagtctcttcttttttcattattttttaagcaattttttatttaaccattctttttttatttattttatagctttccatttccatttccttttactttactcttttttctccatttcattttcctcttttatgtttttccaacttctctttttttgttattcaatttttttttattaattttcctgttcctttcttctcctccatttcttctcctcatctccatcgtttttccaccttttctttctttcctttttgcttttctcttttagcaaaaatttgcgccattatttatgcaaagtttgctgtgtgtcccatggaattattgcacaaaatattatgcaagaagagctaaccactgacaatgggaccgatggtcacacataattgggggccaattccaggtcaagctaagctaacaacacattccctgtgccctgtgaatgatccccaaaatttaatatggaaaatttgcataatattcaaatagctgtgccatttatggtgacagtgaatttcggcattgtggccaaacacaaggccaagaattattatttcatttttagtttttttatttgtttgttttaagggtaatttaaaactcaaaaaaatatatatatttaaaaataacaaaaatattaaaattcgttttgtaaatttattaattttctaataaatacttctttaatttaaaaataaattaatcttaaattatgtgcgtaattggaaaaactggtcggaagtttagcaaatttatttctaaacaaaatcatgggaaatatagtccttaggcttacattttttcataataagagtttagcataacaaaattaatttttgaagaatattatttttatccctcaaaatgcgcgtaatttggcctaagaattcattaattctttggcctattcgctgctaattatgctcaaaatctaaagcgaattgagggataaaccatctgcctgccgggtaataattagcattgaaca

SEQ ID NO: 10525 - DNA, 1751 bp, Heterodera glycines
gaattcccattttatgctttctaacactgcctaagcttaaaatttttaattttcaatttagaaattaagggaaaactttgaaataaggacatttgggaacctggccctaatggtaaattgatcccaacaatgaatgataatcttaagaaaattttaattttttatttaaaaattatgataagcttcaaaattaggacaggtgtgaacccctgactcataaattgcatcaattattagcgaatttgtccttctccagtccgctaactggaaagaagcaattcaggcttttttttgaatatttaactttttaagaatcggcaagttgcaaatttaaaaaaatgcttgaacttttaaagttttgggaaaatttcaaattttccctccaaaaaaataccaaacccaagccaacattccgccgaggtgaaggaaagtttagcaaatggtggtggacacggctgtcacaatgggcggacgggggtgtttagcgacggtgtgtcacccgcgcctcttaaaaatgctaatacattgaaatgacagccgatcggagtcgtccccccccccccctccggcgattaatccccccccccggtgctccaaccgaatcgacacacacacgcatttcaatgcacaacatcgaagatgacataatcgttttaaattcctttttttcaacagtttttatggttgaaaacaattttcatatattttttattttactttaaaaaaataccctaaaagaagtaaagttttttggtttcaaaaaaaagacttttaattttttttaaataaaaaagcacaacccgccccctccaacaattagtctaattcatctttgcaacccattaattttgtcggttagccaaatcgaccttaaaaaattaattttgtatatttaatgaaaggattaaattcatttttcaaatttatcatatttttaaaaggaactttcagtagctgaaaattattataaatttttttttaatattttctttgtttttatatgaagaaaaataatttattacacaggaccaaaagctttgtcctcgaaattttaaaactttttttttaaatatttaaaacccaaatatttgccataatccatcattacaccacattcatttgtcataagcaaaattaagtaataaaacaaataccccatgtttttttgaagaagagacagaaaaaatgtattgtaaaatttaccaaaaaagcccaccattttcattcttaatctcccccattataatccttattttccctaatttgtcttctgcctcccaaattaggcaaccaaaacaatgtctcgagagtcaatggtcgagaatttgagtgagtcattcattggccgatggggcagcaaattccccgctcccccccccccccccctccgccccgctcacgaaaacttcaagtgttttgtccacgaaaagcaaagggcaaaaattacattttcttttctctaacaaatagaaaacaaatttggcctttcatctctaatgaggagcaaagaatggccaaattcattgtgctgcaacaaaatgccaaatgaatgaatgccattttcatttcgaatattcccccgggggccaatgccgccgccccccccccctaaattgagaggaaattgctcgatttcgtgcccggtcggagactaaattccggcacgaaattccatgtgccaaattgaaaactagcagcccatggcacattttaatcggataagggattgccattgttcattttatttattg

SEQ ID NO: 10526 - DNA, 4260 bp, Heterodera glycines
cccaggaaaaacaaaaataaaatttttaagtttattttctgtcaattctacacctttgccggtagtgtcccatcagtagaagttcaaaatgtcttcctcctcctcctctccattgttttcttcattgttcaattgtgatgattccaacctttgtttccccgtccattcgtcgtccgtccattttttgcgttcgcccgaccatttttacaacacattactggtccgtttttccgatgtatttgcaaatgttttttaattttggtttcatcaaatccaatttcgtgattttctcatttcgttttcttcccccccccatgtgaatctcgaaagattttaattttcgattttttgttcgaattcgggtcctggattcagaattggtcaaatggatgtcgggatgttaatcagcgaccccgttaaagccttggaaacatttgcaaattttgcaatggatgcccctccaatcctctaaaattttaaataataaaatttatagaaattcaaaattaggattttccaaaaaaaatttaatagtatttacggagccccgacatttgcgtctatgtgcagaaacactaaaaaaatattaattcatatatctaagaaaatttttctggtcattttttattgtttttaatgcccaaccagccataattcggagatttggcccatgatttttctatttgcctttaaaattcccccgctttttcagcaacgcgttgagtccgcaaagcgtcgcgttgtgctgtccgccctctatttgggcaccgacgcgttggagcagcgattggtccatcggttggcggtctcggcaaaaactgtggcgaccaaacgccccgtcaaagttcgcatttttgctcgagtgtgtgtcgtgtcgagggttggaatataattttaagattaatatttgtttttacatacgacaaaaatcgcaactctactgattcgttacaaatcaaaaaccctacttaattaaaataaataataattaacatttttttatttgttttatactgaacaatttattggcaagaatatgttaaataatgattaaatttaattttccattaattacatttttattatggtcacgaaaaaaacaaaatcgtaaagtatatctaatttatgaaattaaattaaaattgtttcggcaatattagtattcgttccgagagttttgttgaagtccaaatcagggctgggcgaattcgagcttagaaaacttcgcgttttttgggcttcgaacctcgggtaatttacccgaaattttgggaaaaatacacctttaaagatcgagcagtcccccccccccctccaagtagtagtgtttcttctaatttttaaattattcctttctcgatggaaattcactacaaatttaataattccgttagaattttctcagttgaaatcaaaatcaaacttttacataaacaaagtataggcaatattctgaaaattgcgcataaatcttttaataaataaggcccaaattccaaaatcataaaagcaaaaatttgttaggaaaagcctcaaattattaattttttaaatttatagaaacttttaatcaatttttttctcggcttcgcctctctggaaattttcgatctctaacaacataattattattatttttgattgcaaataatttttaccacccactaaattttgttagggaaaaaatattttttcaaagacttggtgcttcgaaaacttcgcgttttttggatttcgaacttcgagcttttgaaaaaaaaatgagcttcgtgtcgagcttctgctacatgtgtgaaaacttcaaaataagatataaatgaattaaattgttttttcattttgggttgatttttattttaaattttaaatagaaaacaataattctcctggctaatttcttcatttgcatgtcatttctccacatgaacaatcagcatcatatttcaatagaacaaattatttgaataattatttagaaagttatttaattaaaatgcataaataatcatggtctatattattttgttttaatttagccacttttgtgtaaatctttttttgttttaattgcatcgaattatgcttaagagaagttgatcagttgtattctttttatacaaagggttattacaattaatttttttattaatttaaatttatatcgataatgtttatttaaaaggaagctaaaatttattttaatatattcatactttttacaatattaaataattctcttttctttgtcaaaaattatgtaatattatatttatagaaatttagtcaatggaagtaaaatttccatcatttttagatgtaatttttagtaaatttaaatatgctcattttaatgttagtttaagtgtttcttcatccatcaaagtaaaaattttcttgttttatttctcatccatagtttcccttttttatgcatttcttattttaattacatatatctaatcaaaaaaatcttttctaactaattaagatattctttcagttcatcttggtcagccaaatgataataagaatctcaaacatgctgtggttttcttacgtgctgggtcgtttcttaaaaactgccaccatgggcgtttcttaaaactgccagggcgtttcttaaaaactgccaagtgggcgtttcttaaaaactgccaagtgggcgtttcttaaaaactgccaagtgggcgtttcttaaaaactgccaccttgggcgagaattaaactacaaattaaaacaactatatagaaatattttatctaaattttattgatataaagtttgtaaattaatatatatattccagtatttcttttttaaattttcttattctttaaaatgttcaccaaaaacatgaactgacaagcataacaaattctaaaaaataaactatttaaaatactaataaatacagacttttgttaatgaacattcagcactttcatacaaacatttgcaaaagcttttgtcgcaatcgtagcgttttctagatttgtttatatagcataaatcatagtaataacagcaatcatcgactatatcatttaaaaatttataataaatttaaatttttttaaaccttttttaaagttgcaaaaccatattactggtgctataaagcatgagtcaaaacatgaagtgccacaataagtgctacaatatttctttgcaactttcaaagggaaattttaattataataagcttatcagtaaaaaatttaaataattaatttatcaagaaaaaatattaaatatatcgttgagctcatttgtaaattttattaactacaatcatcagaagcaataaatttattaatattttaattctactgagcttggtgttgaagatagtgttgacaaacaaatgatgtaaaattatatatatatatatttttattatttataacgttggcaaacaaatgatgtaaaaattatatgtatatatatttttattatttataacgttggcaaacaaatgatgtaaaaattatatgtatatatatttttattatttataacgttggcaaacaaatgatgtaaaaattatatgtatatatatttttattatttataacgttggcaaacaactgacataaacattttttaataaataaatatatttgttttgcagtttttaagaaacgcccacttggcagtttttaagaaacgcccacttggcagtttttaagaaacgcccacttggcagtttttaagaaacgcccatagtggcagtttttaagaaacgcccacttggcagtttttaagaaacgcccatagtggcagtttttaagaaacgcccacttggcagtttttaagaaacgcccatagtggcagtttttaagaaacgacctagcaccggcggcaattgccccccccccctcccccaccccaaaatgaaaagatttactaaaaatgaaggtttgtggatgcttccagggtaaaaaatgaaaatttctgatataaaataagtcattctttgaaaattatcaaattttcctgacgaaacataccatgatttaaaaagaactttttcaaactgtgcctatcggcacctccgaccattaatttcctttgttttcaaacaaaaaaggataaaattcttgtcaataatatatcggattgtcccactaaaatttttctaatggctcatataatcggtctttatgtaaaatgtatccacccattcttttttctgtaggtttcgcgttgcactggtctaaaaattgctgctgatgggcgcattatcactttgtctcgtc

SEQ ID NO: 10527 - DNA, 1744 bp, Heterodera glycines
cctcgctcagttggttggagaatggaaccctacactctccccactgttcctggctttggaaacattctgccgtgccatccttcagctctgcgtgactgaagggggcgaccaccctgtcttctcccgccccgagtgtcgccgccgataagcgcgacgaaagatcaaaggaaagagatgatgattaatcaaaatggggacggaaaatcatatttaagaaagcaaaaagagagcacttcatcattcatttgatcattcaattgtgcaaataaatttgttgaatcattgggaaattcgggagaaataatataatttaatattaaattggttaattcctaaggcataattccttagaaggtcgaattaaacaaagagtctcgacagtcaaattacggatcaaaattacggaaaaatcccaaaaatccgtaacccgtaatccgtaatccgtaactcccaaaaccccgtaatttccgtaatccgcaatccgtaatccgtaattgcgtgcagccctggtctggatcctttaataggacatggggcaggggtctggacccttaatatgacaagggacatgggtctgagggtacttaatagaacaccccggacccgaattcgaacaaaaacctgaaaatttttttatgaggttatatttttcatggggtaaaagctttcaattcatttaacaactattttttgatgtaaaacaatgcttcaatagttaattggttaaaatgtctattttcgcacaaaatttgaccgattagagcttatattttggaaaaaaaaattataattttgttcgaattcgggtacgcggttcggaattgggcaaatccgagttcagattcgtaatcagcaccctcgaaaaccccttggaacttaatttgaatccaaaataaaaaaagtgggaccacaattctttaccattgccagattttttaaattttgattaattttgataagttagcataatgttttacaattatttaataatttgggtttttaatacatagagcatcagaacgaaacgaaaatagaactaatttttttccaaaaaaccacaaaatagaatttcttactgaaaatctgctaaaaaatggtcaaaattcgcccataaaaatcctttattttcttaaaaatttgctcaaaatcgcaaaatttggtcatttttgtggtcaaatctgttaataaatcgtattaaaaatcacaaaatttttcccggcggcgcctatcggcaccgccggcctcccttttccccaagtttttttttgaaaaaagcgctgcaaaaaatcaacttcgatttttcgtgctcagattttcacaaaatgcttatttctaacaaaaaaattgctcaaattgatcatggaaaatcaaaaatataataatttgaatatttttaatgtgttttgaataaatttgtaaaaatgaggctttttgacccaaaatgaggcttttttgcctgccaaatggtgatgcgacatttgcgccgcgccatttgcgcccacagcaaaaatggacatttgcgccgctcagcaaagtcgacacttgcgccgcgcaatttgcgcctcagacagttgcgccgcggatatttgcgccgctccatttgcgccgcgacatttgcgccgcctagtaaaaatggacatttgcgccgcgcagtcaaaaataatatttttcatttcaatttcactaatatcaataagattactaaaaaccaacgacgaaaataacgaagtgaaaaatttcaaaa

SEQ ID NO: 10528 - DNA, 1300 bp, Heterodera glycines
  misc_feature (1287)..(1287): n is a, c, g, or t
ttgctgacaaaggaaggtctggaggtgtccgtggagtttcggaatgaaatttggtgggtgcataaactattcgtaaaggcagtaacccaatacttcgaggctttaaggttaataattttgttttctccaagagtattattggcagcaatggcccattttctgaggatttggtcagataaactcaaattcattgaaattttttcattaaattgatttttcacatggctgtcaatttgttttagggcttcaactttgcatttaaaatttgtttcaaaccttaaattattatataaaaattaaaataaagtaattttacctccgaagcattttcagatcagattcatttttgataaatcgaaatttcgatctcatgcatgaaagtgatcggtgccccctttgtggtgaacgataaaattccagtgcccttttcttatccgaatatgaaataaaatctgtttttggcattttttttccggagaagggaaaaaactcgatccacttgatttttctgaaataattttgttaattagaaaattatttttaaaaatttttaaatgaaaatattttatttctgaaaaatcaaatggacctgaacataatgggctatcaatttcctcaatttgctcatcggaatcttaatcaaaatcctcaaagttttcgccatcaatttcatcaaaatttgcgcaatcgtcaatgaccaaatcctctcgtaattcaatttcctcctcatttttaatgcacctttcaattgatgctgcaaaacttttggccaagaatatttcatgctcgttggttggggtttcctcattatatttagaaaaatatttattgaggagggtgagaatattttagggatttatggacattttatttaggaacggggacgaaaaataaatttttgggtgtgagtgggattgattttttggccattcaattgcataaaagcaaaaataagatgggggaaattaatttgcataagagggattcgaacctgtgggggcaaaaacaaacgccaaacgcacaacctccgcaccaccgaacaacacaaaacggtgcaaatgtttattcgatttattgggatagaaaaaagtttggcacgtcatatctcggcactcgtactcatttcgcagaaaataaaaccacttttcttaagaacccatgggtgctctatgcacccaccaaatttcattccgaaactccacggacacctccagaccttcctttgtgagcattttttggcaaataaaaagagaaaaaccaaaaataagtgacaaggaaattggaaanaattttgaaaatt

SEQ ID NO: 10529 - DNA, 4794 bp, Heterodera glycines
ggagggaatgttttccgaaaaatttcggaattccgaattattttaaaaaatttttaaatgttagaaaattttaaaaaaagatgttttttttttaattggaaaataagtttatacaaagtcttaatgcgtttttaaaacttgcacaatttccttagcgaaatctatacaaaattttaaaatttcccccccccccctgtccccccaaaaattttttaaaaaccacgccgcaaaaaaacgtttttttttttaaaaagtcgtagacttgccaaaacatcgcaaaatttggcccggaccaccctaccccttcccaaagagttttttgaaaaacgcgcagcaaaaaaaggtttttttactttcttttttttctaagactttcgcttcgaaaaataatccatttaaaatgtgacatacctacacatcaaattagtgtagtggattatccaaactgactccattaggggtcgattaccgtctctgatccctgacaaatttttgccggtttctgggaaaaaatatatttaaataattcgtcttactcattccccaacgatttcgcttccccgtcctcatccccgttgtctcctccatcactgatgctttcggattttcagaaattcttgtcgcaaatcaaattcgcgacattccttggccgcaaaaaaagccgttgtaagagaaaaaatttgttgatttacatgactggctccgacacccctccccccccccgacttattcttagattttgagaattttgtattgagttttattattttgcccaagaaggtgaaacctaagcgtcggattctgaaaaatgaaaatctttttaggaaatttgaaataatttgttcaattttgaatttaatcatttttaaattttcctattagtcaaacaaatgagatagtgatcagatttcgaatttgatgcttttgaggtggtgtcaactccgggaacaagcggcgccacgggtgccaccgctgtgtcacaattcattgaaggtactaacgtttgtctttgacacttcataaaattaatcgtaattgtgaccaaatttaaatttagaagacgaggaaaaatgtgcaggttgtgccacagcatcagccactgtacgaaggattgcaacaagcgttgaatcggaagaattatttttattatcatttgtgcgtttgttttgatgtgttaagcataaaaatttttcaattttttcgtgcctatcaaagtgcctttttcacgatttttggcgcctaaaaatttttgaaattcttttttttaaagggagcccactttggcgattttttgaaaaatttggttttttacaaaaatgtcttttttggcactcaaattcggtaatagtatggtttacaggtcccacaaaaaaaagaggcaaaaagggggttttatgcaattcttcaaagtcctttagggttctcgagggcgctgatcacgaatataatattcatttcgaccaatttcgaaccccgaacccgaattcgaacctgtaaaccatactatcactatgggtcaactccactgtgagcctagactatctcgtcgtttctctttttctttgtaatttctctctctttggcgtactatctcttcatttaatggtgtaaaaaacaacatttacttttctatgtctagctttttttctctatgttaaatccgcaccaaattttgcatagcgatagagaagaaaaatctgcatttttctatactgattttatttttgtttatactcccattcaaaaattataaataataataaaaacgtatttcttttttctctcgttttggcgcactattttcatgtctctaacacatgaaaaaacataaattcgaaaattctaataattttggttataagggtacaaaatcactttgaacatttagaatcaataggaaaaagaataaatttagcattttggttagaaagagtctgcctaggacttgagttataacatgataaaagtttgaaattcccacaatcaatatggaaaattactgaatttgaatttattagtacgaatattttggggtaatagcaagggttgtcccccccctccccaccttttttcaaaaaaatgattttttttttgaaattcatcaaaacgtctttcctggggttttcagggtcgctgatcaggaatatgacattcatttcgaccaatttcgaaccccggacccgaattcgaacaaaaagtcaaaatttcatttttcaacaaaattcacatttatcttccaaaatcgattcaaatggatggaatggcaatacaaatgcgttgaagacatgagaaaagaagaaaacaaacattaccagattggggcggaatttgcgtttgtatgtggaccacataccctcgatgttttgggtgtgaacatttgggtcgttgggattaaggaaattttcattatggtttactgtacgatgtttaatttttttaatatttcatccctaaattgcttaggacatcgcgccgtgcaaagattttgacgccgaatatacggaaacgaacgaatggatggaaattttggcttagccgcaatacgacaatgtgagagaatggggagggtttggtcttctgatcaatgcttaatttagggatatggtaggtcaaacaaaaatcattattaatcatcaaacataaaaaataggaccatgtcaaaattatattttaacaaatttcaatgggctatatgcacagtaggccaaaaattgcttgaccaaacactcaaaaaagtaatacgataatgatttataataattcggctaataataacagtcctttttaggcctactcttttttaaattctgcccaaataacatttttctcctcctgctcctaattttgaaaaatagcaatgagaaaaatttttatgggctagagaaaaaaagtcttcggactcccttctctaaattttttttgttctcttttgttggaattccagaaaaatatttcattctttttagtgttcagataataagtaataattttattatttgttgattggactaatttaaccatcccccgccccctcttcgcccgaaaatggcccctaaatgggggatcccttcgcattccccatttttgtgcattttttggcacattgattgatcatcccccatttttcatgcgaaaatatacaaatcggtggttaaaatctccgagaattcgtagatattacttttttagagaatgctccaacaaattctgcgtgctgcaattagtgccattgctaccttagcatgcaaagtgcccgcttagcctcattaaacattgtaccatcagtgaacgccgtcgtttcgtcgtcatttaaaatttgttcggtgttgattttgtgccgaaactgccctttattcataatttaagcaaaagaagtctaatttaagtaattccatttattttacgaattgccacccgtaaatcatttcattaatagaacaatttatttattttccaatttatttaataatttcatctcttcacaacaggattttggtttcaaataatatgtaaacagtttgtttaccaaatttgacaaggcaaatcaccgcataaattattgacctatcaatttcaattttccatttaaatgcgaatgcaaatcagcagaaggagttaagtcagtaatgaatcaaaatttactgaagaataaattctttcactttaattgatttttttaaaaaaatgccttttttcgaagtttttttttggaataacattaaaaggaaatttggaaaatgagaagaaattgatttatattcaaattgattgaagttataattttcatataattattcccctataaatgaaataatttaaatttttaaataaagaagacccaatgttttattcttcttctggtttatttttattattgtttttttcatcaaagtttgtttgaatttcttttattataaataaaaatgataataatttattaagctaaaaatccgaaggtgtcgaacaattgccactagagttgtacgggaccgagaattttgagaaaaaccgggaccggtacaactctgtttgccatcattggtaaagccagtgtttattaaagaaaggagttattttttcctgaactagtgcggagggcggctttgatagaattactttggctggcaaatacgtttcctgcacttattgaaactatttaaaaaactacattacaaattcagtttttctttgagttcggttaatggatttgtttggatttatttttggcacaaatatacaatttttagacgcaccaccggtactgtaggctaatcaaaaaatagggtagctaaataaaacgaaaacccgtaaaaaagtttttcatttcgatttttggtggttggaatttaaatttaaaacaattctgtaaattccagacaaaatatttgttggaattttttttctttcattttcgcattttttaaaaataaaaagaatataattacaaattcctattcgttaatttaaggtgtcatttgaagtttaataattaaaatgcttaagtataaaaaaccagcaatttatggtttgttaaatttttccgcattcattcaaagcaacgaaatgaataaaattttcttattttaatggctataacagcttatatatttgaaaaattgaagacaaattatttgaaataagtgattctcgcaattaaggcaccaaaaagcgcaaaatggcactgaaaaaaggcacaaaaatcccgaaaaaggcatgaaaaaaagcatttaaattttttttattaatgatttttagggagcaaaatacgtaaaaactaacccaaaactaaatttt

SEQ ID NO: 10530 - DNA, 4323 bp, Heterodera glycines
ccactgcagcaaaatacaaacactgatgttttatcataaaacatttaaacgcattattgcctcataaacactaatgttgtgtaaatcaagtaatattttgttaaattaaataaaaagattaaaactcacaataaaagcaacccgaagtcaatttttcaaaacagtccgcaatctttgaagcacattgaacaactgcaatttttgtgaagttcataaccacaaattcgtacggcaaaggagtatggtaaacagaaccatcaaaacgctcaacaacaaatcgttgagctttaagaatcgacattttaattacctaaataatgctaatatatcgtcgatacaacccaaccgtaattacttatccaagcgaacaaatccttgaaaaattttctgaaacctttttgaattcagtaacagcaatgttttcacaagaagcacaagtcatcaaagcggtcaatttcttctcagatggcaaaatgcttacaatttgtccacaaaaaaatctgaaccaatttgctttaagcaaaaaatcagtcataacttacgcaagttgcgtgccacatggaattgctccgagctcttccaatgtactaagcatttgagataagcctaccggcagttgtgtcagcagaaatgcgaaaaaataaatagccgaccggcagttgcagaataaatatttaaaaaatacaaatagttctgctaaaaaattaaaaaaaacgaaaaagcataaatgaagcaaatacaaacaaaaacaatgatgaaaattcaatttttgaatgaacaacaaaacatgcattaagattactttttaatatctgaaaattcaattagactgtaataaaacattgaagggaattgaagcactgatgaaggtcgtgagtcagtgacttcatttcttaaaagaataaaggtctcaaaattacaacaacgatacaacatgcggaaagtcagtccaacaaacatttgtctttttcattcggtgttttacgttctaaagttttgcatatataattaggcatgagaaagcaaaatcctaattccaaacaaactaatcccggcaacctgacataacataaactcagtcacagcaagctgaatggacgacagttgaccgacaggtagatttagttgcatgcagaacagtttcaaaaaacactgaatggccgaccggcagacagtgccgggttttaaaaaatattgccgaatcggcagagcattaatacaataaacctgtagaaaatgaattttaaaatcaattcaatttagctaaataacaaataaacaaaagcaaagcataattattagggctgctaattttatgtaagaaaatttgcgaattatgtaaataaattcatttgttaattgtgggaaatgcctcgtagaaactccaaaataatgtaaaattgattgggctggggattggatggaagataatcatgatcattcaacacattcaacggaaagtagttcctaaccatattcagaattcgtctatctgctgccaaatatttgcctcgctttttctcaggtgacaatccagcgatcgcagaattgtatttgagatcggtgattttctgttcaagtcgaagaacatcaatgaaatgccacaacgatggatgacgacaattgaacgcgccttgcaaacggtggtgctccgcttctgcgttgttgttcgtcctcgcatctccatccaatgtccgttagtagacggatcaacggttgcgaccacgtgccattgggacgaggacgtccaacataattgtccaaaagcctaaaaaattattctaaaattctgaccaatcaatgagaggttgaaaagccgacaaatttccaaattccatgtcaagtgctgtcactgcattcctgacatcacaaaatggaacgaaagcgactgatgtgagcatccgaacatttaaaggaaacaccggatcagcacaataacgcttaaattttgaaaaaatttttaaaataaagggaacattacctgccataagccttgctgtttcactttcgtttgtaagttccgtataaaatgaaaaaagcaaaaccgaatctggcatccgggaaaggttatcgtaacggcatttgacatatccatttcaaaatccacggaaaaagaagtgggagcaaaatttggcccgctgcacgcaaaagtgtgaacattatttcgcacgatgtttgcttccgtccccaaaacacgcatttattctgtccgcaaaacgccaaaatgattggcgaccaaacaataaaattctgagaaaaaaatttttgcttttttttttgcaaaattaccgttgcgggttttgatttccattttcgaagtatacaccggagtggcccaacaaaacagctcctcaacgccatccgtcgacgtgtaggtcttgtatgcttgggcgatctcaaaattcaaattggtcgggactgctggtggtgcattgatttcgtggctcgcccttttgattaactaaaataagtttgcttgttagtttttaatttgttaaaaattcgtcatacgtatttgaagcatttgcggtatagtgtgtggcgttgcgagaccaatgaagtgcttgttgaggtccgtccaattagcctttacatttgtttacgctgtccttgaattcgcacctacaaaattttgtcgttccattttgctcattttatcaaatgtgtaaagatgttcaccgtgagaaagcttcactttttgtttgtttgtttcagtgtgtgaagccatattcgatgaaactgattaactaaatacatttgaaaatatgtaacgcgtaaattagttattttctagagcctggaaattcctagaaaatattttgttttttgatttgctgattttaaccaagtatttgtatttttataatttttttggcgccgaaacgcaaaggcataaaatgtatagcattagttattaatagggcttcgtttttaggcaaatgcctaaaatttttgcgcacttaatacgcatagataagcacgaaaaacgcgttttccgctttgtttagggtgtctacgatgacttttataatgcctattttggactttttgtgcttaatgactatttgcctatttttgtgcctatttcgccatttttggcgcttttttcagaattttcggaaaaatccataacaacaatgaaaaatacacccctaagaatcgacttgaaaattttttagaaaatacacccctaagaattgaaaaaaaatttcacaaaaattgatcctcgaaattcaattattttttcataataaaaatttttgggttaaaaaattatttttatcgaaaacaactttaaaacaattgaaatataagcaaaataggttttttgattaatttttagagttttgctacctaaaaagcgttaataaaaaaacttttttgcctattttagtgcctatttgatgatttttgtgcctatttaatgcctattttgcgatttttaatgcttttttaggtgcctatttcgcgattttttgtgcctaaaaatcgcatccctattaatcacccatatcaattgcgcgattcatctccctccattcacagcagcggcgtctattgccggatcctgcgcaggattgcggatttttggaaattttgaaaaaatttcaattaaatttaaaaaatttccaaaacgataaataagtgttccgatatatttttagacaaaaactggtgaaaattaatatgaaaaattgacatcaggaatagaatgaacaagcgcgtcctcatacctaatccatatgtatattataaaaacaaagtttctgtatattttgcattctgtcttagaaattttttttaaaaagcaataaaatcccgcataatcctgcacaaaaattcaaatttgcggatcctgttgcaggattggaattcaaaaatgtttgcaggaccggatccggccggattaatcctgcaatcctgcaaatcctgttttttccaaaaaatgcaggattgcggactgggatcctgcaaaatcctgcgcaggatccggtcctgcgccgggctctagttccagacatatcctttagctaattttagtaattactaattaccctcaaaaaatgtcgcacaatcagaaagaagcagagaaagaaatgtaaaaagcgatgcaataatttaaatttggctctagtcggttttacgcgtcccatcatatttaatttttttttttattttcatcaaagtggcgaatggaagattgattttttttaaatttgtttacgaatgatgtgagttctttcatcgaatttaaccaattattttagtctgggcctttttaattaaagtactcagccaagtggagatttgaatttcgttctc

SEQ ID NO: 10531 - DNA, 3935 bp, Heterodera glycines
attctataaattcatttttgatatttttaattaattcttctattgacaatattattaagaaaaaatatttgaattacctttttaaaaatgtaaagattaattttatgataaattttatttatatatttatttattttttgataaataagttcacttgtaataattattttttaaactttttctgcctttatgtttgacttcgaatttcatatataaataatataaaaatcaaataataaatagatttatattgatatttatttatttattttataatgttttaataatttataaatttataaaatattatttaacaaagtcgtatctaactttaggaggttttattgtgtggagactgtataggttgtgcacataatttaatttacttttgggtatgaaatggccaaggccaaaacatgcttttaaaatatgaagtacataaataaaagtttttcaaataaatttaataatatcatacttttgttaaatataaattaattgtaattgcggtttaaatattagataattattacaattttatattatataataatttttaattgatgttttagaagttaccttagattttgataaaaatttatctaaataaatatacaatttaatgtataagaatttatgcttatttttcatgttaaaagttttcagtatcaaatatttaataaagtataatattgtcctggcattaatagtcctgtttggttccatccatggctttgaaagctttgtccttgcaaaatgttgcgggaactactttttctcgttatatttagaaaataattccgttctataacttttaaaattaatgttaaaatttatttatatttttaattatttctatatgatttatattaatgatatggttattataaatctcttatttacaatttttgctcgaagattagcatggcccctgcgcaaggatgacacgcaaattcgtgaagcgttccaaattttttattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctctttttccattcccctcttttttccattcccctctttttccattcccctctttttccattcccctctttttccatcaaaaaaattcaaatcgataattcccacaataattatcctcctcaattaactataatgagcaaacgacttcgcagtgaaactgacgaacttctttctgccaataatcccgacctttccattcttgaacaacgaatgtcacgactcgaaaatttgcttgagaggcttttgccagtgggcgtgggtccaattccagaagatcctatccagcgccttgaaaagcggatggaaaaattggaaaatcaagtcacggcacttgttctggcactcgaaaaacggccaatttctcaacaacaacaaactccatggggttgtcccccggaccacatcatccggcacataaatgctgttgttttggactctgacatcataagagaaaagtcaaaaagagctgttgtggagaaactgcctgagggaatcgatgaaaaggacgtggtcaaatcgattgctgaaaaatgtggtgtggctgatgaccttattttggacgaaatccatcggcatcccgaggaaagaagtgagtcgaccagccaaaacacaagaaaacccagaattctcaaaattccattcgcatccactgaatctcgtgatatttttctgaaaaaattccgtatggcactctccaatttaccaaattttccaaaatttctgagtgccagacgggatatgactcagtccgagctctccattctttacaaccttcgctcccaagcttataattcaaacagtagctgtggacttttttaaatattatgtgtccgatttgacgattcgtgaatttgctaatcccgaaccctttagaactcgatacgaataaccactaggggcgactgagcgaaccacctaaaagtttaaatttaaactcgagaaaaagcaattagcaaaatgccttggattaattccatattaataaatgcccgttcaatcgcaaacaaaatagctgatttagaatatctaattgagacaaataaacatcaaataattttgataaatgagacttggttaaataccaggaatacaattacaactgagttaacacttaatggtaaatttcaaactgttctagcaaagacaataagagaggcggcggatgtgctattttggttagcaatgaaattccatttaaaataattttatcagaaagcagaaaccaatgtgaaatcattcatattattttatctttaaaaagtccaatacatattataaatgtttacagacccccaaattgcacaacacaaaacactaaaaaaatgctaaaatatttaacaagtgtaaatgaatcaaatagaataatttactgcggtgattttaacgccccaaatattgattggaacacaaataaattattagcaaaaaatgacccagttgcaaatgctttcattgactttattgaccaaaatcaattattacagcacgtaaaagaaccaactcgagaaaagtcaattttggatttgatttttttctggaaagccttccattgttaatgatattaaggttttagaacatttttctacatctgatcacaaaatgatcagctttaaagtttctcaagaaataaataaaacccgtgaacccaaaatttttgtaagggactttagctacaaaaactttcaaaaattaaatcaaatgatcttactaaataggcttagttgtgtcattaatacgaaattttatttagaagaaaaatataacacacttttgatagagttaatgaaagcatttaatcatactattcccaaaaaaccacttaaacaaatagttaagcaatcttatccacaaaaaattagagatttatacgatgaaaagcttaaactacacaagcttagcaagaactgcaaggggaatgaaaagtataaattaagttacaaaattgtttccagggtgcataaaaagcatttaaagcaattttgggataaaagggaaaataatattatctcttcagggcaaaaagcattaataaattatgtaagaaaaaaattaaatccaaaaaactccattccttacttaatcgataacagtgggaatatttgctttgatgaaaaggaaaaaagtaagctattagcagaaacattccaaaaagtatttattaaaaacaatcaaattttcgattattctgaaaataattctccaagggaaaagctttctgatatagaaattaatgtgggaattgtatggaatttactcagaaaactgcctgggcgaaattccacgtctccagataatattccatatattctacttaaaaactgctcggaaacactagcagtaatattaagtgatatattcagactaacacttgattctggtcaaattcccaaaatttggagaacttctatcattgttccaatatataaaaagggtgaaaaatctaatcctgaaaattacagacctatctcactgacgagtacggtctgtagggtatttgaaagaattttgaggaagaaaataattgaatttttgaataaaaataattcttttcg

SEQ ID NO: 10532 - DNA, 1627 bp, Heterodera glycines
  misc_feature (1502)..(1502): n is a, c, g, or t
  misc_feature (1552)..(1553): n is a, c, g, or t
  misc_feature (1590)..(1590): n is a, c, g, or t
tgcgggattcccttcccttttcttccattccctcctctcacgccgtgtcgcccgcccctttcaccgaatttgttcccgtaattccgtgccattccatccaattgccttttgggcaatggcgccgaaagtgccgtccatttttgaattggaaaagtgcgtaaatttggaccaatgtaaaataatactattaatgacaacaaaagtgccaattttggaaaaatcagtggcattctccgggggaagaaattgggaaaattaataaaagtgaattaaaatgccaaaataataattaatggcaataaaaagagggctttccgctgcccccccccccctttctctccccgtttttctttcgtcgaattgcattgtgtcccccccccctatattttgctcaatttcgagaccattttcctctttttgtcccacatttttcccccctatgctccaggcactttttgtggtttttgccacttttcgggtcgattttatggcattattggccaataataaatggccaattcactgcccattaagtgaatgccaaactcttcaaatggccacccaattcaattctcaaagtctcacatttgacatcagttaatgatttattttggtcatatttcaatggcatttcttaaaaatattccgaaattcaatgaaaataattaaaactcacttcttaattgacttttattgcttctccaacataacttatcccattttaattatttttaatttagcgcggtaattaaggcttaatggtcacttaattaaataaaggattatgatgcattaattaactcattattgccatgatccgcttctttaggtccatcccaaaatccgttcttcggccttttcccccactatttttccttccgtccttttctctcgtcacactgacaatgtgcactatttcatttttctgcccttctctaccatttaattaattttcaattcttgggccaaagtgccatcgcctttggtccgttcatttttgaatcttcgcttggcattcctttcactttttcaaatggccaacactttttgccctcacaaaatttaccgtaagaaaatggcaaaaaacagtaacccaaattatttcattggatttattttcagttttcgttctctttttgctccgtttgtttctgcttggcactgaggcggtggtcagcactcagatgaaacttattcaggatttgctggagaattacgatcggaaggccaaacccacttgggacaacgttagggtgggcaaaaaacgatcagaattcggcattttttcaaatccggcactttccctttatcggaacttttttagagaaaatcccaaattacctaatatttttccaattgagacgaatttcccgtgattctcccaaatgaaattttctttttggtcgtgactttttccgactttttcccgaatttttaactaagtttttgccttttccgattaattcgcccaaaatgtaagccaaaaattcattcttctgccnaatgcctttccgttgtcattttgtcacgcgaccatttctccttttcatannatagcagaagagcagtcaattcaattcaaaacattanaataattaaatatatttttccattaattgactaattt

SEQ ID NO: 10533 - DNA, 3838 bp, Heterodera glycines
  misc_feature (3743)..(3743): n is a, c, g, or t
gataaaggccaacaaatattgtagtttaaatgtcttaattttctctttctggtacagtaaccctccttccatccgttacagtatttggctgcccgacacgacactgtacaattcgttggtgatgaaagacgacgactcgcgtcgccttttgaatgccaaactgacaacaaatatgaccagaaaggtgttgccttattcctagatatttattttttttaatatttatttttatttatttccattttaatatttttatttcccattttccttttttggccgttttggtggaaatgctttacccgaccatttacaagttctcgtgtctgcttaacctgcgttactttccgtacgatctgcaggagtgcacaatgactttctcatcgtggacttacgacaataagggcaaaacattggaaaaataaataaacaaaaacaaaaaagcaaattgaaataattgctgaaattccttttgaaggcattgattatgtgccgtattccgacgaaattggcacttccaattatttggagaacgaaggatggtgaggaagaagggcaaccttccttttgcttctgatcattttcaatttttcataatttatgctccccatttttccctattttaaattttctccgcttttccttttcaaaatgatttcctcctcaatgtgtcccccaaaaggggtttaataattaactttggccccctttttgccaatttttcaaaaatgggtttattaatttcagtttatttcctgctgatcccccattaatctaatcccaaggtatttgctgagctcgacgatgcgtcgggaggaggtcaaatacacgtgctgtcccaacaaatacactcttctcaaactcaccgtttgagtgttctcttttcgccctaattacttgactcccccctgattttcagctttatctccgtcggaagccgctcttttatctgattaatcttatcattcccaccgcaattatcactttaattgccatcgtcggcttttttacgtctgtttttaatttcaaatataattatattcatttctgtgctcattttgcccttcagcacttcttctgcgagcggaatgcgtgaagagaaagtgtccctgggaatcaccactttactttcaatgagcattttgatgctaatggtcggcttaattggaattaccctaattaattgttgaaatagcaaattgaattgtttttttatttacatgaatctttttccataggtcagcgatcaaatgcccacaacttcgacttttatcccgctgatcggatggtgtttaaaaacaaaataaataaatcaaaaatgattaattaaggttcattttgggaatgatcggcgtaatcagtttgggcacactcgcctcctcagtggtcatagcagtgcaaaaaaggcacacaattcgcaaattcattttaattaataaaatatttaaaaaagtgccatccttaaattattatattcaataattaattttattttattttaattacgctgtgtttaattgctttaatttgttcagaggtcgcctcggcgaacggctgacaaagcgcgcggttcgaattgccaaaatatttggtgccatttcctacactgaaggtaagtgaaatgccattccttccattgtaacaacataattcgaaatgcctcctccaatttaatttgggaatgaattcctcaaaatgtcagtgccgcttcacttgcgcaagggaacgagcgagcacgcggaggcaccgccaccctccgcctcttaccgacgggcggccaaattggccacgcggttggccaatcggcgtacggaggacgacgacggcacagcgacgacaacggcaccgaagaaaccggagcggactttctcccaattgttgcgcagggcgacggtgccgtccccagcggcggcggcggcgacggctaacggaggcggcgaatcaatcggaaaaatgccaacggacaaatcgacagaaccgctgatcgaaacggggggagaagacgcggaaaaaggtgggaaattcgttgagagagcttaaagtggagagcacctctaagtttcagcgtatgatcaagccaagcggcattcgttcgtgcgccgttgcggcagtgccgtgccaatcgacgcaatggcggacccgacatcagttgcttcggcgcggagcagtgcgatgccatctccgcgtgccccgcccctccatagcgcagtcaaaacgcagccgctccattccaacgccaccgttttgatgccgttcagtctgtcgctgatcagcgccgacgacgaaagcgaagaagcgagccaagtagggaggggcaaatgcacagatatagctgaagcggaacggaaacaaagcaaatttaggccagcggatttgtgagcccaagcggaaggacggcgcccggcggactgcgccatggcgttgggatgttcaacggttcaaaagccataatgcgcaaaaatttggaatttttcagaaaatttgcgtctgagtcgccaattggcggtcaaagagttcgaatggatggccacaatcgtcgaacgctgttgcttcattgtgttcgccacaatgttcttcttcctctccattggcatcaatttgctcggtgcgttcattagcgtgcccttttttcgtttttctctcatttttcggcatttttttgcccttttaaatttgctaatcaataattaatataattatttcctaattcactggccttgtcactgactttatcagtttatcagcctaattaagcatcactttgatcctctaattaccttttgttttcccttaggctattggcactgggccaaccctgaattggcattcaacaattacacttttgtcgaccaaatctgaacataaatttcgaccattttgcataagtgtcatagttttcttttctgctttattaatttatttctgctgttataaatattggcctaaattttgtttatttttaaattaaattttaaacattttccattatttattccttttttaattattgccaattcatttgacattctcgcacagaatatgtccaaattggccacttttatgctttttgccgtccattctttgtcctccgatgcctttaatccctcttcaaattctagcagttttattctcagcagtgcaaatgaaagacaacggccaattgacgtgaaatatttttggcattttattttatttttccaatttattaggccattggccacagtgtgcagcgacggcgcgagtcgacggccgtggccatggtcagttacacggaaggaccccccgaatttgtgtacactgccgggggcgccagtgacgcggccaaaacgcagcgacggccgtcccccgccagcgccgaccctttcaacgcgttcgccatcactgatgttccgctgatgcgactgacaaagtcgggcaaaattaattggagataaattttgaaattggtggggtcgaaattcggaaaaggggggacagaacgccaaaataagtgcgggagggcctaacccatcccattttgtgatgagagagagaatctttgctgaatttcgtcattttttgccagggacattttggcccccggccgttacgacgttcgcgtccggccgatcattgaccacacgaagccgctgaaagtgcacatttcgatgagcctttaccaaatcattgaggtgaacgagccagcccaaaacatcaaaatgaacgtttggatgatccaaaaatggcacgacgaaatgttgcattgngacccgaggtggacggaatgccaaaaaacaaaaaagaaatgccaaaacgaaaaaaaacggcagagaatacgacatgatcaacagcaccattctgc

SEQ ID NO: 10534 - DNA, 3898 bp, Heterodera glycines
  misc_feature (1259)..(1259): n is a, c, g, or t
acatccaccgcaactcccccgtcacaaaatatcactttgccggacattcactcattttcaaccgaaaatgccgaagaatttgaggagtgggtggagcgcttccaatttgcgttggattgcgcggcggcaaatatggcggatgaagcgaaagtcaaattgctgatgactaagctcaacccggtcgctttcggcgaatataagcgcttctgcctgccggaggaaatcaccaaattcggcttctcggacaccaaaggtcgtctaatcaaattgttttctcatcccccatcgttagctatcgatcgctacgaatgcttgagagtgtgccgagaggatggcgaaaattttgaaatttttgtgaaccgactgaaggcagccctccgcaaattccgtttttcggaattaaacgaagaggaattcaaatgcctggtcctgctcacatcgctgaagtcaccaagcgatgcaaaattacgccagcacatcctcgcgcgactcacaacagaggacacaaagacgacgaaaacagccaaattattcgacaaagtcgtcgaggatttgaacacgcagctaaaaacggaggctgaagcgaaaatcctggagcggccaaaattcaaaatcaatgctgttcaccacagcgatggccaatcatctccaaatgacgcagaaaaaggcaatcgatccgacaaaaatcgtaaattttcggacatttcggatggaaaatctcctcccaacaattgttttcgttgcggagagctgcactgggcgcaaaattgcccaaataaaactcaaatgtgcagcaaatgcaacaggagggggcacatcaaacaacaatgcgacaaaatccaggcctaccatcaaaataagaggaaaattgttcctaaaatcaacatggtaaatttgcctgtggctttcaaaaattcaggcaaattttcgaagcctttgaaagcgaaaattttggtaaatgaaaagccaatcaaattcaaactggacagcgcagcggatgtcaatgtcatcaataaagctgcattcaaggcaatcggccaaccaaaagttcaatattgtccagaggaggcacaattatttgacggcacacgtttcaaatttattggccgtggaatcgccaatttccaattcaatggaaccaacgcggaacaacaattttatgtggccaaagatggaacaccaaatcttttgggtgtggttacgttagaccgacttggattcctggaacaaataaaacgcctgatcaatgcctcgaatcncaatcaaatttcctccgaaataccggccaaaattaaagacaaatttcaacggtcaagtgctaaaataagaagggagggagctgtcagcagtataaatttcgacaaatttcgccctgtccttcgcacaccgactgtcacggccacggaaaatttctcaaattaccggaaattcggcaccaaatcccaaccgcccaagattggagagatcttcagtcgacgacacaaatcagcggcctggagccccggaaaaatcaaccaaattcggcaaaattcctacaccccatttcaggacaaatctcatggtaaaattcgtgccaaccaaccggacaaaatgaaggaaaatcataccggcaattatctcccgcaaattggtgctattcagctatgccatcgagggccgggtgatcatctgcgatcggaccccaataaattgtcccatgtgtgatcaatttcagggctgatcagtagacttaaaaggggaggtgttggggcgacccacaattcaaataattgtttatcattgggtccgttctttgaccgaccaaatattgatttgttcccctctcccatccaattccttccactcatgtccccaattcattccattccaatttgccttcgcattgttttccctcctatttttgctccattcctccgaccaaatatttgtattttatttttccattttcttcaataaaaatattttattgtgttgtccaccggcacaacaactgaattgttcaccgtttgtcttaacaacagcttcttccttcacaatgctcaattcatcataattcatttctgaaaagaaaagaatttgaatgtttttaaattattaaatgatatcataccgtgtccaaatttatttcagtatcgtttcccaaattttatattttctacgttcatttctgaaaatatacaaatatttttattttattttatttattttaaattttaattttaagtcatttaattttatatcgtttccaaattttaaattctaccgtttccctttttctcattaccataatcatcagatgaaaaatcgccattatttgttgaatcggctgaaattgacattttggaatcagcttttaaaactggaaatcaattaacaatacctgttttttagaatagctttgttcatgttcgaacaactcctatctttttggtatcattcgaaagcacaaagtctgaataaggtaataatacgagaaaaaaagagaattcgaacagctaaagaaagttacaaacgaaaataatcacaatatttaattaatcaaaacttttttgacaatggcctaaacgcttttgtgctttcgaatgatatcaaaaatttagggtttgtacacgcatgaacaaaattattgtatacataaaaaccaggtattgttaattgattggattcataaaaacctttggactcataaagtgcaatagagccatttttgaaacaaataaagtgaatttatatataaaaaataataaaaaatatgatattttaaataaattgaagaagtaataaatgaacatctgctgactctgctgttgcttatgttcacatttacatgactcatttatccattaatttttgcatttctgcattagtaatttctataaaaattatcgagcaaaatgttgacctaaaaagaatggcaccaatttagttctttaataatctcagagaatagaataaatctttgtaaaagctatgtaaatgtttggtttttagcatttaaaaatttggttttattgatcgaatgacctgattcttatatttaatttgttgtgatttcttatttttgtttaatccatattacccgaggacgacttaatctatgacatgtccacagtgaaagtggattactctcctttgtggaacttttttttttgcaaaaatttgcattccgtagcccggagtcttgccccacctactggccgccgtggttcgagtgtgtgctggtttttagcgcaataagcaaaatattttgactcagtgccccataatttacttttatacaaattggaaaaaattggaataaggggcaaacttttattgtggataaagtgctttttgaataataggacttttcgtgttaaaattggggatgctttatcctcaagtaaaaaagttacctctggcgttccccagggatctgtcctggggcctttactatttttgatttatattaacgatcttcctgatgctttgccatcaggagtgaaattaaaattatatgctgatgatgttaaattgtatatttgttataaagcaagagcagacacagaaattatgcataaagcattgcatatttttatccgaatgggcaaataaatggcaaataagtttcaattcaaaatacttttgtattatatttgggttcaaaaaaccaaaaagaaacatataaatttgatggaaatacaataaatgctgtggatacaattagggatttaggagtaaatattgacaacaaattacaattttacgtatgcgttctttatttcgggttattaaatcaaaatcttctaggatttggattattttgtacaaaacttatgttagaccgttattggaatatgctcctgaggtttggaatccatctcttcaaaaaaatattaaaaaaatcgaaaagttcaaa

SEQ ID NO: 10535 - DNA, 1424 bp, Heterodera glycines
ttttttttttttaatcccttaaggggctttaactatcccttttacaagttttactctaaaattaaattgggaaaaaaattcattccctttggtgggagggtaacaagaatgtggaattcaactcgataaagacttaataaaaacaaattcttaaaatcaatttaaaccaaaattaaaagttcactagggtaatatgtaagaccgggaaagctagaatataacaaattcctaagtgatttggtaattttatgttttgacctcatttgactttgacctcaattatttatttatttattttcacatattttgtctttttaattcctgtgatcatcactttattttatcacttactctacgacagattaactgacagtcgtcagagtaagtggtttcgcccttctgatgacttttttattttttacgaataaataaataaacatatttttattattatattaataatttaataaatttgttatttaatataagaaatgctgtttatttactattgcatttttttgactgaaatttcaaatcgtcaagccaaatttatagtttttaaaaataaaaaattacattcttttcccttatggcaatggaccgttaacttcgtgatttcgagttcattttgacaagcgttggcatcccaacaattttgtcggaagtttaaaagcgccttaaaattcaaaaccaaaataatttatttaaagttttaaattaaatataataaaataataatttttaatatttctttccattatttattcaccatttgcatctgcttctcattattatcttccattgaattgttttttcttttctgctcatcttgcaaattttcgcttttgaaaatagaaactaaataattagctaattaactaagctctcgaaaatctaacgatttttatttaaaaaagaaattattgaaaaaataaaattatagccaagagaataaatttaaatggttcgattttcttaccgcccctttcctgctgcatttgtttctggtgcttctccaattcgttgactctttccaaatatttcttctgctcttctttcaactgtctgatttggccaaccaattctaataacatgaagaatatttttatatgaatataataaattaataatgaaatatttaatttaaaaaatgtaaatttatttaaatattacttttaacaactcaccgtttgactccttttccccttgctgcttttggtgtttttgttgtccctccaattcaccgattcgcccaaaaagtgtcttttctgaaaccaattaaatttgaactgattatattaaacaataattgaaataaaataatgttacggtatgtacagtaatccttgtctattttcccttacccttttgcttttccattttacaatttgtcaaccttcgcttgcagggtcacatttttttcc

SEQ ID NO: 10536 - DNA, 1518 bp, Heterodera glycines
aaagttatgtgttgatttagtcaaaaatttagcaaattttccactttttgtccatcgacatagcaccataataataaatgaaacatttaatgcatttgtgattcattaaccacttatgctctttcaaaatgttccatcggtcaacagtcccttccccgcccgccccgtttcccccgcccccgtcccctccgaggtacaatccgtccgttgggtcgacaaagtcaaaatgtttgattcattcgcacgccctcccccccccccgatcatgcaatggtccttttttccaaaagggcaaagagtgtttcgatcggatcaatgtttccctgtccaatcatttggccacttctttcctatccaatcgcttggccaactgttcaccaccttattgggttcatcaccatttctctgcatttcccttctgctgtacggcctggtctcttcgacaatgccaactgagtcttcttcctcctcctctccatcgttcctcttctcgtcttccgtttctccttcttttcaaatcatttctcctgaacctgacaatgccatcggtgtttcctcctctccacaattttccttaaaattggcacaaaattcgttgcacgagacttttcagcatcaaatatttggagagcacaatgcattcgaatcgacacgatatggtcttcgtattggtctcttttttacggggaatgggggagaattatgaggcaaatattcgcatttttgaagatcattgtccaaacggaggggagcccgaggattccgagcaggatgggaggataaagctttgtcagttggacgccgagtgtaagctgaccttcaagtgtgagaacatagtcgggtaaaagcaacgggtgggcaatggacggggaaagccatcggctaatttcacagattgacccattttggcaaacaaatgcgcttctgttgtcccacaaaaagtgagtgaaacctaagcaattgaaaggcgccatgccattttcttgttatagtttccgtttgcacattaaagccgaaattagcgactgatgtttcggcatttcccgccgggtgccaccgacctccgctgagaacattttacttttttgacgtggaccggcagaaatgcgcgaagggtcggatggctcaatgcgaagggtttggcgacaaccgattcgccacggagttggaatgccggacaaagtgcgaaacaactggtcagcagcagaaccaacggcacttacttctcccccttcccatttaaatttcgtattaatttatagtttttgtcccccattttcttattaatattacccccccccccccccctccctctttcaaagcttgagaatttggtgagtagattctgctgcacaacgacagtttcgatttgccttttctctgttcttcggatgacgattgcccagtcggttacaactgtcgtcaagatcacatttttcggcgcagcgtttgttgcggctttctcaatttgggtcggccgctgattccatcccagggtttccgtgggatgagaaaaaa

SEQ ID NO: 10537 - DNA, 4131 bp, Heterodera glycines
  misc_feature (1208)..(1208): n is a, c, g, or t
  misc_feature (1249)..(1250): n is a, c, g, or t
  misc_feature (1258)..(1258): n is a, c, g, or t
ttaatgaccgattgccaagcattaggcaaattcatgctctttaaactccttcaggagtctgtccacatgggcaccaagcttacattcatccgttgaccgatggaacaattaaagtttgatcacatcacacaaataataccgtacataaatcactgtttagtgcaatcttcgcaacttcgatccaaccacttcgtgtccccctggctacgtttgccttgaggctgtttttggctccatttggggcttttgttgtgcccagacaatgactggtgcatttatatgctttccaaatctgtcgttttaattgtgccattccattcccttttggcaagttgtctcgaggagtcgcacccgcagatcaatttgatcaccaatcagccccagcgatgcgaactcacgcaacagccgagtgtttgcacgtcggtttatttgcttaaagtcaatggggcgagacaaaccgaacaattttggaatgtcaatttagaagaccaaatgaaacaataattaaaatttaatttaaatcgcggaaatggaaaatgttcgcagactaaaatgaaaaataagctaaatcatttttttgtttgatgccttccacagttacaggaaaaaatatgtgtattctcaaatttcaaaccttcaaaaaaatgggtaacggttttagagaatttaatttttaacaaaagcgctggttgactacagcatgacaaaaatcctgttttgtcaatggaacgccaaaccagattttatgtattgttcaatttcaaatgatcgatgttgacaatttggccagcattaatgttaacatgtgagatatctttaaaaattttcagaattttgcattaaatattttttcagtttttaatttaaaaaaacatctcagtaccagaaacccattccggttcgggctctatgtagtctttatcttctaaaaaaattttctctgtatcaacagaagcgaattcgaatgcgaaactgacgaagcgacgcatttgggggttttgttgcagcattcgaagacacgaaaaggtgaagccaacggcggaaccaatggcgagaaaacgaacgaaaacgacggcatcgacacacaggactaggaacacaacagaagaaatgccaatgacgacaacaacaacaacaacaacaacaacaacaacaataaaggaaaacagggcagaagaagaaatggaactgaatggcacattgaattncaattcagtggaaaatgagagaaaaaggaggccccaatcannatgaatgngcagagagagcgcgcggaagggagagggacggcaaagaaagaggggaagatggaaggaaggaaggcgcgaaagagaggcagacagcgaggggaaagtgcagagaaggggggagggcaatgatgggataccataagagacccctattaaggccattgttcctcctcgtcatcttcagagcagtcggagaaagccgacttgatggaactgtccacaaaacttgaccgatttatcagcggagtgcgccgaagggcaaaactgcccaaggggcacagacggacgacgcggccaaaacaacggaatgggaaccgaaaccgaacaaaatgggacaggagagaaaaaatgggcaacattttcgggaagagagagcatggacgaaggagaagaaagagtggggaagagaaacacgaagaagaggaaaaaagcggaagacggaatgaacggatgggagagggagaaggaagagacgatgaagaagaggaagaagggggaaatgggagagaagaggaggagaggcaaaaggaagagatagcgcaaagggagcaccagaaaaggagggaaggaaacagtaaaataccgaaatgtccacacgggttcagaccaatgaattatcccggaacccggtggacatttttggagtgtgtgatggatgaagaattgaagttgatgaagaggaggaagaagacaaagagaaggaagcaaaaggacaaaaggagaaggagtaagaggaagaaaagaagggggaacaaggaatgggaagatgaggtggaagaggaagaagcagaggagcagcaaaaaagaggcgacgaacggcatcaccgccagcaaagtgaaggggacacggaggtcgagtgggagacagaaaggaggaaagagggaacagtccagcacaaaagaaaaagggaggaagaagaagagactgtccagcacaaaataaaaagaggggaagaggaggaggaggaagatgagacggtccagcacaaaagaaaaacagcggaagaggaggaggaggaagatgagatagtccaccccaagaggaaaaggggcgaagaggaggaggaagaggaagacaaatcggcagtctgtccccgttggttcattcaaatgtcgaaacaataatcgtaaatatttgatttttaggcggctcaatttgtttaaatgcgcgggatgacccatttgggagggcgttgtgttgtgtgaagagggggaaacatttgaaagattacaaattgggaatggaagagatgaaggaagaggaggacaaatttcggaaggaacgaaaggacggcgatgaaaagaagcgaattgaattggccaccgaaatgccaacagcggcggtgccaatggcatttaagagaagcaccggtaaggcacagagagagagagagacattggcattacaaaaatggcattctgtagaccaggcatgcccttttctgatcgcgggacgcgtttgtcagcccgggtctaccgacatatgtgtagaggacggctttttctgtcagtacaacaaggagaggagggcattcgtttgctgcacctttaacgaagctgacgtagaaggcgagcaaagcgggcggaagagaaaagaaaattaaccaaaaaaagtaattaaaatgcaaatattaaaaaaaaaaatttccacaccaatgctgccattgtaattgatataatttagtttaaattatagctcggaaaaaaacttggtgagcggttggtcgaaagttccttgagaggagcgggatcccttaaaaatcactctctcctaaacccagtctatttttgacgggagtcaagggcgggtgcgggagtaatttgttatatatgtaatttataaaaaatattttatgctcaaattttgaaggaaaattcttattaaagcaaaaaataaaaaataaaagcagaaataagcaaatttttagtgaactgtcccaaacatttttgaaaagatagagggacggattgttccgctaggcgcggtcggggattaatacatttggtaccaaaaggttaattttgtggggttatgggtcaatggattcatttattaacagcttttaattaaaaatcgttacttttgccgaaaaaccccaattcttaaataatactagacggggaaaagcgccttccggcgccatccccccgcgttaggtagtcgatgtattattgagctatgaataataaaaccgaaaatggctcggccgcttcgcggcctgggactcaattcttcggcattccaatcacttggaataactcaatccacctgcattccaatcaccaacaataaatctcgccgattcttctgcataccaatcgctgggactcagttctacgacctttcaatcaccgttactgaatccatcagcactcgaaacacctgaactcaatctcaccaattctacataggcaaaacattttaacattctactggcctttttgtttcttgtcatttcttaaacaaccctcggcatttcaatcatcggaactcaaccctccagcatttcaatcactgggactcaatcctccggcatttcaatcactgggagtcaaatctacggcattccgaacactgggactcaattctccagcatttcaatcactgggactcaattctcctgcatttcaatcaacgggactcaaccctccagcatttcaatcactgggactcaattctccagcatttcgatcactgggactcaatcctccagcattccagtcactgggactcaattctcatgcatttcaatcactgggagtcaaccctcatttcaatcactgggagtcaaatctacggcgttccgaacactgggactcaacccaccatcattccaatcaccggcactcaaccctccagcatttcaattactgggactca

SEQ ID NO: 10538 - DNA, 3151 bp, Heterodera glycines
  misc_feature (79)..(79): n is a, c, g, or t
ggggatctcagagcttcggaagcgtcacctagtcaaccgtttggggtttgatcatcataatgaaaagacagatattccngggaaaaaaatcatattcggagcagcatgagagtcagaaaatgttaattatcgagacataaacccgagaagataccccacaagattatctggtgagatatatcgtattttagcgccggttaccgtatccagttttttgttactgtgtaaatcggctctttcaacgtcacgctgagaaccagatgattttaatttagtctaaatgttgtgccatgattgtggacgaatcaagaaggcggggaagcttattaatcccaaaaaagtgccaataagccgtcgtcccgagtgccagagatctctcgtctaccttcacttggtcctctgccagtgctggctggcccgggcgttggatacgcttcttcgagtacggcttcttcttcacgggcgtcatcagtgacggatggacgtcgagcagcgcggccagatgcatggccgagcgaagcgaggtgaacatgccgcggtcgtacgcctcgcgcacggacagctcgcgttggaagcgcgggtcgaccaccacgcctttggacgcgtcaacgaggccctggatgaaaaagagcgtttattttgcgaaatttttatttttaaaaattgtatttcataaaaaccaaatttttcgaggtcccaattgagaaatttttgaaaaaactaaaatagaaattgcaaaatatgctaaaccaagaaaaaaaaagtgaaaagtgccacaatgccaatgccccaccttggaaacggcacggatcagcgacacttcggtgccaccctcggacaagccgcaaggtgccatcaggatgtcggcgagtgccgagtcgaccaacccttggcgtgaggcgtcgctgagcgacaacgtctggcgtaccgcctggtccaaaacccgctcggtttgcacctgagaaaatgccaattttgggtctaaaatctcctcctgtacctgcatgattccagcttcaaccgcttcgttgaagctcagcgtggtgcctagctccgcgtttttgacgcccttcacgtcaaagattgtgtgccgtgcgcggcgcgtcaacaggccctggcggtgcgcctcgtgtaagtccagttggcgctccgggtgcgccccgtctgcggcccagcccagcacaattttgccgtccggcgacaacaggccgcgctccaacgcctccccgatggaaatcacttcctggtcctgctccgacacaatgtgccgcacctccgcgtcaagcagtccagagttgatggcctccatcagcgtgaagcggttgccccggtcgctgaagtgcccctgcgtatccagcagtcccttctccaccacttcggtcagcgtctgcgacttttggatgagtccctggtcgtacgcttgacgcagcgacagttccgcgcgcgtggccaagtcggtgaatttgccgctgcgcgggttgagcgcatgcgctagcattgcctccgcaatggtcagccgttggttggtcgccgtgttgatgcattcgcgcacgttgtccttgaccagcggtcgttggcggtccagcgcgtcacgtagcgtgaatcgctcgccggacgaaccgaaacggtccacaaactcgccggcatgtgcgtcgatgaagccgtccacgatgcagtcggtcagcgtcagtgcgagcagcggctgcgcactcggaaattggatgtagccatgggcgagcgcgtcgcggagcgaaatgggatcctgcacatatttaccgcggaacacgccgctggttgggttcaacacacctaaaacgggcaaaaaaaaacttagaatgatcagcatttctatgcgggttataatttttccaattgtttagtattacaacgaatttctgatatttttttatctatcagaggaaatcggcgatcacttttcgacattcatcctttaatcccctccatttggtaataggtctggtctaatcgcctaattaagcgctaattgacatagcacacccctcaagcggaccattcttcaaagcctgctccagctccatgggcggcagcttcagcacgcccattttgatcaaccggtgctgcacatcggtggggcaaatgtgccgcgagtcgaacagggacagcagttcgcccgttttgatgtcacgcagctggcgcgagtcgggatcgtacaggccaatttggatggcctccagcagggtcacttcttggcccgtttccggatgctttatgccatggcgtccgtttagaatttcggtgatgttctcactgatcaggcccatgtctacctggaaaacatagaaaatttttacaatcaaaaatattttctcgtaaattttcgaatttccaaagaatcaagaatccgtgaatcaatggcatgaatgaaaaacagggggcacttcagtccccccgctccctctcatttttgtaatttttttcttcaaaaaaagtagaaatttttttgcgtatcttcataaaaatactttccaaaattttcacagaaaatttttctgtattttccttttttaaaatttcaagttcaaaaacactaatgtttttctgaatggtaaaaggaaaacacataggaccaaatccaaaatcttatagaattataacaaaatattttgttatgaatgtaaattttctataagtcgagactctcgaactatcattagatccgcgaatgctctagaattaatcacaaaccacattttaatccaatttttcctcaccgctttgtccaacgaaacgctttggccactgacaatgccaaagaattcgccgcccgcactcaaattcagcaggccttgtcgaatttcctgcagggaaaaatggtgaaattattattgttttttaattatttcatatagccctaaacctctggggtccccagacattagagacatttttgtccaaaaacatttcaattgcccaaaatgcctgattcccagaaatatagtcattaaacattttcggatatattctccgaccatgaaaaactacagtaacagttaaacgccaatggaacgaaagaagaaaaaaaaatcaaaagcctaaaactgatttttttttctgaattgcagtccgtaaaaagtgttacgaaattctattgcgtcttttaatacctttt

SEQ ID NO: 10539 - DNA, 1997 bp, Heterodera glycines
  misc_feature (15)..(15): n is a, c, g, or t
aaaaaaaaacttagnaatgatcagcatttctatgcgggttaaaatttttccaattgtttagtattacagcgaatttctgatatttttttatctatcagaggaaatcggcgatcacttttcgacattcatcctttaatcccctcccatttggtaataggtctggtctaatcgcctaattaagcgttaattgacatagcacactcctcaagcggaccattctttaaagcttgctccagctccatgggcggcagcttcagcacgcccattttgatcaaccggtgctgcacatcggtggggcaaatgtgccgcgagtcgaacagggacagcagttcacccgttttgatgtcacgcagctggcgcgagtcgggatcgtacaggccaatttggatggcctccagcagggtcacttcttggcccgtttccggatgctttatgccatggcgtccgtttagaatttcggtgatgttctcactgatcaggcccatgtctacctggaaaacatagaaagtttttacaatcaaaaatattttctcgtaaattttcgaatttccaaagaatcaagaatccgtgaatcaatggcatgaatgaaaaacagggggcacttcagtcccctcgctccctctcatttttgtattttttttttcaaaaaaagtagaaatttttttgcatatcttcataaaaatactttccaaaattttcacagaaaatttttctgtattttccttttttaaaatttcaagttcaaaaacactaatgtttttctgaatggtaaaaggaaaacacataggaccaaatccaaaatcttatagaattataacaaaatattttgttatgaatgtaaattttctataagtcgagactctcgaactatcattagatccgcgaatgctctagaattaatcacaagccacattttaatccaatttttcctcaccgctttgtccaatgaaacgctttggccactgacaatgtcaaagaattcgccgcccgcactcaaattcagcaggccttgtcgaattgcctcaacaaaggtgagaatttcgcccgtttgcttgtgcagaatgccttccatctcgtaaaattgggtctttgtgacggtttcctgcggaaaatgaagaaattattttggaattatttcatatatcccaacccttgaagtccatgatattaaggacatttttgggatttcttcatggacaataatccccaaacatttcattgcccaaaatcccccgattcccactaaatttccttttttaaatcacctataatcactaatcattttcggatacgttctccaatcatatcccagacaataccttttttgaaattctcaaaattatttaaatgatccatcccactttccaatcactcgcagttaaaacttgatgattttgatcaagatttatgatcattacagtaagactaatacagtaacagttacacattaggggacatgaatcttttgctggattttcatgatcatcatcatacatcccctctggaccaacctcctggaacatttggggttcctcctcatgttccgtgatgcgcggcatttccggaatcaccggtggtggtggctgaaactcgtgcacctcttccacacgctcagcttgtcgttgctcttgggcctatattttttaaagggtggaaaatgcgcgagacgacaaattggagcagtacaacaaggtgaaaattaaatgagaagaaatagtggtgaacaatggaatgtgacagccaaaaggcaaaaatttaatgagaataattaagatgaaaattaggaatcgaacaaagcgactaataaaagcaatttagcaaaaaaaaaaaaatctctcaggcttaaagctgattttaatttggcatttctggaaaaaagctaacaaatgatggcgctaaaaggccaaattggatctaaaagggtgactttaagcttaacattcagcaaatcaaatgttcaaggcttaaaaatggcaaaaaaatattttttttctcaa

SEQ ID NO: 10540 - DNA, 1293 bp, Heterodera glycines
ccttcaatgagcttaattcatttaaggcttcaaaggctttgaagcgggtttaatcctcccagctttgccatcctccccatattatgcccttcccattgtttgccttcggtctccgtttgcttcggtgctttcgttgctttaggctcataggtctacgcgtctttcaacgactgttcatattttctgtccaaatctgcctttcttctctttgctctttctttctttcttttccctgctttttgtgaagagagaagcgtacgttttcgttggcttccggtgagcggcacaaaggaatatccatgcatcatcatcatcacttgcttggcccatttgagttcatttgccgtctattcccatccgaattttgccccctctccccgcctttcaatttctttcgatttgtttgccatcaaattccccccccccccacctattcccgccttggtcaaaattaatgcattcgcaaatgagacggtacaaagcatgggaaaggcacaagtccccttccttctgtgtttcactttcccaccactcggccacttattattagtcattggcattggtttcccttttccgccacggtcaaagccaaaagcaatggcatttgattagagtgaggttattaccatcattattattattattactgttattgcgtgtatgcattcgttcctcctcttctcctcctcctcctcccttttctcacggcttttccctcccccccccccaaacctccgtcaatttgttgtgctaagccaattagcattcattcctccgccctttgaccctttcttcttttcctccacaatttgtttattcacctaaaaaaatatttttcggtttgacaaatggagaaggtaatacaaaattgcgaacaaaaattcggcgttgaattggcattggatgtgtgtcttcagatgttgggagaactgtttcagctgaacacttcgcagatgccgggaagtgacggaaacggaaggaatggcaccgaaatcggacgatgtgccgatgagaaagggggtgagacgggggacgaatgggcggcatattttgcaaaatttggggatgggttggattgttcgctctgtcccgaatgccatcctccgccatttgtcagcttcttctccttttacccacaatcgtgaccatttcgatggtccttgcactgccttggaattgtggacattgcgctttgtttttccgatgttgcaatttctgtgcctcggtggaaatctgctgaatctcctcgtctacagctttccctactttggagacaactcttccgtccatttg

SEQ ID NO: 10541 - DNA, 4191 bp, Heterodera glycines
ccccccccccccgcctccgcaaatgatttttgaggatttctcattcttcagccccaactgggccaatccttttcccagcggcgaaagtgcgtcatccgactgacggtggctaccaccgtgtcccatcttttgctggagggtccggctgcgctcggttacgcctttttcgccctgcgtggcgcgtcaatgccggaccaacgcgaatggatgtgcgcactcaccgcgtctaacaacgttctctccgcgtgcgttggcctattcgttggttagcctcgcaaaatgtgtttctattctgtgcagactgaacgcaaccatccctttctttctgtttctgttctgctctgctcagtttcgtcaaatgtccgtcttaggcatcaaaagtcgaatttccgcccctgggcgtgccatgaaaatttgtgccgacgatgggcccagcctttgcgtcgcagcagtaacccaacaaaggcctaacgaaaatggaatgatcgggcggaacaattggacaaggcaattgtcattcggcggttcccccgttattgcggaggaggaggaggaagacgggcacgacaaaaggcactcactaacgctgaaggaacgcaacggcggaaggggaagtgtcagcgaaacgacgacggcacttttgacgaggggaggaggggcggacacacttttgtaggaggaaaagggatggagaagaggaaataggcaaaatgatatgtacaaaaaggaaggaacaacgggaaaaagtgatatcctgtacattagttgagttatcagtgatcacaaatgatctctcccctcctcctccttctctccctctctctctcccctccgccgccttctctccctctctctctcccctcctccgccttctctccctctctctctcccctcctccgccttctctccctctctctctcccctcctccgccttctctctctctcctctctgtctctctctccctcctcctccttctctctcattcctctctgtctctctcccctcctccgccttctctccctctctctctcccctcctccgccttctctccctctctctctcccctcctccgccttctctccctctctctctcccctcctccgccttctctctctctcctctctgtctctctctccctcctcctccttctctctcattcctctctgtctctctcccctcctccgccttctctccctctctctctcccctcctccgccttctctccctctctctctcccctcctccgccttctctccctctctctctcccctcctccgccttctctctctctctcctctctgtctctctcccctcctccgcctgctgtctcactctctcgctttgattgtgttcactgcttcatttctgatcactccctgttgttattgtttttctgtctgtcttacggacacattcctgatcacttatctgtctgatacaaccttatcatgtgctcttccctcgttttctcagaccgttgcttcttccaacagtccattacccatcgtgaacactgtcttgctgtctctctgtctcctttgtggcccctttctctctccctcctctttttctctttgtcgttccctccgtcgtaaatgaattcgtttccgattgctcaaaatgcaaatggcaattgcggtcaaagcgacaataaccaaagcgagcagaagcaatgcgaagaagcgaatgagcggtgaagagacggaggggaagagagtgccaaaggacgacgccgcgggggcatctgctggcttaatgtggcacataagcagataaaagacttttacgctcatccatttacctcactgattttatgtccaaaattctcatcctttgaattcaattgagatccaatttctctgggaaaaagttgcgattgctgacgacaaagtgccgacggtgcataaggcctatcgccaattttaggcacatggcaatggcacgaagtgttggcattcgcttcaaatttgggatgcatttgagcacagtcaagttgggtgcagaaggggtcgggttgattaaagcagcaggcacatctgcgaaaggcgaagccgggacagatcaaaagcaaaaagggggaagggtgggaagaatgcccttgggggataaagtcgtggtaatgcctttgggtgaggatagaactgactgatcaagccgaagccggtgctggacatgcttatgcgtcccaccgaccgagtcgtggaggggccgtcggaagcatcgcgtgagaaactgagcgcagccaccggcgccaaatgtttgccttcgatggtttgggagaattgagaccttctcactcagagaagagcattttacaatcggcactttgatcttctctttgttttggcacctgcaaacgcagaccgaaggcgctttttccggtgccattcgctcgtaagaggataatcggacacagaaagcatccgcccaatcggacgcgcaacggcacgaccgatgcccaaacggaagtgggggaaagaagggcgaaaactctgaagagaaacgagtgtcagaccaagaaagatcggtacagaaggggaagagcaacaaagaaagagaaaaagagaaaaagagagaaaaagagagagagagagagagaaagagagaaagagagaagagagagggaaggagggagggagagagggagagaggggggctgatgacgagctttagggaatttcttgaaatctgcgtaaaatgtttacatattttaccctgtaagtctaaaatattttgctactgattgattttaaatttttcggagaatttttggcttcattcgccgcttcaccgcctcagacaggcgcttagcgctttttaattaattaattgggaccgccaataagtgaatgacagcgattagtgcctgattttcttgtcaaaactcaccgggcggcaaagtgcagcgcgacgacgagagatcatcggaaatggaagagacgatgagtaaaagcaacaaccaaaggaacgggggtgggataaagcatccgattagtgagtcggacatgctttttggtcattggtagcgcatttgcattggcattcgtttagcacattctcttttggctaatcgaatttttacaacgcatagccctataaatcaaagccaattgaattgaaagatgaaaagtggcggactgagaagagatcgtattgaataagagagaattgcagcagaagggcggaaggggggagagattaatgcaaattggcaaattgatttgagaggcaaaagcaaaacaaatcccttgggattgctgacaacaaaaatggcaaattggctgaagcattttctttgccaaaatctggcaaatttcagattagaagaattgccagaagaaaggaatcgcttcattacacctttgccatttgccattgcttctcatcgatgtgtttagcaaatgcaaatgatgtgagaaagagagagcgatgtgaaaagacaaaagagagaaaaagaaagagaaagaggaggaggaggaggagagagtgtttagagggtaattaataggaggggggggggaagagagaatgacaaatgagcaaatgggaagggacagacagaaagggagggaaagaggcaacggcagaaacagaagcagcagcaaaatgcgcaatgttacatattgtataataagaaactagaagaagaaaagaaaggaaaaaaagacaaaagagacaaaagagaggaacagagagagggaaaggagagagagggagagagaaagagaggaaaagaaggaaaaggaaagagagagagataaaaaggaagaaggagagagagggagagagaaagagaggaaaaggaaagagagagagagataaaaaggaagaaggagagacagtgagagagaggatgaggaggaaaggaagaaagggaaagaaagaaaaagggacagttacaaagaaaaggggtgggggggggggagaagaggcattgacagcgaggaaaagaaaaaacattcagtaaacaaagaaacaaacctataaacatttatttatttattcgcattcaattgaaaagtgcgttagccatggagcaatttgtcatcggatgggctttggcatttgtgaaataaagtgatttatgctttggcattggcaaatggcttcttccgccttctccgcttctgtccgtttccgtctttcgcttggcttttccttttatgggacgtcaatttccactccctcaa

SEQ ID NO: 10542 - DNA, 2104 bp, Heterodera glycines
aatgggagggggagggggaggggagtaattaatgtctttattgcccggaaggattgttttggcattaggcaatttgttttttttggtgggtagggtgtgaaaacatttgaccacaggcaaacgtgaaatgagatgaaacaatgcaaatgggtgatgggcagggctgggaagagaatgggaaggaatgtccccgagggggaaacagtgccctcaggcaatttcgccccaggggaagtgccgtccccgcctcttcaaaatctcatttcggcctaaatgctaataaagtggaatttcacaacgagtgcatgaagggcaaggcaatcaatcggccgcctgcttctccccgcttgctcaattgcccaaatcgtcgcaaaaagtccgtccgtccgtcgggggacagtccccgccgattggccaaccgaagagaaataaaggcgaaaacatttcggaaatgggcgctgaccaaagtccaccgtgtttgttgtcgttttgtccgttttttacctttcgcgcacattcccatcaccaattgctgcgtcccaagccaaacgctgaaacattttttgcatttaattggaaaatcggaagcaaaggcatttttcatccatccgtctcatccagaaaagaaagaacgacagggggagggaggggaagggaagtccttgaaaatgggggacgggggagggcatccggaatgggagggcagggggggggaaggtgcgattcggcaccggaagggaggggggggggggggcacaaacaccggtaaaagagaaggcaaaggccacgaaaacgcaaaaagggattaaattattgctaatttactgtttgtatcattggaaaaggggaaacaataaacaatgccttttggcataattttagcaaaagcacattaaatgtttttttattggtaattcgcaatttctgtttttgatttcatcatttggaggtcattagcaaaacgatgtacaagtcaaaacaacattaatacatatgtaaattcgatcagaaaatgattcatttcgccttcgggaaaaagccaatcgctgaagaaaaaagcattggatagccaaacacatggacaaattgaatgatgagtgacagtgggaaaaaagaaaagcaaaagtttatttcggcaatttaatttaatgaaaattttaatttattttcatgttcattgtgcattttcgaagaatacaatgtaaagattaattttcaatcattttccttttaattacggtagatcagttattttctataatgacaattttgaccactctctatctctgtgggtataattcgtaaatcatcattcaaaaggcaattcggtagagatttgtgctcttttctattagcctacacattttttccagaaaaaatttcccaatcacgtaggaattttcagaaaatttcccgatttcattgtgtattcgatttacagaccaagaggagttgattggtactgtatataatttttatacattttcaaccccgacagtattcttcactttttgggtgggggacagagtttagtctggccggtttagtctgagccaagtttaaagaatcataaattttttctcagctggccaaattttataaatttggcatcattcgaaagcgctacatgtttagaagcttttgataagctaattctaagcgattaaacaaattataaaagttgcaagatgaatactactaaaaagtcagaatttttgcatattttaatttataacttcggtatatctttatgatttttggaagccgatagagcttgttaagagtagtgatgcactttttaggctctaaaaactgccaaaataggtaggccttaggctctaaaaacccctaaaataggcaaaaaatggaaaataggcactaaaaaaacctcatttttaggggtgtaaaatgacaaaatgtattaaaaaagtaaaaaattaggccaaatcagtattgaggtaaatagtttttaaatcacaaattcaattttaaaaccaaaaattcttctcaaaaaaataaataaaaaattttggagatgaattttaaaaatttttcatttcttaggggtgtatttttgaaaaatttttaggtcgattcttagggg

SEQ ID NO: 10543 - DNA, 1844 bp, Heterodera glycines
ttgggaagggactgaagggggaggggggtgagtcagttttaaatttgcacaggagttccagtcatggtaaaccctatgattttttgtatatccagatagttttttatcggcgcgatttgtctaaaaacttatgggtcctgatgggaggggggtggatctggcggggtgcaatagggccgcgccggggaaaaaaaatttttgaaatttcagtgcaatttggttaaagttttgtaaaaaatgacctattttgtgatttagagccaatttttttaaagaaaaattaaggttttgtcagctctgacggggaaaaattggaattttgaacgaattttttgagaaaataatgcgttttcaaaaaaacaatcgctttaaaaaattttctttataaaaattttacaaccaaaaaatgcgcggcgcaccgcgcaaaaaaaaaaccgcggccgcgcattcaaattgccgcggccgcggatcgcgcaaaaaaaaaacgccgcgaatcgcggtcgcgctccagccctggtgtatttttcgtttttattgcgtttttgttaacaaattttgggcaaaacgccaaaataggcaaaaataggctctttcaaaattttttaggctttttaggctctaaaaataaaagcctagaaaataggcacttataactcgaaaagtagcttaacaacagcccaaaaaaacatgtttttcttgcgtttcaggccacggggagctcaggaaaaaaataggcttttgcctaaaaagtgcatccctagttaagagctttcgaatgataccaagattgttggatttggtcgacaaagaaaaaagttatgatactctaaacttggctcatactaaaccggacagactaaactgtcccagtccgtcactttttttccttttttcaaagatgataaaatttttctagaacattaagagctatcgaatgacatattaattaattaatttggttgactttgtttaaagttataacgattttttgtcaaaaacaatacgagttggggtatgtacgagggtaggtaatactttgatttgtccctcccactatttttctaaattttttttaaagttatgaaaacatatttccaagggtttttggggtttctgatcacgaatccggcagaaatggatgctgccggattcgtgatcagcgacccaaaaccgttggaaacatgttttcatgactttaaaaaaaaattgccttcataaaaatttttgaaaaataatatcactattttggcgttttgcccatttaattcttgacaagaattttggttttaaaaatttatatctcaatacttgatttggcttaattttgttactttttggatgacattttacgattttaaaccaaatttgaaagcttttagtttatctttatacattctttagacatacaaaaaatggcggatgaacaagaagaaacgcaagtcgctccgcctcagccagttttacacacagaaaacgtctcttccttcttggatttgcaaaccgagttcatcaaacgtcgcgatgccgccattgcggggaagtcgcagtcattcgccacggagccgatgcaccggcgcactccacgaaataacattttggccataagcaaagaggaaaaggcacaagtttttaagtgatttaaatttaaattaaattttagaaagcaaaaagcgaagtttcaacgctaagagcacagcgaattcgtcaaaatgaggaagcaatcagaaaagaggagcaacagagggccaagcagcagcaaatccttcagcaaaaggcggcaatttatgaacgaatggcaaagggcgaacgattggtttacgacgacggaaaagaggccgaatttt

SEQ ID NO: 10544 - DNA, 3199 bp, Heterodera glycines
gagcctatttgtccatcgcccagtgaagttgtctatctcccataatgaccacctctgctgttgaccattgtccattcattatttttgcttgttgcatttctccccatttcgttgcttcgctcgtccgccacttttccaatcaataggtccattcatagtgctctctgccgatgtgtgttatctttttatggctcttttcggtgccaacgagcatttttattttgtttttactgaaaatgttgagttgaagagtttttatagattttttggaatttacagactttttggaaacaaatgatggcatcctttttctgtttccaaaatttgttaacaatcgcagaaaatttcaaaaatttaacccgagggcacttaacggcaccgccgaaccaacaattgctttggttcttcaaaatttgagttaaaaaagctcacatattagtcattttcatgaaaattcaaaaattacatttgtacattatctttagtgtcaggaatttaacaccaaaacaaaaacgcggttttccatttaaagcattaattaagaaagttctcaaatttttattaaaggacattgctttgaaaattgcctcccatcaattcgcttcattttttgagtcaaatttttgttggacacattacatttttggtgatctcacaaattctttatggccaatcattcttcaaatctatccaatttctttactttgtttatttaatttgtaaaattattttagatataatttaaatttagtttaaaaaaaactgatcactgatttgtgtgtcctgccaaaaattgtgacgcaaaagacccaattccgatcagcagcaggggcatttttcccatctttttgaaaggttttaaaaaaatattttttaattaagggagtttaaaaagaaaactataaaccttttttgtcatttttaatgataaaacaaaggataatattacatgtaaaataatttcaatttttcccattatgtgcccctttaaatgagttaaattatttaattgagcaaatatttattttggttattcagcgcctttttaaaaattttatagttttttaattttttaataaaaacaaatcgacaaaacaaaataaacttattttatttgtttatcgagaaaaaaacattattattctttaaggtactttttttttggaaataaaatggctgatccaatcgactcgaaatattttgattttgtgccagccactgaagagcagcagggtaatggggaaaatcacaataaaaaggaaatgcaattaaaataaatgattgaattcaagaacatacattaaaaaggaacaatgtgccaaagggtaaaaatgcgacagttttatgcaaaaaattctaaaaaaggcagtttattactatttttattttacaaaatttacgggttgaaaatctgtaataaaatgaataacgattttcaaaaaaattccaccggcatcgcttatgatgaatgatctcagcaaactcgctttatctttgaaatcctaaaaatgttcaaatggttgaaaatttaatatctaaaagattctcaaagattttcccatcatgtacttgaaaattaaaaactgagtttcatttaaatgggtatttgccaaaacaggcacttctgctgatgtgttcggtttgggccaatttgtgcccagtggcgccgtggtgtcgtcatcatcaatcggtgctgctgctggtgatcatcaacagcaacaaggacagcagcaacagcagaacacggcgatggtgggccaatttataaaagaaacaaaaaatggtggccaagaaaatttaaatcatttttaaaaatgacaaaaaaacaaaaaattatcaagcttgaattattaggtttaaataaattattcttcgaattgttatttttagagcccggaattttgaagattttgggcttgggtatgggcttagacaattgaccaggctagggctgccctatcaaaaaagcccgtttaaccgagcttcccggtcccaaattttctggggcgcccgcctggctcgggctttttccataatttgtggaagtttagttataaaataaaaaaatgtgtaatctctattcagaaaagagatgtaattctattacattaaatttaaaattttttatctgcggctaattatatatttttgtaatataaatttaaataggaccaaagaccagaccaaaaaaactagagtgcagcgggaccgggaatcccggtcatccgaggtcccggttccggttcccggattttgaaaatttatttcccggtcccggtagggcaaccgggaaaaacaagcactggtaagaatggggtctgagtgtgttggatagggatcaaagatcactttcccatcattgttatcgactattctctctccccctttctctgtccaacactatttccattctctctctctctgcctatctcctccacatttctctgaccccacgtctttataagtgcgtccattccctcactcatggctctccgctccattcattcgcattggacatttttattattttattctcctccgtcgctgcactcctccgacctcatcaatttgtgcatttatttttattggtgtttattaataaattgttgatacacaacaattttggcgcagtcagcagcagcagataaattctgcacatcatcaagccaaatcaaggctaattctgcaaaatcttcaagccaaatcaaggcatattctgcacaaccttcaagccaaatcaaggcataattcagcaagcctaattttggcatttcaaaagcctgagcggcttccatcggacatcaataaaaactgatcacctgggtggtgtaagttccgctgggtgcggtttctcatcgacaaaaactgatcacctgggtggtgtaaagttccgctgggtgcggtttaatcaacaatcaaaatggacgcacaacaacttcagcaaattttggacgcggctctaaaaaaatcagcagaaatttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaa

SEQ ID NO: 10545 - DNA, 2350 bp, Heterodera glycines
tgttttggcatattttcaaaaaatgaatttttaatttcaggattagagaaaccgtcataaaaaaatctcaggatttgagaaaataaaaccgcccaaaaggtttggggtcaaaaaatttaaatttgcaaagaaaaaattgaatttccttcacctgccactttggtgacaggtggatgattgatgatgaccttcccgcggcgctgcgcggccgggtgaaaaaagcacccgcgaggatttggggaaatcggatttggttctgcggcaacatcaaaagacttcacccctcccataggctttggttcttggcggtaaatgtccacgggcggcaacttcatagggagtacaataggtttggtttggaacacacccccctcccctcctgggttttgatggggcggcaactttaaagggctgcgcccctcccatagggtttgggattgtgcgggaaacacccgcgagaaacccgcgaggttttgacgccatatactacttgcatacttacttaggattagggtctaaaaagccacaatttttagaaaccaagttttttggagttcaccttattgtcggggattaactgaaaaatcgtttctgggtttgcttggtccggaaatttgtttgtattcggcatttttaattttctctgatccaattcccagtaataaaaaatgataaatcctaaaaattgcattgaattagttaaaattcccgagaaaaacaaatgatacgatctctgaaaaagtcaaagtttgagggtcggataaaaaactttaaatgttccctaaagcagacaaattccgaggacaacagaaaacattctgatcattttgatgaaaaagaaaaattgaaaataattaaagaatttgacaaaaggagagaaatattgaaaaacaaaaacatttacaattgtaagcagcggaggctaattgaacgagaaattgccagggaattggggacataccttcacaaaattgaagaatggaaaagggaatttggactgataaaaagggcaaaaaaggaggacaaagaaacaaagttggcactgattgaacagtttgacagaatgaaaaatgagcgcaaaatgaaaaagggatacaaaaatgccgagaaagtcggcattgaatgtgaaattgccaaggaattggggacacatcggaacaaaatttacaaatggaaaagcgaattattaagtgggtgaaatagtagtgataaatagggattcgttgtttaggcacaaaaaatgtcgtaaaattggcatcaaataggcacaaaaataggcaaataaaatgttttattaatacatttttaggtagcaaaacaaataaaaaattaaattttagaggatcaatttttgggaaaattttcaactgcattttttttttttggtcgatataggggtgtatttttcttctttattgcatttttaaaggatttttccggaaatcctggaaataggaaccaaaatggcaaatcgaataaacaatttgaaatgtaaaaagtttattctttataggactttttgacattgctaaaatgaaaaaaataaaaacatttagtaatttgagaatttttttaggtccaccgacaaaaaagttttcaatgcagcaaagaatggaaattgtcgacacctttgaaaaagtgaaagagttatttgtgaaaaaattcaattttaaaccaacggtagaaattgaagaaaaaattgtggaaaaatttgggatttgcagacggtcaatttatatttggaaaaacattttcgagctgcgcatttgccgtaagaaatttttaactaaaaaatatatagttgctaaaaactgccaaaatcatttcttaggggtgcattttgaaaaattttcgggtcgattcttaggggtgtatgaaaatttttttaggtcgattcttaggggtaaatttttcgtttttacataattgcatttttgttaataattttgggcaaaactccaaatagtttaaaatagttttcaaattttttttaaagtttttaaaaatgtaaaagactaaaaaatggagccctaatcatgtaaatctttttttagcgaagcataaatactctgaagcggaaaaattggaattaattgaaaaattcgacgaggccaaaagcaaaaacccaacgataagcgacgaagaattggaaaaaatgttaccggtcaaaatttccacgataaaacaatggaaaagaggcaccaaaagaaggaaaactgtgaaactttaggctaggctttatcccagagtggccaagtgtccttatttctaagatttgtccttattgggaggtgccattttggcacgacctccttgctttgtgcttattcttggatttgaaaataaaaat

SEQ ID NO: 10546 - DNA, 2836 bp, Heterodera glycines
  misc_feature (15)..(15): n is a, c, g, or t
tagggccgcaacttntagtgacgaaaaatcccaaaatagtgaagaaatagtgacaaaaagtccaaaatagtgacgaatagtgacataattttcagccaaaaaataagccaaaataatttttattcactgattgcagttgcaaatgagtaggactgggatttttaagaccaaaaaacccaaaagagttacctaaaaaaaattttttaattaaaaatttttgccaagaaagtaaatttttaagaaaatttttttcatttcataggagtatattttgaaaaattttagcttgattcttaggggtgtattttttggttttattgcatttttgttaaggaattttccaaaaaatgtcgaaatagtgaaaaaatagtgacaaaacgccaaaatagtgatttttaactattttagtgacgaagtcgccaaaatagtgatttctagtgaccgataatgacatcagaatcgaaaatttttaatgcagaaatgcgttttttaagctcctttcttcaaaacaattgagcaaaaaaaaaagttttttcactaaaagttgcggccctacttatcatttcgtcactgatcgtttcgtcactgagacataattttaaaaaaatattgactaatttcaataaaattatcctatgaaattatgaattggtttaaaattctctaaaaattttcataagagtacaatcaagcttcctttcacttgccggcatcacaaattaaagtttatccatatcatttattcggcaatcctaaagtgggggtccctaatttaacttttttttattttacatttgagcttagaatgagtatttgggggtttttgatggtgctgattacgaatctgaactctgcaaaattcgcaagtattttatgttgttttattctgtttaaataattaaacatcaaattcataattgtctcatcaaaattaactttccttaaaattgaaattcggcaaaaataaaaaattacacatattttaaaaaattagcaaaaagcttggcggtgggcgtttgtaaataatatgaggaaaagcccttttcctatttaatttaattagaatttaaagcgattcagcaattgttgaaaatatagcagaaagattcttttaatttaatttgaatttgccattttagcatataatatttattacaatttaaaagtttgtcaaacaaaaattgttttttttgaagacatttccaatttgacagtcttccgttggttttattttatgttaatttttgataaaagaaattaattgtttcttgataaacaattaacaaaaaattcgaattctcaagattcctttcactcgccggcatcacaaattgcattaattgcttatgaaaaataaaatattatttaattaaaatattcaaaaaatagcatattatttaatttttatgattttaaatagggttcgagccccgtggggcgggggtggcttttcacgggggcgggggatgcgggggtcagagtcacgggggcgggggcacgataattccgcccccgcggggacgggggcgggggtttgctttgaattaggtccaaaaatctcacaaaaaaatattttttaagaatgatttctttggctccacattcctttatttgttgatcgcctcgatactatttcttttgacataaattgcacagatttcgactaaaaagtaaccaaaatttagggatttttgggtaatttttttaagaaaaaaaattttttttttttggggggggggcgtgccgataggggcgaattttaaatttatttctaacagatattcaccaaaaaaattaagactttttcgataaattttcgttttttaactatattaaattatcgtgatttactcaaaattggaactcagattttttaatcttgcggcacatttttcaaaaaaaaaacttgatgaatgtgcgagggaagagtgtctccggcggtgccaataggcgccgccgggaaaattttttgaaaatttgaatacaatttgttaacaaattttgtacaaaaaatgagcaaaattcgcgagcttgggataatttttaagaaaaaatataggaattttgggggccgggggtggcggtgccgataggcgtcaccggggaaaattttaagaatttatatgaattctgttagaacttagccaaatttttcagaaattttctttttttagatgaaaataaggcattacccccaaatcagaacatttgttagaaacaagaacataaagaaaccctgtattaatcagaaaaaataaataaattaaaggaaaacgttagccggaatcgaactcatgacaaaagtactgttagtattgaagcactatccaccaatccacaaataaaataaaaaacaagtaaaatttattttatttcataaaaatttctcgatagttaaaaaaaattcaaaattgtctaaattttttgccttatttcccacgaatgtgccattcttaggggtgtattttcacccccgtgcccccgcgggggtgaaggtcgcgggggcgggggtaagcccaaaaaacctgtcccgcccccgggggcgggggtggggtccgaaccctaaaaaaagtattaacaatttcggtgatatttcaaaaaaaaaaataataaaaacatttttatttgttaataaactaaattttttaaactttaacaaatttcttttactcgttaaaaacattaacattgcatttaattaattaagacaataattgattgtttcattgtgtctgagttcattggtaaattgacggatctgtcatcagagaaggtgtcggacccggccaaacatttccgacaaagcgaaggaggaataacgagagaactgaaattt

SEQ ID NO: 10547 - DNA, 1635 bp, Heterodera glycines
ctttaaatctttaaaaatggttaatcttttttaattacatacacttatcgaccgtagttattagtcgtatctttttgccttttgtaaaattagtgaccaaattgctaaatgtttttactttaaaaatataattaaataatttctttcataaaatggtgctgcttttctctgttcttctgtttttgctgtctctcgtcaaaattggtgattttaattaaattagggtaatgaattatttattttcttattattttcaacttgtgctgctaaatgggcgtcaaaatgtttcgtgggctttcatggcacagtgccggacgaggcttttgccaaaatgttatatgaaaagttcggaataattgccaatgccgacatgaaagagaaggaatgcagtggcaccactaattatcttaagcctccatccaaccgctagattgcttttgaaacggctgcctgtaaggaattggtatgcaaaaaaggtgaattaaaacacttgcaaatttcagttaaatgaatatgaaaagaaattaaaattcatcaaaagtaaaagaagaataaaaagaaaacccacaaaaaacgtttaaaataattaaataattaaaaagcgaaaaaatcttaataaaattgttttacataatcaattaacaattttcttaataccattcgaaaaatattctctatgaatctataaaaatttcaaaaatttcgttggttataaaaaagttaaataaaatcatttttttaaatttccaagtaacttttttttgtacttaatataattttttgattatatgtgactatcgaatgggtagtaagaatgtttgatttagttgactttgaaaaaacgatgacgacttttttgtcaaaaaacttcaaatcgttggcaaaactttggcccaatacaaatcgtcctttgcccccccccccccccaccttaaaagattcagaaattaaaaagcaaaagcagatttgtaagttcagatccgaaggatgccaaactgttgttcgtgttcaacatttgcaacaaagtggacctggccggagtttgccatggggaaaccttgataaattactgcaacgaggcgaaacatcacttgtgatgccgttaactctgtgccgttcgttccgttcaattcgttttgacatttttcggcatttttctgctgcatagttttgacatttaaattttcattttttgatcatctttttattttaattaatgttcgtttcgctctgatttactatcacagttaaagtcagatcggttttacgggaagtggtcaaaccaaggaaaatttgactgtcccaaatacattctacgaatttattattaatgtttaaaaaacatttccatttcgttatgttttccttctctccatcgctttttgattcatcttcattttacatttttacaattgtgtcatccaagcaaaagcccttcctttttttgtgattcatttcttccatttccccgttggttatattctcccgaataaaacatttatttgtaagccttttccgattggccaaacattttctcatttttcgtattattcgtagctctatttaaatgggtaaatattgatcataggccccaaactcaaaaatgcttaaaaacggtcagaatcgatgtaaaaa

SEQ ID NO: 10548 - DNA, 1219 bp, Heterodera glycines
atcaaatattttcctttaaatgtttttagaattaaaatcgaaaataaaatgttcgaaaactttcttattttgaccattttctgttgctttgcaaatgccattgcccaaggccaaaatgtaagcaaatttagttgatgaaaaaatggaaacaatattatttgaattgttaaaaaattgtaaattgttttagggttattactgtcagcaggttggcggcttctactcgtgcataagctgcaatgagccgtcgctcgtcaaactttgtaaaattttcttacccgaaaggcccctgggattaaaaattgaaatggcttttttcgtttgtttgctttcataattacaatacttaatgattaaatgttggcacatttaaaattaattaggcgagcatttgggccaattttttccaccgatggcggatcaaaaagtgcaaagcattaaagacgaacagcagcagcagattgacttgacgcctgccgcacaccatccggcacaacagcagcacatcactttcacattcaaatgccatccgacaaatgaaagccgaggagaaaaagcggcggaggacggcgaagcaaaagcaatgccaattggagttgtggtgagttatgccaatgttgtcctttttgcccaaaatgccaagtcggagcttgaaaatgattaaaaatgaaattaataattaagggcaatcatttcatcaatatatgaaataataaaattaaaaaatcattaaaaatataaatttttctccgttgacgacacattactccaaattatgaaaaataaccaattttgctgaaggtctttgacttataatcccatttctttttcttttttttttggttttgcaaatttttttaaattattttaatttcactggttatctggtaattaaaataattaattgttttacaatattctcagattctccttactgttctcggtgtgctgctcgtcgaggccatcgttggctttttggtatttttgtgcatttcgatgagaaaaggcatttgaccgatggacagagaaataaatcggaggaaatgtgaggacgaacggaatattattcaagcaaaagatgctttattagctgaccagttagcatgaaaatgctcacaattttgaattttggtggaaattgaacaataaatttgaaaatgcaaaagcactaaaattctgtaaaaatagatttattatttcttcttttccacctcataaa

SEQ ID NO: 10549 - DNA, 615 bp, Heterodera glycines
attttaccaatatggtaaagatgaaaaagtaaaaagttcagcacaaatgaatgcaacgatactgatcatcaaaaaaaaaaaattttgttttttaacaaaaatcaattgagcaatcaatcaattaaactcggtcctccgcctaaaaggcttcagcaatgtcagcggcactcttaaaaagccgtttttttgtttattgactttctatggcatttgttgcaattagtctgaccttcacaaatttccatgccttttgcagctttgtctcttcctccttcagctgcttcttcttccggctcagacgctgctccaccgcccgcttctcctcatccgtcattctgttcttctgccggtcgaatagctcctcctcctccttcaagtcctgctccttttggtaatgcacttgctcatcctcgtacaattcataaacattctttggaaaatgagacgacgattaaatcgaaccgaaccgatggggagcggggggattatccattttaatttaccaatcgaaaccgaatcattcggaaaagggaatggaacaaaaatccttgacaacacaacacccacaaactgcaaatgatggacaaataaagtgaaagcttaccttaccaaagg

SEQ ID NO: 10550 - DNA, 1020 bp, Heterodera glycines
aaaacgaaaactcaccttattgaccttccatgaaacctgattttataccattcttaaaataaattcgctcttttcatacaaaaattgctccgcacactgtggacgcagtcatgagcacctcggacactttactttcttcacctaggacactttccttactccagacacattaatcacttcggacactttcttcacctcttctttttttgactccttaaattaaacaaaattaaaatcctttaccctaaaacaacgaattaaaattcaataaattaattttgaaaaaaacagcaaaactattttggaaattacaacttttacctcccaagccttgaaggccttacaaccaactgcgacagttccgccagccacgagtgtcccgatgtcagaggtaccgcgcattggactacctccccgatatcccccaagatttgtccaccgacatgcttcacgatttgtcccccgacttgtcccacgatttgtcgccctatttgtcctccggtttgtccactgattgatatcaattgctgccccaaatccgcaaaaaaattaaaaaacattttttggcaagcagaaaaaatgatcagattaggaatgtgtttgagaatgcttaaattaagaaaagaaaaaacaatgcgtttataaccgcattttcttcattaaaaagaaaatatacatttaaaaataataatattaaatccatttgctgtgattgatgagaatcagaaatggaatattccaatttaaatggtgatttgtgtcatcgaatgagcatggaatgttgacgaatgaagaacagaaaatgacgtaaatattctgttagagcatgtaaatatttacatacatttgtttactgaccgaaaagggttctctttcctcctcattggtcaatgattgatcaaaaacagaaaccaataaacaaaacttttagctgtttcaaaggtacaaatgaaatttggaaagcggaaaatttttgaataagataataattaaaacaaaaatttaaaaaatgacactaca

SEQ ID NO: 10551 - DNA, 4150 bp, Heterodera glycines
ttatatatttatctaataaataaatgctgtttaatgtggatatagttattacatttttagagttgtcattaattgataaattatttatatatattcttttttgtgaaaaaattcaaaaaaatttcgcaaaaatttcaataagttttcaaaagttcaaaaacaggtaataaaaaatatatgaaaaagttgtgaaatttgcattttattttgggcatttcatgcctaatttatggtttcaatgaagatgctttatattaatcctttgtattttattggcttatctgcagaatttataaattttgttttcttgttgaggctcctttgattccattttccgtgttgagtttccatttatttagaactcacattcatttaatttattgcacttagtaagaaatttatcaacattcataatattaaattcttgtttatttaaataaaatttttatgttttttcaaaatttaaatgaatttacatgagtaataatattggtaattaattttttatgttcctttctcggtgcttcccttgtctgagtaccaaaaattattttctccgttgcatgttattaataattatattattcatgttttctaataattaaacttattttacatattttcgagttgcagtaatttatgacattttttattttatgaacaaaaataaataaatatttatgaattgcttgtgaaaagatattttatttctagatattgtattaagattgaatgttttttcaaaatccaattggtaggtttctgcacaatacacaaatgtgcttttcttttttaaatctcataaatttgtaaattttatgatcattccgattaaggcatttgagtttattcactttagtagtaattttcagattattcatcagaaaagtttcttcttaatgatttttattaaaattatcttttccttcattattcctacaagactataattaattattttactattattttttgttttgaccaatgctgtttttatacgaaatttattatcaaaaaaataaatttaaaaattaaatgcagaaagttaatacgttttaaataatccactttcacttgatccactggcattttatttcttggaggtttaatacattattttttttaaataaaacataaagttttttgtatattattcatttttgaatattcttttaaaattaaatgctgacagttcccgataatttatcaaaactgatttattaattaaaatatatttggattttgattttattttgcaaaatgcatttctgtttgctaaattgattttgttttttaatttagaatatcatttatataaatcacactctctatttgttcgaatattttgtttattatctgagaataattttattattttcatttaatttattattttaatcaaattctgattaatttttatatcagatttttaaaaaaggaaaattgcaacgaaccggataaaatataatgcctaaaaagcagcttctttttaataattaaaacaaaattttatcttgtttatgcttttcttttgctatttactaaaatgaaaataaaaccaaatgttttggacagggaattttttgttagcgatctttgcttcagttagtttttagtgtaaatttttgatgttttcaaaaagaaaaattaaataccatgtttttcaaattaaaaataatttaatagaatatttaaattaaatttaagatacaaccaaattggaacagctaatcaaatattggtttatttacatcttgtcatctttctatattagttccagtgtctgtttttaactgactgataaatataaaaatattatttttgaactaaacgataaacaattgttgttaatcataattttgcatttttatattgttattaaggtttgtgaaactattttgtattttacattttattttctggtagtaatatttttttctcctttgaataattaatttacattgaaattgacaagtatttaatttactttgatggtgcaataaatttaggactttattggttcccattcttgctcgggtaattaattggctttttccatcacaataacgatgaaacatttgcttgttttacatattttaaaattctagataaattttttcaagttatctattttaggctaatctaaataattattatttttaattcttaacaaattaaagataatatagacgaaaaattattgttatgttttgtatgtttgattaatgtactttttacatttatttatcttttatgaattttttattaaaaaaaagattagttgaatttaattgaaaatgattttcatttaaagcattcttattaattttcaagtgaactctccactatttgtgtgcatggcaatggctacagttcaaaaatacacttgtttagtattttttgacaattttttaaatttttatttattctgtttagttattatgtggcgaactaaaaatgaatgtcattttttcgagttatttaattttatattattgccgtttaatcaaatccaatttaatgaattaatgattatttttttccaatagcaatttcttgataaaatattaaaagttttttttataattttgtgatattttttttatatttttgcatattaaaaagttttcattaattatttatttattgtttattcacccgttccgacataataatttattccttttattctaataagtttgttttttattttataattgaccatattcattaattttccaatgttttcgcaatgtcgctctgacatatgtcgggtcctcaaaagtcaagtcatcaaatgtcgggtcctcaaaaaactacttcaaaacaatggtaatgagaaatgtattaccgaaaacatatgtttttataatcttactttgtgatagaaagtatataatgataaaatagcctaaaaaacaaaaaactataaatgaaagagattaagcatctaacatctcttcaaaatccactttcatagaacgctcaggcataaatgaagataatttgaattaaaacaatgcatcaaatcagtaattaattaatattaaaattcttaaaatcctaatgaacatgatatggctacctgatactcggtagttgaacgtactgattgcaaagaggcatggggaaaaaagaatgcaattattgatagatagcttgcctgaaattgcataaaaatacaaaataaaataaaacaaaaactcaagttttaagcgcaaaaataagaaacattaatttttaaaaataaataaatatacttaagcatgaaaaattattaattaagtaaaacaaataatacttgtatattcattagaaaaaatcatttcaaattattaatagataaaaataaaataaaataaaacctgatgtataagaatagaaaataaataaaaatttatacaatataccgacgaaagaatacaaaaccgacctttgtaatggaaatataacattttaattaaacaaacaatgaaatactataatagtttaaaaaatataaacaataaataaaaccaccatgttagtgactttgggttgagcttgatggcattgagaaggaacagatagagcggcctggcatgtacacatattattggactttttatttgatttcaattttgcctttccttcgtttatttataaattaacagatttctataatttaaaatgctttattatttaggtttataaaaaatctctgccattccgcaccggcagtgcacgagggtggaagctcacctccgccagtaaaatttttttctttatttaattaatatttctcaaaataaaaatgatttagactattaacaaaaaaaaagtcctcaatactttgttgaatttttttgaatatatatttttctctatatttttgataaatgtttatgctatttcgattctcgctttcggaagttctcgttttagtacctatttgaaattatttttcacgatatttttgcatctaaattccaccaaaatctcaaaaaaaaaaattttaattttttattttacattgttaaaaaaccttgaattttcttaaattaaagtattttacctacattttccaaatattttattatttatttataaaaatcttttaatttttatgaatacttttggattatttaatttgtgaatttattataaatac

SEQ ID NO: 10552 - DNA, 2846 bp, Heterodera glycines
aataaaaaaaccaaaataattttgtattattttcacttgatataaattaaaaatttgaatttttttttaattttttaaaatttcccggttggtcccggttcccggtcccgaaaaaaaatcgaggtcccggtcccggtcccggcttctcaggtcccggcaagtcccggtcccggttttggcaaaaattcccggtcccgtggcactctagtttttcattccaattattattaatttttattgaaataaaattatattttttaaagttattttagtatatgttatttaatagaaatgttgaattttcaattcaaaggtcggtctacataaatttttatttatttactattcttatcaaatgtgcattattagatgagtaacaaattatctattggtctatgcggtaattttatgagttcattcttatttataaaattatttttttggaattataattttatttatatttttttaatttttttatataatctcggcatcttcactcagtcttaatatcattaatttttctatttttttagtatattttaaatattttcagttttatttatttgtatttttgaggtttaacattgtatttttatcattatctttaataaattcgttctgcttttccttttaatcttgacatcgtgaggctcttctctctcgcactcttgagccggaagtgttgttataatatgcatttgtaaaaatttatttatcacaatatttctgcatctaaaaacctctaaaatttaataaatcaatcattatttttttttgtaaaattttggaagtcttgaattgtcataatttgcaaacattttttctattttaatttctcatttaattaattttcattactaatgtataaaattattttattttacacatttattcagcttttgattacttattttttgaattttattataaattaccttatgtatttaaatatgcatttgaagtttggctgtccataaagccatgtcggaaagccgttctgcgctcgacgctcaaggcttttggagtatttactaatctagatctttattaacttctttatcttaatgataaaaaaatatgaatatcaatttttggtactttcctgttttgaaggcgcacaccatttggtacttgtacatttacacctcataaatttttttttgtttttaataataaatgagttaatcacgaaatgacatcatttcgaccaatcttcgaaccccggacccgaattcgcacaaaaatctaaaatatgtttttcaccaaaatccacctttattgagatctgaatgggtcgaaatggacatcatattcgtggggtgcgccttcataacaggaaagtacccacttttttgtagttttatagcattcactattaatttatttaattttttctgcctgaaaaaatgaaatgataagtgcaattcaaaaaatatattggcctggtttgaccgtgattttttagtactctgagtcaatattttgtttcatttgtgagccatctttcaacattcaaaattattttatttttaatatttcatttttattttaaatgattgtaattttatgcattttaaagttttttgttatttaataaagtttataaattaatttattatatttattaatttttttcttgctgaattctccaagtttttgaaaagctgatttgttggttttctatattttcttattccttaatgcattatgaaattcattttttatagaatttattcattttttaaatcattattttaaatatattttttacttccgtatattttttatattccatttttttaatgtataaaaatgttttaaacttttatttaattatttattaaaaatgcatatgaattttataaaattttctattatttcttgtctttggcctttattacttaccgtatatgctcgaattatcgcccagtctctattaatcccgcagtctccaattatccccccatttctgagtggtttaaaaataattccccatgggtgataattagagcatatgcggtagtttgaattcttaatttttaatataattgtaaatattcaacaaaaaatgcgattcgattttgaggcaatcaatcatttcaattcaatcaccttgctttttcaccttcgaaaccattcataagaattctttcgaagaattgggtgcattttcaattgtattatcttcattccttgtggttattaagacctattcaaagtaattaatgttttcacagttattagaaatcaatggtattatattaaaaataatattttgatataaatgtattcgtgccggttgttcgaagcggcatctcatttataaagctaattaatgagtttaatgcactctgactctctgtcattggaaaaaataattcatttaattatcatagttctgttttatttttaattgattttttaaacacatatattgtttatttatttttaaaaattttatgaatttgattttaatttagaaacctaattaaaaatattataaatatttctttattatatatttgatttattttcaatgttaaccgcggctttctcatcgtcatcttgatcgtacaacagcttactgcaaaattcttcttcggccataaggcatccaattttaatttcaaaattaaattattcttcaatttattatattttatttaaattatttttttatttaaaaaaaatataatgcttttaaaatcatattttttctctataccttttattaaattattttccatattcttggcacctttcaaatatccccccggaattcttcataacggcccttaatttttggtgttaatttatatttttttaaaagttaattttaattt

SEQ ID NO: 10553 - DNA, 2212 bp, Heterodera glycines
  misc_feature (2125)..(2125): n is a, c, g, or t
  misc_feature (2163)..(2163): n is a, c, g, or t
  misc_feature (2200)..(2200): n is a, c, g, or t
attttcacaaaaaaatttccggaatttgggcttaaacaagtttaaattcatgatcatggttgacagaaataattttttttttagcgttatcaaaagtgacccaacattcgccgaaatggcacgatgtgtcacgtcgatcgcgtttctccgcattggagatttggcccccggaatcatttgctctggacagggctctccctgacgaacttactcccgtccttgactggtaaattgacaatctcacaaattgtttactatttattgttctttaattgtttaataggttcgtcatgaactacacgggtcgtcttaagcatgatggaagccgaacacgcccgcgatttgacccaaacatttggagtgtttacactcgaacactgcaaggcgatgaccggacgaataaccattcagaagccgcgaacagacgcctacaatgcgcatttgcctgaaaacaaccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatctatttatcattacatttttgatcggaatttctcgaaattatgaaatgagaccgtgatttgaaacaaataaattttttaaaattttcttggatttttaatttcactgtctttttaaacttttggtatggaaatggcccaaatgcattggtagggaattggcggtagggaatcggccggtagggaatcggccggtagggaattggctggtagggaattggcggtagggaattggcggtagggaattgggtcgatccctcggcccagactttttagaatgttgatataaatttttctttttcatttctttaatttaccgaccactaatgtttcagttatatgtatatactttttccttaattttccattccatctctttttggtaattaaataattaatgtgaattagcgtcgatcacctgattccaccgactttattattttcaaattatatacataaaatattttcctctcacattaatttggtggactaaataaaatttaggtttgggtatttgacgtggtgtttaaagggcgtggcaccattttcgattgactttgtacaaatcagaaataaatatgcaacaccactccaatcggttgagcggtgcctttaacggattggccatcgatggcggcagaacggccacactgtcacaacaacaaatccaggcaaatttaatttttacgagtaactcttctctggcatttcggttcatttttactctcatttttagacagaaatccaacgttttgagtcagttcatccgcgcatttatcaaatttatgatttgctgaagaaattgcgttcggaccaaagcaggcaagcggaactcattgaacaaatccaagagcaagtgatcggcattgaaggtgatcgatcatcgcaattttttgattaaatcccaaaatatgaactttccatcattttttttaattttcagatgcatttgtcaacagccaagaatggacaattggcaggacaattcacgaaattcgagtggtaattgtttgttttgtttttataatgaagttctcttttacatttttgaccattttactccgaattacagggagtaataggttcggaggacagctgcaaaaactcactgattcactattttctgacgcgcaattggaactgggaggatgcgcctgaaggcggacgcttcaaaaaggaggtgttcatcgacggactcagctacctgttgctgatcagggacgagggctctcgtgagccgaacatacaggttgatttgaattctttaaaaatatttgtttattttacagtttgcccattggtttgatgcgttgctcattgtttttgccatcgaaagccatcaaagctttaatgcggcacttgaattgcacaaaaaagtgcattattttcgtccgttagattcgaccgatgtgccggtttatctgatcggaatgagggtaacaaattctttatcaattggaanagaaggctatagtacatttttcaaaagatatgtcgcanatggcacagaaacgggcgataagcgaattggatgccncacggatgagca

SEQ ID NO: 10554 - DNA, 1239 bp, Heterodera glycines
  misc_feature (40)..(40): n is a, c, g, or t
  misc_feature (106)..(106): n is a, c, g, or t
aagccgtacacaaaggaatgacttcatttgtcatgccatnccgtcctgttcttcctcatccgtctcctatcacaacaacaataactctgccgttttccatgcgccncaatcgtctgccaacggcacaacttttcgcaatcagctgaacagttacacatcatgcacaccgaacagcaacaacaacaataacaatgccaacctagtaatgcagaccaacagaagtgagacttaatggatgagttggtattacacggagcatgtcgtttaccccaccgaaaatttaaaaaaattaattaaaacttgtcagaaatttttcaagaaaaaagcttcttgttaaaacattttttatgagaaaattttctgaaagtaatttttaaaaaaatattcagtcgattttttcataattttatgataaattactatgtttttttcaaaattttcctaaaaaatcgttgataaaaattttcttaagattttctcataaaattttttaaaaatattttctgtttgcaaatttaaaaaaaaattcgtcagaaatgaagtgcacccgttattactatttacagtgaaaataaaatgttcccgaataaaatttttgaattgggctgaactgcttggactgtccttatttattgcctttagggcgagagtcgatggatcagcattggcctcgctctgtcaacgcccacctcaacaatcacgccagtcaccagcaacttcaacactcggtcggctcgccgtacatggtcgcctccatcccctccacgccctcctgctccgcattggtcggcccccattgtgccgttgtcgaacctttgacgccgtcggccatttcatccgcattcagtcacaacaatttggccacaaccgctgcacatcaccagcagcaacacaacaacagcaaccattatgcaagttgcaacagcaccaatggtgaggaatatttaaaccaaatttgagaggtgtcaaattttggagaaaattttgttattttggaccacaaatatatcaattattttttcattctgctcatttggatgcaatggaaaatgctaacaaacacctaccaattatttttcattgtgtgtcttctcggggccaacatttaattagttaaaatttttgtaaaagagtaattaaagccaattcttgaatacctcagacatccatttttatgacaaataatgcaattttctctttcaaatgacaatcgatattctatgaggtcattttaataat

SEQ ID NO: 10555 - DNA, 1012 bp, Heterodera glycines
  misc_feature (39)..(39): n is a, c, g, or t
ccccttgtaacacctatggactgtagacaaagggacttntagaaaataacaggacttgaaccggaaactccggtccaaatcctgaaacaagtttatcaaactcattttcagttcggtctccgtcctgccactcaacaatgatcagtcaaacgcgcaatttccgcctgcttccagtttccctctcgttggaggcggcacagcggcggcgccgcgaagccgtacacaaaggaatgacttcatttgtcatgccatcccgtcctgttcttcctcatccgtctcctatcacaacaacaataactctgccgttttccatgcgccccaatcgtctgccaacggcacaacttttcgcaatcagctgaacagttacacatcatgcacaccgaacagcaacaacaacaataacaatgccaacctagtaatgcagaccaacagaagtgagacttaatggatgagttggtattacacggagcatgtcgtttaccccaccgaaaattaaaaaaaaattaattaaaacttgtcagaaaattttcaagaaaaaagcttcttgttaaaacaaattttctgaaagtaattttaaaaaaaatattcagtcgattttttcataattttatgataaattactatgtttttttcaaaattttcctaaaaaatcgttgataaaaattttcttgagattttctcataaaattttttaaaaatattttctgtttgcaaattaaaaaaaaaattcgtcagaaatgaagtgcacccgttattactatttacagtgaaaataaaatgttcccgaataaaatttttgaattgggctgaactgcttggactgtccttatttattgcctttagggcgagagtcgatggatcagcattggcctcgctctgtcaacgcccacctcaacaatcacgccagtcaccagcaacttcaacactcggtcggctcgccgtacatggtcgcctccatcccctccacgccctcctgctccgcattggtcggccccccattgtgccgttgtcg

SEQ ID NO: 10556 - DNA, 1244 bp, Heterodera glycines
  misc_feature (1236)..(1236): n is a, c, g, or t
agttggctgggaagttgcgacgaatttggcatttttgagataatcgaagacaaatttggcaattgggaaagagttgaagacgaatttggcatgcgggaaggacttggcaatggcttttgggtgggaataggcgatggttggctgggaagttgcgacgaatttggcatttttgagataatcgaagacaaatttggcaattgggaaagagttgaagacgaatttggcatgcgggaaggacttggcaatggcttttgggtgggaataggcgatagttggctgggaagttgcgacgaatttggcatttgagagataatcgaagacaaatttggcaattgggaaagagttgaagacgaatttggcatgcgggaaggacttggcaatggcttttgggtgggaataggcgatggttggctgggaagttgcgacgaatttggcatttttgagataatcgaagacaaatttggcaattgggaaagagttgaagacgaatttggcatgcgggaaggacttggcaatggcttttgggtgggaataggcgatggttgggtgggaatgtgtgacgaattaggtaattgtgtggtcattgacgaacaattactacataatttgagtactgggcctacgaatgtatcacaaaacaaaaatcctcttcgaccccacggacgatagaatgcttctttgtcagcgtttaaatggctatacacaaaagtgaggcatttttgggaggatttttccagtaaatataaaataagcagcaaataataaaataaattcatctgctatacaccatagctttcaaaagaagctttacatccgatctgataaattaatgtgcaatgtatgggaaagggtgttgagcaaacgcttgaggcggagattaaattgtgaaaacgaaaataattaaaagaaaagggattttttaactagtttgtgaccaattttttataccaaaaaaatgaaaattttttgttgtcctacggttgatcatcctcctttttatcttcaatcccacattccttccgtcttcttttttttcctcatcatccagtacattccttcggtcaccactttcctcttcgcctttgtggaaaaaattgcggacaccatttggtggcacggtcaaagcacgggtggtgatatacggcacagcaactcttgtaaatggccacatattctccacaaagtgttggaaacgactcaaacgctggaggatacacattttgcgggcaaactganagcgaaaa

SEQ ID NO: 10557 - DNA, 793 bp, Heterodera glycines
tttgggtgggaataggcgatggttggctggggaagttgcgacgaatttgcattttttgagataattgaagacaaatttggcaattgggaaagagttgaagacgaatttggcatgcgggaaggacttggcaatggcttttgggtgggaattgataacgtattagacagttgggtgggaagttgcgacgaatttggcatttgagagggaaactgcgacgaattaggctgttgcgtgccaaatggcaatggtttttgtgtcgaaaattgtgaagaaattggcaattgggaaggaattgaagaagaatttggcatacgggaaggaattggcaatggtatttgggtgggaattgataacgtattaaacagttggctgggaatttgcgacgaatttggcatttttgagatatcgaagacaaatttggcaattgggaaggaattgaagacgaatttggcatgcgggaaggacttggcaatggcttttgggtgggaataggcgatagttggctgggaagttgcgacgaatttggcatttttgagataatcgaagacaaatttggcaattgggaaagagttgaagacgaatttggcatgcgggaaggacttggcaatggcttttgggtgggaataggcgatagttggctgggaagttgcgacgaatttggcattttttagataatcgaagacaaatttggcaattgggaaagagttgaagacgaatttggcatgcgggaaggacttggcaatggcttttgggtgggaataggcgatggttggctgggaagttgcgacgaatt

SEQ ID NO: 10558 - DNA, 2580 bp, Heterodera glycines
  misc_feature (2569)..(2570): n is a, c, g, or t
  misc_feature (2572)..(2572): n is a, c, g, or t
ttttttaaactcctttcccattattcgcttgcacttacactttaagcacttggtccaccgttgaatggccggtgcttatgacgtcagggttatgggtataaaactcgggcaccacctgggatttaattaggcaattaaattatggaatttcccgtccaaccctgcctatcattatagaaaagccgcgaatagccacatttcgcgtgctgtgcaagtccaccgactgtacattggcatttgccacgtcaccgacctaagggaaacagaagcaaaaaagggcccaaacattagtgttaaaatgagaatgacatggcattaattaccatggccatggaagtggaaaggccgccgacgagagggtcggggatggcggacagaacggcatccagtttggtgaccacctgaaccaattaatgtgttaattgatggacgaaatgaacaattgatgaaaagttaaatgggccaaatagaagcaattaaaataaaagtgaggcaactaacagaccccaaaagcgatcattgtgagtccgccaaaaagcattgtgaccgaattggcctaaatttccaaagtattcgattttttttgaaattttacccgtgagtgggacgcgcgcccatggcgaatttttttgagtggccatttgggtggcatttttgtccgtccgtgccacactgtccttggggatcagctcaaacattgtcattagcaagcacagggaccaggagaacagaatagcagtcaaatactgtagaaaaacaatagaggagtaagtgatacggtagaagcaatgaaattcgaaatattttaaaaattaacgaattcaattccagtttatcaaactatgaaatatttttaattttacggacacagattgtcaacagaaatcaaaaaaaactgctcggaaataatcattcagttactgtttttttgaagtgtcagagtatggtatgtttgtgtttagtttaaaaattaatttataattcttaattttatcaaatctgaccggaaattggccaaaaacgttgaaacgaatcaatcgaaagcgtccgttggcaaagccggggaatgggacgcggagaggggccaagtaaagcacagtggcgaagagagcggttggttattctgcaaaaaaaacaattaaaaaattgggatttaaatttaaataagagatgccaaaaaatccgaatccgactgatcactggtcattttgccaaccattcccgtggcaccgatcagaaaagtgatgcacgaggaagacattagagtgccttgtatctgaacaacaattaaattatttttattttattaaagtgttgcgccttcttcgagtcatcggagaaaaaaggcgggaattttggggattaaaaacgggatggagacgagcatggacagggacaccatcacttggtaaagcggaaattaacaactttcattggttagggtatggtggggtacggtatgaaatgattgtgatatgcacattgatttattggactgatcaatcaatgcttgcatttgttttacctgaaagccaaacaaaaaggtctgcagaaatggtgggttttcgtccgctttgtacagttttctttgctgctgttgtcttttgtcggcttttccctccgtttaggcattgcccgagggcataaaatcgtggccattcatttccgctgaatttttgtactgctcgccattggcagtgtccaactccgattcgttgggacaaatcattaggtggacgaaaaattggcgaaaactagggggaacagagcataattgccaaattaattaatctgagaagaaacccttagcaagaccaaacaatacttatgccaaaggatgccaaaaaatcgacggaattcgtgcctttaaaattgttggggattcaatagtcggaggcatcggcggggttggttggtccctcccctataatatgccttgactgatcatctgactgatcagtgtgcgctttacatcgaccggtttctgctgcccacccaaatttcattatttcatttatatataaaattatttttgctgcatggaaaaatcggatgaattgccattgtcaacccaagagatttgggattaattactcttgaaacctgtatataaaggcacacaaaaatggttcggttgttgaccgatgctcgacttttaatattccaccaatcgcagatgaacattttgcccgtttggccgtattctttgccgttcattgaacgaattgcgatgacaactttttcgtttgtgtgcaaaatcgatccaaaaggcagtggtggtattagttcggacggaagttattgtgccgtaagtgaaaaagtatttgtagatgggcgattctgtggggaaaattcggatgaattgccattgccaacccaagagatttgggattaattactcttgaaacctgtatataaaggcacacaaaaatggttcggttgttgaccgatgttcgactttcaattttatcaaatgtttgcgccttgtcatttccttcacttcgtcgtccatcgaattccttcgcaaaggctgaagaaaaaaatcagattttaactgattatgacctgnncnaggcatgc

SEQ ID NO: 10559 - DNA, 883 bp, Heterodera glycines
atatttcatttttataagaaactaaatgttcaattttcttttttttttctaattttattgaacaatgccttttgtgtcgtatttataccccattttttccatccttttgtgccatatttaaattttaattgaaatttaaaatctttttttacatgaattttgtgaatcgtataataagtagggcgcggatttttaagtttttattttattttttctgcggctttaactcgacgagaaatgcacgaaaaacacattttttgttcggaaaaccttcgttttaacgcccctatccgaccctagcaatccctattttggatgttcgcccctaaaaatccctattttgagtgttcgcccctaaaataagtttttatccttattttggcgtttcgcccttattttcgtccttatttcgcgatttttaaatttttcacataaaattcacaaattctttaacaaaaatgctacgcaaaaaacttcttttttttttgccgcgatcacattttttagcgacttgttcaacaaatattttcaaaatacactaaaaattttttttcttgaccaaaatttttgtaatttgttttctttcgtgtcaaaattttgatttttgaaattttattattttgggaaaatgtattcaaaaatttcgaatataaataattatttgcaattgtaatcactgaataaaattgtttgctttagctttaacttatttacatagaaaaaaaagagcaatttaataaatttcacccatacatttgaaactttttcgcacctatttcgcgaattttttgcccctatttaggtcccatttggactttttcgcccctaaaaatccgcgccctaattataagatacaaattattttatcaatcactgagttttt

SEQ ID NO: 10560 - DNA, 1754 bp, Heterodera glycines
tttcagaaatacccaattccttcgcaaattctttctgtttgccttggccatataaacttttgaattcatcaaagcgttcaataaattttttctttttctgatcacaaaaactgttttccatcattttctttttatttaaatttaattcttttttccatttatatattttgtcgcgatttgcgcctaaaaattttccaatttttgtctcaattttgactctgttttcccatcgataatttcccctttgcttcaacttttctttaattgcttcaaatttttgaatcatttttcttttcttttgatcacttttgaagggttagaaatcagcgtaaattaatcctatacagtaagactgaatttattttaaaagagtagtaaaaaatcacaatttttctcatttttttgcataattttgcctactcttattcatctaaatacagggcgagtatcgaaaatttttcaaaataagaacatttcgcaaaattgcttcaaatcagttatttttacaatttattcgatcaaaaatgtatcaaatagtatatttttgtctcccattaacgattttaacaatttttgggaggaaattagcaaatcataaaattttagtgcattcgggataaaaaaaaatcagatttttaacaattttttgcggcgcatttttccaaaaaacttttgggaagtgcgaggggagggggtccggcggtgccgatagacgccgccggaaaattttttttgtaatttaattctgatttgttaacagattttcaccaaaaaaggccaatttttgtattaaaagccaagcgacgactttttttgcctttaaaaatactttttttttgcggtgcgttttttcaaaaacttttggggaacaaggggggagatggtccggcggcaccgataggcgccgccgggaaaaattttgttattttatttttgaataaatttatttatttaatttatattttcttgataaaataatgacattctgccataaaatttcaaaattttgaatatatttaagaaataagaacaatagcccgaaataaggacaaatcttacaaataaggacatttttattttgtaagatttggaccctccaagtaaggacaaatcttataaataaggacagatacgcgccctgtctacatataacagaccaaaaaaaatttcttattaaaaattgtgttttattgttacaaatttacgcattccatcggttgaagtcgtcaaatagagaaaaaggcaaaatccagaagcgaaaagttcagtagagatgtaaaacttaatcagtgatacttacaaattagttgaatagtaggcaaaatttcaaagtaaaaaaaaacgtgaaaaaatacgtttttttacaattcttataaaatcaccctattcttaatatacgaaagctaatttcggtggttgtaagcttcgaaaattttcaataaaattgcctaaataagaacttttaactctccgatactaaaagatgagattttttgcgttttttttttacttttttaaatcttatttgagattttattttaaaatgaaaattcattaactaatcgccaaatgtagcaaatatttccgtttgctttggccggaaatttattggattaatttatcgcatttgacaaaattttggctccggcgccaaaaagggcctaaaaaatgacgaaaggtcaagtaaaccgaaaaaacctctttggaaaaatttcgggggatataatttatccatttttcattatatttccatt

SEQ ID NO: 10561 - DNA, 765 bp, Heterodera glycines
aattagaaaagaaattattctaatttatgtactattggaaaaaattaataggataacaaaagattatttattaaattttgtaattcagtttataaactgatgttgattcgaactttctttcggttcaaaaagttattcaatttatttttagtggcaaactttcaaatttaaaaggaattcaactataggtttgtgctattaaataagaatttcctggctaaaatattctttccgtgcatttctcagcaaaacaaatcaacagaagaaaattgaaaactaaaaatccttccctgtaatcatattccaaattataatgattattcactaataggacagaaaagcgtttctaaaaatattctgtgaatttttttaattggccggaaagttttaaaaaatgccaaattaaggctcttattcattttaaatagatttaatataataaactttgaaaatatgaattttcaaagctataccgaattttcaagtaaaatgaaattgtgcaaatttcctattctataataaagtattatatagtaaattttataatattttatttttaattagtttttaaatttattctaaaaatgaagatgaaaaattgtgctttttgaatattttaattcatttcacgttataatattataaagaaaattaaaaaactcctgttgattaattaaatttcataaattaaattctacaattattcagttaatttaaccaaagataaattaattaaagcaaataaaaatgaataaatattaaatt

SEQ ID NO: 10562 - DNA, 3067 bp, Heterodera glycines
atgatgattgggtttgtttatgcaattactaactattaaaaaaattttaataaaattattgctttattttgcttctataaattcgagtaattttgataattaattttgatgtatgtatcattttttagtagatcaatatagaaataaattatttgtcaaatttgaatatttttaagatcatttacaaaatattttaattctgcgttctaataaaataaattgattattttcacctttcgcaattaatttgctgtttaaagtcaaatttcttctaagttttgttgatttgtattttaatgattcgaatgtttattttagattttgtattgtaatttcatagttctatattcgcattttctttcgtttctttatgtattaattattgatcttatttattgaaatatacataactaaatttaattattaaaattttccacagaaataagtaagttttttttaaattgtatttaacattttatttattttctaggataaatttttatttataatttaagaaataatattatttttttcatctttttatttgaatttctatattggtaatttaaaaaattttcgattttcggctacttccgctttccgacgtttttggaattccaatttccgaacaattttttgcggggctcggaatgccatccccgctaatcttcctctttgttggttgactgttcttatttaaaattgttaaaaaaattttcatttctttatggaattatttttattattatttcgtagctttcggtttttcgttttgtgtgccgttgatgcaatttcataatccttaatattttatgttttttaatattttgctttgatttatgttgtttgttcattttatatgcaatatatttattcaatttttcaattcacctttttattcataataatccatttttgatataaatttaaaatttaatttttaaatttaattttggctagcttcaaacataaaacatattaattattttttcagtatttttattaaaattttttatatttttttaattacctttttagattttcatttattttggaaagttttactttatcattgcaacggctagaattaaatttttcgttttttctttcaaataaataatttttgattattttatttgttaaattaaatgagatttgttaatttttttgtatattttcaaaaaatttttggaaggttaaatctttatttgttatttaaattatcaatgttttctttgattgaaaataaactgtctgataagttatcaaatttttaaattgcaaattttcaaaatttttagtggcaccacaaaagttcttttgaaaaaggcgtgccgcgaaaaattgatgtgaaatcattatattttaaaattaaaaataattgttgtcgattttgtttatacattattgaaaatttcatttggaaatcccacggtcacctggggaccttcctttgtaagtgttttttattaccctacaaaatttaaaaaaattcgttaagtttcaaaaagttataacctgagaagctcaacaaacaaatgtttttcagcatttaaatttggttgcttttgagcaaagatatattaaactaatttaatttcgatgatttttgtttgagtagcgtcatagcacctttagaacgtcaattaataaaacttttttaatgacatcccccccccccccccgggaccgtccctgcccccgcttcgcccttcttttgcctggttgtgcgcggctgctgccgcagcgcccgcggcaacggcggcggacgggcccgtgttgaggaagtcccagatgagaatggtgtcgtcatgggagctgctgatgatttggaactcgtcaaattgaagccgaaaaacgcgtccggtgtgttgctgaacgaacatcaaaatgttacttaaaaacaagaatgttcattggccactgaccagcccgtacccgagcatttcgtaagttttggagggtcggaattccattggtatttttgaaaatccggttcaacatacctggccctgaggcaatttacttccaccgaaaattaaacaaaaattatggagaaaacagggcgaatttcggcctcaaactctcgaaaatttactttgttggaagctaaatcggttggcaattacagaaaaattcaaaattttgcttctcgactcgccaatatatgtcattcgattcgcatttttccctggttattagtctgtatgccattgatctgccgactgatcactcaccgaaagtgtctttatacagatggagttgggcggtgtcatcgggtcaagtgccgccgccaggtcccagatcataattttgctgttaaaaaaatatttttaaattatgttaaaaaataaattaataagaaaattaagcattctgctatccgtgaagacttcttgccattttcaaaaaaagaaacaagaaaaaaaataataatttttaaatattttttgaataagttaaagcatttagacaggtaattaattcaaagaatggcaaataaatagattttttttggttttcgttatacctttttaattttgcaaaaaaaaaactaaaaactttgattgttttttttaattttcggagggggggggggggtagcaccttgagacaccccctgtatatgaatgacagaaattaatgaaatttacataaaaatacattttgtattaagcaggcccgtagccgccttcccccccccccccattttgtcttattttatgaaatttgacctcaaaatggttcaaaaaattgaaatttttgcgcaaaactgctataagttcccctttttcgctttctggggcttatttcaatttacgtcatatcactgatatgacgtcatatttttgaccgatttttaaatgcataaaattacccgtcggaagcgccggacacaatgcgtttggaatcgaagcgaatgcaccgcaccaaatcctcgtggccttccaacacgcgcaagcagttgccgcattcgatgtcccaaagtctgttttggagaaaattgaaactagttaagtaattttaaacgaaatatgccgaaaaaaaaaattctatctgtgggttt

SEQ ID NO: 10563 - DNA, 2040 bp, Heterodera glycines
  misc_feature (34)..(34): n is a, c, g, or t
  misc_feature (2015)..(2015): n is a, c, g, or t
ttttagtattttttgaaaaaaaaaatggaaaacncaaaaaagggaagggatacacgctgtactgataattttcatgaaaaaatttccggagcaggtcgtttgccctcccccagaaaaaattttcaaacctagaaatttttcataaaaaaattcttaaaaaaaaaaaaaatttgaaaaacttagtagttcttcataaaatttcgaaaaatcgctgaaaggtttttcaaaattttttttcttaaatttccttattaacaataagaaattttctaagaattttttttatgaaaatttctaggtttgaaattttttcgggggggggggggaaatgaggtgcacgcaaaatttcatcacatcgactacggccttggtaccattttgacatgccattgaaaattgagtttcatccttcacctgactgtcgcgtcactgctgccactggcgatcatctggttgtcgtactgcaggcacagcacggagccggtgtgcccgctcagtgtttgcacacagccgaggctgggccgggaccaaatctgagggggaatttttaaagttagaggtttaaatagaatttatagcataatatttcttagctatgttggctcattttttggccgaagaaaacccatagattagagacgttttaataaaaagtacagaaaaaaattataaaaataaacacgattttccatttccattgcaattaatcctccaatcggcgcaactgtcaaaggatttagttttttgggatttgtaagggagcaggcccgtagccagaaaattttttcggaaaggggaatccaaagacgtttgttttttgttgctcttctggcaaaaattaaaaaaaaatttcttcagttattttagaaacttgagcgccggggataaaaagcaggcatttgtagccaattttcgccaaaaattacattttccaatttttgggtcaactttaaaatggaaatgagggctccggtcctgttgtgccgagaggtgctatcggcagaaaaaatggaaattttgaccatttttattaacagatttccaccaaaaaattgtttgttgtgtgggttactttgattgtgttgtcgcgcagtcccgagatgatcttttcgtcgtcgtattggagacagtagacacctgaattggaaaatgaaaatgtgctcatcgatgaatttatgttttttggacagagtgaaggtggggggaggcataggcctaaagaatcatctcgtttccgcaaaggaaacaattttattttatttttccaaatttattacaattagagattttttaaatattaaaattttttcataacaatttagttcatgaatgttttttttatactatttgcatagaaatcattttaagtcatgttttgaaaacaaaacgattagaatatcgtggattctcttttaaaaaaatctcaataaaaattagaaaacttaaaaagtttctaaaaaaaaaaattttcggtaaggaatgtaatgagccttttttgaagaggaccggcgtcgaaatgcattgagccaagcattaaaaaattggcaaaccaaaatcgggtaggtttttaactccggatttgtgtcgacaaatgtccatacaccaaaaaaataatagttttcctccgccccatgcctttgctattctccgattggcaattgatgcgctccaatcgatgtcgtccctcgcgccaattctgctcaatttgccgaatgtcagcagtgatttttgggtaaagttcgctgaattattcgtttttttttaaatttttattacaaaatcctccatttttgtgtgtgtaccggtagaatttgtgctggaactccaacgcgtcctccccgttcttcggctgtctccacgactgagaaattgcgcgtgtcgcctggtccttggagcaaaagaagtacttcttcctggtgaagtgagggagagggaagaagatttaaatgtgaaaatttgaaaacattttggcaaacagaaaaaaatataaatttacaaataatgttaaaaaccanataataaactaactatttttagcat

SEQ ID NO: 10564 - DNA, 4142 bp, Heterodera glycines
tattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccatctgatggtggtgcccaattagaggtaaacggcttaatatacgacaactcacatgtcgtgccgtataatccttatattctgctgcgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctaaggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccacagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccatggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgatgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttatatatacgttagaatgataaggagtttcgtttcaaaaactaatttgagaagaacgggaatagctggggggctgaaattttgcacacaggggtaactcgagacggcgcattcgggaaaaatacggattttttggtccggtggccaactgagtcccagcggctcgaaaactgactttgccgccagtctcagtgttacgaaattttttgcttttgctttcagagcttagcggaccccaaaagcgaaatgccccaactatggcctacaactttgccagcaaaaaatttttgatcagatcaaaggcctgacctgtaggttaggcaacgtaagaatcactttttttggacacttcagtaccaggcgaatagctcgtaagggtttgctcggagcagggggtcgccagcggacttattgtagagcttcgaaagctcgattttttgaaatttaaaaatttcaaaaattttgaaaatttttcgagctaggcctaaaattcggtttttcggtttttgaattttatgattttttaacgatttttccagggaaaacggagaccacttccaaaacatcgtttttcgagctctatcgattagtgatgtttttagaaaattttcgattttttccag

SEQ ID NO: 10565 - DNA, 1129 bp, Heterodera glycines
tgcgttgcaaagtgaggagcacaaaatttggcacttggcattttgccattgtaattttggcactttgccattgcaattttggcattttgcctttgccattccaatcttggcattttgtgtgttttcacatttttaaatttattttatttattattcaaccaattttaagggggttttaaaatttcaaaaaccagtaaagaaattttttaaatttcaattttaaaatttcttaaatcttcacacacccacgggaaaatttcttgccgattttaaaggattttcttgaaaataatgacaacaaattttttctttcctttcattttatttaattttgcagggcctttaccgaacgtgcggcgtgaagagcaaagtggaatggatctgtgtacaatttgaacaggtcagtggggcttttcatttttaaaataatttaaatgtttatatgaattaaaatttttcattttttttttgccttttaatataaaattccaaaatttcagatcccttcttccgatgttgacattgacttgtccgatgtgcacccaatgaacattgcatcagtagtcaaattgtacacttttttattttcaattacctaattcaaataaattttaaaaattgaaattaaaaaattaaaataaatatatataatatataatattttttaaaataattttctgatcaagcccgtaatcaaagctgggaaaaggcggaatatcctccctcgtgaatgaagattaatttaaatttttttaaggaattaggtgctttttgatgccattttcttaataaattcccttaaaaagcggctgtggcaccgccggatgataaaatctcattttttttttttgaaaaatttgacataaaattcacaaaattggtcatttatttttgtagaaatctgttaaagaatactagctttttcgcctatagtctataatttttgaataattacagaggaaaattttttagaaatcgaaaaaacgaaaaaatctttgggtcccccccccccttcgaatccatttcgattttggtcccgacaacaaatctcgttcgatcacttggcaattttgccaaacaaacccaacaaaacatccaccaaattctacaggtatttgcgccgtctgcc

SEQ ID NO: 10566 - DNA, 3799 bp, Heterodera glycines
  misc_feature (3792)..(3793): n is a, c, g, or t
ggtcgacgaggcattcacaacactcaaattcctgggtcatgcacccgcacggagtgtcttggtcagtttttttgaaaaatttaaatatcgaaaataatttgaaattacgataattaggaaattgaaaaaatttcgggaaatcaataaaaattcgaaaaaataatatttaaccaataaaattcccattcaacttaaaagttcctacattaaataccttatttaaatgaaaacagttttgaaaattcaccaaaatattatgatttaattttgaaaaaacatttcaatattaagaatgcaaaaaattttgatgcattaatttttagtttgaaaaaaaatgtgtttaataatatttttcaaaaaactgaaaaattcaaaccattttaattaagggttaattataatttaaaaattttaattcgaagaagaagtcaattttgggaaaattctcagaaatattaatttaaaaattccaattgaatttgaaaattatcattattttttaaaaataaataattaaggtatttactgttttaattaaatatttaatttaccaggttcgaggcagacaatttaatgtccgtgtccaacttggccgctgtgatcgctccctcgctgatgtggccgtccaattatggcacccattcggcagcaattagtgacgcccatcggcaatcgaaagccgtggaaatgctcacacgacatgcacatgtgagtgggtggggataaaatagcgaccaaaaagccgccgatgaatgatcagaaaaaagttttactgatcaaataaggtttgggaaacccaaaaattgatcatttagaggcgccatttatgatcaatgtgatcactgacaagcaaaaaatcagaagaaattaattattgggttgctaaagagtaattttacggaaaaaatgtgatcagctctataaattgatcatcaaaaagagttccgagccattttttgatcatcataaccaaaaagtattaatttatttgtttttagagaatcatagaggttgaccaaagagtgaccagaccctttattgatcaattttcaagcaaggtgatcagaggaccttgttggtctgagaacaataattgttcatcaaacactctgtgatcagtttgatgtttgcctttttcagtcccgctgggtgccattgcacttggccaatttctgcaacttttgcattgtttcaattagcagaaaattggcgtagtacaaaggttcccattagggagataaaaatggcgagaaattgccattattcatttttggaataagctggattatggggagaaaaattgcttgggaatcaatggaaaaatttcaaatgattgcttctgacttcaaaatgggtgaatttttatcccctccggcgatgggggggcacaaaaaagtgggcggtgtcgcccgggggcacttcttctgagacgacgggataaaacctgtgaaatgaatggaattggtgcaaaatgttgggtttttttgcaatcgcaggtgtcagaaatgaatgggggaaaagaggggacaaattagcgacgcgaacgaataaattttgtgcttttcaccgccaattgtgagagcaaattgaaaaaatggtgatgaaatgaacacggctttcattggctttctgttttgttagccaattgaatcgtttttttttcatcaaaaattcaaaacatttttccaccattgtgccattttatgaaaaatgtcactgatctttggcttaagagatcggttgggtcggtgacaagttgtggtaacacttttgtggttttgaatttttgatcacagatacagaaaatttcaaaaaaaaaaattaaaatttcccataaaaattttgaaattttgtatggtcatatccaggggaaacggaaaagggggggcacgacgtgtccccccccccccccttaaaattaaaaatttttgcaaaatttgtccgaaaaatggctaaatttggcgaaaatgcctaaaaattccctattttttccaacgacttacaaaatttttttttttaatttattggaaaaaaattttgggccaaaagaaaaaaagagtcttcgtgtgcccctcctgaaatttttttctggatatgggcctgaatttcatttcgcgagggatggtgatttctgaccatgaaatggaatgttttcttttcttccatggcctatccatcccgatagcccgattagagtcaacagattatgttaatatcgactcttactgatccgaatcttttgggcattcctggtcctggtccaaaatttcagcattttaccgatggtgatccgctttttggtcacacaagtcttgattagagttatggcataatcctcccaactattcccacgatcccgacatatttgaacaaacaatccccacttccaatcgaaaaatatcatctggtcaatcactgatctcatctaatgcttccccttatggtacaggaggtgtttgacgtgaacttcgcgctcgattggcgcacctttttcgacacgcatccaaacgtgccggagccgacgaatgagcacagcagcgttggtgccatcgaccgaggtatcagcggcactcctcgtcccgagttctgcagcgacagcgtcgacggcgataacaagccgcgtcgccaggacgccggcgacagtcgtcatgccatcgtcggcgaccagcggcgcggtgccggaacgctcgctgcagttgatttgtcggcggaagacattgacgatgaactggtcgaagatgatgatgacgacgagaacgaagaggtggatgaactgctcgaggatgatgacgatgacgaggaagaagaggaggaggaactgatcatgacgtccgctgctgatcatcgccaccggcacggaggacagccgcagctgtcgggcggcggaattgccaaaaacggtgctggtgaaggagcggcacaaatgccatcgccggcggtggacgagaagaaacaacaccaccacttccactcggtgtttgacaagcgattgctggttgatagctactgtaagtggagagaaaaagcatgattgagattactgtattgggtatggtccaagccaaagaagtagtcatagccttgacttcgggagggggggggggaattaaaaaattcaatttttaggagtgtatttttctttttttagaaatcctgaattaggaggtgtgcttaacaggaatttgtagccgttttttgccaaaaaatgactattttttgtcattttgtccccgtttttcaaaaatatggtaaaataggggttcggtggtgcctttaggcgccgctgggaaaattttggaaaatttttaaataaatttgttgagcaatggcttaacattttttaaaaatttgccagggggggggttacccctccccagtggctatgcccttggtcggtcgcttaaaagattgacgggttttgtgaattttaaaatttcaatggcaaattaattatttcattaacattaattgtattaaaagctatttgcttgctgtgtttagcaagctctgagctggaatgcggttcgtcggcagcaacacaccaccagcaactgttcagagcgttgcaacatcccgcgcagcaacaacaacaacaacaacaacaaccgtataatcagcacagcaatggcacaacaaatgccaacaacgggcgactgaccggcattggcacgatcaacggcggtagaccgcccgctccgccgacgacagtgccaagtgcgccccaatcgccgctgctgatcagttcggcacggtaatcttttgcaatttgtggcttttttgattctcggaccnntgcagg

SEQ ID NO: 10567 - DNA, 2646 bp, Heterodera glycines
  misc_feature (13)..(14): n is a, c, g, or t
  misc_feature (22)..(22): n is a, c, g, or t
ttacatatttatnnataatttntaatatattttttgtttatttgcttttaaaatatttccattcttctattatttttaaatttatcacagtaaaacgatgactctcataatgcgtcaactgttcgcctccttgttcttccttttgcttctcattttgctcatcactttttccgatgctcaattatttggcggatggggtcataataaaatttagaattatacctaattaattacaatatttttaacaatttacaaataatataaataaaatttaaataacaaatatttattgtcaggatggaactcccccatttacatgcctggcgtttactgtttacatgccaaagtgtgcgggtaaaagaacaaaaacaaatagaccaatgatggcagaatgaccaaaaaataatttatccatttttcaattttcaatttttaaatctaaagatattttcaaaatgaatttcatttattttacaattaaaataatttatacataacgcttatcagtggaaaacccttacataaatccccaataatttacgtgatggatttagtaaaatgtttcattgatgtatcgtaagctaaaagtcttcctccttcaaaaacgaataaacaaattcaaaatgcgcctgcctctaaagatacaaatcaaaagctttttgatgcaaaatcttaaccattggaccctccaaataaactcaataatttttcaatttttcaaactttggactaaaacgtccagccctggttctaaagtaatttacattgtacaaaaacttgcagaggaccgttttttctccttaacattgacgcacgatgaaagaatttattttcgtataaacaaaactaatcacaaaaatagtttctttgttctcagctgggatattcattctttggctgaaagtgcgtcgttggaaatgggccacatttctttcaaatccaaagagcgcttagtcagaagaatggcaatggtggaagccgttcaaaaggctcggggagaaattcgagtggaatttgtcttggtgcttgtccattttgtcgatcacgaattatgcttcgacagattgggcaattgttgtttttatcaagccttaatcacagctaatggatcatattttattaagattttgtataatgaaaaaataataaaatttaaagcttcatatttaattttttaattcgagtttatctatttattttttgatgtttcattgaatgtgcaagtgcattggttgtacaaatatttaattttgagtgacttttacgcaagaatttggttttataatttttaattctacccataattaccatttgtccaagcattgcttatgaaatacatgctaaaaaattgggatttgttttcttttgtatgccaatctgtgcttaacttacgccacattttattggctcattcttttgattttgccgcccgtcgctttcctcaaactcatcaagacaaattggacaatttttctccaatgaatgactcacaccgccttcgttttggtttgactgtgaagcattttgatgatgcttttcattgcttggactttcgtttttgcttctttcatttggtggtgaacctttaaataatcatttataaaaaaatttattaagaaaaaaaattagaaaatatgggggccgattcaattttagtccttgttttcaaaaaatttgcaacaaaatagtagaaatttcaaaatttaaaattaacaaaaaatatctggcacatataaaaaaaattaaaaatgcttgatcaactattttttaatacttatatccatcccacatacattgactttgcaccgtgattattaatgcaaaaatgactacaattgaatgcattttacgatttgactgtttgggaatttatgaaaatgtcaactagttttatatattttatttttattattgataaattcgaagtattcttctggaaattaaaggagacatttattgattttttgtgtggattttttgtttattgcgtttaaatgaaaaaatatatttagatataatattatgcataattcataaatttttagtaattaaaatacctaaatggtaatacagacattccatcactaagccaaaaacggacatttcgccaactagtcgaaaatagtcgtacgcggtaatctgtacagcttaaagtctaaaagagaaagattgtatgggtaaggaaaaatgagttgtgaagtaaatgaaagcaatgagaaggattataatccagcagatttatcatttgcttatttatgtgcatattttattctgaaactcgaacaaaacgaagacattttgctgaaggttgagagggtagccaaagaacaatggatggaagcaagcttgtatccagcaaacaaaaaaaaaagccgagccaaagtccaggcggaagaggacgaaaaacgatggggaaagagaacggatgaggcgaaaaaagcactagaggataaaatggccgagattttggccaaagcgaaagaagaggacgagagagtggcgaaagagaaagaagagacgacaaagaaggcgaacgagcgagcagttgtgtacccggggagggaatgcccggatcgccgctcggtcgattgactattgccgaggatgaggaggatgatggcgtctccctggcgtcttctgaggagg

SEQ ID NO: 10568 - DNA, 2147 bp, Heterodera glycines
  misc_feature (148)..(148): n is a, c, g, or t
ggggaagggacggacgagcccggtgaagcgaagccccgcaggagtgagagactcctgcgggggaagaccgacgctgggcggacgacgacgcagacgctgacaaatgagcagcagaagggggaggggaaaaccgtcccgatcaaatccnccggactcttttcacaaatatatatttattaagcagcagcagaaatgaatgaatggaaatgtggaagtgagcatatgtgagagaaaaatggtgccctttttataggccgaaaaatgcgagggggcggggcccagaggaaaaaacttaattggactatcactaggaaattcgtgggaaaaaatggctggcgatcgataagatctgtcgccgttggcgacaacttttatctttttaaaatgtttttgatataagattagagttgctacctttagaaattatcgtgtcggggatcggaaatcgatttgggaatagtcaaaagtttatttgatcaaagaaacattcttttttattaattagtagagtcaaacagctcgagcagagccggaccctgtagagctgttttaaagtgcgcgacaacccggcccagtgaaatagtcatttgtaggcgtgggctttggacaaattttttcaaaaaagttgacccgctgttcaaaaaatttatttgcttgttttaaacccttttaatttacatattttatataatttttaatatatttttttgttaatttgcttttaaaatatttccattcttctattatttttaaatttatcacagtaaaacgatgactctcataatgcgtcaactgttcgcctccttgttcttccttttgcttctcattttgctcatcactttttccgatgctcaattatttggcggatggggtcataataaaatttagaattatacctaattaattacaatatttttaacaatttacaaataatataaataaaatttaaataacaaatatttattgtcaggatggaactcccccatttacatgcctggcgtttactgtttacatgccaaagtgtgcgagtaaaagaacaaaaataaatagaccaatgatggcagaatgaccaaaaaataatttatccatttttcaattttcaatttttaaatctaaagatattttcaaaatgaatttcatttattttacaattaaaataatttatacataacgcttatcagtggaaaacccttacataaatccccaataatttacgtgatggatttagtaaaatgtttcattgatgtatcgtaagctaaaagtcatcctccttcaaaaacgaataaacaaattcaaaatgcgcctgcctctaaagatacaaatcaaaagctttttgatgcaaaatcttaaccattggaccctccaaataaactcaataatttttcaaactttggactaaaacgtccagccctggttctaaagtaatttacattgtacaaaaacttgcagaggaccgttttttctccttaacattgacgcacgatgaaagaatttattttcgtataaacaaaactaatcacaaaaatagtttctttgttctcagctgggatattcattctttggctgaaagtgcgtcgttggaaatgggccacatttctttcaaatccaaagagcgcttagtcagaagaatggcaatggtggaagccgttcaaaaggctcggggagaaattcgagtggaatttgtcttggtgcttgtccattttgtcgatcacgaattatgcttcgacagattgggcaattgttgtttttatcaagccttaatcacagctaatggatcatattttattaagattttgtataatgaaaaaataataaaatttaaagcttcatatttaattttttaattcgagtttatctatttattttttgatgtttcattgaatgtgcaagtgcattggttgtacaaatatttaattttgagtgacttttacgcaagaatttggttttataatttttaattctacccataattaccatttgtccaagcattgcttatgaaatacatgctaaaaaaattgggattttgttttctttttgatgccaatctgtgcttaacttacgccacatttttattggcttctttctttgatttttgcccccccgtcgctttcctcaaattcatcaagaaaaaattggaaaaatttttc

SEQ ID NO: 10569 - DNA, 2103 bp, Heterodera glycines
aggcacaccaaataaaactctgatcactttgatcagaattcaacagtgatcagtcagagtgagtgagtgagtgaatgccactgatcgatcagcagaatctctctctctatctctctctctctacccccccccccccacgtaccatccatcaatgatggtggtgcggatgcagcagatggtcggcactgttgtgccgccgccgatgatgacatcatgttgttggaaaaccatgatgaggcagatgatgatgccgaagatgagggtggcatgccaaaatgggcgccgccgttcaacaggcaaccgttgccgttgctgtactgctcgtcctcgacgaagttgttgttgttgttgttgttacagtcgtcgtcaaatgggtcccggatgaccagtcgatgtctgctcaatgaccgtacaccgctgcagccgccgccaccgttttgttgttggtactgtaattggaggtgttgttgttctacaggcccaattgtgccggcggccgagtccgatgaagtggagggcgtatttgagggaaaattgccggccccgatggtgccggtggtgcaattgttgtgatgatgcagcacgggtgtggctgacggtgagccgaacccgaaatagggctgtaaaaaaaagcgaaaatttttagtcgaaataaaattttgggcattttctttccgatcagggtccccggatcaccgacaattttacgctccctgaccccaattgatccccgagaatttctaccccgaggggttggagcttaaccctaatggaagcaattatggaatgccgacccccaacattttatctggaaaattttggtgccgaactcaagaaatctcagatagccaaaaatgaaaatgaattatattttttttttgaaattttatttattttttcattctttcaagttttagtaaaaaaaaatatttacatattattatttaatttcaaattttagttgaacaaaaatttgtaggcaaaaaaatttttttgaaaagccttcagaaaatcttttcatttatttaaattaaatcaataatttactttaaaaaaaggaaaaaatttacttaattaaagtagaaatttatttaataaaaaatagaattctatttaatagagtagaaatttatttaataaattaatataataatttactttaaataattaaagtagaaatttacccaacctccattattcaaaaattttcattttccatctgtttttttcaattaaaatgaaatttttaaaaaaatgaatatagataaaaatataatatttcaacaaattttttgtcaaaaaaaaggttcaaaaaaatataaacaaaattatggtcattgatccgatcataatcaaaaataaacaaacaaccaaccataaaaggcaatgtaaaattagttgtaaaaatccaaaaatttacgagaatgaatgaatgaataacaaacaatgaatggaaatgactgctgacatgacgaaaaattgtgaacgaatttgaaggttaaaaaaatataaaattgggcattaaaagttatttttaaaaatattttaatttaattataaattgtataaatttatacagagaaaaatttctttgaattttcttttttttatcaaaataatatttattttattggttaaattaatgttataaataaatatgtttttttaaaaaatatacatatatttctgatctaagtaataattttaaataaagttttttttaatatattaaaaataataattaaaaataaattttaataaattgaaaattaatatgatttaaattccttcttaattcggttaaataattttaacataataaaataattaaaaaataataatagtaaattttaattgttaaaatatcaattaaaaataaatataaattaaatttattgtatttaaatttctattttaatcgaattaaaaataatcaacctttctaatttcatcgagttcaaaaattttttcctataataccaaaacaatttccaattttatgcatttttaaattgaatttttgttgttttttttgtttctccactaattttctcacagcttgaccaaaaatcgcaaactctcgcctcatttcccatcacatac

SEQ ID NO: 10570 - DNA, 3556 bp, Heterodera glycines
  misc_feature (18)..(18): n is a, c, g, or t
atacaaatggcttaattntgtgtgaccaaaagcagcagcaagcagcaaacacggagcaaaaataattggaaaattataataattttgattttttgatttaaaaataaatataattaatttaaataaattattctgagagagaaattggaatggaaataaaaataattttaatttaatacaaatacttttcgaatattaattacaagtaaaattttgaaaaagtaaatttgtaaaatgagaaataaattaaaaaatgatgaaaattaaaagtgaagaaaaaatgaaaatataattaaaaaagaacaaaattaagaaaaagaaaaaataaattaattaaattttaattgtaagccttaaatttgtttattgggaaaatttgaaaaatatgactcattaaaaaataaaattcttaaaaatttcataatttcaaaaaaatgcaatttttacgtctccgtccatgacacagacaaaaaaaaaagtgacgacgggaaaagggatttataataagccatccgtcccaatgtttcttaatacgattttgtaaaaagtcgtccctcccggaacgccctttgaaagcattcaaggaattttatcatttttcatttgggaggggggggggagattaattataatgggacgatttttttttaaaatacgattattgaaagtgacctaattaattaattagtcatcaattagtctattaatgagtttgagaggtaattttaatgcttaaaaaagccaattataattttgatttgcatttttatacaaatgtccaaaaaaggtttaattttattagcatgccaacgagcataatcaacaaatagatcatttcattttctctgctgacttgttaaaaacctaattaaatgctggctaacggagacttaaattataacgaattaaatggtttctaataaaatcgccaggctcggcaccccattttcccgcatggcattagcctgatcagtctccgcttactcaattaaagcctaattaaatgatggctaattaggcaataagtcgccagggtcggcacctatcatttttccgcgtagtattttggctggcttgtcccccacccccacctccactttgccgtccaacgacgtgttggtcaggttggccaacgcgatgccgttcaagtcctccgggaagtcgtcggctggtgccgcttctgctggcatcatcatctgctgctgctgcagctgatgatgcccgccggcgccggtcggcatttttgccgcgttgttccccgcggcgccgccttcctcaaacggtgtggcgccaccgccgacgcccaactgttgctgctgatggtggtgatgggtgtggtggtgttgctgctgcagcggcgggaagcaggacgttggaccatcaagccccatgcaatttgtatacagtttggtgttgacgttggtggccgatggatgtggacgacggcgacgaggtcgacgacaaatgcgcgaaaattggcggcaaaattttgatgcgagttattaattattattattgtacaaattgtttaataatttttgtttggtctgttggaacaatgggagaatgagcatttgatcatcaaaaaattaattatacgcaattattttaatgagtaattaattattaattgtatatgaaattagggtgccttcccagacaatttcgggatttttcgaggacacccaatgattgggtttcgatggattttgaatcggttatacgtggcatttgcgcccccggaccttgctcccatatggttaaaacaaatttaaaataacttttttttttgattttaatttaaatagaattgataaaattaaaaaaagacaaatatcccaagatcaattttttggaaaatgtttcaaaaattctctaaaaattgaaattacggctttatcaacaacacccatatcagtttttccgcatgtattgtttttatgctttttaaaattgaaaaaaaaaacaaatttgatgggcagaaatctcggcatcattcacgtgttgaatttttttttcgaaaaacattaaaaaatggggtctctgttttgctagatggcctagggcagggattacggatggattaacaggaggactcccgctcttggtacgtttttccaaaatgtatttattaatgcatattataaaatttaggatgatcctgatttatcatcccctctggtccttattgttcataatgccagaattagacggcaaaaaaaataaaaagaaaatttttttaagaggcctaaaaagccggggattatattaatttaagggcaggcaaagtgactttataaattataattgaagaagtaaaatgaactgaactgaacgaacgccaaaaccaatacataatatgtaaatggacatgcataaatcaattttaataaataaaataaaataattaagggaatggttgggggaaatcgatttgatatgtgaaatattaatatgctaattgatttattaacattgtttattaagtaccaataaaccaattggtgatggatttcgtcccaccccccccccccggttcctccataaaaaaataatgaaaatacataacggaagcaattgaaaaaaagatgattggaaaattcattaaaaaataattttattggattaaactaaaccatacacacacataatagtgcaaaatggattattataatttttattagagattgacattttgaacaaaaagcctggattttctggacaaaaatagaggaaatccaggcacagtaaaaaaaaaaaacagattgctgaaaaatggcttagagctggatctaggaaaaattcaggtctggggattcaggtccaggcccaggttgaactataattacttattagtattattatcatgaatcggataaaccattgccagcgattaggtgaaatttaaacatttgttaatccaattagtattgttagtataaagccggaagcattcattcatttccaacaacaatttgcactcccaattttcttttcttttttttgcgcgcgctcgcgcgacgatggcggacatttttatttgggatttttgcggtaaatacaatacatatactgattgataagaaacaaaaatgaacaaaaaaaaaaaaaaattccggatctctcttccacccaaaaaccacggcgctgtgctgatcagccaaaataaatgaatgtgagaggaatgatcgatcgatcagcattcagtcagttaaccccgggggtgtgtgcgcggatccgtcggacggattgcgtccgttcgcgcagcactgacaacacggaggataagtgcgttagtgccagcgcccgccgcgcggagggatgccaaccgctccccctcccccgctcaaacaatgatcggcgcgtgtaagtaaaagcgcaacagggagagaaagggtaaggggaggggggagggggggggggggatttgattataaagataatggtgatgatgatgatggtggtgttggatggattgtgtttgatgggtgagggaggagggagggatatgtgtgtgtgtatttgtgtgatgggtgggggaggggaggcggggaaa

SEQ ID NO: 10571 - DNA, 2897 bp, Heterodera glycines
tacgaatcctacaaaaaatatagtacttttaaaaatatttttgccacaacttttccgttacatggcaacaaaatgccaaacattaggtgccactgggcccatttaaataattcccttggggcacatttttccattttgccacctccgatgcctaaaaatgccaagcgaggcggcaccatttgcaatcgccaaaacggcaaaaatacgacaaaatgaagaaagtgttttatttaaattttatatttttaaaataataaaataaaattgagaaattaaaatttaaaattaagtttgtttttaaatatttcatatatatgaagattttctaaattcattcattgtttgttcttttggtgagcaattattcatatttaaattttttcattttaaattaattttcgaattctttaaatttatttttttcgcttttttatatttaaaatccaaatcgttgaaatttgttcctctttttggaagaaagattcactattcctgatattatgcataaaacaattaaagcatttttaaatgcaaaaacattatttttttaaaatatttttaatataagttttattaaaataattaatgttaaattaatattcattagtggattcttctttctaacaaaattcccaatttaattaaaggcaaccaaaagcattctacatcagcatcactactgaatcattcagcatcaacaaccgaattgatttccaataaaacaaattcaacattagggggtaaaaaaaatgtttaaaaaaaatcgtaaaaatattttgagatgaaaaatccgcaaaattggcttcatttttctatgcaaactcctcaacgcaaagcttaagcgagctgagcacttccaccacacttttgtatcggtctggtgagaaaaaaaggggtaagttttttttgttttgttttatggcttaaatttatttaaaatttttgaaaattttttacattttttttttttgcaaattttgatcacgcataaaacgtctaaatgtgaccggaagctcatcaaattttactgggatatttgcaacacacaaaaatttttatttcctgtaatttgctgtgtttattaatttaaatatttttaattttctacatttttaatatttttttttttttgcaaatttagaccactcataaaaatcctaaaaatgatcagaaactcaccaatttttagggcacaaagattttaacgcctatttttcctaaattttaatttttgtacatttttcggcatttactatttttaaagcaagagagaaggtacgagaattgttttgaaaatttttacttatatttttggcattttatcctaaattaactattcttaattaaatgaattaatatttgttttaacataaaatgtcttttcaaatttttattttatttcttcatcaggtgcccgcaatttttctgtcgacgttttgcccgcattgaagaagcaagcaagcggaggtggcactgctgctggtggtggtggtgccacgaacacagcacttgtgccaacaaaatcccaagccgcaacaaattcagggcgttcatgcactgtgtactgcaatcagaatttttgaaaaaagaaaaactggactagtcaaggactaggcctattcggtttaatttttagccgtttttcaaaaaaatggcgtcctacggtattaataggcttcgtctggctctattaattaacagattgtagaccaaaaaattgccaattttacgtatttttggatcacatggcgagcccaaatcagggaaaattcctggcatgaatcctcaaaaccgggcaaatgcagacccaaaattcggcaaatgcctggcacgcgcccaaaaatccggcaaaatgcctggcacggacaaacaaatccggcaaaatgcctgacacgggccaacaaatccggcaaaatgcctggcacggcccaaaaatccggcaaaatgcctggcacggacaaacaaatccggcaaaatgcctgacacgggccaacaaatccggcaaaatgcctggcacggcccaacaaaacccggccaaatgcctggatttccatgtaaaatcgtatccccgaatagaacccaccaaatgagtatttattttcataatttattacattcaatctctgttcaatagactattaattaataaattaaaaattaatgtctcattgtataattatacctgacttattgtgtcagatattatgatgcacttgcggaacagttgctggaagatagcagcagttgtcatccggaaccacaattggatgtgagggtgaaattttgcaaaattttatggaaaattgaaaattatttcacaaattataaaaaataaaaattattttttaattttaaatgaaaattaattttcagaacgatggtggtaccaaatgtgtgctgaatcctgtcttttgtactgacgaagaggagggcggcaacacgaaggtaattaacggcgcaaattaatacaaattagatatttaataagggccggacggacccgtatacatattcttacggacccgtggcacataacccgtacaaatgatggcattattttcttattttgggaacggcctaaattttggcattcaaaaagatttgaaaattaattttttcaaacattgcaacatttgatgaatattatttgcattcataattagatattaggatttaattgatttaaatatatttttctcctaaattctccatgatctaaatggtaggacgaccctttcttttttgtgtttgcgaacaaaatttgcatttttatttacatattgtttttgggttattttacatatttttgactttttcgcactttgtcagacatattttgcatttttaaaggatttttaaggagttttttttaatgtccaagataaaacccaaaattt

SEQ ID NO: 10572 - DNA, 2036 bp, Heterodera glycines
cgtaaatttttttagtatgtaatggaaattccaaagcattcacatttaagtaattaggtaaattaaattttctattttcaaaatttttatttatttttattagagcaaatttttctgctttttttttgcacataatttgcgtcctggtaacggtaactccttattaacccaaagtgctttgattaatggtaaaataattttagttaattatttcttagatttttacgagtcaaacggaaggggcaaatggcgaacatttcactgatcaaaggacagaaattaattgttcacaaggacgactgatcaaggacaacaagaaggataccacagagtctgcggacacagaaaaagtaaaaaaaatatttaattaatcttttttaaatataaaaaattcattttatttgagtatatatatatatgtataatcgcgaaggggcaaatctcgattctcgatagaaaaaatcattctcgacttttcttgagcaagtcttatcaaagttttaataagtctcactctctattctcgagatcaagtctcagtccggttctcccgtgagcaaatctcggtttcgagtttcgtgttcaagtcaagtcatgagtcgtacggctcaacttttgtctcttcaggcttagctgatcatgaatatattatttggaagggttgactctaattgaaattatttttaatttttccgaccgtcaacaagtctcacactcgattcttgagattaagtcttagtctctgttatagagcaagtctccagccccacacgtcaagtctcggtctaaaatctcggagtaaagtctttattctcgaagttaaatctaattctcgatcatgaggtcaaatctcgagtcccactggccaagtttttgcctctttaggctgctgatcattagggctgggatttttaattttttaactattttttctgcggctttatttagacgagtaatgcacgaaaaacacaattttcgctcggaaattcttcgttttaacgccactattcatcactaggaatcactatttggagcttcgccactaaaaaaaaaacaattttgaaagttgtctactaaaataattttttgccactattttggcattttgtcactatttttgccactattttggcatttttttggaaaatttcctaaaaaatccaataaaaacgaaaaatacacccctaagaatcgacctaaaagattcaaaaaatacacccctaagaatcgaccaaaaaattttaaaaatacacccctaagaattggaaaattttctcaaaaattctttcccaaaattttttttcttgctcaatatttgctaagaaaatattggaaaggacatttgtaactgcaatcagtgaataaaattgtttgccttaattttaaattaggtattttcaaattaaaaacagctatttaaaaaattacaccccctaaatttggaactttttcgccacttttttatcactattttgccatttttttgtcactatttattaattattttggggttttttgccactaaaaatcccagccctactgatcatcaatataaattttcggccaatttgtgattttttttttcaaaaatttgttttctaaaccaaaaggttcaccatttgaaaaaggggtaacctcaacctcccaggccgggcaccataattttatataattggaagggttgattgaccctaattggaaattatttttgaattttccgaccgtccgccccaaaacggcgccaaatttgacagggagcggtcggtgccttcctttcccatgccctccgtccccgccctccaaaattccatcgtcgggcgacggatcgtcggccttctcaccgcaaaatggcgaccacttttgtctccgcaccgctctcccatttataaaacataaatttataattaatggggggggggaagggagaaattttgacatttttttgcatttacagccaccgggagaaataatttttccatttttagaaaatttattgaatggtttaagaagaaatttttgtattttaaattggaaca

SEQ ID NO: 10573 - DNA, 3020 bp, Heterodera glycines
gggacagcacgggcaaagtgacggtgccacaggcggaggacggaccttttgatgagacgacgacggtgggcacaacagaaacagcggaagaaggagaagcgatgggagtgaagagagtgccggacggagggacgacggaggggggcaaagaaatgccaacggcggaggggggcgaagaaatgccaacggcggaggggggcaaagaaatgccaacggcggaggggggcaaagaaatgccaacggcggaggggggcgaagtccgcttctgctggaaagaggggcactaaatcataaacaacggaacactaatgaaaataattaatagtgttgctcgagagtctttggttcgactccgaatttttgtctcggtctcgagcagctcgaaaatcagtcaattgaaacggcacagtgcctccgcttccgttggcgtcgcttttctcatcgcttttctccccgtcgtttcgcacatttcctccgccatttgtcttttgtttgtcgtccgttttctgcgctggatgccgccagcgactgttgcgccattccctcccattgtgccgttttcgtttgcctttgtacgtgccgacgacagcgacaaatccaacggctccgtcttgaattggtcgtcgtcgccgtctacgaattggtcaacagaagcggagaactgttgctcccttttgggatgaatgacggaaacacttaaaaaaataaaatttaattttaattacgcaattagtgccaattaccgaccattccatggagggaatggtggcgttgagttgcgactgctgaagtaattgatggtgctgaacattttgtgccgttgtcgtcgttggatggaccagcgatgaccgaaaagcgagcggcaattggaattggtagtgattatcgtccgcgtcgtccaactgatgcggcggattgcctccgctggtggtgccattgtcctccgtcggcagccgaccgatgccaatgtgttttggcactgtgccgccaccgctgtgtcgcccgttctgtttttgctgcggatgactcaccgccattgtttggtcgatgagcagcggacggacagcgaattgcttttgcatttcgggatgaattgcgatgggaatcaccgtttggggcatgccgagaagctgaaagagggaggaggggaattggacatggaaatttaaatgccaatgaatgttttttgatcatttcttttgcttcccacttgaatgtgctgctcatcggccaatgagtggaaagcgactggcagcagaacaacatttggagagagaaagttgtgcaatgaatccacttaaaaaaacaaattcttttattatttattatttaattgcttttttcagtgtaatattttagtatttttggcatttccgtcgctccgtttttcgctgtcgcaattgcttaattaattgcatttcattttcccacctgttttggcaaacagtgcacttgtccccgttgtcgtgtccattccgccgttcgcattttgttgtacatcgttgatcatttcgagatgatgaccatttttggcacaatttgtgtgcaaattttcacttatgcccattgccgtcatttgctggggttgtgccgccgttccaccggcaaatgttggcattgaattcggtgccgaacagccccacaatgctttgttgtgttgtaaaaagtgcatcaacgaactgagcatggtcggagacactgatgatgcgccattgttttgctgcagcgttatcggtggagtaggcgaaggcatcgccgaattttgggtggaattaaatgccaaaaatggaccaattttatttgagaattttcggcgggtgtgagagaatcgccaattcactcggaatttgcgatacgcatccaaaatgattgggaaatgatcaacattttttgtaatcagttgatgaccaacgacggaggcggcgggttgccctccttatcagcaagtaaacaaaaatggattttgagccaaatttacaattgttttgtgctcattagcgagcgattggggaagaaggccttatcaatttcaatatcagcgcatggaaatttgttcaggcattttatcagcagcaacagaaaagcaataatcataagggaatcgcgggaagagcaaaaggaattggggaaaataaatggacaaacgaaaagtgataaaatgtgataaatattaattaaatgatgatagagagggaggggcgagagcatttagcatcagcagtggtgggagggcgagagatggaaggaaactttgaggggagagtgaaaggaatgataagagatcgggagggggagggggggggggaggggacagccaattccttggcatttgattggtgtgggggaggctggagtctaatggcattttttattatttcgttaattaggggtagtagggccggtccaacaatgaagtatccttgatttaggatttttggggcttttgctgatacccgctgaggaagagaacgcattcgcaccaaaaaagggggctgctctaaaagagggaatgagggcgggagtcgcgaggaaaaataataacatttacttagttaaatttgataaaacccaagtttttctccggcgaaatttgtcgccactatctgatcccaaattttcctaaatttaaaaataaatttagaaattgccaattttgaacttaatttcaaggatttctaatggtattaatgtgagggatgaagaatgactcatccatccaccgtatggacaacgcaacccctcctttgccatagtcattcattcacttcccgcgccattatcgcctgtttttgcccctctctctttggtacttcctccgccctccccttttcccacatgtgcttcttctgttggctgctgatggaaccgcactgattatgaagaagcgtaagcagcaacttcatcacctcctccccccccccaaatcgcagccgcgccggagggtttgacggaacgacgatgacgaagagagagagagagagaggagagacggggaagaggggggggggggaggggagatg

SEQ ID NO: 10574 - DNA, 3724 bp, Heterodera glycines
gggggggggggggggaaagtccattggccaaagcccccggaaaaacgtaaaaaagcacattttcccccggaggggcaaagggaattctcaaaagttagaaacaaaaagcacaaagcgaacgaaaggagattagggatggtatggaatttcgatactttggagtttgaattcctgatatttttgggacagatctgatttggggccttctgactgagtactatgcctgctatatactgctacaacgcagaggactaaattcgactgtctactccgaacagctttgactggccttaacaacaaagattaccgaacatttggacaaacatcgaaaaatgtatttttcatatttctgcaattcgactacagtatgaactgcttatgcccaaattctcattatcttcattgtatttttgttgttgtttaaggaatgaccaatttctggtgcgaaaactggaataaagcaatttataaaccaatagaaatgcatgagcacaataaaaagcatctacaaatctttctgatacccatatctgaattttgtgtagattcatcaatattaagcgaaaaaactcattaaagcagacaaaacaaaaaaatgtttgcttaggggaaaacagcttaatgttcgttcttcttaagcttcatgtccaccttcattttcttagtcgccggtttcatgttctcctttctctcatccttcgtcgtgttgcgctgctgtccttcggtggttttccattcgatgtccgctgacgaacgtcgtttctcaccgtcgttgtccaacagaaaatggtcctcacgcaaacgatagccctgaaattgcgtttttttgtgacacacattccaataataatataatgaagggatgtaccatttcgtcgcatttgaacagccactcactggtgaccactttgacagttccccattcacgtgctcgcctgtacttctcgcccgaactcgcagcagcgatcaaatgagtgcaagtggcacgactcatctgcccagtgaaaacaccgccatgcaactcgaccaaacgtccaattttaacacggtcagtgcccatgaaaccggaagcggtgatttgctgtaaaagtcgacaatattaattatcaagatttttgagtgatttctcactgaaaaaacgaatagtaaatgttcgttaaacttacgcatcctgccaataacggagtcttgtggctgttggtcaagccctaaaagtcgatgttgacggatctttttccagaaatgcgaacctttgtttcagtatcgtcgctaagcaagcagttttcgggcatattttccacgtcgttttgcgcatgttccacctccgaaggacctgacaattcctaaaaagcaaaccgttttccttttaagacattcctttccaaacaaaaattcaaaagatggagtttaaaatgcggacctctttatcagccctgggctcacgctcatctgtcacactttcatctttcttctcttcctggtcaagcggttcgatcgcgacagtaaatgtcaggccctaaaagtcgaacgttccgctttagataggccttttccaaaaatgcgaacttttatttcagtctcaggtaaatacttttcgggcacattttccatattctgcgcatgttccacctccgaaggacccgacgattcctaaaagaagaaacaacaatttcgcaaaagacaccataggcaattgcgaacctcctttttcttctcttcctggttaagcggttcgactgcggcagtgcatggcacgtcctaaagtcgaatgtttacgctttagacggtctttttccagaaatgcgaacctttgtttcagtctcgttgctaggcaagtagttttcgggcatattttccacgtcgttttgcgcatgttccacctccgaaggacctgacaattcctaaaaagcaaaccgttttccttttaagacattcctttccaaacaaaaattcaaaagatggagtttaaaatgcggacctctttatcaaccccgggctcacgctcatctgtcacactttcatctttcttctcttcctggtcaagcggttcgatcgcgacagtaaatgtcaggccctaaaagtcgaacgttccgctttagataggccttttccaaaaatgcgaacttttatttcagtctcaggtaaatacttttcgggcacattttccatattctgcgcatgttccacctccgaaggacccgacgattcctaaaagaagaaacaacaatttcgcaaaagacaccataggcaattgcgaacctcctttttcttctcttcctggttaagcggttcgactgcggcagtgcatggcaggtcctaaagtcgaatgtttcctcgtcagaccggccttttccaaaattagtgacaatacttactaaccttaactatcataaaacaagaaagcccaagaaaacaatttaattatcataaaataagaaagcccaagaaaccttttccgacttcagcgcagcaacagacttgaggacagccatatcctgatgcagtgtatcaattcgctcgttgcagaggtctattttctggttgattcctctgagcatttcccggatttcattttgaaagtcaatgttatcgctcattttcttaaagaataaatgtagtaaagtttgcgcgacttgtttatttgtgatgtggatttatacaatttaattagaggaccaatatttatgattgagacgttattacttttctagtttcttgggaccgatttttcaaaaaaccaaattgggaggggggttctcagaggtaattaaaattttcaaaaatggtcccacaggaaaattttatggaatttgaatgaaaatttatttacataattttaaattatttggcattctgttttttgatgcaattcaggccgcgggatgcgcacaaaagccgagttttcggtgcgggtccctctgcggggcggggtttgaacttaaaaatgaacaggaccgggagcccggcaaaatcctaggtcccggctctgtccgggctctagttttgagtaggggattaggatagatatgaaccattttccgtgaacttaattttctttttctttttttagaaaatgttgccaaataaaattgcaaacggctctttgaaatttgttgaggacctaacatttacgagccattgtataattgcggaaattcataggctgtcatttctcgtcccgactgattttgccaatgtttcgtcaagtgcgtttaataaattgctaatcgacttttcttacttcgaaaaccgtgcttcatttgacaaatttactgagggaagcgaggtaataaaaacgaaaatgaattttctttaacgcaaattaaaggaggggcgtcaattggaaagggaattctacgcgcggttttcctcatttttggaaatgtttggacatttaatcgataagttttacgactttttactcgccgtttccgagtgattttcccttcatttgtcaattttaaaaagtacttcctttagtttttcttacatttttcccacatacaaagaccaattttcgcgtttaaaatgcgttgagcaattggaattgttcggtgctcgacttttgcatttgttgggcattattctcctcctcatcgaccaaaaattcccaagtgatttacgcgaacggattttcgttgctttttataggctgaggtaatggagaaattgatttgtttcaaatgaataattggtttggttttaaaggatcgatttccatccg

SEQ ID NO: 10575 - DNA, 1004 bp, Heterodera glycines
ctgtaaagtattttatggtttccagacggagtgttcattatttgtccatgtatctccccatattcttgggccggatattcgactattccctccgtcgcataagaaatcggtcggtggtgttgaaaaggctgacgatgaggctaaattaaatatttaatgttaacaattcttaagtccatgttgcagcaggataaatccctagccaccaaaattctcattcgtcaaatatagcaaaagcgatctaataattagtgactgattgtccaatgcaattgattaatcaaaatgtaaattgcgttaatttcacccagctcgcctggtaatcataaaagtcgtggagaatgccccccaaacgttgtcttgttccgctagcagaaatttggtgctgattgggcatgtgtgggagatgatcagcaccgccagtaaatgaagcatatcgctgtaaatttaacaattaatccacccaatactctcctaatataaaaacccacagcactgatcgggcgcggaattacggcatatcgtgcgattggacgcgccgtttccatattttgttgatttaatgagtttttggttgccgcagtagacgtcaccggacccaaaaagctgcccattggcccgccgtcatcattagatgcgactccactcaaattagcacgggtggcacgaataacaatggattcagccggagttttgctatttgaatcaaatttggcatatagaaatttaagcgtgtaaatgaaaataaaaaatgaatttcaatcataccgtctggcaaactgtttcatttcatgagaaggcatgtagtcatgttgttttggaaagggatgaaaattaagtgttccttgacaataattagtaaattattaaaaagaacaaagaattatgaataccttcaagtatttggtcaacataatcccgaagagccggtgggaggcacgcctaaattaatcagatataaaggaaacatttttgaccaaaaattgatggtcttttaatcaaat

SEQ ID NO: 10576 - DNA, 2896 bp, Heterodera glycines
gttataaattgtatgattttgcatattttttctgcgcatatgctatgaagaaggggctcaaaaataacatttctgcgttaaattttttgatttggtgaaggtttttattgcatataaaagcatattttgggggttttcgagaataaatacagattttgccatttttacatttttaaaacatatttcaatcatttttggcaattttaataagaaaaatgcaataaaaacgaaaaatacacccctaaggatcgacttttttgggaatttcaaaaacatacccttgaaaatcgagaattttgaattttttataagaacttttgaaaacaatagtagaaaaatgtaatttgttttaacatatctttgacaaaaattttacaaattcgaaattgcatttttggcattttttacggttataagccattttgggtaatttttagggcatattttagtgcatatttggatatttttcggagttttagtgcatatttgatggatttttagtgcatattttatgcgcataatttggcatttttagtgcatacaacttataaccctaataataattagtaaaataatttttgtcaattttctaaattgttcagcaattagcggtctgtccgatgctggtcgcctcgcactgcaatttgtctgaacattacaccaatacgttgatgaaccatttgcacaccaaccacggcaacatggcggcgacacttcgttacgccgaattggcacgccaggccgagtcgctgctattcagtacgagactgcagccaaccgaattttatcagcgacgaatttgaaatcatttctaggcaaaatttgaactcgataaaagaacttgaaaaaagtaatttggccaattgttttatgagcagttacttgcattgttgctttaacaattatgaaactggttagaaactcgaaaaataggaaaaattttttgcatttcttactttttttatatctgacaaatttgataggggcggaagtcgttatttaaaaaactagagtagagcgggaccgggaattttgggcaaaaccgggaccttttcgggttgaaaaacagggaatttttggcagggaaacccgggactggactagtcccggtcaaaaccgggacttctgtactcagttgtccgtgttttggtcccggtcccgctctactctagtatttactcttaccttaatgtgtggtacatatgccgggtcaacttcaccacggtccttaaaagttattacattcctatttaaacatttcacaaactcacaattccatatgcaagcccaagtcgtttcaacacctcaatgtcatcgtgaatctcaaaaggtcgatcaaaattgaacaaatactctgatctaaacttgggcttttataaataattcagcatttaattcacttgtccggtgcaactgcacattcgacgttggttttcttgttcgtactcacaataatataaggaaggtaaagaattgtcgaatccaaaggcctgccatttactcgttcattttctctattgcgctggaccaaagatttgtaagaaactaactaaaaagatcaatttaaatgaaataacggcgctatatggaaagtgggcctttttgaaacaaaaggggggacccttttgttttgcaaattttttttgtgataaaaaaccatgataatttgttatccggggttttaaaggtcgctaatcacgaatctgacatgtattttgactaatttctaatccctaacccgaataaagatcgaaattttgaatttttcaaattatgattttttgttcaaatttagattaggaaatcggaattgatcaaaataattgaaagattcgtgatcggggaccccaaaaaccccagagaataaaacggcggttcaatcacctgaactatcagttcctgaagttgttcggttttttgacggattcgttcctgacgttgtgcctaaagccataaaatttaacaatcgttgaattagctgtggcgtcaaaccttttcttcttcgagccgtcggcactcggccaacgacgaagtgggcaagcccacccaacgaatctctttcttttctttttcaattatgttcatcgccattaaaacattaagcgcatcataaacacgacggcgaatgtttcttgtatcatattgtaatttttcctgaaatttaaatgcattatttcattacgaataatatcaattaaccgggtcagatgggacttcagcaatattgtcaaaatattcattgaccaattcttccgcaacttcgttgtaattagtttgaactttttgcttcactttctcacaaactttttgagcaaaatgacgcaacccgcgcgttttatccgttgaacgatgacgaatttggaaagtgcgcattggatgaatagcggagggcggtgtttgatcaaaacgctgtctttggaaattatgatgcgattgcccttcgtataaatcataatcataacgggcgcgttttacacaaaaaggctgctgttgaaattgttgtgcagttataattgagcgctggtgcgttccaatagcattggacggttggaaacggagttgcgctggcatttcgcttcgttgattcatgaaaacataaagctcaaccttttattttaccctaccaaaaaaaaagaaatttaattttttttaatcacggcgattcaattttgggctccaagtacaattaagtgggttttttcgtcttagtggtctgtgagttagtcaccaaaaggggggtcccttgttttgtttaaaaaagcgattgaaaaatgcagaatttgtttctctatcggtaagcaaaatttggtgtggatttaacgtatagaaaaaaagttagacggagaaaagtaaaagttgattttacattgttaaaaataaagagatagtacgccaa

SEQ ID NO: 10577 - DNA, 1383 bp, Heterodera glycines
aaatgaataaagcgtttgtcaagacagcactgtgctccaaatcgcggaatgcttttctcttcaaacgcctcgtcagccccgtccaaattggttgccgtccaatcaccggcggtggttttggccatccaatgaccaggcaaaagatgcaaatgtacagcccggaaatgagggcagtcaattaccaacaaaagcgcacccacatgcatgtgaggcaatttttaaattgaggggtcacaaaaaatttcaagaaattttggcacttttaaaaatttttcggaggcattttgatatttttgggaaaattacgcacaaattaccaatttgcaatgcaacatttccctgaaaatagacacctacctataactggcattgggggttattaattgaaacaataaacgggaattaaggcattcctagaaatttagacataaagaaaattttaaatttccaaaaaaaaacaaattttgaaatacctgaaaacacacaaaaaacattagagctcggcaaatttttcctcattaaacgcacatttttaggcaattctcaccaagaaaactgttgaagaccgagttatgctcaacttacatttgtttgacaaggtggacaatgacaaattgacgttcgactccgattttttcaaggatcttgggattgattcgcttgactttgttgaggtttacattcatcattttttaattttgaacacagtctggacccctaaaacatgaaattacacaaaaaaaattttggaattttaatttatagcccaaaaccgtgtagagaggaatatttatttatgtatgctattctaatgcatttaattccgaatgtttaaatggtttctaggccataaaacaaatttttgaaaaaaatttgaattttttactcgaatccagtttttgggggtttggaattggcacgaaatgaatgcattttattgctttttttgcagtttatcattgcgattgaggacgaatttgagttcgaaattccggacggtgactcggacagaatgcgaacgccacgagatgtttacaattacatttgcgacaagtgcgatgtgtacgattgaatgtatgacaaatgctgccgtcaaaaaattgttcttttttaaagctaggacataaatttttccgatttccactgaaatttaagtcgaaaggtccgttttttaagattttctcagttttgcccaaggtccattcctctaacaaaatcaaaagttaagtgtaaatgtgtcggataattttttttaatgttttagatggctgctgctcaaaaatttgcgttcccagattcagcgagttcaaaaattagaaaaaaaaacaaatttttataaaggcactcaaatacatggaatgtgaatgatatttgttgtcatct

SEQ ID NO: 10578 - DNA, 1777 bp, Heterodera glycines
cgaggcaccgttgaatatttttgatgaccaacagcataaaccatacaaaaactttaaaaaaaaacaaaaaaattattaagtgaaaaaatggaagcagttcgccccccccccgccccgccgaaaaattcaagaaaaaattttataaaatttccatcgtttttggaaaaatttttagaagaaaagcctagtagttcgtcataaaatttgcgaaaattgctagaaaacgttttaaagaaattttttttgaaaaactctttgccgggaactgtgcacccacaaaaaccccattgactgacccaatgcggcaactgaaagaggattctcaaagtcgaccgactgacaaatgaccctaatgagaagaatgacgacctaaaatgaaagggggaagaattataaaaaacgaaaaaaagaagacaattaccggaatcggcacaaatcccattcgtcggctcacctaaaagagttgtggaaattaaatttacaatatataccacggattttagcagtgtatttacaagcgtcttgatttttcagatttgtttgaattttgagagcagcataaattttttttttttggaaaatattaatttcggtagcaaatcctatcaaatccggattttaattcctatttgttgtactggtgaagaacaaaaaatatggcaaaaatgtagttgaactcacttggtcagagaagtcggaaaatgagtccgtttcatgggttctcagcacatcataagcaatcgtaattgtgtattcttaatttaaaagagggtcgaattttttaaatttagggggaaaaaaaagtaaaaataaaaacaaaccccggtaaacaaatgcactgatctcattgaatttggtgatgaacgcatgcttcaaccaatcaacaatgtgttcggcaaagatgatcatcatctgacaatttatttggggaatttgtaaaaaaaattttttttttaaatactctcccgcgcctcaattttttttattgatgtagaaaaaaaatcacggcaaaaaattattgacaaaaatagaataattcggcgatatttggtaaaaatgtcactgccacatatcccctctatatttaaaagttacacaaaaacataataatattattaccaaatccggtgtcatgtcattcaaatgttccaatttccaattgactgcctaaaatatttcgccgaatcaatttcagagaaaaaaaaaaattttttttttcactttttgcattaaatttttactcatccacaaattttttaaaaattgcttttcttttttttcgtctaatgaattttttggtacgaaaagcagaaaccaccgaccgtcatgttgcgcagcacaacaacaaccaacaaaatgattgagaggaaacgttcgcgcacatcgctgcacgacatttggaacagattgggcttgccgaacttcttgaacacggcccctttcagctccacaaaattgttgctcatcatgatggtgagcagcgattggttgtgcgaattggacgccacattgagggtggtggcctgaaatttgaaaaaaaaaaatgaaaaaccgaaaatataattaaacaaatataattttggaaaaatgtgaatgaatgaatgataaacaaaggagttggcaagtgtattctgctcttatttctataatttgttactgattttaatactcagaattttatttgttggtataaataaaaaaatttcccatgcgtgttgtcttttcttttaaagaagagaatgacgcaaaaaaaaatgtattttttgggtttcaaatc

SEQ ID NO: 10579 - DNA, 2980 bp, Heterodera glycines
  misc_feature (67)..(67): n is a, c, g, or t
tttaaaattaaaaatgcgtaaagaattttccttttgggtcatttgcacgcaaaaaaatgtatttttntgggtgttcaaatcttggatttgagaccaacaaaactttgcaaactccaatgataaatgctgccaaataagttgtgaattcattgacagattctcattcggaaaattcatccgaactggtggattttccagagaaattcgctttttttttttaaatttacggatgatttaccatgattttttaaataattttgactggtaatacaataaatgttcagtcagccccatgtttcgattattataacaaaaaaagaaaaaacctgaagcagaatgaccagcgtgtgacagactgcgtaaatgatggcaacggtcagatggaaaacggttgaaatgaactttttatttgtgccccgttcggaggcagtccaaaggagcgcgtcgaaaatatcctacggagaattaaacaaattaaaaaacacaaaattttttttctcttaaattttgaaaaaaatttccgttatattataagcaaacagcggttaacacgcacgcacctgtccaaaactgctgaacaatttgtcggcaacttcaagctaaatgtaaatagtgtaaaattgggctaatttaaaaaggtaatatttttggaaaggattgggaggagcttttggcttgtaaattttttttggttagtcctaaaaaatcgtcctccagagcttttctgggtcgctgattacaaatttaacatttaacaaattctgaaaaatgtctaaccgaattcgagaaacaaattcggatagttcgagaaatttgaatttttcgatcttttgttcgagttaagtatcggaatttaccagaaggaatggtcaaactcataatcagcgagcggtctcaaaaaagccaggaacaaattgtcacgacttttgacaaaaaaaaattttttttttcccctcttttttggatttttaataaaattttttccgtccattccttgataaaacaataactcaccatgttgtaaaaaatgtacaatttgatgatgccctgaccacgaacaatgtgatagaccacggaagtgtcaacaaattgcatgaaccaagaagcgcaaaaaatgatgattagtttgagaatgtcacaggtgtcggcggccgaccaccgcttcaatcgaactgagcaagcaaacaaattgaactgaaaacacagtggcaattaattaacacattacctatatattctgcagagggattcatccaaaaaaaaatatttataaaatcagaaattttgtattgaagaaaaagtacccattctgctgaaggcttcggtggcaggttgcctgccaagaaatttaaaaaaaaatttcggggagaaatctatccaacggaattttgattctaatatgagaacaccgcataaaaaaagtttaataaaggtcagaaatttttttgaatatttgtttaagatttctcaacaaattgagtaaaagttgcaaaaaaaaaaaatcaaggcggtacccattggcacactaccggccaataaatgcacttgaaaatttcaaaatttgacaaaaaatgcacaattagttatttcttatacaaaaaacgctatttttcgttaatagagccttataatttaaaaaattaaccatggaaaaaattttaggtgccgaaaacacaaatttttcgggatttctcgacgaaatgttttttttccggctaggtacctacctggtttcagggataatgttccagtgtttgaaaaattggccctgacccaataactcaccaatacgcgtattggcagaatggtaaatgtgtggcaaaaggcgtccaaacactgacggaacccgtaataaatgaacttttccagttccactggaattcgaagaaatgcatagactttgcgccgcttctccgcatattgttccttctcattctgaagtgagtagcgccttaaaaatgaggggataagccaaagattggaatttattacaaaaaatgagaatgggaccaggcccgtaaccgaaatgaattttttttttagttagaaaaatttgggtggatgttccagcgcccgaatttgaaaaagtttttaagagaaaaactggcaaactttgaacgataccagcgagtttcttaaaattcggcgccttgattccaaaatataatttcccccagatgtttatttgatccaaaatcggttgacaaataggcaaaaaaaaaaaaaatcagcaaaaaaaatcgtggggtctgacccgccatgaaatccggtttttctggttgcagacctgaatggcacacgtaccttgacacttccatacaaaagtattcgaacactgtcggctttttgcgtgccacattgacaatttcatcactgtccgtgtcagtgttggtcgacgaagaatgcgcaaattggtcggcgtccaattccaatgtgccattttgtccctcgtcgtccaagtgaacgcgctgctgttgaacctgatcatctgaaaagtggcgaattaaattctaaaacaaatgtgattcaaatggggcatgagaaaacctgtcggtcaggccttaattgaggaattggcaagccatgtaaaaaaaaaaaaaaaaaaaaatatatatattgtaaaggtattattattttttttttatacaagagttgtccatttacgtcataaaatcttaccaggcgacgctcgccctctgtttctgatcaaaaattccccgtgaatttcctttactagttaatcatgattcgatttttttttgaatttttcctcatttgttggcacttttatgaatagaaaggccaagaattcctttcacttgcccatactttgttgttgttgttgatgttcctcctcctgttcaggttcgctcagttggtctgcgtctgccacttctccatggccgtctcgtgccccatttgctgcatctcttgcggtgttcgctgtctccctttgctcctccgccgactcttctgaccg

SEQ ID NO: 10580 - DNA, 3278 bp, Heterodera glycines
  misc_feature (28)..(28): n is a, c, g, or t
  misc_feature (76)..(76): n is a, c, g, or t
  misc_feature (103)..(103): n is a, c, g, or t
taatttcaactattaaaaaaaaattacntatacataaattaccaccttttcttaaatatttataaaaatcttttantccacattaaactttctcctcattacnaaaattttttacctttttattttctcaataattccgaagaattgtatacaaaataaaaaatccgggcatatgtaaatataggtaagtccagggctcgcagatctgaggctttagcctttgcttgccgaatgaggcttttgaaaattttcatctgcgagccctgggtaagtcccacaacttttgttcgtacacatgaacaaaaatgttaattttctactattcagaacgcgttgaaccgccaacaaaaaaatgatttcaattacatgaaattagcttccctaatgaccccgccgtattcacatcgccaagctcttccatcttgtgaacaatggaaatttattttgaaaaatgagaaacactaccaacaaaaaatgtatgccaaacataaaaacaaaaaatgatatctgataaaaaaaaaattgtgtcaattttaagcgtatttaactaaggaagtgatttccgcatcaaaatccatctttcggcgtccattaagtccttccaactcgatgatgacaaacacagcctgacaaattggcattttgttagaatcggataaatcccttccaaaaataaaaatttcttttgcctgcgttttggcgttggattggcttatgagttgggaagccgcgttcaaagagccaccggtagctgatgattagggatgggattaaattttttcgggattttaataaatataaatccgatccctacggcggatgaaagcattttcaaaagcaaaaggtattagtgccctcccccccccccagcagttgggtggggccgtttggcttattacgcgtggaatatttgatttcgttacatagcaatgaaaaaagttatgtcaaagctctgctcgagagtcgaaattttccgagattcgatcccgagaaaaaagagagtcaaatgcaactcgtacacaattttttaacgcaaaaatttttaaatttttatgaagcagaaaattcatttagtttattattctttgagaaatttttttagcttgataaagattttaagcagcccaactcttccaacgagagggtttgtcggaatgccaatttccggctttttggctcggaattccggttttcaaatgccgaattttttgaagacattggcacaaatccctgttttccctacccaataaatcgtccaacaacagcacacgttgtccctctgacaatgcattcttttggatttcaaaaacatcctttaaaatgcgtaaaaagttctggttacacttaatacattaacaaaattgcctgcccatattccttcacataagtcgccgagaaaacggactaaaagagcaacaaaacattgaaatttttgaaatttataccaattcccatcaaggactcaaatttttgtctggaaaatcctgtccaggttcaactcggaaatccgggtccctgatccggttctttcaagattccaggctctgcataaaaagctaaccccgggcagttttccacgcttgcgaacaggaacaaatggcacgtccatctcaagcgccacaattgggccaaacaaaaatcctggaattttcaaaaaaaattagccctcctcacccccttcccaagtaagacggacctcgggcttctagcgccacaaccacatcaattttttgtcgataaagtgtcacaatgtgggcacagattgatcggatcagcgacggatttgaaaacaatggaaaaatgtcccttgaaatatccaaatttatttttttcaaaattaccgcccacctaaacagaacatcttttgtaggaaagtcagggaaggagcggatgcaattggccacttcgtttttcagcttttcttcatccattttttaatttccgtttttaattacgcatttatttattaaaaaatatgatttaaaaataaaattgagttacctaatttagataattttattgggaattataacaaattaaattcactttttgttagcacatacattacttttccaaaatgcttatctttaaattccattttttagaaggaatttcgcgttgggactgctaatctttagtctcaccatttttttttcttcctccaatcattaataattcaaacaactgatcagttcctgatcaatcattgcttcaaaatgtccgacattgctggtgcttccagcagcgctttttctgccgatgcttcttcaacaaagaaaaagggcgattttttgtttctcgctgagttgggcgaaggtgagctagctgaactgctttactagggatgccatcgtcaaaactcaaaaatccggcatacaagttcgaaagttttttttttttcaaaaacggcaactgaaaaaaatcgggaccgacccgcaaaacacggacaaatgccgtactttttgaggcaaaatggcattcctgctggctgcttgcttgatttcctcgttggcctctactgagggcaaagaaatttttcatgtaaaggctgacaaaacccgaaaattttgagaaaaaggcaaaaatcgataaaaatttttgtttttcccattttaaggctcctattcaaccgtttatttggcttcagagcgccaaaccagtcgaaaatttgcagtgaaaatgtgtctcaagaagaaaatcatcaaagaaaaaaaggtgagatggcgcacttaatcaagggctgcaaagtttataaaaataagccattttcgcgattgtgtcttttttcagggtataaaaaagatttttcaaaaaacagagggctgaatttggggtatctaacttactttcaataatttcatattaaaaatccataattctttatatctgggcgcctgtttttttagattttatggaaatttaaacattttttcaacgccttaggcccaccttttaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaggaccttatggcccggctgaaaaagctccaacggttcagcgttggccagtgccaatttgcgatggccgaacttttcttggcactcggtgggctgaaattttttaaaaaataacactgaatttttcttatgaaaaaaaaataaaaaaaaaatttttttttttttttttttgatattttgttgg

SEQ ID NO: 10581 - DNA, 1620 bp, Heterodera glycines
  misc_feature (63)..(63): n is a, c, g, or t
tccgactgattttaaaaaaccaattggtaaaactttgcttccatttcagagcacatccatgcnctggacgtcatccaccgtgatgtaaagccggaaaacattttgttgcgcgaggacgggcacattttgttgtcggactttggctgtgccaagcaaatcattgcaaagcgggaaaatgtggcggaggaaaatggtgacaaaaccgacggacagagaggagatgatggccagaaagcagagaaaagtgctgacagcaaaagcagcaaaaaacgggaggaggaggaggcgacaaagctggcactgagacggcggtgctcatttgttggcagtggcgcctatgtgagcccggaggtccagttttgttcaggcatttttttgatagacatgggcaccagcagggatttaattacatcgaacgcccacaaatggttttttttcggaaatctgaaattcgcgtgccaaaaaatgtagtcgcccaaaaaaagtggcacaccaaactgttcaaaatcgggattccgttacatttctgctgggtacaatcggcggatgaccaaaacaacagggcgccagttatgcttttttggattaccggaaatttttaatttttaggttctgaatggcaaggaagtgacgggtgcatgtgattggtggtgggtttgtttatgaaaattggaaattaacgcattatgctgcattttttatttaccgttttaattgagccctcggggggttttttttaacttcccccctcccccccccccccccccagtatggattctttgttggagttggagaaagctacataattgagtaggcagcaggcctatttctccaatttttcaatccctcatttttcctattgaaagaaactactgtttttctgggtcacctccaacccgcccacccatgggaaatttttttgaatttccaaaccatgaatttttcaaggaaaaccctatccaaagaaattttctacttaaatgttttttcttttttggaaaattcattggtaaaattttcacgcgagaaacggaggcgggaaagggtggaaaatcaaagtattgtagaatgcctgctgttttcttttttcttctcagtggagggcggctttattaggggacaaatcaagcactttctttcgatcataaaaaacacacattctctcccgcagggcatttggcgtcactttgttccaactgttggtcggccggctcccattctcggccgacagtgagtatttgctgttccgacaagtgctcgcgctgtcctacaaattcccggacaatttcccatgtgccgcggcacgccaactcgtccaagcattgctagtgcttgagcctacgcaacggattggtgctgcggagatgggcgaacccacgacaatgcggtaccatcccttttttgacggcactgtttgggaaggcattgagaagcgcaaatcgccactttttgattcggcagagaatggctgatcagaaatgaatgctgggagaagagaggataatgtcactttctataacagagaatttatgatgacaaaattctaatattttttgtttggatgaattttatattttgttgtataaaaagactcatggaacatagacaatacaatatata

SEQ ID NO: 10582 - DNA, 2705 bp, Heterodera glycines
ttatcgagcatccacaagcctactcataagtacatctacagtggtgcaaactaaaaaattaatgctaaaggaactcaatgtctaaggaagcaacaatagcatcaagaatttagtcgtttctaggagatagtttctgaaaatcatatatttcactatttgcactgcctcgtttaggcagcctcttccagaagatacggttttattaaaaaagttatttttagtatcataaatatatttcttttgccgaagcaaaaggggttttctattgtttcggtatgttatcataaaatagttcagtcgcataagctgtgtataccctcttcgaatcttagatccatgaagtaagtctgtagcatttctccttacttttatcttttgaagtcaaagtctaatctgcgatcataagtctcgggggtcacttctcaaatcaatcaaactttctgtcaaaaaaagtacaagacaatttgaaaccgttcaataggtttaggtttccccaattaattaattaattgctaccccacaccctacggctgaccaattagtgccctcttgaccgctgaccaattagtaccccccaattagtgactaattgacacccctccccgccagctgtcacatctaattagtgtcaatctacagaggtgtggcagtacttactactcatattccatttcatttggtccgcttttggtggccaatcgttgcgttctgagcccattgatcagcgaaaggaccaaacgggcacggacaaacagtgccaaatgggccatgtcatttgctggcaatgtgtggccaagcgaagcggaataggcacgggacaaactgccaaaaaacatatggcgcaaattcgtgatgagacatttgcgccgcgccatttgcgccgcgacacttgcgccgctcagcaaaaaagactcttgcgccgcggacatttgcgccgtgccatttgcgccgcgacacttgcgccgcctaacaaaaacgacatttgcgccgcgacattagcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggcggattttaagcgaaaaaaataggtaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagatttttttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatggcgcggcgcaactgtctgcggcgcaaatggcgcggcgcaaatgtctcatcacggggggaaacatagttcatgcactccaaattcaccattttgccagacgatttaaatcggctggcccagccgatggcaccaactcggcccacaccatatacaaatagacaatggcattggcaaggtccaaaatgcgaaatgagtagtgggcatcgccaaagtcgatcagagcacacacctttagtataattaggcatttgttttctcatcatcagcgctaattacccctaattatccccaccttggcctcatcatccaccaaaatgttcgactcattgaaatcgccgtgcacaactccttaaattagatgcaaattgatttctgtgtcattgttgtcgcaagccaaaaaaaaaatcggtttactctcaataaataataaattttgtaaaattaggtctgtaaaagttgaacttttgttttgtttttttccaaaaaaaatctcacaaaaacgtaatttttaattttaaaattttcaaaaaccacagattgtttatgaaaaatcttagttactagttcacttaaatttaattttatttagtgaaaaaaaattgtgccgaattccatccctccaccgcgccccctccctacaataccgtaaggaatcggtttctattttagaatacgatataggtaattttagaatacgatataagtatttaactatgaaatgtccatttttctcccctctctttttgggcgtatgccttgctcaaattcgcttctcctccccaacactttctgatcaaactgttcaaacacttcggcacactgtttggccatttttgcctccaatttgtccgtccgtttttgcaattcaaactcgcgccaatgaaaatgccaatgctccagcgccataattggcgcatattggcgaaacactggcggacaaaaattgtgccggtcgcaggcggcatgaaatgtgcccaacattgtgccaatttgttcacagaaagtgtccactctgtgaagagagaga

SEQ ID NO: 10583 - DNA, 1714 bp, Heterodera glycines
  misc_feature (137)..(137): n is a, c, g, or t
  misc_feature (1694)..(1694): n is a, c, g, or t
tacaaatagacaatggcattgcaaggtccaaaatgcgaaatgagtagttgcatcgccaaagtcgatcagagcacacactttagtatattaggcatttgttttctcatcatcagcgctaattacccctaatttatccncaccttggcctcatcatccaccaaaatgttcgactcattgaaatcgccgtgcacaactccttaaattagatgcaaattgatttctgtgtcattgttgtcgcaagccaaaaaaaaaaatcggtttactctcaataaataataaattttgtaaaattaggtctgtaaaagttgaacttttgttttgtttttttccaaaaaaattcttacaaaaaagtaatttttaattttaaaattttcaaaaaccacagattgtttatgaaaaatcttagttactagttcacttaaatttaattttatttagtgaaaaaaaattgtgccgaattccatccctccaccgcgccccctccctacaataccgtaaggaatcggtttctattttagaatacgatataggtaattttagaatacgatataagtatttaaatatgaaatgtccatttttctgccctctctttttgggcttatgccttgctcaaattcgcttctcctccccaacactttctgctcaaactgttcaaacacttcggcacactgtttggccatttttgcctccaatttgtccgtccgtttttgcaattcaaactcgcgccaatgaaaatgccaatgctccagcgccataattggcgcatattggcgaaacactggcggacaaaaattgtgccggtcgcaggcggcatgaaatgtgcccaacattgtgccaatttgttcacagaaagtgtccactctgtgaagagagagatagtgatgcaaattagtatacggtataaatttttttttgtagtattcctatattacggtataaatcccgtaaaaacatgaatttttcaagaatcggtttttctcacaatcaggcttcattttcaaaaaatctttaaaaattttatgaaaatatcaaaaaacttttaaaacttttaaaaattttttttagttattttttgtaaaaataaatttgaaaagcatcgaatttaaaaaaagggggggggagggttaacgaaacctccccaactatcctttttttaaataaaaaagaaaccacactactaaagagtaaaataagaaaaaaacttatttgtgaaagacgaagcaattttaaaatttccaaaaaaaaaaaaaattctcggatttttttcttatttttggcttgtggctcaacccggcccgcctcatttctttttcttcaccggtcaatgaatgttcgtgttgccgttggcgttgaaacgacccaatcgcccaacggagtgcccggcacaaactcacggagcacaaccggcggaattggcatttggtggccaaaaatggcgccattttctgttgtctggtcattaatggccaatttttggcaatttgtagaactgcagtctacatagctgttgcgtaaaaatggaatcacagtgtataaaatgaatgattttttgaaatacaaaaatatgggtacagtaatccgtcaattgttttgatggtttggggacattttatgccctcgttggccaccagttgagcaaggtcggcctgagcttctgtaaatttcgggggtttttaaacgtgagtttgtacganaatttaattttttctttttt

SEQ ID NO: 10584 - DNA, 3417 bp, Heterodera glycines
  misc_feature (1518)..(1518): n is a, c, g, or t
ttagttggttcatacctttattttaaatatgttaatgcattttggcatcccgtcaaaaaaaaatttcggctttcgtaatcagtcgaaatcaacaacaattttgctgacaaatataatgataacatcagttgggaggaaaagatgatggtttccccgcggtcattatcaatagaaaatcggagaattcacctctcaacgccaaacccccgccccccccccaaaaaaaaattctatttttgattgtttaattatattgctgctgaatgatgatattgctgttaatgattttcacttcaaatttcgaataattaattaatttaaggctgaataattttcaaaagatttaacaaagccaaaagccacgaaatttttgacttggaaaatttacctattgcttttatttaaaagatttatttccttttgttttcagatataaacttccaactaccgtatttcctgaaatagagcccacggtggctttatttttcaacccccctcaaaagggggggggctctaattcagggggggctctatttctcaaccctctcgagaggtagggggggaggcttgatttcagagggaggaggggggataccaggtaattcagggggcggtgttattataggaaatgggtttttgttattattttaaaaagtcaaaaaatttcgacatgcggcttttcgggcagggtttgtttagcattaattttgttagcgcttctaatggtttttgacttttattttttaattcgaatatctcaattttcaatattattaattgttatttaatttaaaaaaaaataaaattttagcaaaaaatgtactcaaaatatttttttgaaaattttatgaaatttttgacaatttttgttttcattggcattcactcgtcaaccgttgctgaagttattcatcagcttcctgaagacaatatttgtgccaagttcacagttcaatttttggaggaattttatcagtaaaattaattttaataatttaaaatctttttaattattattttttatattttaaataaaatttatttataaatttctttatttagacaaaattcgtcttctccaatgttcggatggattacagctgaaggcgatgtgacacttggccaacagaatggcacccattttggcattaaatgtttggcattggcactgtccgattgggacttcgtcgtcgaccgtgcatgcttaatgcaaacaattttgaattgctttaattattattattaattaattaactaactaattttcacaaactttcaaagatagatataatttgaatattgtagttaactaaattaattttaattccacaccttaaatattcaaccaatcatttaatttttatgccattattttttcataaaaaaattgggttaattgtgaggcttataattgttttcttgtaaaagaaaattgtgttaattatgaggcttaattaacctaactaactcaaattaggccattaaggattttcaatttttattgaaattttactctanataattttttattaattatttaaaaaacaatattggaaacatttttaggacattggcaccaccaaattcccatcggcgttttattgcaagcccatggcatcaacaaaatgatcaattgaacaatggcacaaatcaaacagctgatcaaaatgtcagctacattgtaccattgaaaagtgctgaagtgcgcagtccgcaactgatcagtgtacggaggcaaatataatataaaaaatgatttggaatacgtaatacggcatggggactgaattggccagactctgacagcaaaaaacgcaaagatttttctagcggttgagaaccaagaaaatatattttggagacatcattaattgttggaaattttcttaaaattttggaaactctcctcttaatattatttattggaaattctgcaacaaatattgccatatttctcgaattttttcaaattctggcaaaaacatgagaacttcttggcttggccatttttaattatatgtctttaaaagaattgagcttattaaccccaatttatgaaaattcttttcttggcattacaataattcttaaatggcctttttaatatttttgccaaataaatttaaattgaatttttaagtttgtccaaaaatgggcgaataagcgtccaactgctcgaccatgcattttcccaattgacgacaaaatcgggtccaaattgagttggaatggcaccatttgtggcctaaaaagtcggcgaataaaaaataataaatttttggtaattaaaaattgcaaaatttaagagacagccgctcagaatgatggcacaaatgccactaatgacagccgatcacaaaaatcaccacaaatcatttgccatccaatggaattgaatttggaagatggaaaagtgaatgatcacagcagtgatacttttcgcctccttcacactgtgagtggcctcaaatttacaaattttatacaaaaaatgttataaaaaaataaataaaatatataaaataaatttaaagtttattaagagacaatttaatgaatacccgatgtcatatatttaaaaattatcattgaaaattcagaaaaaaaatacatttcaacttacattttacaattgtaatgaaagaacaaatatgcgcatttccagatgtatattaattgtaattatttatcagaaaaacgcattttcagttcaggctttacaattgtaatttaatcagtggaaattggaaattcgcatttgtattagacaattgtacttaatcattggaaaattcgcatttgtattagacaattgtacttaatcattggaaaattcgcatttgtattagacaattgtacttaatcattggattgtaatttaatcagtggaaaattcgcatttgtattagacaattgtacttaatcattggaaaattcgcatttgtattagacaattgtacttaatcattggattgtaatttaatcattggaaaattcgcatttgtattagacaattgtacttaatcattggattgtaatttaatcagtggaaaattcgcatttgtattagacaattgtacttaatcattggattgtaatttaatcagtggaaattcgcatttgtattagacaattgtacttaatcattggattgtaatttaatcagtggaaaattcgcatttgtattttcgcatttgtgttagacaattgtacttaatcattggattgtaatttaatcagtggaaaattcgcatttgtattttcgcatttgtattagacaattgtacttaatcataggattgtaatttaatcagtggaaaattcgcatttgtattagacattttacttaatcattggattgtaatttaatcagtggaaattcgcatttgtattagacaattgtacttaatcattgga

SEQ ID NO: 10585 - DNA, 1760 bp, Heterodera glycines
atcattggattgtaatttaatcagtggaaagtcgcattttgtattagacaattgtacttaatcattggattgtaattaatcagtggaaaattcgcatttgtattagacaattgtacttaatcatgggattgtaatttaatcagtggaaattcgcatttgtattagacaattgtacttaatcattggaaaattcgcatttgtattagacaattgtacttaatcattggattgtaatttaatcagtggaaaattcgcatttgtattagacaattgtacttaatcattggaaaattcgcatttgtattagacaattgtacttaatcattggattgtaatttaatcagtggaaattcgcatttgtattagacaattgtacttaatcattggattgtaatttaatcagtggaaattcgcatttgtattagacaattgtacttaatcattggaaaattcgcatttgtattagacaattgtacttaatcattggattgtaatttaatcagtggaaaattcgcatttgtattagacaattgtacttaatcattggaaaattcgcatttgtattagacaattgtacttaatcattggattgtaatttaatcagtggaaataattcgcatttgtattagacaattgtacttaatcattggattgtaatttaatcagtggaaaattcgcatttgtattttcgcatttgtattagacaattgtacttaatcattggaaaattcgcatttgtattagacaattgtacttaatcattggattgtaatttaatcattggaaaattcgcatttgtattagacaattgtacttaatcataggattgtaatttaatcagtggaaaattcgcatttgtattagacattttacttaatcattggaaaattcgcatttgtattagacaattgtacttaatcattggattgtaatttaatcattggaaaattcgcatttgtattagacaattgtacttaatcattggattgtaatttaatcagtggaaaattcgcatttgtattagacaattgtacttaatcattggattgtaatttaatcagtggaaattcgcatttgtattagacaattgtacttaatcattggattgtaatttaatcagtggaaaattcgcatttgtattttcgcatttgtgttagacaattgtacttaatcattggattgtaatttaatcagtggaaaattcgcatttgtattttcgcatttgtattagacaattgtacttaatcataggattgtaatttaatcagtggaaaattcgcatttgtattagacattttacttaatcattggattgtaatttaatcagtggaaattcgcatttgtattagacaattgtacttaatcattggaaaattcgcatttgtattagacaattgtacttaatcattggattgtaatttaatcagtggaaaattcgcatttgtattagacaattgtacttaatcattggattgtaatttaatcagtggaaattcgcatttgtattagacaattgtacttaatcattggattgtaatttaatcagtggaaattcgcatttgtattagacaattgtacttaatcattggattgtaatttaatcagtggaaattctcatttgtattagacaattgtacttaatcattggaaaattcgcatttgtattagacaattgtacttaatcattggattgtaatttaatcagtggaaattcgcatttgtattagactaattgtacttaatcattggattgtaattta

SEQ ID NO: 10586 - DNA, 1012 bp, Heterodera glycines
caaaatcattcttgcaaataaaacaaaaaacgggatggatttgcttttacgacttcccatctgttgctggatcgaattctttgggtttcgcagcagaaagcataaaacgtctgcgactcttctccatgtcgtgtctctttaatatggaattgaagccctctttcgctcatattttttaccttgacataaaattcgtactctcctccgcgtgtatcgaatgtgcctttctggagccatttaagtctcaatgtcattcggggacccaactcatggagtgctgccttctgtccttcttttttaaattcgtacctaaagcggcaaaattcgaatacgttttacaagataactagtgatttacaaggagccttttgcaattttaccgatggtgacggaaaaagacgtagtcgcgctgattgtggaaggtcactactcgtctgccgccataatcagctttttgcgggaagagacaggcgaacattcggctcaccgttttggccagccttgtgttgaagttggtcagaataagttcagggtaatgttccgttgcctcaccgacgtcctgcaaattcaatatcgaaaatgagaaaaacaaaatatactttgatctgtttggagtattgaagcgaatttatcttaaaaaacgcagtgggaccattcggaagatggcaaaaaacgattccatctgaattaataattggaaataatggaaagtagaaaaggaatacaaacttggttttttgcgatcttcgtgcaccaccattaggtcagaaaaaccacgctcaattgcctgccgcacaacacgttttatggcaacgtttttcctagacacaatttctgcattcggaatgaccttttttaactcgaaacagagtttgaaggttttctgacgaaaattttttatttttttaaataatatcattcttacgagttttgctctcggcgaagtggtgataagaacctttcggatggcagaccctccaaaaaatgtgcatcgcatcattttccatgtctt

SEQ ID NO: 10587 - DNA, 2994 bp, Heterodera glycines
tttatttttcgttaactaattaaatattatttttgagtttttggcctcgccaggagctcaggtccaagaaaaggatcgggcctagagtcccggaaaatgggatttttagtcccgggaatcccgatccatcgtcaaatcccggtcttagtccagttcaatttagaagcgagtttagcaaataaaaatgcgctgccgtcgtggccacaaatttttgtttctgcgattttgttcttctgttccttgtcaggggaatcagcgatctgttgattattctcaaaggccattacgtccacttcttaaatatgtgccaggtcataatacttaattaaattggattaatatttttaatttaatttggattttagaaaaaattcgaaattttgccataattgctcacgttgaccatggttcgaatctttggattttgcgactcaatcgtataaactatctattgaaggaaagagtactttggctgatcgctttctgcagttaaccaacgtgatttctaccgaatctgatgcccaatacctcgacaaacttgaggtcgagcgcgaaagagggatcaccgtaagtaaatgaacggctaatttatagaggtggccactcgaataaaaagtcaaaatcaatttcaaaattcacatttatgttcgaatctacatcgaaaacattgagagatttttttagatcaaagctcaaacttgctccatgttccataaggtaaagaaagatatgcgtatttcatttttatattttatttacatttaaggattttatgctcaatttggtgtaagttgaagactgcttgccttgccttttgtcgtctaatcagccattcattcggatcgcggtcataatgggtttttaagcgaaccaattgggtaaatggttatcatttgattggcttatgaacaactttagaaattacaattactacctaattattagtattagcaaatcagtaaagaaaattaatgaatggatggcagttggatgataaaaattatcggacactttttttcacatttaagcgatactcctggccatgttgactttgggtcggttagtactttgattttcatttatttttgtttttttagcttcgaggttaaacgttctctcataacctgcgacggagcaattttgctagttgctgctaatgaagtgacgaaaataaaacattttctttaattttacaattttagggtatccaagcgcagacccttttcaattttcattcagcctttgagaataatttgagcatcattccggtcatcaataaaatagacatgaaggcaaatattgccaaagttgaggaagaattacaacaatcgtttgggtttcatgccgacgaaatttttaaagtgtctgcaaagacgggaagaaatgtaccgaaacttttggaggcaattattcagaggtagaatgattgtaagagaaaattgtagtaataattatctgaacaggataccaccgccacaagttaaccaagaaggaccgtgccaagcccatgtttttgattcttggtaatgttcagataaaatacattacagtgtttttttcttttttaattatttagtttcgatcacttcaaaggtgctcttcttttcgtcgtggtcaaacaaggcattttgactaaacatttgcccattcgattcttcagtagcccagaaaaagaatacgtcgtgtcagagattggcattttgcatcccgagacaacgccgacgaacgtgaactatcttttgggaaagagctgttattcaaatcgagtttccttttttaggaactttaccctggtcaaatgggctatatttattgcggaataaaatcttcgagggatgttttggtgggcgacacacttttccacgcgactgaacgtattgaaactgtgaaaccatatgtggaaattggcaatgttaaacccacggtttattctggacttttccccatggaaacaacggaatacgagcgactcagagtaaaaaagcgaagacatagcctattaataaaataataataattaatattaagaatgcagttgaaagtctccaattgaatgacccttcggtgaatcttcagatggactcgagtgtggtttttggccagggatggcgggtcggatttgtcggcaatttgcacatggaagtgttcggacaacgcttgggtaatattcgttgtgccttaaccaagtgagaaaatatttcaaccgcagagcaggaacatggcgaattggccgttttcacctcgccaagtgtcaaatatttggcaggttggtatttaacgatgcagaaacacactgacaaaggtccttcagatatcgttgacaacgaaggcattcggaaacggcgacacaaaggacaatcgcaaattgccatttgcaagccatccgattttccggaagtgccaacggatgtgctaaggtttaggcatccttccaaattgacattgaaggagtatttattgttggtaatatatttttccactttgagatttttggaaccaatgtatttggtcagtattgtgacacctgccgaatatttctcgaacattgaaagactttgccaaaatgcccgcggggaagtgcttgagacgacttacatagacgaaaagcgaatgattctgaggtggcggttgccgttggtggaaattatcgtcgatttttttgacaaactcaaacttacaactagcggatttgcttcgtttgatcaaaaggatgacggtcagtttataccacaaaaaagtcgaagaatcgtgagtaaacttgaagggagcaaagcgaatgattattattaaatttggcggaagggtcacccctcaaaaaaaagcatacgtgcgccagggatatttaatagggatggattttaagtaaattttgttaaaaatttgaaatttttcctcgtttccctttggcctgcgccccactcccccacctcttttacagccgcaccccttacgacggaagagtgtgggtgcgttacgacgaagcggggggggggg

SEQ ID NO: 10588 - DNA, 2345 bp, Heterodera glycines
  misc_feature (2251)..(2251): n is a, c, g, or t
attaggcatccatttcgaccaattctggacccgggtcctatttcgaacaaaaagtttcgaaatttgctcttttcttgtatttataaattccagggcttaagctttcgttaatgtgaccaagtaagacaaaaggaagattcacccccgattcttgaggtcaattcttgcgaaatttggtcttcacaaaaatagtaattttccattaagtgtatccttagtagaaacaaaaaaaacacaaaaatattttatttctttataaacaaaaaaagctaaatttacaaatgatttaaaatttagatggtagacaggcagacagacatctgtaccataattgatgcaaaataaaatgcaataccgatagaatttcagagaacaaagggagggtgagaatagctacaaacatagtaaatggctgaaaggcgaagaacacacgttttttgatgacaaatgatgaggaggaagggaaacggatgaaaaggacagagaaagagggcgagaaagagagagggagggaagagagacaaagaaaaagagaggaaagagagacaaaggaagagagagagaggtggacaacgcccgcaggggtttagccgaagctcactacatttggtatgccatttatataaaatattaaatgcctgattagcttttaaagctcaaagtatagtaattcgactcaggaaatctgagaatttcactttttttttgagatgtccaccaatcgtaactctccattggataaatagaggatgaatgaatgaattaagggggaaaacaaagggcacagaaagggaagaatggtagcaccgagggaagaggttttgaacgattgcgatgattgggtcggctctcagtcagcctttaaaaaataaaacgacggtcggatgagaacagtcggctcatttccttccggtcgacttgctgttttccaaccgttttaggcgcactgaatgaaaagaagaattgggcttctgcatctgtttttctgtgttatttgacttacgtctctcgtaattcctctccaacgcctcccccacgcggttccgcgcctccatcgattgcagcgaaacaccgacacggagaagcgagtcgttgtcctccacgctgagcataatgtcctaaacgtatgggggagggagggaatgatcaaaaattggggaacaaaaaaccatttcgatttgattgcccagcacggattgcctctgaaatgcaataatcagtataaaaggaggggggggggcattatttgttgtgaattgcctgattttcggcgtggaattccaccaatgattgcgtttgcagcgtcgccctgagcaatttggcgatcatttcgggactgatgaaatttgactcgatgttcagcactttcagtgagtcgctgtgctcgataagctcgactaatggcttaactttaagttaaattctccatttttgttccacaaattacacccaaaagcccagcaaatttcgtaatatgcgcagaaaaagagaatttctattgggcacaaaatcatttttattaataataattcaataattagtcatattcccccggaaaatttaaaagttagagaaactgagcgattctttcaaaaattagccgaagatttttcaaaaggagggggaacgaactgctccccggcctattcattacccgtgcctcctggtcggagatggccgtgttggccatgcacagcttcttcaggtgtttggatttgcacgccgctcggagcatcgaccgaatgcgttcctttgacactcttttcaggttgtttaggttgacctcctccaatttgacgtcgccactctccaacctcctgaacacatccgttttatgttatgttttttttttgtatttttgggactgaattattcgccagtaagtcccggggtcgacccaatctataattactataattaagtgtcataaaatgatgcagcattcgctcgcctggtgcactcctccacgtccgtctcgttgtccggttcgtccggaaccacccgaggctgaaacgctttgatcactccgctgaaggaaatgccggtctcctcattctgtcctttgcccttcagcgcgttgtaatattgaggttggttgagcacattatgcattcctaaaaataaattagggaatgccaaatttgttttaatttgtgatggtcgatcacccaaaatgccggccaagtcgaccaggtccctttccggtgccgcagtcagtgccttttcgatgatcgtttcgtcgttctttgcncctgtgggggtgcgcttcgccctcagccgtttcttcgtcctccgcctcctcctcttcgtcgtcgtccaaatccaaactcattggcatctgacat

SEQ ID NO: 10589 - DNA, 1889 bp, Heterodera glycines
ttccttgggtttttcagatctctgttcacgaatctgctctccatttttattatttccaaacttgaattggaacaaaaagtcgaaaactcaaattttacaacatttttcactattgctcgaaaattgattaaagcgatataaatttagtcacaatcattgaaacctcaaaaatgaataattctgtgtagactcgaacacaaaagcaaattttgagatttaaattttcgactttttattcgagttcggatccgggttcggaattggccaaaactgatattagattcgtgttcagccaaaaatttcaggggcgggtgacaaaaacagaattacccaaaagagattggcttgccaaagtctgatcgcggagacaaagtccacccgacttgtgcccttccccccccccctttttcacctgcatttccctccttccgtccgcccccactttggccttcggttcgtccgactcaaaaacctttcctgaatttgcttatttttcaaattttgagaaattgacaaaaatccgacccctttttacgcccggggcgaatggaactgcctcctcccagtccttttcacttttggccttctcctccaagtattggagcagtttctcgcgtttaaaggggccggtcggctttttgtccgtttggttgcgacaccgttgggagggtgggagcagcgaattctgaatttaaatttgaattagagccaagaaaacaataaaaataaattttttgaaaattatgtcgtctatccgtgaagaccaatctgaaggttttcgtggtgaccgtattacgaatgttgtcaattctggtcaattcttctaagcaatgacttttttcttacttagccaatgaactacatttttgatatcaaacgatagcttaaagtctcattgtcaggaattaaaaaaaagaaaaaagcaaatactgacattaaaaaaaacaattataatgataaaacaagaaattcagtttttcgaattttattcaacaacaattttttgtttattgcatttagttcagaatttagttgttcaaagaaaacttcaaattttcgtttgataccaaaaatgtcggcattgaccaaataagaaaaaaaatgatggcctttgaaactgaggatgttccttaattggatgcgtaaactgcagtattttttatgacaaaaagttttgaaaacaaataaatttaaacaagcccactgggggagggcaaaggcatttttgcctcccgcaaaaatgaggtgactttctcaatttgttaaatccctccgtttctttttcctacgtccgggtcaaagtcgttgttcaactcctccaattcgtccgtgttcaaattggacagcaatccctcaatgtctttgtcgtcgtaattgctcaggtccctcccgtaatatttctctcccccgcaatttccggcaccgctggtcaatccgccgacgccgcccgcccttttggccaatggttgctttggggccgccagcgttttttcttccgcgtaataactgaactttttaataggaaaatgaactttttaataggaaaatggacaagaaagggatgaatttaaaaaatgatttttatttatttaaaaaaataagacaaaatgccaattaaatgaatgtttgaaaaaaacaaattaaattcaaaaatttgaaatattcaaatttcaattttaataatttaaattattttctatcggaaaaaaatcattgaaaaaacaagggaaatgcccgaaaatgttttgatgaatggcttttctccgttggtcctcgtcctcgtcgttcggagatggatggcccatcgccccccacacgatggacatgtcgtaccgcactccgtttcatgttcaagagcgtttgttgaatacaaaatttctcaaaaaaag

SEQ ID NO: 10590 - DNA, 1910 bp, Heterodera glycines
  misc_feature (1902)..(1902): n is a, c, g, or t
ctgcactttattgatcatttagcaccacacctatcgcagcacccttctcatccctccctcatcaacccgcttcgacgggcgagcgaccggcgatgactttgagtgattccttgtgctgttggaccattccctcccccccccccctcggtccgcaaaaatcatcggcttattccctccccccgttcattcgttcatccatttgtccattcattgtcattgtcccaatttgcacaacatttgctgcttttgttattaagcatttgcagcggacaatgcttttgctattgcttctcccccccccccctcccccgaaagatcactcaatggaaatgggagagaatggacaaggctaatgaatgaatgatctgaaaatgcttttttggggctggctttgtggttggagaagaggagaaaaattgcctaattgttaatgttgaccagtggaaaatgttaagcaaaatttcctatgaaaaatcaccacaaataaaactcactcgcttttgctcatccttttgcgattggtcttttattggtcggccaaattaaattgaagaaaaaaaacaattaaaaagataaattcgggaatggcaagaagaaaatgtacagacgaaactgaacacaaaaacattgcattaaaaataaaatattataaaatggagaaaaagaaaatgcccaaatgtcccttcataaattttaaaatgaattaaatattaaaactcaatcaaaaaacggaagtcagaaacatttaattactattaaaattggccattaatgctaattaacttttcaataaaacaaggcaaactcaaattaattatttttcaatggtaatttcataatccagcgatttgacaacaaaaaactgtcaccgatgagtaaaaagccctccttactgatctagcaattatttttgggttttcatgatttattaaatttatgcacttattttagtattctttttgatttcaagcacctcaaaatccgatccctattgataaccaaccctttggagaaatctcagcaataaaattgtatgtggccttaaaatgtacgcagaatttgtacagagtgggggcgggtggggagggcgaaagtgagtgagtgattttggtgggagagttaggggagggatcaatcgatcaaatgttttttgtttggagataaacgagcccggtcggtcggaccgatcggtgtttgacagctgagccgaatcagcagcgagcacaaacacagttggcggagatgggccaagggggggggggggagaagggcaacgggggacccatcaccccagggaaggccagcagaacagccaatttcggacattttgttgaggaaggacgacggacaacggacggacggacagattggcaactcatcagagtgccaccaattcattcgatcaaattggcaccgatgggaacggaaaaaggcggacggacgaagaaagtgcagaactcacaatcagcagaattgtggcgaaggaaacggataaatcacattgggaagaggtgaacggagaagcagcgatcagccagccgaaaggagtgggcgaggaggagagcgtaggcagagaaagagaggaagaaagagaaaagtgatcagcagtagtcaaaaaagatgaggaggagagaaagagaggagagagtgatcaatgggaaaataataaggaaatgatcagaagaagccgaggaaccaaagatgcgggacttaagtggtcaataccttcggtactgaattgtaaagcgcatgaatgtcctacaaacactaattgatctctgtcattaatgcatatatgaattcgtaggatttttttgaggttatagtggtgcttgagtgaagtggcaaaattgaaattgcgttcgtaaaagtatttttttcccaaaaacgggacccagtcgnactacggc

SEQ ID NO: 10591 - DNA, 5669 bp, Heterodera glycines
  misc_feature (27)..(27): n is a, c, g, or t
ttttccaacacgtcaaataaatataantttttttaaatataaaaaacagacctgggtcgatggaaatccacacgtcctttttgctgcctaaaaatgagtggagtatttgtatttgtgaacaaaattttagggaattgaacacgaaaattgaaaaaaaaatgccttacatttttaaaatggttaaaaaaaatttttgcctgtcttttttcgattttttttttggctcgttttacgaccgacggtttgactcggagacggcaaattttaaatatttcgtaccaaatttttataaaaaatataacaataagagagaatttgtggttctttcgatggtaaatgacgcgccaagaaaaattttggaaaatttagcgcaattttttaagaaattattcaaaatttcactgggccatgcccatgccatgaatgccaaatgccatggcctcctaacctgcgtagaaaacgccgtcactgctgcggcacggcgacacgcggaccaagtgggggatggtgaacggcaacttggagagccgaccttcgaccaccaaatacagttggccatcccgcgggttcgggatgaaggtgaagccgcgctggatgctcaccggcgaggacagcagggggcctgcaaatgttttttttaattttggggtggaaaatttaaattaaaaaaaatgccgagggggtggcaaaaaatgaaatattttgaataaaattaaaaaatgcatattttgacgggttggaaatttagacaaaaagcaaaaccccggttacccgtccgatgtccaatctagagccccaaaattttgaaaagtcggggatcaggattaaatacggaatttgggcacgggttccctattttgccggaatgtgaatcttgacacttgaatccaagtcccggtttttgtcggaaacccaggaaaaaaatgcaaattttgggtggaaggcttggaaatttagaaaaagccgggaccaggatcccggaaaaatccgaagaatcccaattccgtccagggccctagacgaatcacagttttttgtaaattaaaagtcaacaatcgaaacaatttaataagcgccactctgcgcaaattgtgccgaaaagcatcacctcgaccccgccaaaaatgccaaaattcgaatgccaaaggagaggatgaggctctattatgcgtccattcaatgttttgaataactaaattttgggggctaataaaaaagacaaaaaattatttttgaataaacttgaaaaaatgactttcaatgttttcgcatttttaattattttctaatctcacaatttgcccttttcttgcattggtaaattccagagactttaagctttcgattgataccaaaaatgtatgctttggccaattatggaaaaagttatggccttcaaaactgagaatggtcattgattagacgcataaattggaataaagccggggataatgccatcaaaaccaattcaaatcggccctccgccgaggacggcacggcaccttcgtggaagcgccatttgtgggccccggtgtgcgcgtcgatggcattcatatagccgtcgatggtggacaccagcagcaaagtgtccgccgctgcaggcctctgttccgccaccttgtccgtcgagtaaatgttgggctgaaaaggcataaaaattttcaaaaaaacaaaaaaaattgacccttagccctccaaaaaaccgaaaattcgcaaaataaaaaaaattttaaatccatttaaatcctcaaaattgaaaaaaaaacagtaaactctcttggtggatcatttttaaggggacggaaaacccgacaattctcaaacaaatcaaatatttaaaaacaaataaataataataatcccctgaggggaatttaaaaaaaattgtcggggtcaaaaatatttttaaaatataattttaagttttttagaagagaggcaaagaaacatcagcccaaatatttcattttttgcaccttataaaaaaatttaaccctcggaaattgctaggctcaatttatttcattttccaccctataaaatttttttacccttttttgccacccaacaaaaaatcgattaaattttttaaaaattcaaccctttgccacgctaataaaagggcattgtcattgtctgtgtcagtctgtattatgctgtgccatatacgagtgccatgccaaaacaaaaaacaaaaagtgccaccgttggcgcgacggttgtccacgccgaaacattcggcgccggctgaacaatgagaaaaatggggaggaggaaaagccatgatgccaacagcagcatatttgcttcacattacatccattctctgtggaagattgaagagggcaaataatggattagtaaaagtcgattgtttctcactgaaaatgaaaaaaagtgagaaaattgccgatgaattaatggatggacaaaattggtatatttaatgagaatttggcacaaatttttggcaaaaatattactgttaaaaaatttggcacaaattttcctattttcaatgaaaaattggcataaatttttactgttaatgaaaatttgcatttttttctagctgcagaaatcgggtgtttataaacttcggaggcgcaaactctaaattaattttttttaattaaacgattgatatagaaatatttcattaaattttaaatgaaatattttgttatttgaaaataatcaatccatgaaatccataatgcttatggaaaattctcgtccggaaagtattgcaaaattgaaaattttcatgccttggcagcctaattagtcacgcctattatggacaatttggaagatacaaaatttaatttgcgcttttattggcgttttgttttcaaattaaaaaaaatcatttaaaaaaagtgtaaaggaaagggacgtcacaaaggccacgtcgttatggtgaacaaacaacagaaaactgaatattttattatcaatttttttttgtccaaatgaattaaacggtgaaatttaaagtgcgttaaaaacgaacaaatcacaatttcttggtaaaaacatttattccataaaaataaactaatttaataaatctttattaaaagtcttaaaagtcattttgtaaaaatggaaaattggcatcgtccatttcatagaaaggcaccacaataaaattaataaggaatattaataaccatgacaaataaatgatggcactttatgaagtgtgcgtgtttaagggaatgggctctcattttccgttcttgacacaccaaaatatattttaaaataaaattaaaatctgttttaattatattaaaaatccatttttattatttttaagggattgacgtgtgcagaacggaaaatgcaacaacaaaaataaaaataattatcattaattaggttgataatgtaaaaatgggtcatctaattaaaaaattttattgtctgtctatttcttcttcaacacaatcgccacacgggacggtatgtaaacgcagagatggtttttgcgtccagcgtacctaaaaaattaaaaaaaaaaattttttttcgaaattttgccaacccctcggcaaatgtgtggtagcattggtcctgcttcaaccggttgtgcccaccaaattcggactggtcactgttcagtgccaaacagtagctaaatttaaatttggaaataggaaaatgttccccttttaattaaatccattaaaaatttgaaaataaaaaatttaattattcgaataagccaaatttatgtaaacttacaaaacccacccataattactattaaaaaatataaaaaatcgtcattttttgaattttgatttgctaaagaaatttcaattttaaaattttatggtgaaaaagcattattttttatttaaaattctaaaaccaatgaaaaactttgatattagacgacttacaccccggacatctccacgccaattttgtaatcaccaaaacttttctccggatggaagttcaggatgaacacgaggccagcacgttcgaacacgaccagcttgtccccatcatgtttccaggacacgtaggcctataaaaatacatttagaaaatttcaaaaaatttaattggggggaattttttacctttttgaacttgccaagccccccccccaactcgccgaaaaagagtgaatgcaaattagtccccaacttacatgtccatgactcaaaaattcggaatccatctccagatggttcattgcccgatcccatgcattcaagtacttgtagcgaagtgtcaagtcctggaaaactttttttgaagaggtatataggacaattcggcgccggacagtttgccgctgccagctaggcgtgggcccggaattggacagtgattcaaccttcaaccccgaaaatttaatttaaaccgggctaaaaatcttaggaataatcccaggaattcggcttggagtgagtatcgcgcccaggcgacaacatttttctgggctccgaatgcttcggatttatctgtcaatttagcaatccccaaaatttccgagtctcgagcaaattaaaatccattttcctatagtagaaaaatgcttacatccgccaaattccactggcgacggcaatagtggtaggattgattgttgccctcacgcgggaagtccaaccattcggggtggccaaattcgttgcctaaaaacccagacaattaattattcatcaaaaaggagacaaaggaaaaacaattaataaaggagcgaaatccgttccatcgggagcaggttgtttcccaaaagcataaaaaatagaatttaaaaaactaaaaccgagaaaatttttggcgacagaggcggggggaaatttgtgaggggaacagctcgtctcctacgtatcgttttccccagaaaatttttaaaaaacagaaaatttcagccaggaattagttaattgaaaaatttctcgaaaaattcgcagaaaatatggggggcagtgcatccatttcgagccacgagtttttaaccaattaaagattttaaaaatacatttttaaatatgaaaaatgcattaaaattatttatttgtttaaaataaatgtgttctgtcattatgaagtggataaaaatcgatgtaaagtgaaaaagcttgaaaatgagccctcaagcacaaaatttcgacttttgaggccctgtaacttttgaagcaggcggaatgcaccgctaaaattaaaaattcacaatagaagtcgaccctgctctatccaatgatatgtcatttatatgcattttcctagttacagctcggaatgttccgttaactgtaaaataaaataaaaacaattgatcgagatcagatttattcatcttcgaaataaacataatttattagctaagagttaacagatttatcacaggtaaaatgggcaacaaaataagttagagcagaaattgtctttttgaaaaagttaaagtcaaaaaaggtaagacaaagaaagcttttccgaattgaaaagttagtcatatgaaataataaaagcctgcataataaagggcacggttagatcaaaatcagctgattgtgagtcacttcccttctgttggataatcttctcacgcttcggtcacataatttgcggggaaaagtccctcacgtccgtccagccgtccttgccaccaaccggagtcgtccctcttcaccagttcg

SEQ ID NO: 10592 - DNA, 2672 bp, Heterodera glycines
  misc_feature (2575)..(2575): n is a, c, g, or t
  misc_feature (2652)..(2652): n is a, c, g, or t
atttatactccggatatgctggatacgggtatcaatttaaaatacgataaatcaaattattaggcatatttagatgcttgttgaccagtcgagagaatataaatcaatttttatattttttgaattgggacatttccaagcaatcatagatcctaaggaattaaagcaaaactagcttattataaaattaaaagcatttcataactatttttaaatgttaataataacaaaaatttgctctttatataatcaagtataattgtattaaaataaaaaattgatttgctttttattcaatgataaacatattcaaataaaattagtttaaaaaattttaacttaaataaataaataaataaaccaatataaataaaattatatttattttgcttaataaaatttatttgctttgcttgattgctgtggctttgtgtgtatacggtttagggccgaaacacacataataattaatttaaattatttaacccaaagagacaccgtactgatgaggcccggtctctttcggttaaatttgcactgtcgcgaagtgccctttttgcacttgtcgcgaaatgacgaagcaccgtggaatttacaaaacgccaaatgtctcacctggcattgcgccaactattttttcataacccaaattgtgccattgcgatattgttggagttgcgctttgtgagatggcaaattttttgattgttggcaatgcgcgaaaaatgctcaacgaaaagtcccatgatgatgtttccataatgccaacattgaattggaagccaaacaattgctggatgatgccataataattcgtcaaaaaatctgcaaaaaaataataatttaaaattcaaatttatcagaattaaaaaaatctcaattttcctcctggcacctcataaccgaatcgtttatttgttttacgaaaaatgaactcttttttaacaaatatgttatgtaatttcaataattttcccgggcagtacctttcggtaaaattagcaaacttaattaaattagaaatttacgcaaaagagtaaaaatttatttttgtcctcttcgcccatttcctctaaaagttataaaatgtttaattttaatagtttccttagcaaaaaaaaaaaagattttatcaattattctttcttcttccttaccaagttgaaaagagtccgctttgttggcatttggcaaaaaaaactcagtaatgtcctgttcccaaatggacacctgctgaccgtgttctggcctaaatgtaattaagtgtataccgtagtattgcgttcactaaataaatatattaaagtaccatttaaaaaggttagctttaaataaaatgatcggccaaaaatttaatttttaaaataattatttcgaatatttttatttatttggtggccataataattaattttcagcagctgtttaaggtaagaacagtagatggtgaaagtaatttcgctcgataaaaataaaaaatatgatctaatattaaaaatcaagccaaaatatattaatataaaatgacttttgctgcgtaattaaaaatttacataatattttatggtgcatttttgtaccttttaagtaccgtcctcgtccacactaaaagtcgtccttcatattcagcaggttcttctgtgggctgaaagtcactggttgaattcaccgcgagtaccaacttaattaatggaaaaaggcatattattattattgctaaaataaatgcaaaaataataataataaattgcgaaatgaagaaattggctgaaatgggctattctcattttaatattttatattttttaaatttaatatttataaattattaaaaattttaaattttgaattaccactttttccacattttgtacatcggatgcgagcagttcagccaattttctatgcaataaataatgcgactcgctgaatgattctcgccatattatgagtaaaatgcgcatttttggcggaattgcgacgaaaaaataataattttttatttacaaataattaaataaatttttcaccttgtgttggctgctttcccttagattcattccttaatgatggctcacttttctcatttattggtgcggccgaagctgtaaattttaatttaaaaaaaaataaaattttaatttgtttttaccaattttaagaaaaatggccaaggcaaaaatattttttatgagacttttcattttatcaattacaatttaaaatttattcagtaatttttcttatatataattaaatagtttttgaaaggaagcaacgtttggccacgaaatttaatgcgtgtctttgcgtttttgccaaattcttttttgtctacgaaaatccggtcataggaaggaaacacgtaaaattatgccttcaatgaaattgggcttgaattcttatcacaacactttttgaaattacaaaattttttattggttttattttaattataaaattttcaatttcgaacttcgctaaatctcttagcactaatttgaatggtttccatcaataattgcaaactgaattattgccgtaatttattcacaacattcattcactgccgtanacattttttggttttgtgccgtcgtctgcagctgtccccgtcatgagagctgtattttatattaattagtttattgncattattgcattatcataaa

SEQ ID NO: 10593 - DNA, 1990 bp, Heterodera glycines
gaaaatagcaatgggaattaaaattaattaaaaaaaccaaaaaagaaatcgccttcaggaaaaaaaataattttgaaaaattaccattttaaggagtaaatacataattaaaaacaaaagacgctcaaatagttttttcaaagcacaaattatccaatgacattttttttgcaaaattctaaattctaacggaattgaaataatttcaagaaatcaaatttcattaacatttaaattgcctgcggacatatttatccaaatttttatacattagtccttattagttcaataataactaaaattttaaaggaactggagaagaaaatgaaaatcaaggtggtcaacaacaaggaggaggaggaaccaataacggacgtggcaacaatcgtggcaatgaaaatggtggccaaaatggcaatggtcagcagcaacagcaaccgcccgccggcggtgccacctgcacgaacagggccaccggctgtgacgtcgcctattgtggcaacacagactttgcccgggcacattgtgccggcacatgcagaagctttttgaacgagtgcagtcatttggcttcggtgccagacccaagtgggtgctgaaatattaagcatagaaataatttatcattggaaaacgaaaattgtattggcatcgaattttttggtcagttttctagattttgggacaatagttgaaaaggatatattttaagtggtgccggcaggctttatgagggaaaaacattgccaatattttaggaatgtaaaataataataataataaaaaaattcaggcgttgcttgtggcaacccggcaggcgattgtgccatgaacccaaacgtatgcagtgtaagtttacagcatgggtttttttaatgttttttacaaattacataatgtattacatatgaatttaggacgatgttttggcagtgtgtggttgtcctagaaaatgtggtcgttgttctgatcacacaacatacattatgcaaggcaaatgcagaaatgtgctgtgaatgtactgtagcagatcgacgagaggaaatgcattaatggatggcagatgcatactgtagtggcgtttttgaatttgttttacatacaaaagcagccattcattgtgtcaaatttttaaatttttacatacataaaattacaaaggatgaatgattaaaatagattaaaaaaacacattttacccttggtgaaaaaaaaacacattgccatggtgagtatccataaatttttacaattttttcgatccaaaaagctgcttaattatggcccttttcgccgaagcttactaaaaatgtagaaagaatattgggaaaaattcgtgtcgattctgttttcttgagctctgttggtttcacagcagcaaaaaatttgctggagaacatgaagggtcctgcggatgaaaaattgtgccttttttggcaaatcttcatttaaaatcacttaatattttcaaaattttccgtctgtgccgacaaccattgtccattcaaaaaattaaaacataaagaaaaataataatcttgagctagaaattctcagaaaatgctggcaagacaaatacaaattttgtttttcacctttaatttccattttatattttacaattaacaaaattgtttttaaaacaatttatgaaaaatgaaaaagatattggttatattttattgttttggtaacttttaaaagatgttagtatgaacaatttttattgtaataatttaatttttttgttttaaaaatatataaaatatatgacagaaaagacaaattcaaaaaaatattccttttgtgtgggggttgaaccagggctgggaccgcgcagcgatgcgcgatgtgcgatccgcgattcgcggcaattttttttgcgcgatccgcggtcgcggccgcggtacattaaatgcgcggccgcggttttttttttacgcgatgcgcgatgcgcggaatttgggactccgcggcaatttttgaccaa

SEQ ID NO: 10594 - DNA, 1673 bp, Heterodera glycines
ttttccatccaaattttgcaccaacccaaaacctcaaacattcagtgcacctagcgcagcaggttttacacgaaaataacagcaaaagcatcacagcagcatttggcaaaagaaagggccgccaattggccaaaaaaaaggccgtaaatcggtggggcgaactgattaaatttcattgatttgggtggactttgtgcggtttcaatttcaattttcgttagtggtgatcagtgaccaatcaattgattgatttagttttaaattttgaatttttaaacagtctcaatttcacaattggaattttcggcattcccgacattttggatttgccgtaatcattttgcctttttttatggagatcaatcatcccattcaatcttcttggagatcaatgatgatcggctaattggtgatttttcaatttttgatttttaaaacggcggttggcatttttggcattttctgcatccccaacatttgaatttgccgtaatcattttgcattttgttttttgggtgtgggatcaatatcaatcatcctattcattttcgtgcgcatcattgatcaattttgatcggcagattaatgagatttttgtttttgttttttaacttgcgtatggcatttttgacatttttggcatccccgacattttgggtttgccattctcattttgcctgttttttggggggatcaatcatcccattggcatttcaaagatgtcagaaataaattattccttttttcaaatttttctctttcgaatcttcaaattctctgagaaaaaacatagtttttcccccaaatttgcataaattttcccctcatttttttttgcattttcattttttgaaaaccgcccattaattcctttaaaatgaaatttatttaaatcacattcacacatattataacacatgtagtacatacatacatacatatgtgtttgttatttgttttgcttgtttttacacctaaattattatttttattttaaatttgcaaaatttgtcccaaaacaaaggccttggaagaaaaacgggaaaataggcaatttatgaatgtaaaaaaataagacaaaatgccccatttaaggaccttgttttcctcaacagatgatgatgataaatgagcataaataagctccctcctcaaatttcagttctgccctatttttgcaagaaaatcgctaattatctactaattattctttttttatcctttaattatgaattttttcgtaaatttttaatttatttaaaaattagtttttcccttcgttagcttcagactttttttaaaacatttaaaattaaatcttttaaaaggtcaatccattttctcatcataagataggcctgaggtacaatttttgcaaaatttttctctcaatttattaattaattgcgcaatttaaaattttctgccgctaatattttttaacccataataaatttcataagcaaaaacaattagttcattataaagtatagagctaattaaatttcaaaatcaccttttcattgccccggggcgcccctactttttaaaaattaattttgtctcctcaatttaccccacattaattaattaggcacacaatttatgaaaatgttcctgcccgaggccactttcaaccttcattaattcccccccccccccgacataaaaaa

SEQ ID NO: 10595 - DNA, 1591 bp, Heterodera glycines
cgcaaattgtcgcgggggcgggcgaggggcggtgttcaactgacccagaaagattttccgcttccttccgcgtcctttcttaagcatcatcgactcccccccccccgcccgcccctcttcaaatgattgaccgcaattcaaatgaatgaatgaaatccctccgtccgtccgtccgtccgtccgtccgtccgtccgtccgtccgtcgtccctcgggggatgtcccctcgcccccctcccccccgcgcggtcggtttgaattgcagcgcagcgatcgcgacggatcgccaaacgccaaacatcgccagacacacatagacaacagaagagaagagttcagatcagcagcagcactaaatctgatcagaattgacctgctctgcttgctgctgctgatctgaactggcgcactttcgggggacttttatccacgcttaaatcccacggttgtcataatgttcgttagaagcccggggagcaatttggtaattagtgatttatccctattgaatgttatgtatacggaaaatttggcaccgaaaaaataatattttggcaccgcgtcatacattccatttattttattttgttatgccaaatttaaatttccagccgaatttgccccaattactcgcaaaagcttttaatggtcgcaaattaaactctaatagctcttcaaaggccagcagtctgacctcctccgtttttgcgatggagaggaggcggtccgatcggatttattccattttaatgatgcctcttgatccacaaattgatcaggaaatgcttgaggggggacggcatgcgccgcttgttgagacggaaaaattgcgctatttaaccaaaagtttgatcggattttgtgctccccactttgatcatccctccttaaacgattgatcggaattgagattttgattcgcttaggtcctgttaattattgggccaatcgatttgatcggatttgtgctccgcactttgatccatccctccttaatgatcgttttatttggacaaatggcttaatcgaagactggtagcaaaaatcactgatcatatttggcctgatcatgatcgtactggaaaatgatggggcttcatctattggaagcaattccaaattactgttaaattattggtcaacttaaattatgatcaattttcagtcattatcgaagtcgtcatgttcatatttcaagggcctaatttagagcatccgtaatctgtaattgcgtcggcagttgttttttataaattgatcagtcgctttttgcgcatctgtccgtcgcccatctgttcactaatcggcgcacgagcgttttgcgtaatttttttttttgttattcatcatcattccttgacataattatctcattacgactccaaccagcaagcaattagtaatcgatccatcattttatggaaaaaaacaaagactgattgatcatttgctcctcaattagtagtaatcggaatacataagaatgttcgtgatcattcattaattgttttaatcggaattcattatgatcagcggggttcaatggcaagttatgaggccaataacaagaatatttcatggtataccagttt

SEQ ID NO: 10596 - DNA, 1611 bp, Heterodera glycines
ttcatgtttcatgtttcgaaatttctcgagttttgtcacccccctcatcgatctcaattctcgatctctgattctcgaggggtcaattcacagtccagtctcaactctcgaagggttaattcccgccttgattaccagtatctcttttctgtctcgactctcgaggggtcaatcaattcccgatgtttgcctaccgtcgtctcgattttctgtctaaaacccttgaggggtcaatgttcggtttcaattaccgagtttcggcaaaatgccaactctccaacatcagcccagtcttattatactaattgtaaatacatatatatatacatagctaacatataagagggatgagtggattagtggacggacaaatggaccatccatcatttttcccaattttatacatttgcacaaataaatgtgtgttttgtttgtcccttctcccgtccgtctcccccccccccccatttttgtggacgacgaccgacagaagacacaattaggccaatcccaaatgcctcccgtccccccccccggcgccccctaaaaatttttccacgtcctttcgtcgtcaacaaaaacaggagcctccctcatttttgcccaacccccctcagctcagctcaagcacttttcttgttgtttatgcagttgtgttttgtttatttttcacggcgggagctgtgcttcctgcatttcctttgcctttcccgcctttttattctccgataaaaaaattttctggcttggcattttgtcatttcaaatttaagtttctcggcaaaattctccaagaaaattgaaaatcacttctttttctaatacaagaattttacccaaaatttacggcctgttttaatatctattacttgattttcccaggttaggcttaggcttagtcctgggcttcaaaaaaaaatcaaagtttataccttagccctaaatttttaggctacgggtaaaccatcatggctaaccccaccttcttttactagggcccctgtatgtagtccgggaaatgttttcattttataatgcgctttgttaacgaatttcgtccaaaaatgacaaatttttccattttagcagattttcatcaaaaaattctggatttttcgataaatctagcgaaattttttggaaaatttggttgcggttaagtctgggggagggtacacaaacaagtaaaatctaaaattttcagcaaaatactaatttttccttaaaaatttcgggtgcggaggggccttggggggggacgatttcgtcagtattcggttttattaattttcctatgggatgggagtgcgtgcccatgtccatcttcctctcccctatctttgcttttctcccatcgctcgtctcgtgtgcgacacttcgtccgacgtcgacggggtgagggtgctacgctattcagcacttctctgtgaaaagatcgctcctcaggtccgtcagttgattttaaaaataaatttttaaatattctaggtgtaaaagaatttaaaaacgaaagaatagtaataaatgttaattaaggttgttaatgctgcttttttgatttgtgaaaagcctgaaagtgtcccgatgaaagtaatttttggacttaccccc

SEQ ID NO: 10597 - DNA, 1914 bp, Heterodera glycines
  misc_feature (10)..(10): n is a, c, g, or t
  misc_feature (1855)..(1855): n is a, c, g, or t
agacactaanttgtaaaaaataccaataactttcatcattttttttttgcaaaaatttggcagctatataaaaatatataaaatgaaaactgatcaaatcttattactaataaatgaaacatatttattgtaaacattcggcatttgattaaggaagtaaattttatgattgaaagcacatatttttctacaaagttcaaaaattattattatcttttgtggttttatttataaaattcttctcctaaatctttacatttatttaatattatatctataaattttaggaaaataaaataagaactgcaatcgataataattttaaaataagatattgtatttattcttgttaccgatagatcgtaattttggcgcagggaaaaattcgtacggtttgattcaagatttttaaaattaattaaagtcttcaatcatttaattaaacgttaattaaattattacatttgtttttgtaatattttaaattaagttatttggacaatataatatttataatttttttaataattctaatcctagtaaattttttaagataaaatacttaaaagttgtacatccatagaatgtgaaggtcataaaaaagaatgccttcattaattctcataaaacattgttttaaacctataatagttaaaaatacaatatggtattaccaaaattaagtaacagattgtataagaagttttttaatgaatttgaaatttaaaatattattacacaatatggttggctttataaaaaacaattcttgtaataatctcaaactaataaatatatttttttataattttttaatacgtctttagatggatagctattttttccgtgacatcaaatattatttattttgttttcattggatttagcacaaagtcgcgaataaaagcttgcaatttatttgattagttctgatgaatatgaatggtctataatgagaaaaatcaatagaattaatgattaaatgaaaaccccccaaaaaaagtgccagataaaatttaaattgaattgaaaaacttttttccgaattaataaatttgaataatttctttaattcaacataaaactttttaatttttgtttgatgatttttttcatataatggtaagaaaaaattcctttttattaatatataagtaaagaaacagtatatttaaaatatttatttattttttaattgttgaaacctccctgttatttacactgttctcccagaatattattaacgttatatttattttgatccttcgttagataatattatgtacaaattcaaataaggtaattcaataaaagaggctttgtcgatggcatattttgtataataataaaaattgacacatttcaatataaaaataaattaagatataattttaaaaaatgctaataacattttgaaataaatgttttgtaaattatataaatttatgcatcaaatttttggagttatgaagctttatattgcatataaataatctttcgtctttaatttgcaaaattttataatttattaaactaaatattaatatacatcgatttattagaacaataaaacataaatttacaagtaaataaagatagggtaatcatactataataaaatatacattatactttaaataaaaatcacccagtcgccctttgtgaatttttgtctaaaatgctccgagtacttgaatattttataaaatgaaataattatcttttgggttggcgatcacactcagctaaattgtcaacaaagacacgccgattttaattaaaaaactcaggaatttcatattgaatttatcttgtacagcaaaaaacattgaagataaaaaataatcgtctttgngatagaattattaacattgagaagcagaatgaatatattaaacaattaatttttttcaa

SEQ ID NO: 10598 - DNA, 4548 bp, Heterodera glycines
  misc_feature (1028)..(1028): n is a, c, g, or t
atttttgttttaaatcactaaaaatgcttcccaacaaaggtacatacaaaaactcacttgagctaattgatattgctgatcactgttttccattgaaatgggactgatcagataacagttcgtctcatttgtgcacattaacagtaacgacagaataaaatcaaatttaatgatgcgcattttgtttttattatataattttttgtgaaaaatttctttttaataaattaaaaatttattacatcgatttgattggctcatttttagagaaaaagaaaaagaaagaggtgagaggggataataaaattgatttgtttgacgattaattgcaatattatataaaaagtcattattaacataaatttaaattggcttgtcatggttaagcgaaagcgaaaacgaaattgcaattagaatccagtgttcgcatgggaaaagctcactttccaaggacggttatactgatttcctaggacataacgggaaatttcgggaaatccaaggacgcgtaaaaatgttatcatacgcaatgaaaaaggattaattattttttaaattattggtatttttcgcaggaatggatcttccctatatttttgttttatttctgctggccattttccacatttcatcgcatgtgtaccagggttgttccgggtcgagaaaaatatcgggtcgggtttcgggtcgggtcggccgaaaaatcatcgggtcgggtttcgggtcgagaaaaaggccgggtttcgggtatcgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataattagcaatgagcgaatacaaaatttcgattccttgaacacaatcgttcaaaaaaattctcaattccttatccacctaatttcacccagacncctttcttaccagtgcttatttcgacccgaaacccgacccaaaattctcgggtcgggtttcgggtttcgggtcgaaaaaaaggccgggtttcgggtatcgggtttcgggtaacccggaacaaccctggtgtgtaagcaaccccaaattcaaaaaaaaatacaaaatttttcaacacatacaaaccccaatcattctttttttgttgactcatttgactatttttcaattcgatctcatacaccatcatttatttattctaggacaaaagccactcctgttatttcaaaaaataatcctgatcttcacagatctccaacaatttctgacactaatcaaactatcaatagaccaattccagaattaattataggaattttatcaaatgttcgatcaattatgaacaaaattaactccctcataatcacacttaacactgaaaaatgtaatttcatagtattagttgaaacatggttgaccccccaaaattctgagattttaaatgcagcaattcctgaaaattaccaaattttttcagcccttcgtaaaaacaaacgaggtggcggagtttcaatcataatagaaaaaaaattttctgtttattcagcctctacggaatcagtttttagatgcgaaattgttacattgaggcttaaaaatctcaaaaatttttctattgtcggtgtctaccggccccctagcacttccctttccaactccaaaaaattctttaactatattgaagaaaaaattataggacaaacactaatattgggagattttaatctaaatagtaaaagcgttaaatggcacaataatacaccagccccttttaacaaaattggacatcactttgtcgaattcttcatcaaaaataaattgtctttgcactgccaaacatcaacgagaggtacagagctattagacctatgcctgacaaatgatcaccgactatcacttgaagcccaaactagggatagcttgataaattctgaccatgaatcgatctatctcaacctatctatctctctaataaaaaatccctgtacaaacatttttttccgtaaatttgattcaaaaaatactagtttaataaacgcattcctaacacacaatttagaaaatgtcacccaaacagaatataacatagaaaataaatacagtcgatttgttaaagaatctctaaacgggcttttaagttttaattttctgaaacgttttcatctaattttaaccagacctctaacagatttattcaaattgtctctaaaatccggtaaactaccaaaaatttggaaaacctcaattattctaccactatttaaaaacggagataagaatctagcatcaaacttccgtcccatttccattacctgttctcctcagaaagcgctctaccaccctccaattaatttcgactcttgaggattggtataatgccatacttctcaataaaaaaatcgactgtatttatttggacataattaaagcatttgacaaagtccctcatgaattgctaatttataaaatagaaaaaattggaattaagggcaaccttctaaattggctcaaagatttcctaaccaacaggacattcaaggtcagaattaatcaacagttttccaaaaaatttcccatcaaatcaggtgttccccagggatctgtcctggggcgaattctatttttgatttttataaatgatttatccccagtaatccctgaaagaatttcgctaaaactttttgccgacgatactaaaatttacttgtgttatgacaccgaatttcaacgtaaaaaactaaacgaagccttacattgcgtctgccaatgggcccaaatgtagggtctacaattttcaccagaaaaatcagcttctctttacctcagcaaggacaattttaaggttccctaccaatttaatggaaagactattaaatagacccaaacaattcgagatcttggaatcttaattgacaacaaactgacttttaaatcccatatttcatctattcttcaaaaagcctaccttagaagcagaacgctttttcaaaaaattaaatctaaatcatcaaagacatgtattaaagtctataaaagctatattaggcccttacttgaatattcatctgaaaattggaaccctcacattaaaaaaagcaattattcgccttgaaaagtttcaaaagttttttaccaaaaaagttttcttaaagtgccatttaccggttttacaatattcagataggttaaaataccttaatatttccactttgggaaataggagaaaatatttagatctgatcacggccttcaaaattattaaacaagaaactcacctaaaccctctaaaattatacaatttatctcaaagaagaaaatcgcctttccacgaaaaggggggcaacaaccgcggcacagcagcagataagaaagaaagcccccaccccctctccctccctccctgtcggcttctcttgccttttcaaagattagatttggccgagtcgcccccccccctttcttttgctgacagccgcttaatcccccccccccttcaatgggtccgtgtcaaccgcccgccaattctctgccaaaatgtcgcaattgcggtgagtgaggcagaagaaatattgaacgaattctgactttagcgatctcaaaaccccgagggcagcagaagcaaggatcgatccctccaaatgcttttcctccctttcccttttccctttgagtgcatttgccccctccccattttttgtcccttttgacttttcccattgtttttaatgggttttcgtcgctttaaaagctgttttggtttaagtggggaggtgcttttccgctgttcaatttggccaaattggctgagttcactgaccgtgaaaatttggacacaaacggccgacactttggcacaaaggcaaaggcaatgaatgggcggagaaagaattgagccaatgccaacaactcttttaattgttcactgtcgaattttcttttccatttctcgccaatatttctttttaatttcgaaatttcttttggtcactcccattttaattttttttttagaattgaaaagtgccaatttgttcttcccaatgttccgttatgagtgcccttcccaacggcaactccctttgaaaattgtttttttcccaaatcgcctccgtctctgcccctctctttagtcgtctctctctctctcttttgtttctctttctctctcttccgatggcatttcccttccggcactttcatccccttccgatgcctacgccttcccttggcctcattctgctcgttcttttgctcaatttggctgatgacgcgtcggctggcaccaattgttctgctgcggatgccacgcgcaattgcgtggacgggtgagaaaagcattggccgattgccagtcgctgatccactgatcagtggtgattggttctgactgatcagtcaatggacgatgatcagtgtgccaatggactgtcccttctcccttaagaatgggcatacccattt

SEQ ID NO: 10599 - DNA, 4225 bp, Heterodera glycines
  misc_feature (4159)..(4160): n is a, c, g, or t
  misc_feature (4188)..(4189): n is a, c, g, or t
ctaaatccatgatgccattttattatgaaatggctaactccgattttcttaatgatttcggcgtaatttttttacattttttgaatcttttcttctttcttgcttaactttttattttatcttattaagtttttcaataattatttttctttttctctgttctttctttcttttttctttaatattttcttcgtctttttctgcccattttctccaaatatttcatcaaatgattttatttcaattttttcttttctgagccaatttttatttatttggatggacaaacaccaaattaaaatcatgcagtgtaatccaatctattactattcatgaaaaatcagagctttcaattgaaaatttcaaaattgcaaaagcatgttttaacagatgttgaccaaaaaatgactagcgaaaaacaaacggagcggcaaaaccctcgtcccgtcaaaccaatgccccagggcaaaagtgacaggggcagcgaaccgccaccccgccagcgcaaacagaaaaataacgaaaaaaattgttataaaattttaaaaaccgggctttttataatattaaatattaaatcattgcatcgcccaacgcactgaaacagcaaatttagtagcaaatgcattaaaaattacaaaattcaaccattaaaatttggattggtgggtattcaatttaagttaaaaatttattttctgaaaattcttgtaaaagccttaccaaaagtggccacatttcgcgaagtgattgtgttcaaaaaaaagcggcattaaacaaaaaaccgggcggaataattttgaaaaggcattatgcttatgttgaaaataattctgacaattaatggcctaaattaaaatatttaataattaaatttattttaaaatttattattttatggaaaattaatgtgtcaattgtcattaaataaagaaagaattcagaactttgagctaattgctttgaaaattgatataacaattagttaagattaaatttatcaatttgagaattaattcactttgtctgtttctgtcaatgttggcattcgcttttctaattttgttcacttctccatctgaatcggaaattggaattcctaggatttcaattgacttaatgagaaatgaggcgaaaacaaatcattgaaaattgattagcctagcaggtggccagccaaaaaaatgttttttcaaaattttttagctttttaggctctcaaattaaaatctagaaaataggcactaataacttgaaaagtagcttaaattagatgaaataaaagcagtagggatgctcgaaaaatcattacaaaacttagcaaaattttgattttattcggctacaggagcggtatcgagtatcggagtcaaaaatcgatatcgaaagcgcttcgaatatgattaagacattcttaggaataaaccacaagataagaacgccacttgtttcacattatttgatcgtttatggcgagttttttcgtcacattttcaatgaaaattgctactttttaaggatgattaataaagaatttccgtaaatgcgatcactgttggaaactgacagaatttcacttaattcggtagtactttatgggtgctttttccgaattttaattgtcaaaaaaaacttttgggtttatttaacgtttgagaaaatttgatcttcgattgctgatcgtaggcgtagtgttaattcttcaaaattgtaaaaaagtgatttaaaaagcaaaataaaaattaaaaaattaaataatttataaattctatttaatagatgatcagtagggcttcttttttaggcataaaaaatcgcgaaataggcacctaaaataggcagaaaaaatcgcaaaataggcattaataggcacaaaaatcctcgaataggcactaaaataggcaacaatttttttttttattaacgctttgtaggtattaaaacaagtaaaaattaatttaaacaaatattttgcttatatttcaattgttttaaagttgttttcgataaaaataattttttaaaccaaaattttatgaagaaaaaatgattaatttttggggaagaatttttgtgaattttttttaaaattcttaggggtgtattttctgaaattttttcaggtcgattcttaggtgtgttttttcatttttattgcatttttgagaaggatttttccgaaaatcccgaaaaggcgccaaaaatggcgaaataggcacaaaaataggcaaataggcattaagcacaaaaagtgcaaaataggcaaaaataggcattataaaagtcatcgtagacaccccaaaccaagcggaaaatgcttttttcgtgcttatctaagcgtattaggtgcgcagaaaaaagaagccctaatgatcagtccctgtaatatacctaatgaaataaatttgaaataaaaaaggttcaaagcgttcaattatgccattcgccgtttacttaagtgccgatggaccaaaacaatgtggcggtgcaacggaagtcgctgagtcggctcgaatttggggacatttttgtaaatgacagagaagcgatatatcttttgatgtaccgtatttcctaaatgccctttaaatcaaatataatttacttagaatttatggaattggtaccattttattggatttttgggtcctaaataatattatctcataaaatgattttatcatacaacttcaaaattgattaattcaatgattgtccatgttctgaatacaggatttatttaatatttggccatttttccatttttaacaaaacaaaatcaaactatcatattttgttaagaaaagatatttatgcctttaatcgccaattacctggctcgtatttttattttattttttcatttctttttgccagataaaacaataaaaaaaatataaagttgggagtttaattttatctgtactgcttggtcttattgtattagtttttgttaaaataaaaaataatttgtttgctcacaatttgcaaccggcaaaaaagaaaaaaaaagacctgatcaaaataaatggtcaattttgaagtaattataaaagcattttatgtaataaaatgattaaaaaaactataaaattaaaataattttacaattcccacttctttctccagcactttcactgttttttgtcattgtcaactttcacactactgaattattgaatttttacgccactttaactcttaggcaattaaatcttgccttttttgatgttttgtttaataaatgataactttggtttttgtaaaatcatcagtagggctgctaattttatgtaaatactttaaatactattcagaaaaattttttcataaatattccattaaataaatctctaaaaaatccccccgtcttcatttattatcggaaaaatcaaaatttaatttccccattagtaaatttgcttcgactaatccccatttttttttgcaatttttaaatttaactctggcttttgacgaatatttccacattttacccgccagggaaaaacgaacggagcggcaaaaccctcgccccgtcaaaccaatgccccagggcaaaagtgaaaggggcagcgaaccgccgcgccgccagcgcaaaaagaaaaatcacgaaaaaatgttataatattttaaaaactgggttttatgatattaaatattaaatcattgcatcgcccaatgcactgaaacagcaaatttagtagcaaatgcataaaaaattacaaaattcaaccattaaaatttggattggtgggggtattcaatttatgttaaaaatttattttctgtaaattcttggaaaagtaaaaaagtttttgagaacttggggggaggaggtccagcggttccgataggcgccgccgtagaaaattttgaatatttaagggtgatttgttaacagattttcaccaaaaaatgacaaattttttgcgattttttgtcaatttgttaagaaaaaatgtgagttattttttggaagggcgatgtgcggtgccattggtgctaaaatttgaaattttgctcttttttaaacagattttcactgaaaattttcgttttttcggttaaatttagcaaaaattaatgattgttatgacaaaatgctaaaaaatttgatttttttacataaaatgtacattttttacactcatacgcnnaaaataccggtttccaattacatgggannatgataccgcgtaaaaatttcctaagcacaaagccg

SEQ ID NO: 10600 - DNA, 2087 bp, Heterodera glycines
catttggagaaattatgggaatttgaaaagggaaattaatcgatatcccaaatttattcatcgataaaagctgaacaaacaaagcaaatggcaaaattagaagcaaatccaatggacaatttgacaaaaaggactaaatttagaagacaatgaattgaatattatttatttattctacggaccatcccaaaaaggagagataacccaataaatagagagagcagagaaaaaaaacatatgtatctgattagaaaaacacaattactttttttccatgtgtagcttttcgtcctgattaaaagccgaatccaaaaaaggcccaacgatagaaatattttattttattttcagaataataagtcataacttatgtaggtatcttaaattgattgaactgaataatagagaaacatttttggtctatctaaccataactaaacttttttaggttcggctaaccgtagtttttttgtcctatgttaaatctgcttcaaattttaaattttaatctttcatatgtttaggtcattatttaaataaataaataaaaaataacaaaagttgaaacgacaacaatatttgccggatttaggctattaattttttatggtctgcttttgtctatttttatgatttttttttcaaatctctcattccttttttattggaaattatgaatttataattgacattttgtttaacattacgttatcactattattattgttatttattatattttaaattacaatacaattgctaaacaatgaaaaagttcagttcaatggcacgcaaatggccaaaaaaacaaacaaaacaaataaatcactttttcttcttccattgccccattttaaggcgattaattcgttgaaacttcggtgaggcgttgggtgggggagaaacgtcgttggcgtgtcactttataagcggtcaaaatgacgtagtaaaaccacagactgacgcacacatccgccaagagaatggccgcctcgcccccttggcccattcgatagcctacggaggggggggggggaggggaattggcatttggattttgggaacggttgttggcactcgttgattgtttttccctcccaaaatgccacctgttctttgcttcttccaacgattgaaattcggcaggggtctctttcaacatttgctgcacattatcttccgatggattcagcatgaaaaggacggacacaaaaagctcacatgcataaatcacaatttcgatggcctttaatgagaagggtaaaaatgtgcatttttaattgacattaaatcggtttttgccctcccattgtatccccccccgggcaattcccccaatttgtgcccccccgctcactcactccgtaaaccaaataagggaaataaagtcgcgggtcacggcgatgcaatgccaaaaggacacaaaggcaggggaaaacatagagaagtgccacgacgcccataaaggggtcgtggacattgctgaagggcaggaagaaggcgaatgccccgagaaagctgtaaacgatgccgatgaaagcgacgatgatggcaccttgctgaagaaaggggggggggtaattagtgggaaggaaatgaaagggacggacggacttctgcactggtgcggaaaattccccaacaacaggtggccttttcagagggatggccagcgccgacgatggcactgctgctgtggcattcgatgggaatcatcgaagagacggaaatgaatgggaagggcgaacgaacgaatgaatgaatgaagaattgttgggggaagggtgcgggaaaagcacaaatttcacttaaatatttcctcaaagtttaaaattccccctgcggcggccactcaatttttctcttggattaaaattatatgaacagaaaaagaaaggaaaggtgatatcggcatttctttgttttctttctccatttcccatttaaaattttcacccattttttgaatttattggtgattttttcggtttttcctatggaaacccccgggggtggggggatgggaagcagcaaaagagaggagggaattgtggggggggggggatgcaattcgctcgtgtgaggag

SEQ ID NO: 10601 - DNA, 2254 bp, Heterodera glycines
gggatgcaattctttcgtgtgaggagatcgaatgaatgatagcgataacaaagtacgggcaaaaaaacaccgggacaaaataaattgacaaaaaatgtaataataaatcgatgaataattatttaaatgcaagcgactttcaatcattggaaaaaatatgtaaatggtcaaaaagtcagaagcaaatgatgaaaaagttctgcaaagaatgcgaaaatcggtgggaaaaatgaaacaaagtgacggacggcggaggggcggcgatggcaccgccgaagaagcgaaggaatgcggctcttttcctttgtgcatcgatcgccaactttcgcttagctttgcttctgcccaaatgacactgaaaatggacgcagtcgcagtgccaccgcccattcgtttaaaatgcctgctaattaacacaaaacgggggtgggagagggggaacaattaaagtaattaggactaatgagtgtcttggatggacgaggaaaagcatcgatctgttgggatggatttgaacagatcaggtgggcctttgaggcgatcaatcactttcagtccttcccccccccctcccctcccatcaatcattcaatggaagaaaagtgttcgaatttcaataatttgatcaaaatattttgacttttctcaacattcccccccccccttttccccctttccccccttttccctttgattcttttgttttctccccctcccgcgcccctccggtcgcatttgaattgtgatttatggtataaattggtgtttttgtggtgtttgcctccttaattttgtcattcattggaaggtttttcggttggtcatgcgactgatcagccgaagcaaagcaaattcagcccaatttctcttaatttgattccgttgcgcattttgcaaaaccgtcgttctctcccattttagacgaaattttgtcaattttttattttgaattttagagtgacaaatttagaaaattgggagggacagaacggaagaaagggaagggaagggaaggaacgggacggactataaaaagagagaaacgcacaaattaggcaattgctcacattatgcgatgtgctctgtgtgtgctcacttttcacttttgcttgtgttttgtgtccccgcggagaatataaaaggccctttaaatgcattcgttaagaaaccaaacaaaaatcactttcacttttcgaaaaatgatcaaatattccttcacttcttcccaaatgtcttcagcacgtactcttcggtaagatttattttaatgcttttccttttttcttatttctctgatcagatttcagtgggctaaacggtcgatcagtttcccttttttccagcaataataatatcattatgaccatttttgagcttctatttgcctgaacaacacttttgctctctctgtctgatcatcctaaccgttttctctctatctgaccaatctgatcacttcttctctgtctgatcactttaatccctttgcttttttccttttccatctctgatctctctaatcatttctctttttcagtcactctctccattttgtgctctctgtgctccttctgctcgctttggccaatgtgctgacagtaaatgccactccgttgaccattctgacccgcgagatcagtcccgaggctgtggccaacaaattattggcgtcgttccccgaggggttggaccacatggaggaacagcacttgagagaggcgcgattctttggccaacgatgaaaaagagaagcgaagggacggacggaccttttgaagaatgatctctcaaattatgaccagttttttggcaattcattaaattttgattgttaaatggatgcaagaaatttctgccaaattggcaatcgaagaaaaaaaaagcaaaaaaaaaaaaaaatgatacaaaatgagcgaaaatgagcgaaaaaaggggggaggggcgaacggagtgccaatgccaaaacggaaattaagttttaatttttcaaatttgcatcgcttttccctgtttttctaaagactcggaaatccctttagcctttcctttcgcaagtgcacgtcccccaccaattccccgtgccaccgccccctcctcaaataatgccacttccacccttccacatcagcaatcgctttggcattttcctccttctcatcacaaaagccgtaaaaatcgatgcttttctttcattaattcagacattttttgactgtcagtcactaaaaagcaaaaataatttattataaaataa

SEQ ID NO: 10602 - DNA, 2252 bp, Heterodera glycines
aatagtatcattaatccatttgataaaggctggaaatccccctaagcatttcaatgatcaaattccggttattttgattttggccgtattggtgatcatcgtcgatttgcggctgcgttttttcctcattgtaacggtgcaaaatccttagaattcttgtgtccgtgtcgcggtagcgttttgcttttggcggcggagcatttccggcaaggaaatgttcgaagtcaacgtcgattactttctggtgctcacgcaaaatattgatgaatttccatattgttgggtgtccttgtccgatcgcatgttgcaacgtgcgatggtacgcttcggcgaagttgtttgtgcggtcggtgccgttcattgtgcgctcatacacactccatgcttcgggacgaaacaaaagacgagtgcgtgtgccattgttgcgaagtcgcccaacgtagttgattacaaacctttaaagtcaataatgaaattgaaaaaaaaattaaactcaacaaaccaatcgagaacgccctcaagttcacccggcagatgatcttctagggctgccagcgccggtgtaaggtcctcaagcggcacaaacgccagcgaagtgaccattttggcgaattgtgcaaaggctgcgtcagttttgaaacgctaaatttgagaatttcaaaagtaataaaaaaaatttcttacgtgagtttgctcgtcggtaagacgtgctttcatgttgcgcaccaaatggaataggcaaaagttgattgagcattgtggatgtttggcacggagggcgttgaatcagcgagaaggaaaagctcttgcgcttcttcggtgcgtttgtaaatcctgtactgctctgggagttccaattcttgaagcgttctcggcactggcggcggcagttcaatttcatggcgtactcgcttcaccagcttgaaatcaaaaatgaaaaagtaaaaaaaaaagatttcacttttttggtggcgttttttgtcggaatgcttgccattactggagtcgggatttgatgaagcgtgtgggctctgattgctgctggcgtttccatcgtctcagcggcacgtcgttttatgcccgtgacgattttctgtgcgacgacatttgccgcgctgtggcgacaagtgtgctctccaatagtcttcagcacgacatcattgagtgtcgagtgaattctccctcggcacttgaattctccgtgttggtgttcacagcgccagaatttgacgttccaatctgcatttaatttgtgaaaaacatacaagcagccattgtgctcgagttttttatagttccgttgtgatttaatttcgaaattgtccatttttacgctaaaaatatgtaaaataaaagttgtcattgtttaaaagtttttctttcacaaattaggaacttgcataaatcaaaaactaaatcggtcattgaaatcaagacttatgaattgttcatacccaaatttattttttaaaaattcttgaatttttgcttgggacagagttgaccctttttgtattgggacggagttggcgggacggagttggctcgggacggagttggctcgggacggagttggcctgggacggagttggcgggacggagtgacccgcttcggtcaggcggtgccaataggcgccgccgggaatttaaaaatttgagtgcaattttttaacagattttcatacacccctaaagatcaactttttgagaattttcaaaaatacacccctaagaatcgacccgaaatttttcaaaaatataccccttagaaatgaaatttttttcaaaaattcatctccaaaatttatttatttactttcttgacaagaatttttaattttaaaaattatttaggtatctcaatattaatttgccataattctgtagcttttttgaataaattttgtcattttacacgctaaatttgaaaggttttagcaactatttccccatttttagcaactattttgggggtttattttggcgctttttagcaactataaatcgaatccctaattatcagaagaaatttgtaaaccaagagagtagtcccatttggttttaaaaaacattcaaaatgatcatttgttaagtagcaccgcttttcttattaagcggagaaaataatgaactctttgttggcctacggctcggacagtgacgaggaggggcagcaccagcaaagccgacatggccaacctgaacctgatcaacaaccgcgggaggagcagaaacagcgaggaaatgggggt

SEQ ID NO: 10603 - DNA, 1210 bp, Heterodera glycines
gcggcttagttatggcgagagaagcccaaaaatagcattatctccgaacaatttttgatttagagcgacttataaaaacataaaaacacatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttagaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctactaataactcgaaaagtagcttaacaacagcccaaaaaaacatgtttttcgtgcgtttcaggccacggggagctcaggaaaaaaatatataaaaacctaaaaatcgaagccctagtccacacaaaaaaaagttttaggctgcgcctaccgggtcccttaaagttgattaggcagctgatccctcctccatctattcaaatattattatttttgccacaattttttcctctctctttaatttgggataaaaattagtttttgtcatttttgtaatatttttcctatttgcttatttctgaaggcacggattgtgtgatgtatgtgctaattgtagcggaaaagccaactattgcagaggaaatcgcaaaaattttgtcaattggcaaatacgaaatacggagaggtgaagaaattcattaaaaataaaataaaactgaaaactaaaatattaaatttttttttgcaggatggaaccgcaaaagtttagtttacgaatgccgcggcgaacttcgtcgacaaattgtcactttccgaattacgtcgacatttggacacattatgagtaagtaaatgtttttaacaaaccaatt

SEQ ID NO: 10604 - DNA, 829 bp, Heterodera glycines
  misc_feature (30)..(30): n is a, c, g, or t
  misc_feature (166)..(166): n is a, c, g, or t
ttttagggctcgattttcatcgatcacccncaaagagatcaaacgggcaatggatgaactgggcaagccggacttcaatgtgtcacagtccgtgctgtttagacaggaaatcgacttaaggatcggatgtgcgttcacccgctttctgacgacgcattccggggtntaatttttgggttttcaacaaaatttcattttttaaatgcagtatcgttattgcgactttgacaacaattacgtttcgctggggccatgccaaacgccgacattggcattttgtgtgaggcggcatgacgcaattgggcagttcaagccccagccgtactgggtggtgcaagccgaggtaatccccctcccatcatccaccgattcctgttgagtcatggccaaattgcaaaagtgaactcattaatttcctcttattgttagtatttttggaaattgcaccgaaaaaaaagattggattaaaaaaaaacgctttgtaaagatttattagttttttgaaaaacttagctattcatcataaaaattatgaaaaaaaatcgctagggaaattcttcaattttatttcattaaaatttgttttaaaattttctaatttcaacacatttattcaggtcgaattgccaaatggtggccaatcgctgacgttggaatggtgccgaacgaggcaattcagtcgcgaagctgcgcaaacactgctcgacaagatgaaagtatcggttttttttttattcaattaaaatgcttattccctgtaaagtgtgcccttcccggaggcgaaaaaaagatttcatctatttttggcaccttttcgggaactcatctg

SEQ ID NO: 10605 - DNA, 1190 bp, Heterodera glycines
atatgaaattcttctatatgcattttttcaggtttcccaggtacacagctgatccaaatttgtcgtgaatatttggtgggccttctgttggagacggcacggaaagaattgccacgcgactccgtggaggatggtaaaggacattttttaaattgaactttgattttttcttttccagctaaacgcaacttggagatggccgcctatttcacccattgcgacattcagccggtgcacaagattttgacactgcgcaccgccgccaatctgagcttcaaaaacaaacaaatgcgccactgtgcttcgttctgtcgacgctgcattgaattgggtttgaaaacaaagggacatcaaagtgttaacaaaatttattgcatttaaagctcctaagccggaaattgccgcccaaatgcgcaaaatgttagcggtggcggaacgcgacaacaccaacgcgttcgaggttcagacatttaaaatctccattttgcaaacattgtttccactgtgcagctcaactacgacgagcacaacccgttcgtgctgtgctcgcgctccttcgtgccgctgtaccggggcaagccgcagacaaagtgtcccttctgcggcgcttcgtatgcgcccacatttgccggctctgtttgcgacgtgtgcgaagtacgtcgtttttgtaaaaaggaaaaaatgccaataaacagatattttgtttcggtacaaaattagagcgatgaacctgggttccaggcctggttttttcctggacccaggtccagattctgcttattttcggcaaactggtttttttcttgacccagatttttccacctgtctaaaatctgttcattttctaaacaatttccatgtggaaattagaatgtttccctgaaacgaatgaatgtcaaaccaaatttgtcctttttataatgtgcatcactatttttcaggtggcggaaattgggcgagagacgtcgtcgaatttgatgatttctaattttaaataattcactgttaggcttttttcatatgtcccactaatattggtgataattggcggttgttttttttccctctcccaacactttttcgtgatgttttccattcctgcattttctctgtttttttttgtgtgtgatttgcaaaactaaagaaaagtgttccaagcaccgaatgaaaatgaatgatattattcaaat

SEQ ID NO: 10606 - DNA, 2001 bp, Heterodera glycines
attttgtttaccaatttaagacaattagagaatcgctcaaatttttaattgtacactcgcaaaatgagtgccaccatcagcagcacagctgacaacattgcgttgctgaagcggctcgagcccgcccaattctacgagcaatttctggtcgagggctgctacccggacgggcgcgacattgccaaacaccggccgaccatcatccaatgcggcggggccaccgggggccatcaggcgcgtgacccattaattccatgccgacccttccgttggcactttttggagcgggaattcgcgttttcttttcggctccagcggaaattcctctaatacagaaaatcacaagctaaagctttaatgagcggtccaatgcaatgagagtaatcgtcgtccatttgtcgtctttttcactcggataagtgccggaatgaagtggccaaattctgccgggactttttcccgtgccgaagtcttttcagcgcggtaaaacgcaggagcccacaacacatatttccagcgtattttgtccgtttaagtccgattcagaactttttggcacaaattttgagtttggcgacagtcagcttgatacggggggcgggggaaggaaatgagctgctcccgttttgtatgcataagtcctcatgtccccacagggttccgcctacgtgcagcaggccggtgcccacgtgtcgtgcgccgtccaactcagtctggcgcccgactcggacgacccgctgttccgttgggaactgcaggcgatggactccgtcccgaaggtgacgaaatccgggtctggagtgtccaattgctgccgggactctacagtccaacgctcaaaataggattagagtcaaaatgccaaaaattactaagaaacgcaaagttgaaattaaatcacttataaattagcatttggacacgtcaatccccgggctgtaactctccagggagcgccttccgccaacaaaatactcattaggattaattaattacagacctagagaattgcaaaaaaaacaccgaaaatcgactgacgaatttttccatggacaggacataattggtcaagcgcaagcacatttgagcaaaatccttggcaccgacaatttgttgctggatcccacgcagatgcgggtcacgacacggagcagtggcaccggcaaacagttcgaactccgctggaccatccacttgggcatcgtggtaattgagataaacagttgaacattgcgtacgaactctcgaatccaattgaaaagttttcgcatttcttcagagcatattaccgtaaatccggtagttgaaggcacccctccaatcaaaggcccccttttggaggggttgaacaatagaaggcccaggccttcaatagaggatttattgtatattatttatttattatacgcctgatagaacgccaaagaattaaaagatacagtaaaaatggggcgcttgttctcggctcaaagcttatgttagcaaaaacataattgtaggcaaaaatgatcatcgaaatttgctttaaatttaattatttgtttaaaattggaggtgctgagcacggacggcttcctcctcgacgcgctgctgacagctgttcaagccgcactgcttgacgtccaagtgccgaccaggcaatgagtttgaattggtggcgattaggcggaagccccgagagggcaaaataatgcgatgttttttaatggaacggtcgatgaaatttgtcaattttttgaacaaaaaaactactgtttgcacaatttccaatcgaacttctccagggttgactacgcggacggcaaggcaattgacggtgtgttccttgagggagcacaagacactgacgactttctgcttggcgaagaggtgttcaacttggaggccgtattttttgccattttgagtccatttttcaaaattattacaaatgggggtccccgactgtgccataggcgattttatgtaatttttaaggagtcgtagcttaaggggaaaaga

SEQ ID NO: 10607 - DNA, 1901 bp, Heterodera glycines
gcagatacgtgggtgggttcaaagaaagactttgggggatatttgtcctaaaattttgataaacagggtaattatgtagaggcataaagctgctactcaaaagtctcagacaattccaataataataataaatgcatttataatcaatcagaagaattgctgtaacattgtttaattcaaaatgctccgccaattgagtaacaaataaattcaagagccaatgtcaatgctgtggaaacggacattccatctgaatttaaaaacataaacaacggcagtgaaattgattagccttgcgaaaacacagcataaatgacagctggtatccattagaaaaatttgacaaaagacaaagtccgttttttagttcaaatttccgatattaacctctgtttgaggcagatacgttgggtggttcaaaagaaagacttttggggatattttgtcctaaaattttgataaacagggtaattatgtagaggcataaagctgctactcaaaagtctcagacaattccaataataataataaatgcatttataatcaatcagaagaattgctgtaacattgtttaattcaaaatgctccgccaattgagtaacaaataaattcaagagccaatgtcaatgctgtggaaacggacattccatctgaatttaaaaacataaacaacggcagtgaaattgattagccttgcgaaaacacagcataaatgacagctggtatccattagaaaaatttgacaaaagacaaagtccgttttttagttcaaatttccgatattaacctctgtttgaggcagatacgttgggtggttcaaaagaaagacttttggggatattttgtcctaaaattttgataaacagggtaattatgtagaggcataaagctgctactcaaaagtctcagacaattccaataataataataaatgcatttataatcaatcagaagaattgctgtaacattgtttaattcaaaatgctccgccaattgagtaacaaataaattcaagagccaatgtcaatgctgtggaaacggacattccatctgaatttaaaaacataaacaacggcagtgaaattgattagccttgcgaaaacacagcataaatgacagctggtatccattagaaaaatttgacaaaagacaaagtccgtttttggttggatgtactgtaattgttcgataagaaatacggtaagaatattgtctctcccctcctatttgatcggcttttctggcattgcttcatagtcgatcatgttagtgtacttcacatttggttctttttcgagattttcaccggcaaaaaatcccgaaattttgttgcgatctttgtcctttggttatcagtttttctttcgaaatttcgttttggcactaaaatgccacacagtgacaaaattcacgtttcataagaaaaaaaaattaattaaaatatttcgatcatttttatggcattttgtgcctatttcacccttttccgaagaatttttttacaaaaaaataaccattaaatacatattttgagcactttttgttacacataactcgtccactttaacaccttcaattttgatttgattttaattcatttgtataatatctttctaaattaataaatattttcgttcgtttatttatttataaaattaatttattcatttttttttctctttttccatcaacgggatgggatttctacacttttttcacagtttatccatccccaccacttttctctgctaaacaaaatcatccgacaaaatcggttgtcaccctgcagtatcctgcaaagtttgatgagcttctgatcattattcgaaaaagtatttgggctaaattttttcggaaagggaaatatataaaaattggaaaatccaaaaattttaggaagc

SEQ ID NO: 10608 - DNA, 2369 bp, Heterodera glycines
aaaataatgacaaattcttaaatttcaaaagctggtaattttaggcttttagtgatttcaagactttttctttaataaaaagattttcctttaaattagagcattcattatattttttgcgttttcatttacaaaatgcgataacaactttttacaataacataagcagtaaaataaaattgttttttttctagtgattccccccccccccctccccctctcattttttgtgcttttttctgtcttctggcggcacttttttgttggatttcaaagaaaattcgctttaaaattcgcttttcgaattttcctctgagagatcagcacacaatatgagacgatggacaaaagtagtaaataccatcagcagaaggaatccaacaaatttgttaaatgcattttactcttttaacgccagatgtcatctcaaaagtttttacgaatgaaaaggccaacaaaattgtgctattatttggattcgcaaaacaaacattttgcgaataacagaaaagaagcacctgcctgctggagatgatcctttccttatctcttctatgaaaaaactttgtgcaatttggtcaactattgttttgcccactgtgttgatcatcccattctttcctgtgcccatttgtccaccccctcacattatgatttggcatataaatgggccactgccggtccattgcacccgtaaaaccattaatactatcaaaaattaggtactttcccattatgagaccagaagccaaaattttaaaaaatcaacaaaggggcgcgcgcaaatttcaccgtgaccggacatttggacagtggacattacgacagtgatccaaatgtccgggcgccaattccacattcccaccgcataaattaacaatttgaacaatttcgcccttcccccacccgccgccgatgaatgcataaattaacgcactacggccgttatttttggccaaaccatttcacattatccacgattccaaaatggccgtaaattttatttgccaaatccaaaacacacccctctggcgtgaacattgcaaacaccgaggagctgaaaatttatataaaatgaccatttaaacctgttttttttttttgcagaattttcctagtcgtacaaaaatctaaccctgaaaatgggccaaatgcttggtgtggcggtagcacttggtgcctggtttttcatggatcgatcaatccgcagatgtgaaatgcgagccgttatgtctcgtgaagaaaaacctcccatcaaacacttgcttgcgctgcatggacgttctgatttagtggattgcttttacaacatattggaaaaaaaagtaatgacaaaataaatggaagtgtgggctttccgcttatttgttagttttttaatttccttttttttttttgattttttggaaaggaggtgccaaaattgcattgaattcaccccttcgttcctattttaattcataactaaaatttgaaaaactttaagaacacaaaggccatggagtcggtaaagcagcaattgagcgacctcggcttggaccacgtttccgacgcatttgtggagggctacaagcgagttgaaatggataataaatcaaaaaataaatattttaattaatattcaattcctaactttacaaaacatttagcacgaaaatggtttgtgcaaaatgtgccaaaaaagtggaacacatcgatgagctttgttactgcatggaagcggcaaataaatgccaccaccgtaattggtaaaaagacaatgaataaaaaaattgttttatttttggcttaattcacttaattgtttcggattgatttcggacttttcatgcaaaaatttaaatgagtaaaatgaaatattaagaaatatatccataaacagttttttttaaaatatgttatcgtttcaaagatttattgtgaatttgtctctattattttagctgttcgagccgcaacaatcgtgctctgacctactactgattttgattggatgagaagaaaaaagcgattttaggcccccttcaaattgaattttcatacaactaaatttgtaaaacaattttttggttttatttttgggttttttaaaatttaaaaattcaaaaaaaaacaattttgaatacaaggttaaaattgccttttattcataatttttataatttattatatttatattatgatttcacttctaaaataagaaaaaaaatcgacaaaaatgtctttcccatggagcagaagtagcaacacaaacactggaaagcatttaaatgtaattcacaattaaattaaaaaagttattttcaattgcttatttaattgattttcagaaatagttgcttcctcatcgagtggctttgcgtgcgtca

SEQ ID NO: 10609 - DNA, 1261 bp, Heterodera glycines
  misc_feature (16)..(16): n is a, c, g, or t
ttccgtttattattanttttgggctgcaggattaataattaccttttttctaacttgctatggcctaatacgcacgaaaaacgagtttttaacttggtttgaagcttatatcttgaactttttggtgcatttttttgccttttttttgcgattttagtgccttatgccggacacgtaattttgttgccttttttgacctttgtgcctttttcatgccttttttactatttttttgaaaaaaatagtaaattttttgaaatttttgcaacttttcctatcatattttattacaatttccaaaaaatttccggcggcgcctgacgacaccgccggaccctcattaccttgatttttggaattttaacctctatgattttactattggtaaaaaattttgaaaaaaatttcgcttttcgcatttcgctttttatttttcaatttggcccatccctggtgtatatcaaacagcaatgaacagattcttttcttcttttggcatgggttaaaaagattaaccgccccctcttcacccagctttttgcaaagtaatgcttaatttccgaaaacaaaatctgtgctttaataatgatgttgggccattgctaattatgatcttaaatagattcatccaaacaaataaaaatgatgaataataccaactaaattgattgggacccgatgaaattgatttacgcattttctgaccgtccacggctttaaaaaatagattaaaagttagaaattttgattttttgttttttgcttgctggcttaatatcgcggcacaaaagtcggcaaaccgttcataagtgtatctcttttatgctaatttagcatattctaacaaatttacctcgagaattttcccgtcgcaaatgatgggtgctgaaaattatatgtgtaaaatttatggcatataataaggagggttcaattttatatatgctaaaaaccctcaaaatatgttaaaaagcgaaaaaaatccaaaaaatttctaaattaagtgctaaacactgttgaaaaaaaaaattaaaatttatttaaacaggctatttttctccaaaaacgctaaaaaagacataaaattattttacacatttctctcttaaaactagggttgctccccgacccctcggggggtaaaaagtcgggggccggagacctcgggggggcggcatgtcggggctcggggcggggaataggcccaaaaatgtcgggggtcggggaccggggagctcggggacggggagcaaccctactt

SEQ ID NO: 10610 - DNA, 4503 bp, Heterodera glycines
  misc_feature (3467)..(3467): n is a, c, g, or t
  misc_feature (4395)..(4395): n is a, c, g, or t
  misc_feature (4399)..(4399): n is a, c, g, or t
  misc_feature (4401)..(4401): n is a, c, g, or t
atctcttattatgagtttcagtaaataaaatgagtccctcccaggagaaacaaatgcattaaaatgtcaatgcgaaggctaaataattttataaaatttgttataaaaaaatcgaatctcacaaacaaataggaaaacttcaaaaaaaagaatatgcaaataatttattatgaaaacatttattttttactctttttctgccattgccccttagcaattgaatttttttctttaaaattttgaattaatttaccatttgatttcatttcacttcaaatcaaattataaattttgtttgagaatcaattaaaatttttgcattcgaaacccggtcggaattccgaacacgtgcaaccctacttaaacatatataaaaactgaacgaagattatttgggttttaattaaaatattttaaaattcaattttagagaaatttatcgccaaagattaaaaatctgtaacataaataattgacaatatttttaaaaataggcacaacactttaaaaaccgagcaaatctcaaaaattattaattttaaaatggtaaaataagctaaataacaaaaataaatattttcataatttcggttcattttgtggacagaatctatcttttaggacgaattgtgctgagttttcaaagtgaaatagaaaatatttataatgaaactgtttgttttattattttttttgtcattgccccgggcaattgaattttttaaattattgaattaatttcccatttctttcaattaaaccaaatcaattggattttttgttgaaaatcaattaaatctttgcattaattcgcccaacgaaaaaatccgccaaaaacacttggccattgttgtcggcactttggtcgtattcatctccgattttttcatcttcttcaatctgtccccagtctttggccatttcctcgcagttttgaccaattgaaaaccgtcgcgaaacctttgactgcttcaatttcatgtgccttggaaaatgataaattttaactttcaaattataaaaaactaacaaattgcaaatattccatgccaaacattgcaatttatttttgatttccgcgggaggcgtagaggacaatttattggtggtggtcgaagtactcgtcggagtagtggaagagaaagttgaactcaaaatccaaatttaaaagcatacgagaatcatcaaaaagtggattcaaaaatcataaaaattgccaaaaaaaattacaaaagcggaaaaagtcggtataattttgtggtattattgcgaaaaaaaggcaaattcgaaatttgaaaaaaagataaggaaaaggaaaaaccaaaaaatattgtgaaaagtatgtctaatttttaggatcaccttttataattcgatttcggggtgcttttttatttatcatttattcccataaatgtttggaaaagttgggggggggggtatttgttcgtattaccgtaacttcctaattacggtatcaaattttttccattattatttaagcggggactataatattatattagaattagagatcggatgattgatcatttaatgggtctttttcaattttaattgaattcctttgtccggttaatattttactttttccaacttttgttgcatccgtccgtgttgcaaatgtagcaacatgctctcccgccttgaccttcgcactcactggtgaaatgcgtgcaattgaccatctccggcttctgacagtccacaatatttggcacaatttcgtctttttctaattgcatttttttaaatttttatattattattttttatttattatatttttacttttcctaattttgtcaatgcatcggacataagcgcattgatggccagcaacagggcattcataaaggtccaattggtcttcagggtcaaatttgcctttgggactgaactggacgaaacatttcaatgctaaagagtttcagaaaattcttaatgttatatttttattttttaccaaaggctgtgtacaaaaatccaacggagaaaaaagtgatcgataatcccagcatttaattattaatttatatttattttttattttccttaattttacttttacacataaatatttttcaataaaaacactaaaaaaataaatgagaacaaaataaaaataaatgttaatggtttttgaattgtacgaatgatttatccgatttaacgggctgagaatggacataactaaataaatggttgttgctgattcattggtaaggatgggattcttagttttttaactattttttctgcggctttaactcgacgagaaatgcacgaaaaacacattctttttcgaaaatttttcatttttagtgccactattcatcactaggaatcactattttggagctttgccactaaaaaaaactatttcggaagttggccactaaaataattttttgccactattttggcgtttcgtcattatttttgccactattttggcattgaaaatattttgtaactgcaatcagtgaataaaatctttttccttaattttaaattattttcaaattaaaaaacagctatttaaaaaattacacccctaaatttggaactttttcgccactatttttaccactattttggcattttttggtcactatttagttaattattttgagattttttatcactaaaaatcccatccctattcattggttttctaaaaagcaagccattgcacaaataataacaaattctcctttctatcgattaaattaaaaataaaatactttatttagcgccgaattttccaaaatgaaaaaataaattataaatgataagaaaattaaacgagtggttcctcgagagtcttgggcagagatttgactcgagatttcacgcctgttacgacataacaattggacaaaacaaacatttctatcggaccagaagttttcgctgaaaatcttccttttcggccgacaaccttttcgagggcacccgcaaaaagtcacgcaaccctttttttacagtttatttttttttgatttttaattttttttggtttttttgacaaatatgaaagtccatggatttttttagccaaaccctcaaagaatggcattattactttttagaaaacataaagcttaaacattgattgaatgttatagcaaatcctactggtgcctcaatgtaaaaatagagatcattgaattatttagtgaaatatcaattttttaaatgcatttacaaaataggcaatgcccatggatgatagatatagcaaattataaattttatattagctatagttgctataatgctatataaatttttacaaggtgatcaatgttgtataataaaatatttttaaaaaataggcatgtccatgggtaatagatatagtaaattattaattttatattagctttattgctataatcctatatactaaagatgaatgtctgtcagttcccgggccataccgnttcgtacagcacacaggttttttgactttaacttttttctttgtcaaccaaatccaacgatcttgatatcattcgagagcccttcagatgctctattagcctgcaaaatttcaaaaaatttcgttaagttttaaaaaaaagttcgggccaaaaatttggaaaaatctggttgtatgaattcttctggccataacttttttgagccttaacggtacttttcgaaattttgcaggctaatagaggtcacttagggctatcgaaggataccaacaatgttggatttggttggcaatgaaaaaagttatagccaaaaacttgtgctcgtacgaaaacggcccgtactaaaacgaccccgaccggtcagttccagtttatgtggcgttttgtttttgttttgcgttaaaaatgcatttgaaaaatgaaatgtttgttttcttttttatttgttttgattaattaattaatgatgcgccgaaggcgctaaccccgctagtgctatattaatttgatcattttagttaaacatcgattgtttttaattttggcgtgtaaaaaattgctttacaatgcaagcatttttcttaaccaagtaaaagagggaaactttggtgccaattcgaccactgaattgattcagaaaaatgcgactggcattttatgcaatgtaaaacgaaaatggatgaaaatttgaaaaaattgcaaaatgattttgcgactcaattattagcaattagtactgctaattaacctttcaatataaaagacaatcatatatggagaaatcacaaacaattttatttatttaagatttttttgattcctttatttattataaaaatgaacgctcgagaaattcacattattatttttattttttcatgaatttttaattgtcttttgtctaaaattttttaatcctttttattangggntncggaccccgcccccgtcaccccgcccctgccgggggcgggacaggttttttggcctcccccccgtgcccgtccccgcgactctgaccccgcaatccccgccc

SEQ ID NO: 10611 - DNA, 1175 bp, Heterodera glycines
atagggttcggaccccgccccgtcaccccgcccctgccggggcgggacaggtttttggcctcacccccgtgcccgtccccgcgactctgacccccgcaatccccgcccccgcgaccttcgcccccgcgggggcacgggggtgaaaatatacccgtaagaatggcatattcgtgggataaaaggcaaaaaatttataaaatttgaatttttaaccatctttgagaaattttttttatgaaataaagtaaattttgctgttaatttccaaaatatttgtggtttagtggttagtgcttcaaactaatagtatttcttgttaggagttcgacaccggttgacgttttcatttgaatttatttttatctaattaatgcagggtttctttatgttcttatttctaataaatgttctgattttagggagtattttcatccaaaagaatgaaatttctgaaaaatttggctaacttctaacaaaattcattaaaaaaattccccccggcggcgcctatcggtaccaccggcccccaaaaaacctattttttcttaaaaaattagcataaatcaataaatttggtcattctttagacaaaatctgtgtaatttatgccaaaaggaattgaatcgaggcgatacaccgactaaaggaatgtggagccaacacatcattcataaaaattaatttttttgtgagattttttggagctaattcaaatcaaacccccggccccgtccccgcgggggcggaatttcgtgctcccgccaccgcccccgcgacccccgccatcccccgcccccgcgaaatgccactcccgcccacggggtccgaaccctactttttatgatttacaaatctaaaataaaggtgctcaggcccaagtccaagcaaaaaaagttcttcaatgtgtttctgcttcaaaaagttaatatttttgtttataaaattcataattcaatttaaaatgttttccaatttgatccgtcgttttttaatattattttttaaaatttaatcttaaggaaaaatgaaacttaatttagttagttcattttcggtaggggtcaattgcttcatgccaactgcgtctgagatagcattaaaaagccataacatttttaagcaacccataaaatttaaaggttgaaaattgtagaaaattataattttgtatattt

SEQ ID NO: 10612 - DNA, 1543 bp, Heterodera glycines
gatgttagaaaacctaaataaatcccataaaattctcctgatttttctctatttttaaagctttgttgtatgaaaattgacttaccctgaggttagttatgaattttcaaatattaggccaaaatcccgagggccaaaaaattgccaaaaaataaagaatttttaaaaaattcccaaaattctgaaacttaaaatagacatcatattcgtactcagcaccttattttaccccagaaaaatatttttgaccccaattttcaacccaaaaaaaattttcgaaaatttctagggggcctagctcgaaaatttttgaaaatttccgaacatgttgcacatcatccgatagagcttaaaaagctctacaattttgctcttaggccatttttggctaaaaccaacccctaacgagttatgagcccgggactgaaatgtcccgcttaggccaaaatttttttctatttccgggaaaaaatcgaaaatttttcaaaaaaaataccagtcgatagagctcgaaaaactatgttttggaagtggtcttcgtttctctgggaaaaatcgttaaaaaatcctaaaattcaaaaacccgaaaaccgatttttaggcctagctcgaaaaattttcaaaattttcgaaattttaaaaactggaaaaatccagctcattgaactctacaataagtctgctggcaccccctcgctcagttcaaaccctggcgagttattcgcctgggactgaagtgggcaaagttggtactgaaaagttctagaagcacccagcccagggggttagagctagaggcctagaattttttttaacttttaggcaacattctcacttagggccctcacagcgggaattttttgatccgagaaggcacaacagtgattagaagtggtacaacagtaattagaagaggtacaacagagatgagaagaggtacaacagtgattagaagtggtacaacagtgattaaaagaggtaaaaagtgattagaagaattacaacagtgattaaatgacgtacaaaacgcccgtttttcaaattttgttgggcttggacgggcgttcagcaattatctattaataaatttaaaaaaagctgaataaattaattttttttaaatatgttaatatatacaaaaggtttaaaaaaaatgaataaaccaagtattatgtaaaaaatattttaaataaattatatatataatttaaaatatctaagaataaaaataattatgctggtgatatgctccccacagacagcccaaaaaattttaaatacaaacttatttattcaaaaaattctttgatactcaaatattttacttaaatatactagattaataattttaattttaatttcttttttacccatctttttctaaatttaaatgtattattaagtacgaggacataaatttataaaggcggcaatctgtatttgaaactaccattaatcatcaaaagagattatttgctaaattatatatacgttagaatgataaggcaactcatctcaaaaactaattccggtcggacgaagg

SEQ ID NO: 10613 - DNA, 3842 bp, Heterodera glycines
  misc_feature (3828)..(3829): n is a, c, g, or t
ttttcagaaccgaggtataaatttttttctgaaaaatcgacaatttccagaaattctggaataactttttttcttttgaagctagaaatcccaaataaatcccataaaattctcctcatttttctccatttttaatgctttattcattcaaaattggtcaaaccttaggccagatatgaattttcaaattttagcccaaattcccgatggccaaaaaattggaaaatattttcgaaattttaaaaaattccaaaaattttgaaacgaaaaataaacatcatattcgtgctcagcacctcaaaataccccagaaaaatatttttgacctcctttttcaacccaaaaaaattttttgaaaatttctagggggcctagctcaaaaaattttgaaaatttccaaacataaaatacaccattcgatagcatttcaaaagctctacaattttgctctaaggcaatttttcgctaaaaccaacccctgacgagttatgggcccgggactcaaatgtcccgctgaggccaaaaattttttctatttccgggaaaaaatcgaaatttttccaaaaaaattaccaatcgatagagctcgaaaaactatgttttggaagtgctctccgtttctctgggaaaaatcgttaaaaaatcataaaattcaaaaacccgaaaaccgttttttaggcctagctcgaaaaattttgaaaattttcaaaattttaaaatttggaaaaatctggcttttaaagctctacaataagttcgctggcaccccctccctcagaccaaaccctgacgtggtatttacctggtactgaagtgggaaaaaaaaattaactgagtctccgtgtctgtacaggtccgggatttggtctgatcaaaaaataaaaaatactggattatagaggacacttctgcggagtgccctcacagcgggaattttttgatccgagtttcagaaaaaaagttatgggctaacaaacgcaagaaaaagtgagaaatcggtccccgggactcagtcgtccgcgcagaatttttctctatagttttcccggatgctcctcaaaaagttgtaagacccttccactactttcagggcgctcccggccttcggccgggagaaaatggttttagcaacgaaactccttgtcaatataacatatatagtaactagcgggtgcgtgaaccgtcggctatttagctggggaaaagcgcttcgcgctttgggagcttcgctacctaggctgtgaagcgattcaaattgatcgaattggttggagagatttttttgaatttttaaaaaattattaggggttttttagtcaacatcgaggctcaagacgggcgcttcgcgcccgtttttcaaattttgttggttcatacgggcgcttcgtgcccgttattcaaatttttttggccttacagagattagaagaggtacaacagtgattaaaagacgtacaaaagtgattaaaagacgtcaaaagtgattaaaagaggtacaaaagtgaaataaaaaaaactctacgctagtgcatttgctacgctagctttcgaaaaaatggtagcggactgacggtttcgctgcccttttatagacttttctgtgggagtagtgtagagtgtagagaaactacactggatactctacgctagtgcatttgctacgctagctttcgaaaagggagtagtgtagagtgtagagaaactacactggatactctacgctagtgcatttgctacgctagctttcgaaaagggagtagtgtagagtgtagagaaactacactggatactctacgctagtgcagttgctacgctagctttcgacaaaaatggtagcggactgacggtttcgctgcccttttatagacttttctgtgggagtagtgtagagtgtagagaaactacactggatactctacgctagtgcatttgctacgctagctttcgaaaagggagtagtgtagagtgtagagaaactacactggatactctacgctagtgcagttgctacgctagctttcgaaaaaagtgggagcggattcacacagaaaatgtgtctctttatataggctcttagctgatgctagtgtagcatctctgaatttaaaacaaaattaaatttaatgtaaataattaatttatttcatattagttaaacaaaaacatttaaatgaattaaaagcatagaaaataatgataaaatgcaaagaaaaataatgtacaccgcccggcttcgaacttgcccccccccaaaaaatgatgcctcagaatccccaatcacacggggattctgaggccttaacgatgtcataactaaaatctgatttcatattcgttatcagcgacctaaaatagccctaaagacatgtttttagattatttttggtgaaaaaaattttcaacacaaaaataatgtgcacccccctttggtcccgaatcccaaaatcacttttatttttgtatctttttaaaaaaaagtgataaaaataccaaataaaatttattttatagagaaaaaaattgcggatttaagtaatattttacttttcacgagtgacttttcagaaacgagttctgaatttttttctgaaaattcgaatttttccagaaattctggaatatcttttttatttttagagatgaaaataccaaataaatcccataaaattctcctgatttttctctatttttaaagctttaattcacttaaattgacaaatccttcaccgagttatgaattttcaaactttaacccaaaatcctgagggccaaaaatttcccaaaaaataaagaatttttaaaaaattccaaaaattccgaaacaaaaaacaatggtcaaattcgtgctcagcacctcaaaataccccagaaaaaattttttcaccacccttttcaaccaaaaaaaaaattccgaaaatttctagggggcctagctcgaaaatttttgaaaattttcccatcatatagtacaccattcaatagagctttaaaagctctacaatttttgtctaaggcaatttttggctaaaaccaacccctgacgagttatgggcccgggactcaaatgtcccgcttaggccaaaaaaattttctatttccgggaaaaaatcgaaaattttctaaaaacatcaccaatcgatagagctcgaaaaacgatgtttttgaattggtctccgttttccccggaaaaatcgttaaaaaatcctaaaattcaaaaactgaaaaaccgaattttaggcctagctcgaaaatttttgaaaatttttaaaatttttaaagatggatagatagagcttcgaaagctctacaaaaagtccgctggcgccccctcgctcacatcaaacccggacgcggtattcgcctggtactgaagtgtccaaaatgagatgacctcggtctgccatttttccaggccaggcctttggtctgatcaaaaaatttttgctggcaaagttgtaggccatagttggggcatttcgcttttggggtccgctaagctctgaaagcaaaagcaaaaaatttcgtaacactgagactgtcggcaaagtcagttttcgagccgctgggactcagttggccaccggaccggaaaatccgtatttttcccagatgccccgtctcgagctacccctcggtgcaaaatttcagccctgtacgcttagccgttcccgagattttgtttttgaggatgagttgccttgtcaatataacatatatataaactagggtggacagtcggctatggtgtgcatgcgtggcttggtaatatatggccctcatttgttattttaaaacatacaaaacattatcaattgagttctgttgtgnntggggaaagcgct

SEQ ID NO: 10614 - DNA, 1819 bp, Heterodera glycines
aaactaaacacattaaatttaaaagtttaaatacacatgtttatttagcttgagtatttgctgaataccgcgacaattattgtcaagaagtattgccaaactgaagctgcaagcgccgaccgcacacttttatccattgccaaacgtgactatttttacaaaaattaatacattttttttattgctaacttttggcgttgggcacactggcaagaaaagtcggaaaatatttcccaaaatctcggcgatgccaattggccttgcttaacctggtgtaattgaaaatccagttaggttgatcccacccctatataaaaactctcgggagaatcaccccaatccttatcgatccgattcccaaattctgttcgttggtcatgttttttcaaaattactgatttcattaccgaatattttgaaaaaataattatcgaaattgctaaaaaaaattctcccccccctcgcttgatccccctcccccttgtccatctataccgtaatcatttcctttattaatattcaaaatctcagaactgtccctactcgacaaccgtatcgacaacagtattcgcttatttcatgaagctaaatctttaaaaaataggcgaacatccaagcaacggagaactgatcgaagtgcaattaaattcaattaatttccaaaaaaattattcactgaattttttaaattaaaaaattcctttaaaattaaatcaataatttttcttcaatcattcatttctccctaaaaacattttttaccattttataaaataataaaaatgttttaccatgtgtttctgctatttcttgggatcccgcagggttttttcgggatatcgcgttattaaattcgggatcccgaccttggcatacgtcccaatcgcttttccaaaatcttctgggttaatttaatggaataattttaaaaaatttgcgagccgcattaacgaatatgaaatttatcacaataaaaaaattataaataaaacaaaacccaaaaaattactactaaattaatttaccgatttaaataaactaaaaattcattaatttgtaacgtaaaataaataatttgacatctttccatttaattgcacaatgtcgacgaattaagaagccctcctcgcatcagtctgaaatggaaaggagggagcagaaaatgaaatttccaaacaaatttctttaaaatgattacaaatcgaaaaattgagaaattttcccggcgtcgcctataggcaaatcgatggccccctcacttttagagcaactttgggggataatcatttttttaatatattttttaattttatgtgcgctgtcgaaagaattatttttcaaatgaatgacaaattttgcggttatcattcgaaattgctaaaaaaattttctgaacgccttttttcgccacattttttttgcggcaagttttttccagggaatttttgcggaacagggctgcggggggggggtctgcggtgccgataggcgccgccgccggaatttttttctatttgggtgtaagttgttaaccagattttgtcgaaaaaatgaccacatttacgggttttaaacaatttctcgaattttttgtaaacaggattttcattaaaactttccatgaatataaaaattgcgaaatccaacttcgtaaaaaatatacgaaatttataaatttaagaaattgaaaaacgaatgacacttcgtttattaagaaattaaaaccagattcaattcgtaaaaattttttttacgaaatttaaaattttaagaatttaaatattaatttaaaaaaataaaaatatttacgaaatgcaat

SEQ ID NO: 10615 - DNA, 2603 bp, Heterodera glycines
  misc_feature (10)..(10): n is a, c, g, or t
atagattttnaaagaagtgataataactgttctgattatttttgtcacttcaatgaaattattatccataaaaccccaaaaagaaaaaatgatttttttcaataatttggcaccaattaaggctaaagaacgtgtttttaaggaccaataagttatatcaagcaagatattcttgtaatttaatgatgaaagccttgctttactattttatcttattgagataaattttccaaatgattttttttttttggcaaatttaatcaatataatcaaattgatgatttttattggaataaatttgccaattattaaattatttggcaaattaatcaatataaccaaactgatgattaaataattttggcaaaaaatgattaaatttttacattaaataaaaaaatgtttaacccttcgtttgcaattccttttatcattattatttgcctcctttttccattatcattatcaaaaacaaatctatcggtgagtttcattttaaaaattgtttaaattttaattctttttaattaggttgacgaagaagacaattagcctgcaaaattgcgaaaaatatcgttaaggttcaaaaaagttatggccagaaaaatttaaaaaaccaaattttccaacttttttggctcgaactttttttaaaccgaacaaaattttttggaattctgcaggctaatagagtatcagaagggctatcgaatgataccaacaatgttggatttggttgacaaataaaaaagttattgtccaaaaacatgtgttcgtacgaaaacggcctggcccgaacaaaatcaaatctgtgaatttacagcgaaaaaaatatgaggcgcaccttggcattgtgtattttttaagaaagaattggcaatgtgaaaaattaagaagaagtttgaaaaagaataccaaaaatatcgcaagtatttgggcattttgtacgaatatttgttcagacaaaacttcggacttcccggcgttaagccaaaatttgtgtttataatagaccaaacggaaataattgttcatttgttcaagtggtatattacttggccaaaattgcatgtttttattttgattccaatttgcgtgaaaaatatattttcattattgcaaaaccacgattaatgaatgagaaaagattgaattttgaggcaccaaaaagtgaccaaataatgtcaattaatgaatcgattttgcaattagcaattgatacgtcctatgaatggccaccaaatgaaagtgtggacggattaatgcgacaaatttttcatcatcgaatgcttttgattttggccttatcacacgtaaaatttttaattaagtggcaagggcgattttcggggggttgtccttaattaattaacgggaccgtaacgggcgagaattctgttcacgtcatccagcataatcgatttactgtttaaaatttttgacttttttggctccggcgccaaaagtgatcagaaaaaatcgatcaaaaacccgaaaacccgataaaagtggtcatttttttcaaaaagagggctttttaaaatattcaaatttcatttgatgcataaaaaatttattcatataaaaataataaaaatttatttattaaagcaacaaaaaattaaaaattgatttatatgtaaatgatcaaaaatttacttcatcaaaaatttaataatattcatcaataaatcacttgtaaaaggcatacaataatttattaattaaaaaataataaaaaaatccatcagataacgcagcaaaaaattaaaaattgatttatataaatgatcaaatatttactccgatcgaaaattaactgatggtgatgtaaatgaatgacataaaagagaagtgttttcccaagtgagaagcatcaaattccatttcccttcaaattaacactcacctattaattaattacccctgcgggccgaccggttttcgcttaaatgtcgcttttcaaaaaattcattagtaaagactaaaataccatttaccaggtaaatccaactcaaattattttcgccaaatacaaaaatgtaactcgcccggtgggactcgaacccatgggcattctaaaccgtctaatgattggaccgactgagctatggccgttacattaaatggctctcccatttttagtggatttggagaaaaaaaaactcctaaaatagactcaaggccaggaatggatattttgttttcaaaaattagtttcatttaaggtaagtcggccggtgggactcgaacccatgaccccaagcaatcagtgccgtggctctaaccaactgagctacgggcgctccttttagcggtcctctcagatcctttatcccactttctcctacactccgttccttctggcatcacactgaacatgattatctaaatttttgattcggtgacactaaaaacaaccaaaaattacgaaatgcatttaaatcaaaattcgaaatcgaaaaaaatgttttttccgggtctcgggaatgtatatgaaaatcgtcaaattcctaacattcattttctgcgccttagatggaaccattttaaaccaaaaatgcctatgttttaaaagtaaatactagaaaattatgagcatc

SEQ ID NO: 10616 - DNA, 1298 bp, Heterodera glycines
ccccactcgttgtgttgtgatgaacagtttcgttttcgtttcgtacggaaacggtttttttgctttcatgttttgttatcgtccaaaaattttttatttttttggattttaaaatcgttattttagtttgtttttcttttcatgaaaagtgaattcctaccccatttgtcgtggaaaaaatattattattttctgaaaattatcacaaattctccaaaattctcaacaaaaaaaaaactcccgtcattgcctatcctaggctctaataaacaacaataaaatttcatagcataaatttgtgttcccgaagtggcaactttatgctcgtttttcaccgcttgtgctcggattcggcattgaaccgttggcttacaagacattcaaattgcttgatgctaatgaaggtgatgcacgaaatggatcagtgataaactatgaaatcctgcttaaatgcaatatcagtcctcataaaaacgaaaactatgtaatcgggagcgaattttatcagcatattggaggagaagccggttttataatccaagtaaaactgtacgacattgagatggcacgcttatgctatgaagatgaatatggcaatgaaaatagcatttcaattaaaataagaaaaaacacgaggcttttgaggtaaaatttaataaatagaagaaatatttaaacagtaaaattgaaaaatttttccaattcttggtgtaatcattttcgcaaatttagcaaaattaaaaaaaataataataattaaagattacttctaagcaatgaaaattttattagaacattcattgttgaaaaatccagtttcattaaactcatgaattcgaacttgatatgcgaggtgatgttgaagttgttaatttattaccacattcaaaagtcaatgtcgaagctggcacgagctcaaatagcagcaggttaaacgcatcgataatttgtacgaattttagaaatggttatatttaaaacctaattttaagaccacaagccctaactgtcgatgataaaaaggagataaacccattcaaacactgatcaaaaagcaatagacttgtggatcggctaagtggatgtgatcagatggaaaagccgtaccccccccccacaaaagatagatcatttatgattagcatgaacagtatataaattgttgttgtcattatgtaaacctttttttaaataaatttatttccttgagccaaattcagtgtaaagctctaatttataacaataaataaataaaatcaggggccagctttatgtagacttgctttttttaataaaat

SEQ ID NO: 10617 - DNA, 2534 bp, Heterodera glycines
acgattgcttcttgcccatttttgatgactcacccttttttggtattaaaaatgcatcatttaaagacattgccgctgctggtaggtatggtacaggagttgaagagcttaaccaattaatgttgctttaaatttgccagaattttcactgtgtacaccgagaattataaatttaataaaaacaccgtcgcgatagtataaaaataccgtattcaatttaccgatacgataatataccgtatacatattttgcagtgggatgtacgagatcgggaccgagccggcaaagcctcggtcatcacaaatcccactcccggtagtcaaccgataagcgggaatgataagcattgataagaatgggagagggggtctgtgagtaaaaaattatggatgaaaatgataaaataaaaatttatttctttttggacttatattgtaaatttaaaaaaagtctaggttctctctatttttaatatgatgagaaacgcttaatagtcctaatagcctgcaaaatttcaaaaaaatttagctagacacaaaaaagttatggcacaaaaacctcaaaaaattgaatttttcaggctgttttggcaccgcacgccatatctttaatatattattctagaattttgtaggctaatagagaacgcttaggcctattgaatggtatcaagattgttttatttggcttgataagaaaatagttataacactttaaaatttgcggcgccaaaatattccgcgccaaagtgaccccgacccgtggaggagccacctagttcaaccgatgctatgccgttaggcgaaaaccatcaactgaaaaattttctaaagcaacaaaatttttaattctatatatcatttgatagctctaaatgttttctattagctacaaaatttaaaaaaaatttcaagaagattattatcaaaaatgttcaaaacaaaaaaaaaacttggttttttgagttactcagtttataactttttttaatgatttttttttttgaaattttgaacaaaatgtccatcaactgttttcgtgttgtccgcattcctggtaatgtcaaggtcaatccatgcggtggtggcaacaaatttttcatgttttgcatcatcgacggtttaaatggtcctcccgttgcttcttggacagcttgacgaaaattttgtttgtcaatatgtatcgtggtagtctgacgtgatgggtctcgccgtcgagatcttttccgttttaatgttcctacagatgacgatggtgctcggcttggcattctgtttctgtctctgcttgtgccaattttcaatgcgccattaatgccatttggattgtggcccgaattgttgtcattgtttgtgttggccaatatgccaatgttgtccaaatttgaagttaaatcgatgaaatttgagtccaaattgtttccaggtccattttcattattgatactaatgccattttggcccatttcatcataattgttgccattgtttgtgaccaatgtgtcagatgtgtgccaatttggtacaaaattgttgaaataagagttgaaatctgcactttgtgttgaaaccttgtccaaaatgttgttgttgttgttattattaatgccattttggcccatttcatcataattgtcgccattgtttgtggacaaattgtcaaatgtgtgcaaattttgtgttaaattgtccaaatttggttgataataataattattattatcaggttgattttgtgccgatctgtcattgtttattaacaaattattatagtaatttattgccaagccattgctatgatcattttgattattctgatcattatcattagtatgattaggcttattataattactatcataatcagtggaattgagtatattatgcattccattgcatacattaacaatatataaaaatatgaaggtaaaaataaggaaattcatacttctaaattgaaaattattattgttatattattattatattattataaaatgtaaaaatgggggaaaatatatgtttttaatattataacaaatatatttatacattgattttattttcttattttgtttttcatataaaagagacagaggcgtatgattttattcacgtcataaaattttctatcgtttgcaaaagtcggaagtaaaacataattaatttttaaataacaaaaaaaaattatttgcaaaatctggcaattaaaaattgctttaaattaaaaaaatcaggggattccagatgaaattttttaaaatcaatcaacattttgaaaaaaaactattcattttatgaaaaaaacaagtaaacaataattaaatattttatttttctttgtccataatccctttcaacggtgtttccatcatgaattttttgccatcttattttcaaaaaaaattttattggtagggtccgactacgcgggtaggcaccgtcgggaaaagtttgaaaatcttggccagatttcttaacagatttcctgtgagaacgcaattttgggtgtattaaagcaaattcaaataaaa

SEQ ID NO: 10618 - DNA, 981 bp, Heterodera glycines
aaatggcaatttttggtcccccaatatggccgaaattttgaccaagaaatcataaaaaagaattaggtaatttttaatttatggaatgagtaaataaaaaataataatttactttaaaataaagtaatttttctacgtttgttcactgatgatttttctattaaaaaaatttaggaaattttgactaattattaattacacttaaaataaagtaattacctttttcttttaaattcgaaaatttaccctaaaaagccaatttcctcttcaattcgtaattttatataccaattcttcattatctccattagatttaagcattaagcaaatccattgatccgcttttccaccatcacatagttttcccaaaagaaaaaatgactatagcgctgcttcagccaggtgcacattttttacgctcctccccctcctcgatccgttgaaaaatgatgatgatgatgatcaattgcgccgcctgcttggccaaatgatcacaatcacttcacaattgcctgttgggaagggagggggattaagggattaagccggatgaatcacaacacttcgatggaaatggtggccaacggcgataggcggcggcagcagcggcggcgccaaacattggctgatgatatatttcacccaaaaatctccccccccccccgccccgggcaaaatgcttcatctcggctcaacaaatccatccaatcccctgctggccccagacaactgctggagaaacggggctttccacggctctcttccctaaacaaatccacaaaaccttcttaacactgctatattgccaatgatctgctggtgatctctgctggctaaattggctgcaattttgaataaaacttataattaaattcaattattcctcgaattttttgataattaaataaatttaaattttctttcgggttcagctttttattttatattaaaaaaaatttcgattgatttattatatttgtt

SEQ ID NO: 10619 - DNA, 2855 bp, Heterodera glycines
  misc_feature (26)..(26): n is a, c, g, or t
acactaatttgaaatgattttatttnttgaaaaattattttaaatatcacttttttgggttcttctaaaattaatttattccttgtttttatccgctattttgaattatttttccattatgaacaccattttttacattttttctcaaattaatttgctattcgatttttagccattttgaataattattttaatttgaaattattttaaatttcatttttggattaatttgttttttttcgatttttagcaattttgaaccaacgaacatctgccgagaagggcagatggcagttgaatgtgtgcagcatcgaatttgtcaacaaaaaactacaagattaaagcaaccgacagaaatttgtgcagcgaatcgtacaaacaaaaaaaatgctagcacaaaattatggtaaaaataattaaatataattaaaatatttgaaatttaatacaaaaaccaatgctttagggtcaccttttttgtaacgacaattttatttctcattggagttaccattgttgatacggtattgggaaatattttaattttaaaatatttaataagtgaatataattaaatattctattgttacggtattggaaaatatttaattttgaaaatattaattcgaatttaaaataaaatattgcattttttttattttacagcaaactccatgcagcccttatgactgcaatcagcgaggatgtttttgtgtgggcgaaaaaggttcgtaaaattaaaaacatttttttaaatttgacaatgtttataaaattcacttttttaaaggaatagtttaaaatggtcaataaaactttaaaaaatcaaatatttttcaagaaccatatatgaagggggttcgcaaaaatttttttaaatcgtaaattttaaggctctcttgggccaccaggcccccaaggtccacccgggacggcaggaattcgcggcttccctggcccagatggactccaaggcctcaaaggacaaaaagtgatgaaaatttaaaaagatttttaatttaaataaattttttcagggagcccaaggtccaccaggctcggctggcataaaaggcgacagaggcccggttggcatgccaggctttgccggaaatgatggcactccaggacgcgtaaaataataatttttgtttaattttataaattcgaaattttcagcccggcgaggcaggcccgcctggtccgcctgggtgggacggctgcaacggcacggacggatttatgggcctacccggcgtacatgggccggctgggcttcccggatttcctggacagcctggaacggacgggcccaagggtgagccggcacttggctatgctggcgctcctggcgaaaaagtgatggcggaaatttttttttaatccaaaaaaaattttcaagggtgacggaggagtgccaggagttcccggactgcccggaacacctggccgagacggatttcctggtgagaaaggtgaccgtggtgatgttggactgccagtacgtgaatgaatgccaatttatcaaatttaatcgtaaaaatggtttttttcagggccctcgaggtccccctggcgaacccggtttgcccggaaacccggggattggcacggttgggccgaaaggcgacccggtaaaatttattacgaaaaaatatatttaaaaaataatttcagggagagcagggcctagttggactgcccggaccgcctgggcctgccgcgtatggcctcggtgcaaaaggaacaattgttggccccgaaggccaccctggccacaaaggcgacaaagtgagtctgattgggggcgggataaatattattggacaaacattcaattaaacagcatttgggaattggtggaaagtttgattttattattagtgaaattaaaaataaaaattaatacttgtgtagttttcagcaatattaatcaaattttttaattggcgcaaaaaacatttgctaatgacatcaaattaattaacttgattaaataaaaaattaataataataatttgacaccaatttcctattgaaaatgaatctgaagtataatattataaactttaaatggtgaaatttgtaatggaaaaataaattaagaagtttattggggtattacacattaaaaaattttccttttataattaaaattttaagaagtgaatattattgttaggcatactgtaagtcgttttattgtaaataaattgtcccaaatatactcattattattattattatttccctgctcagggggaagcaggtgaattgggtcatcgaggctattccggcataccaggactgcccggtccgcccggagcacccggcatgaagggagaaaagggcctgccaggcccagcaggaccaagggtaaaagaaaaattttcaatttaattttgaattttttgaaaattttaaattccttggcttaagggcaaagaaggccgttcgggcttgcctggcccacccggcttcaagggcgaccgtggagtggatggcttaccgggcgttcccggctcaattggccagaagggcgagcagggctatgctggccgagatggtgtgaaattttttagtttattaaataaaaaataattattttaaatgcccattaaaattaatgggttttgattctttgaaattaattgtttaaatttttttttataaaattcataacctataactcaccttaaagtggtgaaaaacgcaactaattttaaatgaattaacttctgtaattatgtgggattaaattgctaaaaaatttaaaaattaaaacattgcaattgtttaaagggattaaatttcataaaataagctaacaaatttatggaaatctaatcataatt

SEQ ID NO: 10620 - DNA, 2113 bp, Heterodera glycines
aataaactattttttaaatttttatttaactttgaaatattcttcagaattttcccttcaaaatgagcacaaaatggttttatttggtctattattgaaaaagttataagctaaaaaaaattcataaaatcaagggtaaaataaaatgtttaccttttattgtttgtatttgttcttttggcgttctgtatttattattattttatttatttgctttaaaaaattgaaatttatacacaaacacaaggaggaattgaacttagagcccctttttggtgactaactcacagaccactaagacgaaaaaaccaacttaattgtacttggagcccaaaattgactcgccgtgtctatctaaaaaatacaaaaaaaaaatcgacaaaattataaaacaacaaaaaaattgacaaaacaacaaaaaactacctaaaatacacacatccaactttgttcctcgcgtttctctctgataaaagggtttggtttttctttttgctttaataaagttattcgaattaatccgtcataatcgtttgtttcttccttgttttcgttttcttctctaccaacattttcacactttaagaaaataaaagaaaatggcgcaggcagttgctgctgttgctcccgcaccaaatgctaacgcagcctcggctcacacaacccaaccgcaggttatggcaccatcttatccgttggcttctctctatgtcggcgatcttcatccggatgtgagaaatcaaattaaaattttttttttcaaacaccgattaatttttttggtattgccaggtcactgaggccatgctctttgagcggttcagcaatgctggtcctgtgctctccattcgtgtttgtcgtgatgcaattactcgtcgttcgcttggctatgcctatgtgaattttcaacaaccggcggatggtaagttaacacatttggactgcgtttttttaaataattttttttgcttccatcataagccccttattctgttaagctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaggtgtgtttgcttaacttcaaacaatttcgtctttattgtccacaacaacttttgtagattgccactgacattgagggaggaagcaaagggtatgggttcatccattttgagactgaggaagcggcgaacagtgcaattgcgaaagtgaacgggatgcttttggatgggaagaaagtgtaaggatgatccccacctaaaattgtttttgtgctattaaatttatcccatcttttttgctgtaggtttgttggaaaatttgtgccacgcactgctcgtgagaagcaaattggtgacccgtccagtcgtttcaccaatgtttatgtgaaaaattttggcgaggcaatggattcggagaagctgagcgaagtgttctcacagtatggcgaaatcatcagtgcaaaagtgatggaggatgacagcggcaagtccaaggggttcggctttgtcgcctacaaggaccataaaagtgctgcgagggcggtggagaagatgaacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacggattttgtttggttggggggaatttttctcaaattttaggattttgttagtttggggggggagtttttctcaaattttccatggataacttttgtttattatattaatgtgccattttttgtgtaaaactgttcggaaagctctccactaattaaaaaaataatggaatccataaaggtatactaccaaattgtttactgaactggagattttaaggtacgtcatgaacctgcacgataccatccaatgatgagacactttcgaataaattttgaa

SEQ ID NO: 10621 - DNA, 825 bp, Heterodera glycines
gagcagttcaaagctgagcgcatccagcgttatcagggagtcaatctgtacgaatttgtttggttgggggggggggggagtttttctcaaattttccatggataactttgtttattatattaatgtgccattttttgtgtaaaactgttcggaaagctctccactaattaaaaaaataatgcaatccataaaggcatacgaaattgtttactgaactggagattttaaggtacgtcaagaacctgcacgataccatcaatgatgagacacttcgaagcaattttgaatcctacgttacttcacaagtgcaaaggtttgtcttcaacggattattggtatttgctataaagcggtgcttgaccagataccaaaacgaattttgcggaatcctaatccagcgaaagccgactttttttttgatttgggcattaattacaaacccggaccggcaaaaatttatgaaatccaactacacattttggctcgcaattttgattttccaatttctattttattattttccaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttagtgagtcacgaaaatggaatttggttgaacattgtcttcgaaaatccacaatgttaggcagtagtagggttaagcccctttcccacccattttttcgaaaaaataacccta

SEQ ID NO: 10622 - DNA, 1799 bp, Heterodera glycines
atgaaagtgcaaataaagggagaccgctgttttttaatgaaaagagcaaaataaagcaataaagataaattcgtgtgtgtaatctgtttgaccaatcgtaaaatttttcgttctctaggtggagcgaattccctttttgtgttcgatcttttacgattggtcaatcagatttcattacaatatcaaaattgaaaatcatttttattaaagacgaacgaataaatttttaaggagaaaataatgaattttccaaatcgacttcattgacatcttcaacaatttcagtcggcgacggttgaggagccgtcggtgttgtaatggtcgcgtagtcagacttaaagggtcaaaaaagtaataaagcattggaaattcgaatttaagaattatttgggaaaagtttaggcgatttctagaattatttaaagaaaacaaactaagaaaaaaaacttttttgtaagttttgcacaattttcctattcattaaatttcaaaaatttcccggcggctgctatcagcacagccgggttactgcccccaggggaagggttgtctgttaatttggtggatttcaaaaaaattcagcaatcttttttagaaacaattaataaatatatttatttatttcatctattagcacctttccatcctctcaactgaattttcgctcccgttttgttgctggaccgtctcgtcttcttgtgaaggtgctgatgcggtggacttttgctgcttttcctccacaattccgctttccatttgctcgctgaatatgttttaaattttttacaatgtttctcccattttcggccgattgaaaaatgtgcctttccacccgttttgactttcccataacattcattgttagttagaccaacaagactatcaaccccaagacctatccgcactcgaaattttaaagagaaatagcagctaaaaatctcggtttttttgttgttgttgatacccctccacatccaatctcacaaaaattccaaaaaataacgcgaaatttttgcgaacgcccataaaatagcaatttttggtgaaaatcgattaacgatatgtcgaaaaattctatcggcaccgctgctcatttttttaaaaacaccgcaaacaattgattagcaatttttagtgcaagtgcactttttgttgccgctgacctctcttaaggggacgggggcggagaggggtcaattaccaatacaacaacagttgaaaaaagcaaatgttagttacatatccccccacatcgttttcgttcttgcattgattacctcctatcctcgggtccgctcagtgcgtcgtccggagaaacaacagggtctttttcagcgtggccaggatacttaaaaaaaggaaaaagcttatttgttttgaaaatgagagcgatggtgcatttcataataaaaaattgattttttatataaatcgtgtaaacatattaggttttgagggtcgctgattatggatctgactcattttcggccaaattcgagtttaaattttcattcaatggaattaaagacaattttgggtttcactttttgtttgaaatcggcttcaggactgggaacgagtccaaatgccccagtaggcgatattaaaaaaaagcaaaaaatttggttttttttaattcccagcaaaataatttggtttacttcgtttttaggccaaacaatttatttttttgtctaaaaaaattgttatttacttttggtcccgctttgtcctttccctttttttcgctgccactcgcattctttgatggtttctttttgtctgaaaacccaagaaaa

SEQ ID NO: 10623 - DNA, 1756 bp, Heterodera glycines
  misc_feature (1672)..(1672): n is a, c, g, or t
agccattacaacaagtggtccgagaattgaacaagaccaattacaaagcgtatgaattcaatcaccaaattactcaattcacagcaattaccatttcagtgttgtaaagttggcaactttggccggtcgggaacagctttgcatcaacgaaaaggtcatggaggagaagaacaccgagattcgagggcacatgtgccgaacattggtcaaatcgcgcaagtgcaattaccactggcaattggacggtgcgttttttctgtttgttaatttcagtttgttcatatgaactcttttcatttgtcagcggatgatctgcttattgacgcgatgtacaaagcagaaacggacggaaacgcaatggacattgaggatttgatgaacgcggcgcgcaaatttcggtttaaaatgcatttttttaaatgtattaaattcaattctttttagccactgtcctttttaccgggctcgtcaaatgtacgactcggctgaccttatcctgctgccctacaattatcttcttgacccaaaaattcgcaaaatccattcgattaaagtaaattccattttttttctttttttatattttctttcgtttccatttttaggtaaaaggcaacattttgatttttgatgaagcgcataatatggtgaaagcggcagaacaaaccccaaattctataaaatttattatttgttaggaatcaattgcagaagagtcgatgtctgttgatttctccaccaaatcattaagtgttgcaattcgggaggccaaacatgttttggaaatggttgtggacgaggaggaaaatttgcgtgacgaaatggtcaccaaaagtgttgatagtttggccattccgttgtttattttaggaaagaaatggcatttcattcgccgaattgaccaaaaaggagaaaggcaaaggccaaaaggacgacgatgaggaggaacagcagcaattgaagaagaatgacgtggcccatttgctaagtgatcgaaagagtcggcactttcccttcttttaatgccttccgtcgattaagcgcttctccacaacttcgaggagcaaatcgatgctttggtggcggcgggcggaggcgccgtcatcgacagagtgccgggccgagtctattcgggttttttcggatttgaaattgcaatggaaatttatgttttctcaggtgaaaaaatggttgaactgatgaagaagtcacagataatgcgtgttcatcgggatagaatttgcgctttgatcgataaaattggtctttttctcgccggacatggtgacacttcagaagtgaccaaaagaattaattaatattgaataaatttagccgaaagaaactttggcgtttggcccgtcaaaggctctgcacttggtgaattcgcttctttggtttctgtagtttttgaggagagcgatgaaggcactgacttcaattattgaaatgaattaatgcattttttaatggaaattgttaaattattgtacacatttttgtttatttttgcagatgcctctcgtcattttcaactttttgttgagcaaaaggaaaacattttggacccgcgagaacagcacaaagaactgatggaagttggggaaaatggaattgaaagcgcaaaacccgtaacggaagtgaaactcaattattgtacgagaaaaaatgngggcgggggggggggacaaccgcaaaatcaaaaccaatttgaggtgtttcaacgctggcgtagcaatgaatacctgcaggtact

SEQ ID NO: 10624 - DNA, 3421 bp, Heterodera glycines
tactggtggctctgctgttttccttaattatgatatgaatagaaacgtggcactcggtccatcgttctcgcctccggcactttggccccgttgccaatgttcaaacagtgcaatgggaaatgttcgtcttttctgtccattgctttccattagcgtcttttcagtgcgttcggcttcaccttggaatctccgcactgcgctcgttcggatcaagctgatcgttgccgctttgaaatagggggcccaccggcgtggaagttggccggcacttttcagaacaggcacttcccctccattaatatttcatcctccgctgtactttaattgtttaaaccgcgtttctttaggcatactcttaaggaacagtttcgcctacaaactttcggttggcgagtcggttttgctcacggcgaagagcacgccccagggaatgttggccttctttccctcctactctcaaatgggcaccgttttggaccattggaaggtcccttcaattaattttttgtccatttagcttttgctcctttcagatgtgtcgctctgccaatggccaatacctttgggatcaactcgaacggcaaaagcgtctcctcgtggagccgaaagacaaaagagaagtgcccgcattgttcagagagttcgatgccgccgtgcgcgaaaatcggccgtcggttggaaaaagtggcggtgcacttctgttcgctgtttgccgtggaaaagttcgccgcccttttctctgctggtcctttgacctatatttcagctgagtgagggcattgacttctccgactcgcactgtcgtgccgttgtcatcgttggcattccctttccgcccctttacgagccacggatcattctgaagaaggcgtgtttgacggaacagcgcaggaaaggccgaaatgtatatagagtatttcattggaaaataataattgggtttcttttccgctttcagtcgcttaatgcggacgaatggtaccgaattgagggcatcagagcggtcaaccaggcactggggcggatcattcggcacaaggaggcgagagtcttgagcactaacagcaaaagggtataactagtcccttttacccaatcccttttaggactttggagtcgttgtattggctgattcgaggtcacttccgcattcgttgattaattgagggcattttcgagtgtttaggtatgccaacctcaatcggcagatgttcccgtgttggatccgaaattccatcaaggagctgtcaaatacggctgcttttggacaaattgttgtccgtttcttctcagaacgtggcattctcatccaaaaatcgcacgacgcaatggttcaacaacagcagcagcaaaatgaacggaaacgacggagaacagaacagacgacggaccaacaccaaagacagcacccttcacttggggggacactccgaaacggaaagtcccaactgaatttggcactgctggacggaatttctgatctttacacgattgacgacggattgtcgacgccgtcgacctcacaaaatgcaaacggaagggaaaaggacgaagacgaggagaatgatgacattcaggcaagaaggagtgaaccaccgattatcaccgaatttggacaaacttatattttcaattttgcaggtaatatgcgttcagaaaccaatggacaacaaatcgagcagaacgccaaacccaccaacgatgaaaatactgcccgaaattcaatttgtcggacagcaattaaatggggtcaaacgggaacaacagcagcggcgaacgatggacagagaggacgaattgcgactgactttaagtgagaagtccaaatggaagagggcgaaactgcgcatggccgagctgaacccggcatattttgaggaaattggcgagcattgaagaagcaacgggcagcagtgaaacgggcaccaattaacacacacttaccggatgacctttttattgttcatttttactagtggaaaattaaaaaatgaaattcaattgggactttgtgctgtctgtcctttcgaaagggcttttccgtctttttggcatttgccttcctccagcagcaatgaattcgaattcaaagcgcccattgtcacagttggccggccacccattcgcttttgctcgtggacatttgccatggatttgttgggcccccgcccctttcccatcgctcgtcaaattcgctgctctctccgtttctccggcagcatggcacaccttttcctctaattccttggttttttacccttgctataacattacgaagggactggggaggaggaggggttgatggatgggaaggaaagataaccaaccgcaaaaccaatgaattggtcccccccccaggggcaaaagacccatcggccgattcatttcctttccattgttttgattaatttgtaataataattaacggttttattaaacttccaattcaaaaataataatttaatcgacaattttccccgcaaatggccgaagagaatacaaatcaatcggaagtgcgttttgccttcttttttatgttatcagtccaatggcattgcctttgaagggactcgacttctttctgaaccgaagcggatggacagatgcccaattggaggaagtcattcggcttttgtacggcaaaaggctccagtgagtgcccttccttcccttcgctttttccgttggcattttgtgccattttttttgaaatggtcggcccattctttcacaaaatcagacaactttcgattgcccagcgtttcttggactcggcgcaagaagcaaattttgagctgaaaggttttcaaatggtggcgcaggaggagcagtgccgaaggccgaagaaaatgcgcgtggcggccatccaaaacaaaattgtgttgtcgacgagtgcgccggtgcaagcgcaaagggacgcactgcaccaaagagtggcaattaattaattaactaattagggcttaattagggtattaatgaactgtggagggagagagagagttttgatcatttaataaaaggtcggcaaaatgatcgacgcggcggcacgagcgggtgcccaaattgtttgcctgcaggaggcgtggagttcgtttattatttttaaaaaatgtttaattattggccatttgaattgcctttgttttagcgatgcctttcgctttttgcacccgcgaaagattaccatggtaagagaaagaaagaaagggaaaagaattgaatatttctcatcaaaaggacggaatttggagaatcagccgaggacggagcgaccacaaaattcttaagcgaagtgagaaaatgaagaaaaaattaattaatttaattaaaaataatttaattaaatttaatttaactcttttttagttggcaaaccgtgagggcgttgtgatcatttcgccaatttggagcgtgacat

SEQ ID NO: 10625 - DNA, 2433 bp, Heterodera glycines
  misc_feature (2369)..(2369): n is a, c, g, or t
  misc_feature (2379)..(2379): n is a, c, g, or t
gcactatgcggtcaagcccagtgtcagacaaaattgctcataacgccaaatagcgcatttggcgtaaattattgcgcgctatttcaaaatttacactggaaaatgccttttttgtattttttattttgatctgccataactcgcttcatacccaattaaactgaacaaatttggtatctaaaaaaagtttttgaaaaggagaatctttttctaagcgaatgctaagcaatttgacatatcagaaaaaagttgtgggaatttcaaacttttatcatgttataacgcaagtcctaggcagctctttctaaccaaaatgctaaatttattcttttttttaattgattctaaatgttcaaagtgattttgtaaccttataaccaaaattattataattttcgaatttatgttttttcatgtgttagagacatgaaaatagtacgccaaaacgagagaaaaagtaatgcattttcatgttttatatatatctcatgaaaaagtgtataaaacataaaatggctgtattacattatgcagaatttctttctctatcgctatgtaaaatttggtatagatttaacatgcagaaaaaaagttaaacatcacgaagtgaatgttgttttttacataattaaaatgaagagatagtacgccaaagtgagacaaattacaaagaaaaagagaaacgacgagatagtactaggcttttctctgcacagtggagttgacccatagtgtattgacacatgtctcgttttttgactcggtgtgttaacaacgcccaaaaaaactaagcccaaattcttggtgtcatttttaaccatttgtaatggatcaaaaaaaaataagttagaacccaaaaactcggcctggtgcgaaaacgaatgcggactccgaccgaatgttcaaaccaaaaagtttatgtttttttggcgttcttgttttttaataaaaataaacatttgcattggcactgggaacccaaaattaacttgctgtttgttttaaatgttctgaaattaattttatgatgtgtggtgtaattgttttgtattcttgggtttttatggagttctaattttaaatccgtgctgaaaacgtattatttcgctagatggttttatattagttttgaaaatgtagtgtccaatttattagcatttatttagctcgataaaattctaactcagttagacatggaccgtaatttgaagaggaatgaagacagtgcgattagaaatgagcaacggataaaggctaactttcaacttgcacaattagtggtctgtttgttttttttatttccttaaaaagcttacttttgtttagcctgatgttccgttaagagaggacgaacatttgttggaacacagctacgtattttcgtattttatgcgaccgcagggaaaattcgaccccgaagattatgcgatgttagtagtgagtgaatggttgaaagcaaacaccgtcagagggaattagagaatttgttgggttgggggaaaagcgggggaggaggaaggacagtcattgcttaaatctaaataacttcaggtacgtgcaaccagtctcaaagatcagttcagtcgaacagttttggcaagtgtaccgattcatcaaaaggccttccggtttgtttatttattcagggaagagcacgcgcttgtaccttttgtgctgtacttattcggacttcctttctctctattttagatatagcggaaaaggtcgacttccatttgttcaaagagggagttaagccaggtcaaaccattcgattcgtctcttttgtctctatgattttttggttttcagtttgggaggacccatcgaatagaaacggagggaaatggattctcaggtaagctacaaaatgccgtagcttgaattgtatgccactcagtttttcgtcccgcttaactgcttatagattgaagaaagggctttcctctcgcatttgggagaatcttctgctcgccatgattggtgagttacaatcaccccattaacgcttcatgactttttactgccaaaaagtggaaaattgaatttttaaaatttttggcataattttctgaaaacaaatgaaacggaaattttactgcctataaaaaacttagatatttttgaatgcttgaagttattaagcattttatggtcttgtgaatttttatgatcgtgcaagctgcaatagatccgtaatttttttgagttgcgcttttctttttttgaggcgaacaatttctcgtcggtgacgaagttgttggcgcggtctgcagcgttaggaaccaggaagagtgtgtttaatgggaaaagcaaaggaaaagcaatttttctttggtttagcattgtgtcgctaaggaatcgaccgnccgattctcncccggtgccactttaaaggcgcactttgcggagagtgctcaatttgccaacaaa

SEQ ID NO: 10626 - DNA, 1178 bp, Heterodera glycines
  misc_feature (363)..(363): n is a, c, g, or t
atccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaagtaaagtacccacaagtaccgnaaaacgcatctctacgaaaacattcgtacaaaaggggtgtcccacaattggacggcaccctctatcttgtttcctcaagaatttacacattatttcaattttttagtttttaatcttacacttttgctccgtcttaagacgattgtctgcgtgaccagcgttcctactgccacaccagcgccagcgttgggcagcaaacgcatgcgcactatcagaaccatcaccaccacccgcagcagcaaatgggcggcgggaggggaggggtgaagtgaaggaaaggcgaaagacaccgcaaaagtccgtcagtgttccgaatattgcaaatgtttctcgttgttcaaatatctatcaattgcttgggcaatggtaaagttttgtggtttcttcgaaaaataaaattaaaaattttggaagtgccttttctaggctaaaaaatacgctgatcacgaatctgagctcggattttgcaaaatcattgattttatcaatgattatcatcaagtacttgactttttcaaaaaattttaagaaaattaatcgggcgtaaaaaaactcatacacagatgttgtagagaacaaaaagagctttcgaataagctattgaaggtctggagaagtcaagtatttaattttctatggttttttgaaatttagttattaattagttgttgtcatatgagacggggtccggggttcgggtccgcttggccgcggcttattttttatgatatttgatgaaaaatcatagacaaaaacattgatttcgcatgatcggagctcggattctttttcaacgcattttttaacccctaatt

SEQ ID NO: 10627 - DNA, 1717 bp, Heterodera glycines
gtgtaattttccctttcccatgctttgggcgcaacagaagcgtcaccttattatccgcaaacaaaatcaataagtaatttcacactttgcagttttgtccttttttagctgatattttctaaattggttgtttgttatttgttagttccatttttgctaaaacaaaacaaagaatggcctcccaagtcgaccgcgtgttaatttatgggggccgtggggcgttgggcacggctttggtggagcatttccattcgaaaaacattgtgggttctaaacagccgaaccaattcaaagaattcattcattgggcaatgcttttggtctgtccctccattcagtgggttattagcgtggacttggccagcaatgaaatggcatctcacaacattttggtggaccccctccagggagtgcaagagcaggagcattctgtgctcgcggggttcgttttgctattctctgtgtatgtttctcggagttgggcttttgcagcgtcgatggtgcgctcggtggagaaaagctcgacgctgtgctttgtgtggccgggggatgggccgggggaaacgcggcgcacaaagactttgtgaagaatgctgatttggtgggcctcaatgtttcaattccgaaaatggcatttcctattggcagatgtggcgtcaaagtgtgtggagttcggcattagccggttagaaaaagcggcaacggggggcgggggggggtcattttttaaattaattttttaataaaaaacaatttaatttatgaaaaacgctttttgaaataaaaggcatttcaaaacattatctagctgggttgtctgtcctcaaccgaattgtcccattggctgggctttaaaatatcaaatgcttaattttttatcaaaaggaattggattgaaaagccgaattttgtgcctgagtttgtattcttgtgattagttaaagttgacctcatctgccaataatgaggcccttttagccaaaatcggcactcgctttctcaaaaccaacggccttttgcaatttaccggcgctgcggcagtcggtgacttttttgtgtcatttttaacggttttcttcaggcttctgactcgaccccgggaatgattggctacggaatggcaaagggtcggtcgatcaactgacaaatgagcattccttgatttggatgtttcattttaagcggccgtccatcaattggtccgaagtttggcggatgcaaaggctgcggggcttcccgaggggacgtgctctttcgctttgttgcccgtcactctcgacactccgatgaaccgaaaatggatgccaaaggccgaccattcctcgtgatcacttcgttttacagtgccggaaattgtatttttactcaggtggacgccacttccttttgttgccgaaacactcttcaaatggacctttgaagcaccttcgggagaacggcccaagtcgggatcgctggttaagctaagcaccaaagagggcacaacgaaaacggaggagcaatgaaagagggaggacaaaagggaagaggaggaggaaagggacgaacggaagggaaaacgaacgaagagaggaagaaagctaaaatgataaagagacgacggatggaagtgggggggggggggagaagaagttttggcattatacccaattcattttataatgattttattgaaattgcaaaagttaaattgaatcaattaatgtgaaagagttct

SEQ ID NO: 10628 - DNA, 3739 bp, Heterodera glycines
agaatcagcatgaagaaacgcagaaagacaaaactgctcggatggcgaggacaaattaaaacttcatccaaaaggtgaaagggaaatggggggggggggagaaagtgttgatttgcacgggaaagggacaaatagacacaaaatgaccgctggaagataacgaagtgtgaaaagaaaatgagaattcgagaggcaattttaacgtcgtacaatcatttcatggaatggaatgaaattatgcgatgaagagaatatacagattagcgaatgtcagcagaagaatgccaccggaagtgaaaggggacgaggggaatgagtgacggatcaaagggaaaagggagaaaaggggtaaaggaggaggaagaggaagagacggaggggagagcgtgcatagatggaattttttacttattgctaagcataaacattataatgatgtaagaaagaaattttatattgaaaaattaattaataaaatgatatataatatgaagtatacatatatacttatcattatttttacattttaataaatgaattaaacttatttattaataaattatattttacaataattaactactaatattttattaagtacattttgttaaaaatttcaagttaaaatgttctttgattgcattatacactacaaaagtaaaatattaataggaatttcctagaaatatacaataaaaacaagtaaaaatattgtaaatagtgaggatatcatacaatgctaaacggtgcacggttaaaataccttttatgccgtgctgagcggcgaaatagcctttattggatagaggttctgaacaactcctttaaattaactgaataataaataaagtaaaataaaattcaaattaattcaaataaaaagtaaaataaaaataaaaaagattaaaattaaaaataaaataaatgttaaataaaaataaaataaaaaaattaaattaaagttgtattaaaatataataaaaataataaatacaatagtattgattaaaattaagtaaattatatctaaaattaaattcaatttatggtgttactgacaataaatagtaaaacttttctcctcaatttatttaatatccccatccactaaaaacaaccacataaatcttttaaatataatgaagggtctaggtacaaattctaccacaactatcttctcaactggaaaatttgtatttacagaggcaattaatgagaaaaaaatgtaatgacattgaaaattttaatgacagcgctggtatcgtttaggagggaattatttgatgtctcaaaggaactaaggcattattaagggaaggcagcgtcttttagtacccattgatgtactaaaggaatgtatgactagtatacggcctgtatgcgatatttctagatcaataacttttcaactgaacacttggcaaattgatcattattctgtggatgaatagttggaaacagagagaactgcaatagaagtaagcggatatgtttagcatgcctgcaattagcgctacctagaagatgtatattaatgtctaattgaaaaaaataactgataaagtgcgggagaggaatgtaaaacgttatgaatttatacgaagtcaagttgtccatccagttgtaagtgtattaggctacgagatcgctaaaatgttaatgagcaacaaataaatgagcggatttgaagacggaatgaaaaaatttctatgtgacttcatttctctctacccctttgttaattttactacacactactcgattggtaaaccaatgtacataagtcgagttaaatacccggaagataaacactaccccttgacaatactcaaagttttggatgatttctttagaaaattcgatattctgttttgcccgtcaaagtggacgacaggctctgattctctttatgtatgaagtgcaccaaaaaccatccaaaaggcaggatagacgtaaatacatatgcaaacataatgacaaacaatgagatggctgagcaatctgcatttcaatcgaaattaatgttactacggttgaagaaggttacccatttaccaattgatactgacataaaaggaaatggtgagaaggaagctgaatttgtaagagagtgcaaagagaaattagagatcttaacccaataaagatagctgtgaaccaagaagagtaggattgttaaactatgcttgaacaatttgtgcgacatatttctttacgaaattacagactttaacagactttacttcaataatgatgtacttgattttggagaatatttgggataatcgttcaatagacgtaatggccatcgaggattgaaaggtgtatcatgttttgatcacctacgaaaataaaaaaagtgggtaataaaactattcagaaatgatgatatagccggggcgttaagtactctccaccgacacggatagtcttgttttctcacatctacgcgatgctttttagctgaataagatcgacaaaacagttcattgatggaaatcgtagaattctggtgcaaaatagtatgcgttggctttaagacgtataaatgttctacatgatgcggaaatggaatacgtgcttaaactccgtggattgacactcaattatgatgtgatcaacaaccaaggctttagatataaaaacaacaagtcaaacgttatgctcaaacaggagagattgaaccaattaatgtaatatacccaaactttattagacccaatattctaatatcaagctctatgcaaaaatgttatcacccatatgttgggaagggtattgtaggagccgattataatgttctcaattttggacacactttgtaattgctcacccattataatgtcttttcaccattcattgtaattgttcacacattgtaataccttcttcaccaatctttgtatctctcacacatacacatatgtacccttttgtattttgttcaccatttattgtatctctcttccacacgcataaacatataccccatacacacacgtacacatacatggacccttttatttctctattttataccaaaaattgtattattttatcgttttattcacgtttttaataaaaatgtatgcagaattaagcaatggaagatacaatttgtaaattattaagcatttgggaacgtcgtttttaggtagaaatatgcagaattaagagaaagaagttacaatttgtaaattattaaggagttgaagatacattttgattatgtgcacgaacttgtcgtttttaggtagaaaaatgcataattaaacacattaacatgtatgcagaattaagcaacggaagacacaatttgaaaattattaaacatttgggaacgtcatttttaggtagaaatatgcagaattaagagaaagaagttacaatttgtaaattattaaggaatagaagatagaattttattgagtgaacgaaattgttctttttaggtagaaaagtacataaataatgaagtgaaaatgcattcataattaaacaattgaagatacaatttgaaaataattaagcactcaggaatgtcatttttgggtagaaaaatgcataattaagagaaagaagtacaatttgtgaaatattaaagaatttacgatgcaattttaagaaaatttatgaaaataacgaatatatggagaaattacttaaaaaatgtttacatatattagtgtgcgtgtgcgtgtacatacatgtacttgtgtgtgcgtgtctatgcgtgtgc

SEQ ID NO: 10629 - DNA, 2014 bp, Heterodera glycines
  misc_feature (70)..(70): n is a, c, g, or t
  misc_feature (95)..(95): n is a, c, g, or t
tttaaatcgttttttttgtattcaaaaaaaagttttttcttttatttattttttataacaaaaataaagnaaaatatcgctcctaaattagctancatcgaatggaaaataaacaaacaaaaggttttcgtgtgtaaatgacagttgagattgaattaggcatatgaaaaacaatgtaaatgtgggtgaagtgattaaacattgtgttatactaagtacattaaattgtactaattttcttatgtatttttggagtggctaaatttttattaataattataattctaattacttgtaatgccgtagaaatgccgtaaaataggtgtttaaaatgtcttaaaattaacaaaatttaaaaaaaaagagccagtatttttttttatgaagcaacagtttatatatagtattgacttaatagcatttctaggctaaactgatgcaaaggcagcgatcagaattccatgaaaatttatacaaataaaattgtatgtttggctgaagaaattgcatagatgtgggtaaattttttaatatagggaaaattatctttttttaaataatttcattttttagttaaattttacgcctgtgcattaaacatttacgaccgtacagaatgaattttgctgaccgccttcaagttgtgaggtcgatccaccgctcacgaacagtcgcgtgctgctggcattgttggaactgatgccaatgccgccatagtcgccactaaccgaaaaggtgcccgagtcgagcagcgacgcttgagacaagttgcgcgagcaactgcttggtgttgtggtcgaatcgccagtgcctgcgccgccacaaccaatgttttgcgaaaaacgtcgatttttgccagctgcgataaaaaattattaactaataattttttaattagaaaattatatatttaaattctattgaagagtcacttttattgtcttaataataatttctcacctttatttccatatttttcagttgcttctttcaatgccaaataaacgggatcgatgtttgactcggactcttaaaacttattgtataatattgttaattttatatataatattatttttttagtttttagtattcattaggaataatttttgggttgtaaaaattgtcattagtagagtagaacgggacctggactgagtcgggaattctggtcccgactttggtgtcccggcaagtcccggtcccgctctacttttgtttatttgtttggtaattttacgagattaaagttcaatattatgaattcttttgaattgtaatgcgttttttttataaaaaaatcgaaaattattcaaaaggttatgaaatgtatggaagtcttaaatatgataatattataattatacttttttatttgtcaaaaaggccgaaaaaagcatatgaaaactttcttaaaattttttaaaacccacaaaacaaatattaaaaagtgttgatgcctcaaattgtcaaaaaaaaaactttcaatataatcaagggcaacaaacgaataggcatattgcatgggattgatacacctaaattatccatccaccgattaatcccaccttgctcatgtgcttcatcataatttcggccaccactgtttggcaccgattcactggagcccgaaaatgaggacgaagcggtacggcttttgcccgtttcagcaccgttcatattcccagtggcaccatctgctggccgttgattgttggaatgctttaaaaaatggacatgataatatgtattcattaattcttatcaagcttaacaaaatcataacaacgattcgtacaataaaaaaaaaccattttattgaaaatcaatttaaattttattatttccgtcagccttttttatattaaaaaatgaaattttcgtccattatttttcttgggactaattgcctttggaaaaaaaataaatttattgggttttcaacttttttgtacgagttgctttgtttaaatgaaaatgctctcatttctaaaaactttattgttaaaaattt

SEQ ID NO: 10630 - DNA, 2339 bp, Heterodera glycines
atggtcgtactttatactttatgagcatatatttattttcaaaaaaacttacaatttccaaattttgcatgcttatttttcgcattaatttcatttcttatatgttttaattagcctcctccccccgctattattacatttaatgatggtgatgtgctgtaaaatgatggtccggcactcgtttttcgcataacaatgcccgactgggttgtcgactgtaaacatgtaagtaacactgcttactgtatatatatatatatatatatggtagaaaaaaattatatttaaaaaaaataatgttgaattttggaatttttcttcacacaatatgccaaaaaacaaaattttatgccaaaaaattctttttttttttaaaaaaccccgacaggctgtggctctgaacgcttttgtagcggttgcaatgggaacgtctgcagcgagtgttggcgcagtcgacagccggtccgagcagtaacaggacgacgattctgctgctgctggagcatccccatggcacacgaagcggtgacagtaccgcgcagcgaagcgatggccggcacaattgctgagggcaacgtgcgtgccaagcgcgaaagtgtcactgcgggttgcgatggcatgtgccgaggactgttgccgacgctaccatatgtgccgctaccgccaccgtcatcattattactacggtatttgtccgacgtcttgcgcgagttgggctgactactgtaatagtaccgttgttgtcgctgttgttttacagtatcaacaccgctaccaacaccaccatcttgctgcagctttgcactacgatcgccactaccatttttgtccaaaaatagtcggtggaccggctggcacaagatggaagaatggcgtccaaccggtttgtatgccgacgaatcgtcatcatctatcaattgatcaagaacagttcgatgatggcgcagcgaattttgtgtcgtcggctggcatctgtcgacatgccaatttgatagatggccaatgctggcacgccttcgtgcacttttcataatttgtttagccgaatggattgttgaaattttatagttgaaataaattatttatcctaaaatagtttttaaaataataaaacattctatggtaatagacagggccataaaaagtaattacctataatttatttaaatagcatttattttaatttgaataaagaaaatttttcataaaatataagatctcaagtttattattaaaatgaaataattatttttaaatgaattaatactggaataattttcaaaaaaaaacatatataaaaaaattctcaaatgaaaaatataaaaaattttccatttttaatacaattttttgcagaatttctatttttgttgcaaaaaattctcagtgtcatgccaataaggctagggacaaataaggcaggccaaattgtgtaatttgtggcctatgaaatgcattcattggcctttctcggggcgggagattaaccgccgggccatcattttcagtaagtcagtcagtcatcagcttaggcatatccaatttcttctcttctgccccgcttttcggggcaatgtttttgggttcccccacaaattctcagtttcaaatttggcaaatttatttattaagaaatcaaaaatctatttttggtttaagttaaaaaaattaagaaaaaaataattcttttcaaaaattgttacaaaaataataataattaaaatagcaataaaaaaagcaaaaaaatatagacaagttaatatgttaaatattttattacaaataaacaaaactagtaaatcacttaaaaaattattttaattaataaaattaattttgatttaagtggaaacatttaattttaaaatattattatcataaaattgtgttgttataaaaatgggaaatgaatttttaaaattttttggttgttttatatctaaataataaaaaaatttaattaatatttctttattagaagtgcaaacattaaaaaagtttttaaatacatatttataataaagcatgaaaattggcaataaaatttacattgaaaatgccaattcgtaaatttaattttgtaatatgtcacggaaagcaaattaaattgcgccaatttagcatttataataattgagtgcgtgagaattaattaattttttaaacaagaaaaattatttaaaaaatgcttaattgtaagatattaaaatgattttaaagatctcggtttttaaaataaataaaaattactattttttaaatatgaaatttaaagtaaaaaccccttaattttttttcgaaaaaaatcttcgattatcattttgtattcccgtgtaaaa

SEQ ID NO: 10631 - DNA, 1193 bp, Heterodera glycines
cacttgacctggcacattcggcatcatgatctcgttgacttcatcacacgtgtcaatgtgcggagcgagaatcaaacgattgagcagctccttgtcattgccaaggagttgttggaagttaggatagacataatctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacacttccccccccccccctcaatctgctgaataaattggtaaatcgaagtttcgctgcaaaatgtccgtcccttcgccgcctttcccttctctttccaattccattttgtttaccctcaccaaatacaccaaagggaagggccggggggaccaccttattaaggggctgctgttgctgatagtgcgccattttatcattggccgtccctttgggcccatttgcctctgccgggtaaaacaattttgagaacagctcaaagagaaagtcgccgtacaaatgacggcgtgtcacaaagaaggagagcattgctgggcagtttcgatgagaaatgttagtgtattagtagattaagctaaacgaaactcattaaatttgtcccttttcaaagcagcccttcgccggaagtgccattttttgtgccactttttctgctctgttaataatttgcgttgtttcaaaaatgaaagtgttgtgttgcgcatgacagcaaatgaatgaatcgatcaaatcaaaacgaattcatttcccgcacatttagaagaaacgcacagagaaaaggaccaaagggagggaaaaggcaggaaaaataattgggcaattgcaattattgaaattattaacttttatcatcagaaacaatcaaattaaacaatgtttttcattgaaattataatatgatataaattggaatgtaaagggaatgaatgttttctgctgaacccgaattggcagcatttcgtgccaaaagcgacccgaatatttaattcacagaatatgaataacgccgaagcactgacttggttcggattggatcattcaattaataagaacattagaattgatgaaaaaacaacgaaggatggaaatggaaatggaacggggggggggggggggg

SEQ ID NO: 10632 - DNA, 1255 bp, Heterodera glycines
gtctttcaaaatgggatttgaaacaaaaataataaagaaaatgaatacatttgattttttattcataaattgcagttaaataaacacagcgttttaattattttggcctcccctcccagtcaggggtctgtaaactcgcttaaatacgagtccaacatttggcgatgatggaacgcgttttgtcgctagttttttaatagggtgtgccttaaaacggaaaagtcccataaattcaattaaactccattaattataaatgtttcaattgtatattttgacgagttcatttgaagtggcgggaagcgaagtgatcggacaacagtgctcaattcggacctgaaaagagtcagttccgactattgtttgtcagcaaacaaaataaatcgtacgaagttgaaaatgcaggaatggcaaaacacgtagccggaaacggtgagaacggtgtcatttttgcggatccgacgacaaattgggcatttgtccacttccatgcaaagagtttgctgttcagtcggtaaattctaaacgaaagtcaaacaaagtcaggcggaaaagcattccgaattcgcaaaacattggccaagtgatagcgtacgttgaacggatgcgtcggaattcgaatattccgacgcccttccacaaattgcccgaagcgacggccgagttcatccgagtagaaatactcgagaaattggaccaggaaaagagcgtaagtaaagagacggcccaaagtcgagggaagcgaaaccaacgaacgccaaagacgcgcgaaaacactgacaaagggagggaagggaagcgatggcatactttaggacttgagacataaattcgatgatatttcgcaaaatttgatcaaatcaaaattgcgtcacttaacgattgagtcaaaaaactcgcaaaaatagctgtctaattttatttcggataaactttgccatttttagaagtgccgcgatgagcacggtattgggtattctgtgtttctctttgcgccccgccgatcactcactttgtcctccgcaaatgaaaaggcaattggccctcagcgtcgaattgcgccacgtcggagagagttaacttctcaagacgacatttggccaaaagaagggaaaggctggggacagaagagaaggaaaagacgaaggccaattggaagagcaacgtgacgaggaagagaagggctttcagagacggataaaagcgaaggaaaagacgacgccttccctcgaagggaaaagggattgggggaggg

SEQ ID NO: 10633 - DNA, 3217 bp, Heterodera glycines
catactttaggacttgagacataaattcgatgatatttcgcaaaatttgatcaaatcaaaattgcgtcacttaacgattgagtcaaaaaactcgcaaaaatagctgtctaattttatttcggataaactttgccatttttagaagtgccgcgatgagcacggtattgggtacggtattgtcggcgttctgtgtttctatttgcgccccgccgatcactcactttgtcctccgcaaatgaaaaggcaattggccctcagcgtcgaattgcgccacgtcggagagagttaacttctcaagacgacatttggccaaaagaagggaaaggctggggacagaagagaaggaaaagacgaaggccaattggaagagcaacgtgacgaggaagagaagggctttcagagacggataaaagcgaaggaaaagacgacgccatccctcgaagggaaaaggattgggggaggggcaggaagaacaggggcactcacgttccccccccccccccccccgcatcggttcccccgagaaatttctgacggattgtccttcactgacggattgtccggaccccgggaagagcaagggggcaaatccgagggaaattaaaaccaaattaataaggtttttcagataagggcaaaagtgcgtcgttcgccttttttcggattgtttcgttttgcactgactttttgccgaattgcatccctttcactttcaatttgttcacttaatctttcgaatttgtcgtgaatgtaaggcaaaacaacctgaaggattttagtaggaacaaattctcaaattaattaattaaacgtttttgaacttacaattagaaaaagcgaccgaaagcgatggcccagccgagaaaaggacgacgcattcattcgccacggaacccttttcatcccatagaaattctcggaaaatgaagcggcttaatttgagaattgctgaaatttataaaaaaagacaacaaaatcgtttgagaaagcgattctccagcaacaaatgaagcagcaaaaacagctcgtcaaaatgagagtcgacgaaagagagacgacggcccgaaaaatgggaaaacagctgaaaatgggcaattagggacaacggcaccaattaaagtggcaaaacggggagaaaacaatcacaatccgactttgacccgctttttacatttaaaacactgcgaatgccctgcttcatcgacccgctcagagattcttgcgccaaatattcgaaaatggacggcaaagtcattgcgcacggattacccgcgtcagtgcgtgcgccgaggacagtagcaaagtttggatttagtggaaacattttaccaaaatttaatcttttaaatttagaaaatttaccaatttaaaaataaaatagaaagtatgaacaaaaagttgcttatttaaaattcattttccagtttcgagcataataaataaagtccttgggataaatataaatgcaagcggagaatgaataaattaaaaagctgaaagttcagtttggtcttcgccacagggaagaaaacaatgaaacaaatcgctggtcaaatcgttcgcgtctcttttctcagtccacctccattttttccccctttcttcggcccgggcgtcctccatggttttgctgctgtctgatcgcttggttttgtgccttttccgcccgtctctcctctttcagttgttcagggtcgttcaaacggaaaagcggacgaaaatcattgggcgaacgctttaacattgcaattccatacctaaaaaaggatgtaaaattgggtaatattgcgtttaaggtggtgattacatctaaagatttcttacatgactttccatcggagtgacgccaaactttgcttgccaacattagccgcgacattatgcgaaagttctaatgggtcctgaatgttgaccagagaaaagcgccatttcttctcaattctcttgtcttcgtccacgtaaagactcttaaattcgtccagtccaaacattcgcccgtcccgcggggcgatcacacgactttctttgatttgctggtagaggaaagtgaaaagccccttaaaagccactgggtaattcgtaaagtgtaacaatggaaacaaactttgagaagagtaggcagtccttcgtcgagtgcaaaaaaggaaaggtcgtattcaatgggccatccttcgaccaatcgggaattgtgccggagcaaaagttgaatgggcggaatgcgattcttctgctggaggaaagcgacgacgagcagagaaagggcgtacgaattccaatgagtcttcggatgggccgtcgaccgctgttttgaggtagccgtcgtgccctcttcgccctccgccgcttttttcttttctgccaattgagggtcaggcgagaaaagtccgttgcaggaggcccaaagtttgaaaaagaaaatgagacgccaaagggtacctaaatgagcgagaaaatgtaatttagcaaatcagggaagggaggggaaaagccataagtggacaatggggggggggaaattaattaaactctcatggttttcagaccttcttttttaaaaaaaaaaattagttttgtggctttcgagatagataattttaaaaaatgggtgggaaatgaaaattataatagattttgaacagatcttacagcaaaaatggcttattgtgaatttttagttggatttaatttttgaatttaccgagtccctttcaaacatgccaacttattgtcagttatgagactaatccacacgaataccaaccagtggtttcagctcggaccaaatcacgaatcaaattggctttgcattctcctaacaaattctgcacagagagttcacaagaaacgcgtgccgatgagaggcgagtcaaaaaacgaacgacgggagtacgcgcgtcgggaatgggaacatgcgcagtgaccgaccctttctccttgcgaaactcgttaataaggcgattaagcagacgaacacgatctgacaatgaatgtgagtacagaagtaaacagacaattgactcttcccttaataaacacaattcgaaacgctaaactaaaggaaattcgaacaaatacaattcgaaatgctttttggtcaatttgtactataatttatgtatcggtgggtatgaaaagtagcaaaacctattttgggaagtcggttgaaagtatctctatcgatcgggcttcgtttgagcttttcaggagtcagttgttg

SEQ ID NO: 10634 - DNA, 912 bp, Heterodera glycines
  misc_feature (194)..(194): n is a, c, g, or t
gaaagtgtttcgatgtgttcgtttttctgtcagtatcgatgtgagaaaattcatgaacatcttttttcaaatgtcaggttttatcaggacagcagaagcaaggtattttatgagtttcaattgcaaatttaccagttgactcccgaagtcgcttgctccattggcattcaaaaaattaagcacttcttcagagnttaatttcgctttgttcggaaagtgagcggcaaaaggttgccaccccttcgaagtcgacacgtctcggatggattctgacgttacactaaacgaaaaattaacggcacaacccctcgctgaaagcacctttccaatgcgcaaacgttcaaatgaattgagcaaattctgagcggcgtcttcctccttaaattccacaatggcaaaagcgccgctgccacttttgtccataatcactctgtcaacttcgccgaattgtcccatgatccgagtcaactcagaatcatcaattggcttcgtaaaattgttgagatatacagaacgattcattaatcgatctgctgttgctcgaagttcgatgttttgattgtgcacttttcccttgaggtgatcgtcccaatgtgcttgggaatggaccaaaacacgacaaatatcgcatttaaattccatcaagaagacgaattattaaatgattaaacgtaaattggaaaataatctggtgcattcagtaacaaaaaaacatttaaaagaaattacaataattctaactatttttttcaaaatctataacataaccgtttactatcatccaaattgatcaacagaatttgttggctcgttttggttcgctttctgagcagacttccaattgagatattcataaaacttcctttgtttttggttctgaaatattactcataaacaaagtcacaaatcaaa

SEQ ID NO: 10635 - DNA, 2394 bp, Heterodera glycines
cttttgtttagtttttgaattttcaatttttcatattttttgcacgtaaaatcttgttactcaaataaaacgcacgttaactttaaaaatataagattagtttagcgcctaaaattacccaaaaaaatttcgagaaggggtcacaaaagcgataattaagtgccataaaattacccttttcgtttttcaattttttatattccgtttcaaaaaatttgtttttccattcatcgtacaaattgaattccagtagcattttgcttctccacctgcccaattcagtgctattcaagaaatattccctgtaagtcaatgcgaataaagcatcgcgcggatttgcaattgttttgcctaaaaaattatggaaaaacaaaataattatataatgattaattggactgatagtctaattaatgtatgattaattggactgatagtctaattaatgtatgattaattggactgatagtctaattaatgtatgattaattggactgatagtctaattaatgtatgattaattggactgatagtctaattaatgtatgattaattggactgatagtctaattaatgtatgattaattggactgatagtctaattaatgtatgattaattggactgatagtctaattaatgtcttttcatctaattaaattattattactaaagccgggattttatgttagaaaggtaattacaatatgaattaaaaatggcaaaaaatatgcgaaatattaacataaatctcctaataagtatcaaaatgtaaataagattttttgcattatgctttctctttggataaaatttctttgaaaaaagtgattaagcacaaaagtcataaaaagacctaattatttgcaaaatagttttaggcatttttaaaaattaattttcggttattaattttaaattggtttttagtgattttttgattttcaaaattctcaaattcaaaataacaatgctaatggacattttttaaagattttatactgtatccccctccccccattcctcctacggtatctgctcacaaagtgtggccaattctttcatttgccaatcgcaaatcattgccacccgcacacttccgaggaggtcgatgaaattcatttgcgcttctcccaattctcttctgtttttttgcgtcgataaatcgcttaaatatttttttaaatttattattttttttgcattttttaatttacccaaaatatttgagcagtttttgcctttgccccaatgaatgtaaaaggtcactcagaaggaattccttaatttgttcagaaaattcgtcaacgattgccttcgctctcttctcattttcacattctttgtgatcaaaaattctctcaattttattatatggcaaattttgtgaatttaaaagtcgcaaaagttcgaatttgagacgtaacaataagcacatggcctcgtcaaagagttcataacgggcgaagaaaaattggatactaaattaataagattaagaataataattatttgtatgcctttgaatttgatttttaaaatgttcttattttaagctatttcttaaaaaacgaacaaattgaaaaataatgattttctcataaagtttcgttaaattttcaaaattttccaattggcgcctaacgccaaaaatgaaagctgattaaagaatatttatttaaatggaaaattgattaaataatattatttaaatgaattgatttaataatatttgtttgttttactttgctaagttggctttatgtttccgatatccatttaatcccttgggcatattctcgtcaagcaaaattatcttattttgatccaatttccatctcagaatgtaaagatgcgtgtaaatttcaatttttgatttgaatttttgccgaattccttcatttttcgctgtaaaatatgacaaatagaattcgtccagcaaagtgttccgcgcttttccgtaaggggaatagagaaattggagctcacagcaaacgtcaatgtaaatggctgttaaagcaaataaataatttaattaattaattagggaggggacagggggacgacgatacggtaacacaccgaacattaattacacttcccctggatatgtttgcttaataattctaaaaaccagtgatcagcttaaaacgtacatttaaagaaatttaagccaggcaatgcatttgtcggtgaagtgatcagatgaaaaatgaaagtaaaaacaattggagacattttacatagaatagaaacaacggcagtagaagaagcagaatatccaagctgcttaaatttatttgctttttcaaaaataattttaaaaaatgaaaaaattattaaagagaaggaataaaatgatgggtgagcaatggggggggaataggggggggggg

SEQ ID NO: 10636 - DNA, 3804 bp, Heterodera glycines
tgtaaaaccatgccaaacggcaggaaacgaataaaacgacgccttacaataaaaatgatcaaacatcagcagggaggcagaaaaatttgttgattataaatatgctaggatagattggcttgctctattagtatgaaaaatttcagaaaaattcattcagtttttagaaagttatggcaacaattgaaaaacggaaaagcaaaaatttgaactttaaaattataaatgcaatttcgaaatgcactaaaacatcaaccaaatcaaaaaatttaacgtagaaatgatatttttgagcccctttcttcatagcatatgagcagaaataaatatgcaaaatcacacagtttataaccccaattatcacataatgtacattcgtctcaaaatttttacataatttaaaaggcaattgaaaatttaaaaataaataaaattatttaaaaaaataataaaaaactatttctaatgtttcaacttattttgatataattaaatctttttggaaaataatgcgtcatcaacgcattttccactgtcgcatatttttttttagctgagtagttcaattgtcatgtagaacaatttggaatcgtttaacaaaaaactttgttattttaaaaaattttcttcaaaataatttagtttttttcgtaaaagcaatgcttaaataaatgttaaatgtcatcattaatgtttatctgtctttgtgcgagtacatttataaataagcatggttttgttttttggctagtttacttttgtaactttttatacacaaaattatctcaatgatttaaaaattattttaaaaatgtttttttctgaatttgcttcccttttcccttcttttgctgattctctgctcttctttttccgcattattttttgattaaattaaatgcttaaaatgcaaaatgtcaaaattatttttaaaagcgaaaaatacaaatttttttgtcttttattatttaatatatttttccactattaattaccattcacaaattcatcttttatttgttttgctgtggtcacatcgattcgattggccacatttttttcgggaaatattggcgaaatgattggcatttccaaccaaatttggtgcccatctctctccacattttgctgcattttgtcgaaccattcgcgccccaatgaccaactcagaaattcgcctttctttgtgtaattaattctggccaattgtaacggcaaaggccaatccctaattattatttattattatattattaaaattaaaaattaccaaattgagtaaatcaaataaaatttctccaccaaaaatggcaccgaaacatcgcccggaaacagcaaaaacactttggtcagcataacaaacaaaacttgggaattgaaatggccaaaatgggcatcgaaaaagttcctccctaaatattattattattattttattattaaagcaatttttaataaataattatttatttttcacttttcgcccataattccaaataggtataagctgttctgaaatttctcaatttgcttccgttcatcacttctctgtccgagtggtgatagattctgttgaattcgtttttggtcagcaaaagttcgaggattttcaagtgaatggcatggtctgtttaaatttgaatttttacaattaaatgattaaatgccatcgaaattcttactccacaaaacggtcattgcttttttcacttcctccattttgtgccttcttttttccgcctcctttttgccattttcttcgttttcgtttctgtcggtctctcctttttttgtggtttcttcacttttatttagcctttcaattttgttcaatattctcataattgcttcatcgtcataattgccaccattctctaaactgataataattgtcctttttaattaattataattattttatttttgtttttcatccctccgaattcattcgtttggtgatatgtcgttatttaaaaaccatcaatatgatttgatgaaaaattatttataacttagctcaaaagtaaaccaaatttaattcttgatatcattcgattattctctatcagtctacaaaatttcaaaaaatttatttaagtttcaaaaaagttgtggctagaggaactcaaaaaccttgttttcgcccatctttggccctacttttttgatactcaacaaaattttttgaaattttgtagacttatggagagttcttagggctattgaatgatattaagaattaaaaatttggttccttttgagctaagatacaaataatttttcatcaagtcatattaatggtttttccgccccattcgtttgtacggggccgggagagagtgggcacgggcgtctcgcttccgacgcggtaaatttgggtctccgtttcatttcccggggtaattactagggatgcgatttttagttaaatacctaaaattttgcgcatttaatacgcacagataagcacgaaaaaagcattttccacttggttttgggtgtctacgatgacttttataatacctatttttacctattttggagtttttctacctattatacctatttaaggattttcagagaattccttaacaaaaatgcaataaaatcaaaaaatacacccctaagaattggaaaatttttcccaaaaatttatttgtttttttatgtaacaaaatttttaatttaaaatgtcaatattttctaagaacatattaaaaatatttaaattattcgtttacaaagaaatagaaccaaaattttccccttttgtttgcttttttccactaaaaatcgttaataaaaaattttatttacctattttggtacctattttggaatttttgtacctatttaatacctattttgagatttttttttacctatttaagtacctattctgggatttttcttacctaaaaatcgcatccctagtcatttacatcaataaaaaaacaataaattttagcattttgattataaacagggattctatttttatgtaaatacatatttttttcctggcctccatgctctaaatagtgggaaaaacactttcttttttgtgtttgcgaacaaaagttgggacttttatttacatattttgggatttttctacatattaaatatgtacatatttttatacatattctggactttttcgcattttttcgtacatattttgcattttttgagaatttttaaggaattttttattaaatgcccccaaaaatatccaaaatttcgcaattttttcaaaaattttgagaatttatagaattttttgtgaaaatgtgctccaaaaaaataattttttttttttgaaatgggatatcaaaaattaatttttttttttttaaatactaaaagatgattctaagtctatttaggtcatatattttagcattttttatacatattttatttacatatttcgcgatttttcttacataaaaatggaagccctggttatttctaataaatgttctggttttggggttgtaccttattttggtactagttaagcttgggtcctacggataacagtacaactgagtacaaggtcccggttttgaccagttttgaccgggaccggggaattcccggcttttttcccggttttcccagccaaaaagtcccggtttttcaaccaaaaaagtcccggtcccggtcttgcccaaatttcccggtcccgctttcttacattttgcttgtagatagagaattttaagggttattgaatgataccaagaatgttaaaagttatgacaatttttttgtcgaaaaacagtacgagttgggttt

SEQ ID NO: 10637 - DNA, 2485 bp, Heterodera glycines
aaaagtaattaaaggagatactcgagagtctcagtttcgaatcgagaaaaaaaaattggcccaaaagcgctttatttgtatctgttacaaattgtcttaaaaacgatctatcggcactagggatagcattccgaggccccaaacattttcgaaaatcggaattccgagcccaaaaatgtcagaatcggaatttcatgccatccctgatcggcaccgccttccgaataatttggcaaattagtttcattaattatttctgtttgattaaggcactcgtcgctcgtgtgattgacaaaatgaacagagagtccaccaaaccgtttctgtatatgcctgtcaacaagatactcaccgtaaacacaatgtttggacataactatgtaatgaaaatgttggtcggagagtcaaaatgcgtaaaaaaagtaagtgcaacaatggactgaaattggcacaaaaatgggcaaagtcggcacaaatactaaaatactcaaaaaattttcccggcagcacctatcggcaccgccggaccactattttaccatatttttgaaaaatggagaccaaaacggcaataaatagtaatttttggcgaaaaacggcaaaaaattttgtaaaatacacccccccctaatttgggatttcaaaaaaacgaaaaaacaccccctaaaaatcgactgaaaaaagaaaaatacacccctaaaaatcgaatttttgataaaataatgctaatttttaaaggagccgctgcagccgccgccaaagattgactacacaaactgtgaagcgaaagctgacccggcggcgctgaaacgggcattaattaattcataataattatttattaattagcctaagccctaattaattactcttcaggattacaattacaccgagtgtgtgtgtggcaaactttggtgaattttgagtcgattgaattcgataaaaaaacattggtaaatttaataaattgttacgaaaggatgtatgggagggataaagtgatcaccaaattgtcaaaatgagcatattaaaatgccaccctgttgaataaaacgatcatccttaattatgactcaccgtcacaattactgtaaattgaaatttgtattttaaaaaatttcaaatccaaaaaaatttgaggaaattttttgatgatttgttcacaaatcgtgtacccctgctactgttttcacgcaaattaagaaatagaaataattatacaaatcaagtctttattttaaattcaacgagggaatggaatcaattgcccaccgaaccgctccctgaatttttgacgcaaattcaaaaaccataaaggggcatggcttttactcgcttaatatatagtaaaaagtgatttttgggaatttttaggacctaaagtctacccctattttggctatttttagagcctaaaaatataagcactattaatgagcacgacaatacatcaataacaactgttgggttctagtcggttttatgcgtcccatgtcagattatgcgtcccatgaatgaccatacccagtttcttaggccataacttttttcttacttggtcaatacccatattcttggtaccaagcgaaagacaaaagtctcgagattttataaatgcaagaaaagagcaaatactggcattaaaaaagaaattacaatgaaaaaatacgaaattcaacttttccgagtataattttttgtctattgcctttagctaaaaataaagttatacaaaagcttctatagaccttaagcttttgtttaaattcttaaagctagttacagtttcagaaaatcactaaatttatcctaaatgcatacacataacacaaataaaagttgatcaccgcaacaaaaagaacaatattatatataattcaaatgggctcaaattcattctccaacaccgcaattcaaattgatcggttcgatcacttctcagcaaatcattcattcacttctcctgatcacttgggcccatcattgcgtgaaacgtctaaaaaagcaacaatttcgcattttttaataagcatttgacccatcttacgctcattattaatttgaatgtcgattatgttccattggtgattaaattgccagtcaatcgcttcctcctcccattttgcccatttgtccgtgtcgcgcacaattggacaacggaccaacagaagacgatagcaatagtcagttcttttcaatgccaattgttcccgagtgaattcgttcgtcagatcaaatggcacaacggagtcatctccatcgaaagacaacatagacaatatgacaacaatgaaattagcaggggatgaagcattggcaaatgcctaaatatggcatgttaagaaatatgaaatgaatgacattttactacggttggggggggggggatcaaatatgaaaaatttctatttttcaacttatttttaggaacacatttttcaaaccaaaaacgagttgaatgccgtcctaaaacataataattctg

SEQ ID NO: 10638 - DNA, 1001 bp, Heterodera glycines
accagcattttaacacctttggcacattgtcaggacgaggagtgaacagccatttggcaaatgcttgtccattcgaagcattggcactgtcatcgcaaggaaattcggcgaagaaaccatcagaaaatgaattgataatacgaagcgatggacaatcgtttagaattgacggcatgaattgtcgcaaacggtagaaaattctggcatacaaatgcatggcacaaatgcttttcgcgatcattggccaaaatttgcgcaaaatgaactccaaagtgcggtcaccacccgtgtagatggccaaattaattggacgggaggtgaaaagttgacgaaaacggtggagaaaagcgatggcattttggtcgatgtatctgtgaaaattaaggaatcgttttacaaacagaaaacaaaaaattaatcattcatttcacttgattgaaatgtccttgaatccgacgattttctttggcaacgctttttgtggaattggcaaaggctttccagcgcaattgacaatttcccatccatttgtgccatccgcttcaaatttggctttaatttccatggctttgagcgcccagcgccgcgtcttgaagtgttcgtcgacgtaaaagtcaaaacggtggctgacaagtgcaattccaaggcccaattgagaaggctcaagcaaatcgaacacacaaagccaaccgtcgccggagatgaaactgaaaaaaaggaaaataaaatttaaaattgaaattgaaaattggcattttaattttacattgcttttgccattttttattcggcttcttttcggttgtctgacattttgttgcagcaaattattaagacagttttcggcactttttcagttaaataggctttattttcttagaaattcatatgaaaaatgcaatcaaagaaaaaagaggagaccttcatctaagtacataaaacaatcacgagaaaacatacattttattaacgtataccgaaatcttttttgaagctattgt

SEQ ID NO: 10639 - DNA, 5704 bp, Heterodera glycines
ataataaattaaattaatgaaaattttcaaacctttttgcttgcattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaattggtaggattttcatttaaaagatgataaaatatgtatcaatttaaaaaaaactatgaggaatcatattttctttataggaaacccacgagtatacaaaaaaaaaattgaaaataatctaatttctgtagagggattgaaccaggggaaagaaaaagggaaagtcaaggagactagccattaggccatttgcacactttggcagtgttacttttaaagaatatattaattattattttttatttttccctttgactccaattttcttcactaatttttcactcagacccccattcttaccagtgcttgtttttcccggttgccctaccgggaccgggacctgagcttttcaaaacccgggaaccgggacctcggatgaccgggaattcccggcccggtcccggtcccgtggcactctactatttagttttaaatttcattaaataaattatgacaaaagaaatttatttaaaaaataatattcgaatttaatatatattttatttattaaagtcgaaaaccaatttaataatcaaacaaatattcaatttaaattcacattattcagcggctccgcctgttttttcccgctctttttttggcttccaccaccattagcatttttccgcgctttcattagactttcttccatttttgtgatgccgccccggggcttccgtttgcgcgtttggacagtcaaaaatttcaaaaatatatataaatttaaatattttaaattaaataaaagtgtttaaaaaaataaattttctatattttccacctcttttctcatggtcaacggcctgttaatgttatgcagcttataatagagaccacaagcactaaaatgtgtcaatttagaattttttttttattaatttgtaattttaaattaatttttaaatttttatgttatttaattaattttaattttaaattttattttttaaattgcttgtttcacttgcacactggctccccatgttgattacgtctccacaatgttgttgaactgccatcacaattggaacacaccaaattttggcgccctccctttggcggttgcttaattaatgttcgttaattaacccattatttaattattttacattttttgttggtgatgcggatgttgaagcagcaaccttctttgttgtcccattttttggctttgatttcacactttttactgctgatgctgtggacaattagttttttttaaatttgattattaattgaaattatttttaaataattcattattttaaattaatattaatttttttgcatatttaaaaatccatttttaattcaccttttgcctcgagctgcgattgattttcaatggccttatagtgaatgggtgaagaattcaatttattgctgttcaacggggggagtgcctttgaaaaaatttatggaattcattataaaaaaaatcaggaaataaaaaaaaattttttttatgatttacccgaaaaaatgtaaaaaatatataaatctaataggattaaaccaagcactttttaatttttttttttttaattttttcaaataatcgcaaattcgtatttttttttgtccacctcataaaaaaacactcactgccgttatattctgtggtccaacaatttgttgatatgcaaatgcattggacgacaacacatcatcctttccctgctgattgtccatgcttggcccgtaaagtatgcggccctttaggcaaatttactttaattgaattaattagtttttttttcaccatttggctgctggccaagccgtcaatttcgagctgttgttgctgctgcggttgttgcagatgcaactccatttgctgctgttgctgctggtggtggtgatgatgttggtgttgttgctcatggcatggctcacaaattgcataactgaagaaatttgaatcccaaaaatgaattatggaatcaattaatcaattaattaattaattattggcaacaaagaaatattaatgaataactgagtttaattgattcattaaattgataggttgattaattagttaattgattgattgattgtataaaatgaatgggtgtttaattaatttaattgattgataattggttgatgaagtgatatactgtttgattgattgattgattgagtgaggattaattctttgattgcttgataattgattgatttattaattgattaattaattaagtgattgttttaattgtttgattaaatgattgttttattgattgattgattgattgattgattggaatacccgcgcgcatcaacgcggaccgattcagcctcatataaacggccaccacatgaaatgcactcgcggtcagcagcggttgcagctgcggccagctgttgcgatggaagcggatgaacaaccagcgaacccatcagaaaatcgccgccaccttcaattcagacaactttttacatgtttataaaaaagatattttggaaaataatttttaaaaaatcttaaaaaactttttaaaaaagccaaaacaataaaaaaaattgtggaataaaacttattaaattgaattaattaattagggtagagggaggacccagacgcctaccccgaaaatttaggctattttttgaaatataccgtggcccatatcctcgaaaacttattatccgacccctacactcaaaaatgtagccatttttcagggtataccccgacccgggcgctccgcatctggacaaaccctgactcccccgacttttttttacccccgaaagttcgggcgggggcccaccccgaatttaatcataaaatttttttttgaattttaccgccaagtgctgcggactgatgatggtggccaaccatgtgatgatgatgttgctgatggtattgcatcggtgctgctgcttcaatgccgccagtgataaacgctgaaaatgctgttgaaaaattagcagaatactcaatttcttaaattatataaattaattgatttaaatgatttaaaaatggataattataataattaattcaccctgttgtccagcaaaaagtgggccaaaatggccataggcattgagcgaatcgagcgaagctgagcccccaagcattgacgaaggctgaccaaaataggatgaactgcaaaaaatatgatttaatataaagaaaattttttatttatattgaaaatttaaaaaggacgtaaaaattaataattttttaaataaataaataagaatttcaaaaacatattttctatttcttaaatttttttaataatttcaaaaaaatattttaatttcttagatcatttaaaagtgtattaaaatataaaaaaatgaaaataacatgaatttaaaacatatttcaaactttgtaaaaaatttttaaacattaaatatattaaaatttgcaaaaaataaataaataaataaataaatgattttttactcagcaaaatacgaatgcaacggttcaatgtaatattgtggtgtttgactgttccatgagttgctgctgttgtgcagctgctgctgtgcatagaacgtgccggtgttgttgttcattgtgctgttgttgccctccactggggcagcctccattttcagtgtgaaaactagcaaaaatcttatcaaaaaatttgtcatcatttttttatcaaaaccaaattttgccgaccccagcgccgacccttttatcattttaaaggcaattagggttaatgggatagatattatttcaacagataaaggttgggtggtgatgatgatatgatagttttcagttctcaagacttaattactctcctcgttgtcactcttgagatattgtggtacccaaaaatggcccctccggcgtttttgggcgggggcgggagaaaaattgttgtggacaacaaatgacagcaacaacaacaacaacaacttcaagacgtccacttatcataccatctttataatcattagcaccagaaaaattatcatttttctaatcgctgattttgttggacaagatttatcagcacccacacacacccaacggttcaatttttggggggtatatcagtgtcagtggtggtggtggtggaccccggggaaaagtgccgataaatttttcgactcgtccacccccatcatttataagtaattatgatttgattaatcatttttcacattttctacgcccagcagtgagtgatttaccccaattttttgtagttgtcctttttttggcaggaaaattttctaaaaaattgcaaaaaaaaaattttttttttttttgtaattttattattaatttattatttattgttttttggacatgtaaaatcagtccattttgatgaggaaagtacaatttgtgatgatgatggtgattgaaagaggaagaaggactctgtgctcttctcatcatcgtcataagcccgcggtgatgaatgaagaaaaagaaaggatggtcccacccaccaattggcgttgattggttgcccaaaaacttcaaattttccgacaaattacggtattttttattggtaaaaaagaaatattttacaactctttttgggaatttttttttatatattttcatttaaattccgtacaaattatggtatcatttatttttaaaattaaaaaagcatattttaaactatttttgggggaattttttaaagtttttaaaatatttacattttttttatttaaaaacacataaacatttcacgaaatttattcccaaatattttcaaattgaaataagtgccaatttttgagagcattgctgcccattttggcatggccgtttcggtaattgcttaccaaaatgttctgctgcattttacctatcccaatagccccatcctgctcattttcgtcaattagcgacactttcaatcacggcatttcacacattaccacgcagcagccgacaattagcggctaattgaagctacaacaatcttaattacttaccacgcagagccgacaattagaagctactacagtacgcctaattaccctcccctcgcccagcgcctcatatgactatgaggcgattttttttttggatcgatcaacagcagcagtgatcatcgtcccatacatattttgcttgctacctgccctcccaaatatttgccatcccagcaaataaaatttcccccattttttcatggcaaaaagtggtggggctcattaatcgacggacggaaagaatccgtctcaaccccccgcccccccccctcagttccccaacaaaatcaccgccattttttccaatttctaagacgatgttgatcatttgatagtaatgatgccttcctccccccccccccattccccctcatctcatccctcattagtcaggctccaccacaaaactgataagaaattattattattatggacacgaaaattctcccctactgctttttttgatgt

SEQ ID NO: 10640 - DNA, 1018 bp, Heterodera glycines
gatcaaccacttactaattctggtcatatttgccactgtttccggcctatgccatcgtcgccatcgctttgaacgtgccgaaaagtggcggcggcaaattttgtccgttaatcaacgaatttgccaatggcaagcagtgccaaatggggcggcatttcctttgacgctaaaatttgaatttgtaaacaataagctatggataatactcacttttgaaaattttagtaataaaacagtcatttgatatttaatttaaatattttcttaattcaatttaattgcttttcaaatttttcttttaatttataatagaaattttttgaaattttattaattaataaacttgtattatttaatagatttataattctgttaattgttttttcaaattttccatttttgattcaataatttttttttaatttttattttatccaatccgtgcactttcaattgttttattattgttcaaacaccaaacaaaagcagcacactttaagtggtttgtaaaattgagttaaaaaacacagacaaaaaatacaaagctacaaaaaacgtgtgaaatttggtattgcaaaaaaagcacgcaaaaagtgaatattacaacggtgtatttcggcatttttatcattgtgttttccgtcaaatccacattgagtaatgacgtgacaattcatccgcagcagcagcaacgtttggcaaaagtggcccaacaaatggtgccgacgccataggcgtgtgctcacgtttttgacggatctgcaaaaattgcgtgttaattgaaattagccacactaattgggtttaattgtttaattgatgcacattaccgcagtggccggatatgagccaccagtgcggggcaatgcgaccacattattgggagctcctccgcttaaaaaaaataaaaatttgttgagtcattaaaaagtaattaatttttaaatataaattttaatactttttttaaatttatttaacggataaaaaataaggataaatgacgctagcaatgaaa

SEQ ID NO: 10641 - DNA, 4871 bp, Heterodera glycines
  misc_feature (64)..(64): n is a, c, g, or t
  misc_feature (98)..(99): n is a, c, g, or t
  misc_feature (101)..(101): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (124)..(124): n is a, c, g, or t
  misc_feature (147)..(147): n is a, c, g, or t
  misc_feature (149)..(149): n is a, c, g, or t
  misc_feature (161)..(161): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (184)..(184): n is a, c, g, or t
  misc_feature (188)..(188): n is a, c, g, or t
  misc_feature (195)..(195): n is a, c, g, or t
  misc_feature (202)..(202): n is a, c, g, or t
  misc_feature (204)..(204): n is a, c, g, or t
  misc_feature (212)..(212): n is a, c, g, or t
  misc_feature (214)..(214): n is a, c, g, or t
  misc_feature (217)..(218): n is a, c, g, or t
  misc_feature (221)..(221): n is a, c, g, or t
  misc_feature (243)..(243): n is a, c, g, or t
  misc_feature (245)..(247): n is a, c, g, or t
  misc_feature (249)..(249): n is a, c, g, or t
  misc_feature (267)..(267): n is a, c, g, or t
  misc_feature (270)..(270): n is a, c, g, or t
  misc_feature (272)..(273): n is a, c, g, or t
  misc_feature (278)..(278): n is a, c, g, or t
  misc_feature (298)..(298): n is a, c, g, or t
  misc_feature (300)..(301): n is a, c, g, or t
  misc_feature (308)..(308): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (4696)..(4696): n is a, c, g, or t
  misc_feature (4778)..(4778): n is a, c, g, or t
aaaaatgaaaatattttttattagttttatttttcccctcccccagcttgattatttggaaggncataaatccggatttcttctaagggtaaaaaatnntnaagnaatatnanttgtnaaaagntatgaaaaaaaggaaataaagananttgatgtattanatgganaanttatgnataaaggnatanagatttntatatgnantttgaaangntanntgnataagataaaaattgtttttgngnnnanaaaagataatgttgattnatnanntaagnttgaagtggaaaaatggttntnnaaaaagntgantaanantatttatataattggaaatggatcaattggagaaaatacattcagactaatgaaaagaataatgatctctacatttcgtgctccaactgtttgtatttacgtgaaaaggaaaacaatactagatctattatctcaacagcagtgcttcgacaaggagttaatcttattatgttgcgctcggaacataattctgagtgtaagccagaaattttggaaaaattaaaagccgaacaaatggaccgagaacaaagaaaagaaaatatacaatgtatatctgagggaaaaatttgcacaaaattattcggtatgcagacaattatattcattgatgaaacaaattgagaggagcaattatcagctatcaatttacgggattcccgacaaattgaaaaaggaggtaaaaatttcatgagcttagaattctattaaaaacagacaataattggggtgtaaacattatgatcccgaacttaacttttttaattatttgagcttagaataatcagtggtgattttcaggtttaaaaaatctgcataaaagtccaaaaatccaaacaattaattaactaaatgtattcgaacaaaataagcaacaaataaatataaggggcaattatccgatcaatttctattcataactatcgatcaatcatttcctaataattctttcacttttcttctgttgctgtccgctgggcccaggattcattttgagacgattttttgcttaatttggcccgcttctggtggagacaattgcctaattaaggtcaatttgaattactttaaacaaaagaaaatgttgttgccactcgcccaaattcataacgaagatgcaacttgacattgttcaatttgttcgtctttttgtcgtcctatttaaccgttgccgtttgcccaatttggcatcgtttcattatccattttttgtaccatttatattcggtttctttggccaatgtcagcttttcgttggtccgttcattcaccaattaaaatgggccaatttgctttgatttaaaatatttaattcgaatttcgtagctggccgaagaagagttggcacggagaaatgcctataaaatgggaaacgaaaagcaaataaatggcaattaatccgaatattttattgaaaatgtggccacacctctttgaaattggtgatcattcttttggtttttgacgtataatcacaactcaattgctttggctttccattttttgtcagagtgtgcaaccatttcaaatggtgaatctttggcgcaaaaatgggccaaatttcgggactgggtcgttttggcgcccacgttttggcgccgacgatttggcgcccacgttttggcgcccacgttttggcgccagggtcgttttggcgcccacgttttggcgcgaagccaaaaattaaaaagggaaagacgtaaatttcaaaaatgttgcaaaaaaaggaaaaagattttttttttcaaatataagtaaaatttaacaaaatgaaaaaataacaacaattcacgggttcatatgataattgcgcgaaatgccacgaagaaattccaaaataatatgaaaatttggatttatgtggtaattgtgatcattttcattgttcgggttcaccgggatgtaattctgcaccaaattgaagaggcgctcatcagccgcttggtaggtatttcttagctttctgcggtggctcacgtccagcaagaaatgacgcatacttcccatcggtgcccttctgctcacggcggagaacgtcaatgaagtgccagatcgatggatgacggcagttgaaggcgccttgaagacggtgatgttctgcctctgcgtggttgttcgtcctttcttccccgttcagtgtgcgagtgtagacgtggcagcggatatttcggcaacggaaatcgtctcttctcaacaaacactgttgcatttgttcgcatcttgctaatttttatcaaatttctaattgtcagttcgcttttgccatcgaaatgtttgtccactaaaacatcgaaacgaggcgaaagaagtgccaatttgaattaataaaaaaaattgcacaaaaatcaagcgtgaaattgtgtttcatccacctttatatattcatgtgaagtcaaagtcaatgttatgaatgctaaactcaaatcgacgcagttgcgatttgtatcatcccatttttggccaattaaaattttaaggactccaaaaaacaggaaaaaaacaatgaaatgatggacattccaatttggcagaaattgttttgcttttatgcctccaaaatatgtaagtctattaataaatgggtgtgccttaaaaacaggaaagtacccaaaagcaggacggaaaacgggaacggagcacacgtgacgggattattcgagaaaggatttttagatgcttcaaatcgcaaatccggtacttactaacaaaagagctgaaaaagtgccaaaataatcgtccgttattcaactcgtaaaaattaaatgtattcaaacaaagaagcaacaaataaatataaggagcaattatcatatcaatttccattcctaatgatcaatcatttcacaataattctttcactgttcttccgctgtcctctgggcccggcattcattttcagacgaccttttgccttcattggcccgcctttgcggagacaatggcctaaacgaaatggaaattaaattgtcgagacaaataaaaacaaaagccgttgccactcacccaatgcaatttccataaagcgaaatgatgacattgttcaatttgtccgtctttttgtcctcccattgaatcgtccgcccaatttggcatcgctccaacacgcaattaatatgtgtatatacatgatcatcatcatcttctgccttcaatgtcagcttttctttagtccgtccgttcaccaattcaaactgcgcaattgaggtgtaagttttgaattggattatgtaactggcagaagagttggcacggagaaattcctaaaaaatgggaaacgaaaagcaaatggcatttaatccaaaattttacgaaaatattggcacacctttttgaagttgacgacacattcattggtttctgacgcagagccacaacaaatcaattgcttcggctgcccattttttgtcggtgtgttcaaccatttggtcaatgcttgacgagcagttgcatttggcccatcatcagcaatcgccgcgggcaacaaattatcggagacaattgaattcaattggttgcaatcggtgaaaattgtcggtgaaatgtgacaacgcaaatcgcccaaatgatggccaatcaaatgccgaatgtttggcacgaaaatgggccaaatttcaccagcaaaaaaattccaaattggctggacaatgcctttgttgtcataatgcaaattatccaaatccaaatataaatccatatgggtgcctttctcaaaaatttgccggttggaacgaagaaattcgatgacggaatggccaatgtatctgaaaaggaaatcatttagatgtatcatttagtaattctttgatttactcgattcgaaggttgataaagcggattttgatgggcaacggattgctcttcgtagccacagatagttttgttcctttctttgcaattctgatttgtctcaaaagtggcaattcgcttttgccatcaaagtgtttgtcgaccaacgcgttgaaccgtggcgaaagaagtgccattttgaggccgagttgagcatggtcaagatgcaggaaaatgtccatccaaacgtcattacacacccaactgaaattgaatttaaaaaagtttagttcaatgaaatatgtaattttataactcattaccgtcggttcattttgcggcaattggcacaatttgcgtattatgaaggatgtcacaaagagacgattaattgcgttggaaatgtttttgataatgagaggcaaatagaaaaagcaaacacttttatagtcatgaaaatggaattgaaaaaatggagatatatttccttaaatctttgctgtttctctctctttataaatgtattaaaatcgaccaatggccttcagtttgtaaaaaaagaaaattttcacccgaaaattttaaatgattttgcgtaaaatttgaattgcttcctgacttcattaatgatgctgatgagttccgctcgtccgtcattcgtaaaagattaaaaataaggagtaatgactaaaagacagatgaatttacaattttttgacgaaaagtttaaaaaaatcgccattttttggaaaaaaatgaggttgaaacaaaacccccgccggggattctaattgaataaataaattgaaaacagagagcacttcctttccatccgaaaattctaaatcatcataatacataattgacagaaaanatggaattttgcgattcatttattctttacgcccaatttttgttttaattttttaaaaaatttcctttatttaggctactanattacaaaatattttttctaaatggcacccgccaaacaaaaggaaaaaactttctccgccaaccatcgcctcaattctgcaactgatacaaat

SEQ ID NO: 10642 - DNA, 969 bp, Heterodera glycines
  misc_feature (43)..(43): n is a, c, g, or t
agatagttttgttcctttttttgcaattctgatttgtctcaanaggtggcaattcgcttttggcatcaaagtgtttgtcgaccaacgcgttgaaccgtggcgaaagaagtgccattttgaggccgagttgagcatggtcaagatgcgggaaaatgtccatccaaacgtcattacacacccaactgaaattgaatttaaaaaagtttagttcaatgaaatatgtaattttataactcattaccgtcggttcattttgcggcaattggcacaatttgcgtattatgaaggatgtcacaaagagacgattaattgcgttggaaatgtttttgataatgagaggcaaatagaaaaagcaaacacttttatagtcatgaaaatggaattgaaaaaatggagatatatttccttaaatctttgctgtttctctcactataaaggtattaaaatcgaccaatggccttcagtttgtaaaaaaagaaaattttcacccgaaaattttaaatgattttgcgtaaaatttgaattgcttcctactttctttaaactttaacgatgctaataagttccgctcgtccgtcattcgtaaaagattaaaaataaggagtaatgactaaaagacagatgaatttacaattttttgacgaaaagtttaaaaaattgccattttttggaaaaaaatgaggttgaaacaaaacccccgccggggattctaattgaataaataaattgaaaacagagagcacttcctttccatccgaaaattctaaatcatcataatacataattgacagaaaaaatggaattttgcgattcatttattctttacgcccaatttttgttttaattttttcaaaatttccttattttaggctactaaattacaaattatttttctaaatggcacccgtcaaacaaaaggaaaaactttactgcgccaaccatcgcctcaattctgcaactgatacaaat

SEQ ID NO: 10643 - DNA, 1865 bp, Heterodera glycines
cttaaactaaccattggggaagagaacgaaagataattgtcctacgcggaggccgcgtgcgaggaaacgctggcgatgccgcgccactaaattgtgcacgacgcattccctcacccgcggggcgtcgtcctcctccattagcatttcgctaattggcaaaacatcgtcctgaaaggaagcgatcaaacctcgcttaaaagtcatttctttgtgggatttgatcatcggtcagctcattctcgctagtgcttctcaattgattccgaatcaacaaatgatcgctaattagggaaattaactcccaatgcccaatgatcgctgatttagtattgattcctcattaaagctccctgccaaatgattactgataaaatgcgtgttccatttctccccctccccatttaccagttgattaatcccttcatccatcatctcttctcccaaaatgtctcttcctcgcaccatttccacttgcttcttcactgatgatgatctccgccgtgaattggccattctccgcccaatttgctcattttcctcgccctcggcaacagaagtcgtggaaaggccggccaaattgaacagagagccaatgccgagagacattcgcaacgaacgaaggaccattttcttgtcctatcatcggagagagcgatcagaaaacaatgccaaattaggggagggtggagagactttgtaagcgatgaatgccatttcgagaagagaggcgaagataaaagcgatgcaaacgaacatgaagtaatcgatggactcaaagggggggggcgatcagagagaaggaaaagccgatcagagacgggacggaccttcacataagagacgggcggaagggaacctatcacattgccaaactgaagtgatcagaacgggcattttggcattggtattttccaataattgcctggagacacaacgacatcagcgtgttcactgaaaggatcactcgggcgggcaaagccttaagagagatgcaaaaggcgatccaggagaggaacacgttgatgtacatgttggcatacaccttaaacagcaaatgataagcaataaatgggataatgggcagctgatgcctgaagcacgtaatagccgtaacgacgacggaagccgacctctaccgtaagccgataccattcgcctgccttgtagtactgtaagtgtgggaatacgggattcctatcctttgtttgctgcttacctccgtgtgtttgtagtgttttgtgtgggtcagctcaaagtcggacgcactgatctccgccgtttggagagtcaccgcggccaacggtagccaatcgatggttacggtagcggtgttgaaggagtaactctcgaacacctcaaaatcagagtgaaaagggtattttgatttgcgagaccaaagagcaaagaacggtgtccattgggaagtcggacagacgaaattcgcatggcgcctcaacacggaccgaaaatggaaaagggcacaattcaaattgggaaaaatgctttttaaggacttttaaggacaaactctgtaattgagccaaacggtgccgttgctgagcagcatcaaaagcacgttgggctttggcgagctgtgcacacgactcatttttgtgttcaccaaacaaacatttggcgaccaaagaaactgtaaaaagagagaagagggaaaatagtaaaacggtacaaaaaaatacggtaggaaaattacaaaagaaaaaaataacaacaaagtttgacaggataaccttttcaaatgtgtcgtcgaaagacaaattttgacgacacgaattgaaatgagcaaaggaaagtcgcgggtcgtgacaaatggcactgaaccaaaggtcggcggagaaggaattgct

SEQ ID NO: 10644 - DNA, 952 bp, Heterodera glycines
ctcgttgatgtcctgaatggtcgtctccacgaacacagccacaggattagaagggctaacacttctaaagaaaggaacaccaattaacagaagatgctaattgggatcagctaggaaagaaaaaacggaaggtcctaatggcccattttgaactgcttgaaaaggacgaaagaatgcatcttattgtccatttgtcattttactaatgataattactttttttacctgctgtaattgttcaacaaaagcttgatcatcttttccgtcggaattgtgttgcatttggcaattgagtgttcttttttgcccattttgtgctgtcggattgggtggcgaatggggccaaaagtgggcgaaacagtcggaggacaacagcacaaacagaacaaacccatggccaaccaatggaaaagcattttctgatggaaatgcccgcggggaaatgggcgaaagaaacccggcaaaagcatagccaacggctgacggcggcacggcaattgctcaacagtgccaccccaccattttcattttccgatttgcccctcccccgcccccttattagcacaaactgcggggtgccaattcaaaatgccatcggagagagttttctgctcacaattacacgcaaacattagcaaaaagaaattaaattttatttttccgtttggggccaaacatccaaattaaaaaaatgttaacaaagagcgcgcttaacattcacacggtttccatacgcataaattagccactcattttattgcattttttaaaattttatgggccccaaacggaaaaataccgaaatttagttatttttttttatttttcatatttttcgcattaatttgtttttatctgttaattattatttattttattaattatttttgctgattatccgaagaaagaaagttgcctttttatgttcatttttcacccaattttccagact

SEQ ID NO: 10645 - DNA, 2418 bp, Heterodera glycines
aggaagaaaaaggggaagaggaggaagagacgtaagaaaaggaaaaagaagaggaatattgaacaaaaggaaagaagcggatgaggaaaaaggaagagagacgagagaaaaggaggagaagaaggaagaagagatagcgaaaaaggaagcaggaggggaacgaaaagaggtgttgctgaagccttatgcataaattattccaccggcagtgacgaccattgaccattatattttatttgtcctactcgcaccccccccccccccccccccattggcccatgtcaaacaccggcccaaattcgtcgttggcgcggaatgactgttctttgaccacgctcttaactcatttgccactgctttttcactgtgttcatccgttctttgcattgcgaaagtccatgaggaatgcaaatgccaaagtgtgccgcccccatcaatctccgctccctttaattgtgtccaaaaaccctctccccccatttgtgccaaatccttggcccactattcgtattttcaattgttttcctccctcagattgatgaatttgtctttcactgccgccaccacattatcaaatttcactctttcaaatgcagcggaagagccgaccatttccttttcagtgccttcggcggatgacgcggccgatgcccgcgagatgcaagcccgtgccaccataaaattggtgttttgcattgcctatgccatcctttttctgctcggatcactcggcaatgggtcagaaatgatcaaatgccaatttccacttggcaatttccttctctgctcggctgatcagtcattggtcccaatttgaggttggtcattgtgatgatttgcaacgttttgtccacgttgtcgcgcaatcggaggaagacgagtcggaagatgctgatggcaagtgcggaacacgtgttcatttatgtgctcggtcagttttatccccgtccaatgctttttcctccgcttaatccctctattttcttttccgatgattcttcccctccatccggaaaattggcatcagaaaaagggacaccgaaaaagcttattcgtgcaattcaaatgaaaattgcgatttggttgggataacgaaatttcttgatatcgatgccgaaatttgaacccgaaaattaattgttttgagtataatttaccgtctttgtccaatactctccggcgatgtccaattcttacaaattattttccgatttttttatttccaattcgccccatatgatcccccactttccgtccttcctcccaggtctgtccatcgtcgatctgttcgtcatcctccatcttccgcttctcatcttcgaaatgcgcgaaggccaatggcccttcggcgaatttatgtgcaaattgtattggtttggagaaagtgtgaacaaattgttgagctcatttttgatggttcgttgattgggtcaagggttgctcgatctcagctctcaaatcggggaatttcccggctttttggtgtttcgctttcgacttttggccatttagtttctattaaaaaagattttttactcccttaaatttcaaatatagttttgtttttggcttgggcctttcttttctcggttctctcgagcagtccttttctgtttgccgtttttcttcaaactaataaactgttcagacggtgcttagctgggaccgttatttggccgtttgttcgccaatcaaatcgatgaagtacttaataatctttatcaattaattgctgggttataaaacaatcgcaaattttaatcaataactcattaattgattgactaattattttgttaattaaggatgcgcaccaattcaggtcgtccgtcacttccatcgtttccgatcacttttctcttcactttcccaagtcccttcagtggccatcaccgttctgatcagttgctccgcgttcgccactcttctcctttaccccgtcctgaaagaggccaccgttttgcgggtcaacaaactcaccggagtacgtcttcacacggacgacgacggggggagcagagacagcagccgggggggacacggagaagaacggagtgagggggggggggagtggaagagtgaatgggggaagcaattccaggaaagtatttcgctgacccacacagtgttatagtctcaaattggagtcttttattattaagatgttgtctaaagtcatgaaaggccgtattatattatgtatatttcaaaatctatgaacgcgaaaaggctaagggtcctaaattagactcattttgattttataaattgtgaaaaattttggacatttcgtgggtttttactcttttggacatttcgtggcttggacactttgagggggcgccaattattttcgtaaagatatttacctttttttgcgttttttccatttctatgacccccccccccccctctccc

SEQ ID NO: 10646 - DNA, 974 bp, Heterodera glycines
  misc_feature (18)..(18): n is a, c, g, or t
  misc_feature (26)..(26): n is a, c, g, or t
attgtaatttaattcatntaaaattnaatttaaattaattttccatttctctctgattattattttttttgtgcttttccctttgacctgatattcatccaattgatccgagctgaatacgccgccctttgagaaaaggttcaaatcgccaagtgccgaacccgtgttgcccattggcggagaatttgccccgagggaaggaaaggaattgccgaattttggaggaatggccacgggcaaagagaaagcgtatcgaacgaatgttttgcccaatgaaaagggcgagaaaaagagaaagcgaaagaaaagagagagaagggagagacagagagaagagagagagaaaatgcaatggagaagaaaaggaaaggcgttaagccaagagtcttcgagactctcgccaattaattaagaccaaagggatacttttatttttcattttattttcaaaaaattaaatgaaaaaaacgaaacattggcattaataagcagcagaaacaaaaggcaaattagaaggaaggcagctgatcagtcaacaaatcgttggagaagaagcttcatcttccaattgagtcgttgcgcaccaaagaaaatccaaatcaacttgttttgcttattgccaaagtctttgtaattattttggcgaggatttagggaagaaaaatcccaaaagtagcggccattgggtcaaaaaatggcgaaacaatggatgtttatttcttaagctaaaaattttggcgctatttgcataatttattttttgatttttatttctacagttttatttaatgcttttttcatttttttaacagatggtcaaatttcctgacggaatcgtaagtgtaaatgaacgagtttttagacttaatttcttggctaaaggatggattctctgtttttaatgactttggttgaattattgtgccataattacaatagtaatgcttatttttattaataatgtaacattaaaa

SEQ ID NO: 10647 - DNA, 4689 bp, Heterodera glycines
aattattttcctatttcttaatatttttctactctttctcttcttagcttatttctcactgttgttctctattatcccaaaccttcttctatatgtctaaatatcatttttcgttaactcatttctaatgtccaccttccaaccaaatcttctattctcaatcactccttacactaaattctctctatctaaaattgtctctcttcaactatctctgatttttataccattcctctatccttttctgacatttttcactatttcttacttccacaattaatcatccgtccattcaatgacgcagtaattggtcaatatcctcatatgttctcttcactcttcatttattcgttttacaagtcctttcttcactatatatttagccattagtctaccgtttctaacatacagtcagatatttggaaaaacacactctataacatatttattttcaccctcaaaagtgtacactacatacgcccatacgcacacgcacacacaagtacatgtatgtacacgcacacgcacaccaatatatgtaaacatttttttagtaatttctccatatattcgttattttcataaattttcttaaaattgcatcgtaaattccttaatatttcacaaattgtacttctttctcttaattatgcatttttctacccaaaaatgacattcctgagtgcttaattattttcaaattgtatcttcaattgtttaattatgaatgcattaaaattacacaatttgaggtataaaatagagaaataaaagggtacatgcgtgtgtgagagatagagatagagatacaatgagtggtgaatgatgaacaagacaattacaatgtgtgctgacaaaatagttacaatcaatggttaagactataaacattataatcggctcctatcctattatccttcctaacataagcatggtaaatttttgcatagagcttgatattacagatccaccatcacgaatatttggtctaaacatttttggagataccaattatttgctaaatttaatgtttttcataatatttgacttgctgtttttatatctaaagccttggttgtttgttaaccacatcataattaagtatcattccacggtttttgagcacctattccatttttcatcatgtagaacatttatacgttttaaagccaacgcatactattttgcaccatcagtgcagaattctacgatttccatcaatgaactgttttgtcgatcttattcagctaaaaaacattgcgtagatgtgagaaaaccaagactatccgtgtcggtggagagtacttaacgccccggctatatcatcatttctgaatagttttattacccactttttttattttcgtaggtaatcaaaacatgatacacctttcaatcctcgatggccattacgtctattgaacgattatcccaaatattctccaaaatcaagtacatcattattgaagtaaagtctgttaaaggctgtaatttcgtaaagaaatatgtcgcacaaattgttcaagcatagtttggcaatcgaccgcttccctttgttcacagctatctttgttgggttaagatctctaatttctctttgcactctcttacaaattcagcttccttctcaccatttccttttttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaagggtagagagaaatgaagtcaaatagaatttttttcattccgtcttcaaatccgctcatttatttgttgctcattaacattttagcgatctcgtagcctaatacacttacaactggatggacaacttgacttcgtataaattcaaaacgttttactttcctctcccgcactttatcttttatttttttcaattagacattaatatacatcttctaggtagcgctaattgcaggcatgctaaacatatccgcttacttctattgcagttctctctgtttccaactattcatccacagaataatgatcaatttgccaagtgttcagttgaaaagttattgatctagaaatatcgcatacaggccttatactagtcatacattcctttagtacatcaatgggtactaaaagacgctgccttcccttaataatgccttagttcttttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatgtacttaattttaatcaatactattgtatttattatttttattataatttaattttttaatttagttttatttatttttaacatttattttcttttaattttaatcttatttttattttactttttatttgaattaatttgaattttattttattttatttattattcagttaatttaaaggagttattcagaacctctatccaataaaggctatttcgccgctcagcacggcataaaaggtactttaaccgtgcaccgtttagcattgtatgatatcctcactattttcaatatttttacttgttttaattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattatttaatttttcaatataaaatttctttcttccatcattataatgtttttgcttagcaataagtaaaaaattccatatatgcacgctacccctctccgcctcccatctgatatgaaattcttaacgcttttttcttaattatattttaatatttattttttctacaactcttcatctcttcattaggcttgggttatgacacaagtaccatttgccacccctccagtcgccacatgtcaccacacccctcaaataagttttgggttatacgaccaccatttggcaggttgccaactaaattgttcatgctatgccacactacactaaaatgagtcgccgtatgaccaacattttatgccatccacggtcagtcattagcgcttaaatgaccaccagcgggcgctcagatagcccatgcgggcgcttaggtgacacgtgcgagcgctcaggtggcctggcatcccttccctccccaaaggccacgacagctgatgtccgtccctccaatacgatttgactttaataattatttaattaattaattttatattttttcatttatttttaaatttttatctattattttaattttattttaatttatttaacttacctaattttaatttattttattttatttttaatttaatttgaatttatttaatttaattttaattaaatttaattttttaattaatttattattattattatttatatttttatgtggtattagagagagcaagagaaaagagagagagtgagagagaagagagaatgagagagagagagaaagaaaaaagagagagagtgagagagagagataagagagagaaagaaaaaagagagagagtgagagagagagaaaaaagagagagagagaaagaaaagagagagagagaaaagagagatataagagagagaaagaaaaaagaaagagagtgagagagagagagtgagataagagagaatgagagagagagagaaagaaaagagagagagagaaagaaaagagagagagagaaaagagagatataagagagagaaagaaaaaagaaagagagtgagataagagagaatgagagagagagagaaagaaaagagagagagagaaagaaaagagagagagagaaaagagagatataagagagagaaagaaaaaagaaagagagtgagagagagagagtgagataagagagaatgagagagagagagagaaagaaaagagagagagagaaaagagagatataagagagagaaagaaaaaagagagagagtgagagagagagataagagagagagtgagagagagaaagaaaaaaagagagagagagagaaaagagagatataagagagagagagaaagaaaaaagaaagagagtgagagagagagataagagagagagtgagagagagaaagaaaagaaagatagtgagagagacagaagagatatagagagaatgaatgttagcttttttattcaattatatttaaattataaaaattttttttttttaaatttatttattttaatttagaagggattttattttaatttaatttattttttaatctttttttt

SEQ ID NO: 10648 - DNA, 3199 bp, Heterodera glycines
  misc_feature (30)..(30): n is a, c, g, or t
  misc_feature (3126)..(3126): n is a, c, g, or t
tccatgacagatttggaagaattttttaanttgattgggactccgcccggccattttctacgataaagcgtggaaaaaataaaggacccccttaaaaaagttgaggaattaattccggaaatagaggcattaaatgatcactttgattcacaatttgttgatcattttaaagaattgggcataaaatcgaaaggaaaaaaattggaaaaggaaaaaggaaaacgaaaacttagtgaaattgacaaattggaagatgaaaatgagcaaaaaagaaaacaaattggaaaattaaagaaggaaatgaaaaagaaagtgggaaaatttgatttaaaatttgtgaacgaattaaaagaaatggtcaaaacaattgacgaaaacgatggacaaaaattggaaaaagtgaaggaattggtgaaaaaaattctggaaatgtttgaggaaaagaaaaaagcatatggtgagaaaatggcggaagaaaacgaatgaggacaaaaagccaacaaattccgattgaagggcatttttgcggatagctttattggcatttagactaatttttgggactatttttttttgagtgattcgtagggcgaattctaattttttttcgattttctgggccaaggaaatttgattttatgattgaatttttgaacgccaacattttaaggattttaatttttaaaaattatagaaatatgttctatcagtagaaaagaatctggaagattattaattatataaaattggaatggttccatagggatttggcattttattttattaaatttatttatttttgaattttatttcaattctcttcttctgctattagcctttttaagccgagatgtattgtcctttatatgtaaaaatttgttttttattttcgaatcaccgaaagtctgaccccgagaaattaattttatcaattgtgtcgctttttgttttttcatttaacacatttggcttttattcttcctgtggtccattttattccataagataaacttttctattctcttttttgactgattgcttcagcaaaaataagttatccaataagatttttttaaacatttcttagattttcccattccttagcattctccttgtctttttcctttttttggcattttcttattgcaggtcatttcttcttaaccttataatcggaattaaatcccttcttttataagaaaatattttaaatctgaaggactggcagaaatcattattttaataattggttatcttcgaaaaagaattaataattatttcttggaaatttttacaaatttcataaaaaattaatttcccagcggttcctattggcattgcggcaaaaaattatggccgtaaagctttcacttttttcgagcatttcggctccaatttatttttggaactcaatataatttcaattttgctaactctgttaaaactttgtcctattaaatataaaaattgtttaatttggttgcttaaaattggcggcgccaaacatatcccttcccctcaaaaaccacgaaagttggtcagtttttttgtattttggcattttgtgccttattgcatgcttttctaagaatttattgttaaaaacgcataatgtttattaaaacattcacatatgtattttggtaatatttcgacattttttgtaagtatttatgcacatattttatgaatttcttaaataaaattttacatttctacttagaatactaattaagaataaatgacaaaatcaatttttttttcattcaataaaataataatttaatgtttttgctttaattggtcagcaaaatgcttcgtccggcactgtcacaatgtaagtgcgcccgtctctgactagtcgactgtttttatgttcagctgacatgacgcaaattttttactgatttccacaatgctcaatccatgttccttggcttctcttcgctagaaataaaaaaaaaattgttcaccaaaagatttaactgatgacaattaagcataattaaccaaatcactataaattaaggtcttggattttattttaaaaaaacacaattataaaaaagttttccaaaatcttgagatttcgtacttaagcctccaacttcataagcatattttgtgacagatttcagcttggtagtaaataatgaagtctattatacatggagggtaaaagttcggagatttagttcagatacatttttttaatagtttacccattgtaaaattcagtttctttgaccaggattcctgttaaatcagcacttatcccatcctattagtcctgtcctggtgcgtctcggaaataatggcaaaatcccagccctacttgtttcggtccaagtgttttaggataattaacaatttgccgtttatccatggtaattagttagtaattactcaaccggaccaattcattaaaataattaaatttattaattttatagaatatttatgcatccacctgcacctgaattccaacattcccaacagatttgttgtcacttctccaatggttctgtccgccgttgtttccaccaaaaattctttactgtattcgccccggcgacagcacttggcatggtaacacaatgttgtgactttgacgagaatttctatcttaatctccaggaaaatattttaaaaaatggaataaatctagaaaataataattattttaatttttagtcaaattttttaccccttcccaatttgtcaaaaatatatctatctcgactcgaaaagtctcggctttagagacctcgaaaaattttcagtttcaaatattttttcataatttatcaaattaaattttagtcaaaactcgaaaaaaatatatagcattaacgaattgtttaatttatagattcaaagaaatttttaattttatccccaatttatttgaaaacattttggaaataattgtatttttttatacccttgtaaaaggaagcgatgactgtgatggcaaaaataatgggaaatctgctggcggaggatcagtttcagtcacatccaaaagcatcagctcacagtgcaacatttcagtgcatggcaccataacgaaaagtggcaaaacggtgaacaaaagccaaacaaaattcattcttcaaaaattanaaagaacggaacgtcattaaaggattaagaaaaaaaaattcaaaatactaattgaacttgaaattatacgaaa

SEQ ID NO: 10649 - DNA, 1898 bp, Heterodera glycines
  misc_feature (33)..(33): n is a, c, g, or t
  misc_feature (41)..(41): n is a, c, g, or t
tttatatttgtaatttaaaaatataatattaanggacactnttaaggtacgcaacgcggaattccgactttcgactttttgaactcgactacttatgtatatgttgtacgacaaagaagcaaaaaattaccgaaaatatataaattttaaataaacgatttataaagtttgctataaatcaaagtgtaaaaagccttactctcgaagaccgagtccgaaaccccgtgagaaagacagcaaaaaaaaaactctagagggactcgagaccgagacgctcggaaagcgctagtatataaacaacttggcctgcctttttcaaattttcagcaattttctctgaattaaatcaaaaattttaaaattcaaatggggtatttcttcggaaaggggagggcgaataacagccaaatgttcctgttacttacttttcaaaaaaaaattatttagggggtgcgacatttggcatcccttgttttcctggtaacgggactgattaattccatttttaccattttcggggaattgcccttcgttcacattctgctctgaatttttcgttccacacagagtatgttcggcaattaacttctgttggtgaagtgaagatggcacttcaacagctgctccactattactgttttgattacagcaaatttttatacggtaattgtagtcgttggatatgggaggcggataaatggacaaatttatttcccttttagcagcgcagacggtgactatgctaattgcaagcaaaaagccaaagagcaaaagctggcagaacatttctaaatgttgcgctttgaaattatttcgctttaattttaacttattttatttttttaaacgttaaaaatattataaaaaatttaaaaaagtaaaatgtaaattaaaaataatataaatataacattattaaataatgaaaatttatttcccttcacattatatgcatatgcataaaaagatattcagcgataatgtaagtgtaaatcacatgaaatagggcaatacatatagatgaatgaatacgaatatgcgggcgagcatttttacaaatgaattttatgtgcattgattttgcatttttctcagaatatacaacataaatttattccgaatcatattacgattagggatgggatttatatatatttttaaaatacatattcttgctgagaaatgcacgaaaaagacctttgtagcgcgaaattcttaggtttaatctccaatatccattaaaaaatatttgactcttttttatttagtaaatattttggcatttttcataaatacaaatcctatccataattatatattcataaaactattaatgtttctatattttatagttcgatttgtccgtaacccatgtccgccatcgtcgctgacgatacacaacccaaacatcgaccaaataaacagccgagcagagaggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttatctt

SEQ ID NO: 10650 - DNA, 4318 bp, Heterodera glycines
gcttggcatggctggaggtcagagttgaataattctaaaagtaaggggtactctttttccacaccccgaatttttcggctcaccgcacgacggaattgtttctttcgccgaataaagttgacgtgcaaatatgcgtgtttttaagaaattttcaacgtgagccattaaaactaaataactaactcgaatattatttaaggttaatttgtttttttatcgcttatcgattgaacgttttaagacccaaaggcatcttaggcagtgccgctcgcccgaaaatggcaaaattttaatgaaaagatattttaaggttttgaaatatctaaaataaatgtcttattcccgaaataaaaacgagcggatcagaaatagttctccttcatcagactattcggcacaaagaaacagaaatggaaaaatggggaacaacatggacaaaaaacatagcagaagaagacggtcttcttcaacttcaggcgaggagaaagaattcgacaaagtgcttggacaggaaaaggcttgaaaagattttgagagaaaaggaggagaaacagcgactcaaagagattgaaacgcccgatgagaaaaggacacgaagacttgcgaaaaagttgcaaaaggttgattttagctgtcaaaataattgttaaataaaaattgtttttttaaggaggaaagaagacgagcagaaacaattaatggctttcctgaagtcattccttatacggacttgaacaatccattcaatgacaccaatttgactgacacatttatttggaagaaaaagtgggaatccgaagggaaggcgaatgtatctgtaaaaaaggccgagaaagtgtaagaaaggcagccaaataaatctttaacttaaataattcagaaaccgcgaaactattgctaagaattttgccgaaatggaacagttaaagcgaaatagggaggcgcgggacgcagcgagggaagacatggaaatgatcacgagggaccaggagagacgccagtgcgattggagtcgtacagaggatgtttttcatctaaaacaggcgaagttgcgctcttctattcgcataaaggagggcagagcaaagccaattgatttcttggcaaagtgagctaagggacggaaaggatgggcaatttgtaaaagtctgtcaaaggtatatttcttacacggacgaagcgaaccaaggcacagcatttgaactgaacaatccgttgactttccttcccacggactccatcgaagattttgaagacctaattgccgacattcaagtaagtctgttcttgttacacagttcattaatttggttcaaggcatagtccaaaacctcctctttttaattcaaaaataacaaaattctactaccatttataggtttatcgtctaatcgatggccataagaacaaatgttattgggatgacatagaaacagtcgccaaaaatggaatgaaacgattgttagacacgcgaaaacgaacagcagacatcggaacagttcattcatcggtacaagaggaagtgcataagatatttaaggtattctaatgctttgctaatttaaatttgaccatggataattcaggggaaaacttacgacgaacttgaacagcttgagagtcaaatcactgcaagaatttcgaacgcgaacagagggaccgatgtgacatattgggagtcgttgttggattcgctaaggccgtttatggccaaacagcgcctcaaagagttgcacaccaaaatgactcaactgcgtctgaaaattattcgtcaggagcagattaatcaaatggataaaagtgatgaccgtgaccaagttgaagaagaaaccgttgaaaaggacagtggggagacagatgaggagaaaccatcagaggacgaattggagatggaaatcgaacaaaaggcgaagctggaaagggcgaaatacgaggacaaacagcaaactgtgcagcaggaaacgaagacaatgccattcacaattgagcagttcatcggggcagacgatgaacaaagggagcaaatgaatcagtaagtaacgacaatttggatccattaattggttgatatttaaggcaactcgaagccagaggcatgtcggagcaattctcaacagttctatatgagtatggtcgctacagtccggcgtacggaagcttatcacacacaatgcctggcatagaaattttggacgaagcggaagatgaaaaacggatgaatgatactcgtttagcaacacaacataaagaagatggaactggaaaactgacggtggatttgcgggaaaatcatatcttaagggggggggggggaagttcaggcattggttccctaatgtcgcctaaaagtagaaattcagaaattgtgaattttagaaggcccttttatgtgcacacaaataaaaaaagaatgtttaaaaaaatgcgtgtaaaagttatttaggaggcaaaaaatatcttaatttagccaaagtcttcaagggatttcctttattcatttaatgtcctattttgttttattgacgttttcttacaattgttagtttctggtttaatcgatatgttaaggccaaggacaaaagaatgttggagatcgcaaggcaaggaatggaccaggacgaggccgaattttctgtcgaagaaaagctcgaaaagcagaatttcctttggtctgataaataccgtccgaggaagccccgctatttcaacagagttcgtgattgacttttgttggtttaaaatttatttctgttaaggtgcacaccggatttgactggaacaaatacaaccaaacgcactacgacattgacaatccgccgcccaaaattgtgcagggataccgttttaatgtatttgcacaatttggcttactttcgtataacataaaagggtgattctgttacagatattcttcccggatttgttagacccgacacagacgcccaccttcactctgatcagatgcgatgaccccgacttttccattcttcgcttttgcgcgggaccgccctatgaagacattgccttcaaaatcgtgaaccgagaatgggaggtcaactacaagcacggatataaatgtcaatttcagaatgggatttttcaactttggttttttttcaaacgataccgttatcgtcgctgattcttttccattttaaaactgtaataaactttcttcactattattgaattttcattaatggttgaattccagttttaatttatctgtttgtttttccttaattgggtataaacagttaagggaatgcttcgccaaatttgtggtggtttgttgctgcgtaagggtgcgtctgctgctccgcctttcgccgtcagaaatgccgtccaaatggcctctccgacgaaggtgatgggtccgcatgccttccattacaaatttgaacgttattacgccgctgcgattgttccgctttttcccctcgcttatttcgtccacgcgcccctcgtggattatgctttaactgctgcgattgttctccactcgcattggtcgtcttttaaattttattattcgttgttaatcttgtaaaatgaatttcaggggcgtaatggctgttgtccaggtgacttttgataatgccgtcatttggaagtgtccacccaaaacccctttaggactacgcgaggcccctggtcattggcaaaacgttggccaaaatggcgccggctgtcccttacatcgcttccgttgtgcttttggttggcttactgatgttcaattacaacgacgttggactgaccaaagcctttgaaatggtcttcagtttataggtgtcgatcatttgttaccgtagcattttaaatactgtataaaaattttatggaatatcaattaatggtgcgaaatcgtataaagttcattgcagcaaatacttttctctttttcaatttaaattataatttgggtaattaaactttctttatgtcaattaggccgtcgttctttgtaaattcgatttgaaatgttggacaatcgcaatttctctttttccactactcgaaatggcattctgctcacttttctgaatttgatgttcactgttaactcgaagggttttcttctgaccgcttctctcatgtttcttgtcgaaattggcatcgttttccaaatcattcgattggtcccatgtcggtggtccttttattgcttttcgcttttcaaatcaattttagacacggatattgactggtccacttacatgcagcacgttggagtttatgaagacggacagagaaattacacacaaattcggggggacacaggcccaattgtgtgagtcaatcaaaaataataatt

SEQ ID NO: 10651 - DNA, 954 bp, Heterodera glycines
cagtgccattctcctccacgtccttcacttttctgtgattatttgtcctgcagaaattcttcgtcttccgcccattttccgctgaagaacgaataacaaaaactgtgcctttaaatttgcatataattacatcatttattcactgtgacttctatgtttatttattctgttgttatttccccttttctgtttcataagttgtttttaagaaatttgaaatttaaaaaaatattttaatttgatcattaaatttctctttccttcaaatacggcatgtcaatgccattctccgctgttcttctgaacactgtccgaaatgccttttcccctcgcagggcgatgagtgtgcgcactttgccccccgaattgaaagtaattatttgaaaaaaacattttatgcctcagattttcgacagagaaacgaagcgaaaacagcgcaattgggcagcagagcaaaacgaattcggagaatgcaaatttataagggacgaagtaaagcgggcggagaagcaatgcctttctttttctgagcttttccatttttcagtttggctatcgaatcgccgacaaaggtaccgccaaagccatttcatgggaattgcgctgaaagattgtgccgcactttttagtgttcgacgtaattcggccgaatccgttggtctttgagttgggctgcgcggcgggacacgtcgggtggactaattacgcataattagcaccaatcaatttaatacaattggcacactttgaagacctcatctgatcggcgaaaatgttggctgttttgtgcagtgtgacatgagcgagaaaatggtggccaggagcgaaaaggcggcggagaaagaggtggcccagcgaaccgctcaaaggatttggcccaccccggccggcattttaaattgaacggagtcccggaaattcaaaacaatttgtatcgaacccccccccccccca

SEQ ID NO: 10652 - DNA, 3345 bp, Heterodera glycines
  misc_feature (3282)..(3282): n is a, c, g, or t
  misc_feature (3293)..(3293): n is a, c, g, or t
  misc_feature (3315)..(3315): n is a, c, g, or t
  misc_feature (3329)..(3329): n is a, c, g, or t
tgcgaagttgcgattgtttgctctgattctgcccctagtttagaaactggccgaagtggatgtcatattcatgaccgcttgcgggttgcttccttgttttatgtttgcttccgatttatctttcccagccaccccgatatgaccatacaatatttttataactataattctaccaaatgaaaaattactttttgagaaatcttattacacttgatgatccatctcgtattatatgaaggctcctgacagatctgatgttatattcgtgatcatcggccctcgtaagccccgagggggacaaaccatcgaagaaaaccgcctgatttattccttttttatgggaccactacaaataaccattaccgaaaatatgcgtatataaacacggtcgatagcatcggtagcggagcgtgtgtcgattttgatccaattgctctggctcagctgcagataatggtagcaaaaatttccacaatctgcgaatggtgatgacgctgtgaggatgtgaagctccggatccaggaatgcgttgagcgtcttcttgtcaatgcggatttggaccggaatgtagcggtaacagttgttgactgcttgatattccacattttgcattgaaaactcagcgcacgagaagatttgcatcgtgtcctcgtttagccacctggccataacatccttgcgtcgtaaaagtcgtctggcctgaatggtcggatttcctcctctggaacttcttcggcattccttggaaaaaagctgcgcgattgatcggcttgtggcgagttgtcctgcggttaattgtgctgcgagttgttcctcctggatggctctttttcccaatccacgatcgttgacgatcttcaggtactcatcctccaggattccaaacgattggtccgacaagcgaatcggttttccgttgcatgctgtttccattttcgcctctttgctaaacgttagcgcctgttccttgcttttggatatccatgttccgcctgcccaatccgttgatcctgtgtgctctccgtccatactttcgacgaaatggtagtcgcatggcttacagctctcgttgcactccgtttcccaatttagggttgtgttgtctgccatgttgcagtttccggtcaaatagttgcaatcctccaagtgtgagtagagcgggctgatcaactcaaaattgtgagggcggtaaaacagcgtcgccttctcgacaaaacaattcagcgttacgctctctcgctcccccgaaattagacttgagaatcttcccggaaattcctcgttcagtgggttgttgctgctccatcctcctccttcaatcggagtcattggcttatcttcgtacgggcatttgtgctgttcgatcatggccatgcagattctcttttgtactggcaagaattctttctccgtacgaacgaactgatcccccagaaggttagtataaaaatactccttcgttcgtttgatggcacatctgtaggccttcttcacttcttgtggcttccgatacggcatgtagagtgagatggtcaatcttttccactgagaggtgagccctggcggtggtttgcagaatggtgatttatccgcgtccggtattctccacaaggatgatcctttgtgggcacaccaataaatggggtcggctccacggtgaacttcctccaattctcgattgagtcgtcgtaccgccggtttcgtttcatcggtcaccgtgccctcggttgggttcggctttgtcgttgttggcatggcactggcttgagatgggccttccgtggttgctcggattcgatcagtccagtgacggcttggagtttgagtccactgcctccgtcttgagtccatccttggttcttgattcgtagtcttccgctgtggttgcgtggtgactccctttgttttcgtcgtcgttctcgtggttaccgtcgtttcgggagttcgtagagtagtcattactgtactggcactggtactcgtacgcactgtcgtcgttgctgccgaagtttgagtcgtaccacttgtttgcatccgcgcctttttgtaccattcccggatatgcgcaatggacatatccgccgctgttgtcggcaaagtgggcgtgatttgccccctcttgtcgaggctcatccgaggtaccgtcggctccgcaaatccaacgagttcctccattcgtagtggtcttccgaagggatttacaggaatccatctgccgtttcgttccggccgaatgacttgtccattgatcatcattggttgcaacagcgtgatcaataacatgaccagcatggtcaatcctgtcagacttttggttacggctcgcctccatccggttgtactcttctgggctgactctcctgactcgggatttgttcccgtgttggccggtgttcctctgatcgccgctgcgagttctccaattttttcgtattggtaaattccacagccttgcatctcggcgaattcctcaaactctcgtggcaaacgtgcatttttccgagtcgccaaatgaacttccagtcctgcccttgccatatcttttatgtcttctttgaacacttccaattcttctctttcttccctcctcagctccaaattgaagataattttgatattccaattggccgggaacatcttttcacgcaacggtttgtcaccaaaatggacgaaccagctcgagccttcttcctcaaattccttggctaccagctcagcggcttcttggttactcacaaccaataccctcttgctttggagatggcagtccttccagtactccttggctctcagtttggtcaaggtctggccgaatctctccgtgagattcctgagccaactctcaaattgcgcctctgcacttatcacattcgttttcactggcacatcctccagaccaactggtccatagatttttcctttccactcttgtccaaaaacttggcacgaattgtcccatgccatcagcacacactcgagttgcttctgtggtatcgtcttctcattgttttggagcactttcgtccaccaattcctcaatgaatcctcaatctcgcttcctcttcccagcaaggcgcaccaatttggcgtgcatacgtcctagccaatcgaatgcgaaggcttgggccaggcagaccgcttttgattcggcttgcgggattttggttagccggccgtgggacagacttcccatggtgcaattcctttgacaaccttcatgtccctttacaccaggctcacatcgcgtaaacagcgaataattgatggtacgtcggtagccgngacttgctggntgcagctttattctgccagggntctcttcagcttgnttgccctttttgcctt

SEQ ID NO: 10653 - DNA, 3293 bp, Heterodera glycines
ggtcggaagttgaatggacaaatacataaatgtaaaaaaataagcattgaaaaatgctttaagcatgactttttcacgaaattgacacatgacactcgctgctgacaacagctgccaaatattttttttaattaatactttttttattattaaaatcctttctaattagcccatctctctgtcagcagcagctgttggaaaataccgttcaagtagtccagcagagccaaaatcagacaaaatatttataaattgacgtctctcgatctgtaattgaagaatccgaaaattttcgggaaccagttcctgaaaaaatacagccccgggactaaaatggctaaatacctttaggactgaaccgtacactgaattaaaacgcaaggaaatgcgaaaaagataaaccttagaaggtttaaaccgtggtgcgatatttgaggatttgacatttgaggacccgactttgaggagccaagatttcaggacatacacaatttcaaaaaaaatggaaattttattttatatcattataaaaaaagaaaatgcttttacaagggccaatgggagtaatgtaaactatatgaaatctggatcatatcagttttcaaaatcattgcgcatgagactgccgcagcttatcggttccgaaaggactgctaatttgtaggctccggactaaaactttgtatttttttgctttaataagtatagcttctccctctgaattttgcgatgctttgtccaagatagaataagcaaaacgaaatttgtgtcttttcaatttaaaaaatggacttacgacaaatttatttctttaattagctgtgaaagtgaatattttaaatgatgcaagttgcacaattgtggtgatgaaatgataaatttgccgcccgagagtccgtatctttttggcaccgacgtgttggcgccatgcaggaggcagtttttttgttttcagagaagtgaaatctacaaaagaagtagatgtcagtaaatttaagcattcattattattttttcaatttacatttggttcaaaaaaagatggcgcactgcaccaaatggccagtaaaagtctattttggccataacttttttgcatttcggccatttttcgtaattttgtaggctaatagatactgtcaatctctttaaaaagatcaaactttttgtgatcaaattgcgagtaaaaatgttttattctaattgctttttttaaatttattttgtttattcataaaaaataaaaaagtcatcagaagggcgagaaccacttactctgacgactatcagataaatgtcgtagagtaagtgacaaaatatatggatgatcacaggaattaaaaaaagacaaaatatgtgaaaataaataataaataaattgaggtcaaagtcaatgaggtcgaaataccaaatcacttagaaatttgttacattctaactttcccggtcttacagattaccctagtgaacttttaagttttattttaaattgatttaaagaatttgtttttattagttctttatcgagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataagcaattttatgcgccatgaacagatcaaacagctttcgcctattctcaagtgttggcagttgcaggtattctaatcgattttggtatggaattggcggaaggctgcatttaaaaaaggctcccggacaatccgacagtggacaatccgacagtgaggacaatcggacagaagtggacaattggacagtggacaatcggacagtcaaatataaaatagataagaaaataccggtcgccgcaatggaccgattgtgccatatcaagaaaaaacaaaataggcaaataaactaatgttctgggaatgacctagaaaatgtaaaatgatgtgaatatgagctgataaaaatgtttgccaaattacttacaagtagaaatgaccattcccgtgcactgcacaaattgaccacttccttttccttcccaaattttcacttgtttcctcacaaaattaattcctcatcttccgaagaaggcgaaattcatgagcatccccagccaaatcccccagttcaagaattgcatccaaatccacaagcccatgaccctctcccgaaccttcaaccaaatgaaaaaaaagttttttgttgctgaaacaacacagcgccgggctgttcttttggcggacggttttgagtacaaggcgaccggtattttcttatctattttatatttgactgtccgattgtccactgccggattgtccacttctgtccgattgtcctcactgtcggattgtccactgtccgattgtccactgtccgattgtccagtcacctttaaaaaatacccttttggtgaaatatttttgacacttttcgatttttttaatatttttttgaagagacggattccaaacctccggagcgtattccaataaaggcctaatataagttttatataacgtaatccaaatcttagacgatttggatttaattattcgaaacaaggaacgcatacgtaaatacgcattccttgttatttggttaatatgatcggaaaattgtaatttgttatcaatgtttactcctaaatccctaattgtatccacagcatttattgtatttccatcaaatttatatgtttcttttgggttttttgaacccaaatatatacaaaagttttttgaattgaaacttttatttgccatttatttgcccattcgaataaattatgcaatgcattatgcataatttctgtgtcggcttttgctttataacaaatatataatttaacatcatcagcatataattttattttcactcctgatggcaaggcatcaggaagatcgttaatataaatcaaaaataataaagggcccaggacagagccctgggggacgccagaggtaacttttttacttgaggataaagaatccccaattttaactcaaaaagtcctattactcaaaaagccctttatacacattaaaagtttgccctttataccaattttttccaatttgtataaaagtaaattatggggcactgagtcaaatgctttttgaaaatcaatataaatacagtcaacattttttccatttatagttgcctcgtaccaatcttccacaactgttattagtttaaaggtcgtagacctatttctaacaaaaccaaattggta

SEQ ID NO: 10654 - DNA, 3865 bp, Heterodera glycines
  misc_feature (3719)..(3719): n is a, c, g, or t
  misc_feature (3753)..(3753): n is a, c, g, or t
  misc_feature (3789)..(3789): n is a, c, g, or t
  misc_feature (3797)..(3797): n is a, c, g, or t
  misc_feature (3810)..(3810): n is a, c, g, or t
tcctggaccgggataatcttggatatttcaagaaaaaaaccaaaaagattattaatgaattaattatttacacacgaaaggtaagcgattaaactaaagtaaattaattttagtcgtttctaaatatttttatttttctaaattttgctaaaccttttatggtattttcaaaaaccatctcttgccgggatcccggttccggactctccaaaaattgtactgatacaaaatttctgaaactcttaagtggccataccctatcaagttttcaaagtcgagctgcgcgtacagtctgtaaagaaattataaggccactaaagattttttcatttatcatacttcccatgtcccaaccgagctgaaatttttaccaaatttaccctccccataaatattaagaatcacactaaaaatgaaaaatgtatattataaggtcattttattaaacacaaaaactgtaaaaattttaagtggaagacgaatatggcagaaggggccttttttatttatttaaaattttacattacataaaagaattattatttcaaataaattttttatttcgtctattcattttttaatgttttatttatcaaaaaactcaaaaaagctaatcaattacgtcttgactgaattaaaaatttttctgaaaaataaattttaataattaattaattcggttatgaaaataattattcatcaatttaaaagaatattaaaaaatcatttctttgaatttttgatttttctttctttaaaaatctgttatttcgaaaaaaattggttaaatttcttttgaaaaggtatttgacttatgttcgactattaaaaaagcaaataaatagttattttttgaaaaattttccaattattatggatttttgaaattttcgcatttatcgacgaaacaagttgcaggaataatttaaaaaatatataaatcttatactatacttaattttttatttaataaaaataattctttaagcagaactattattcagtctaaataaataaaatttaattcgttaaattacctaaaaaaatcccacataattggtacttgcatttaaatatgtaatcacatttattaatcaattaacaaagatttctgaatttataacaaaaatgttataatcagggttcccagatcaaaattttcaaaagcctcatttggcaggcaaaaaagcctcattttgactcaaaaagcctcatttctacaaatttattcaaaacatatttaaaatgttcaaatgttatatttttgattgtccatgacccattttagcaattttttgctagctttttgtgaaattttgtgattttgagcaaatttttaagaaataaaggactttaggggctggcggtgccgatagacgccgccaggggaaaaattgagaaatttgaacatattttagcagattttcattaaaaaattattaattttgtgattttttagaaaaaaatttgttcttttctggtttttataaaaatttagcaaaattttttggaaaatttgggtgagattttcgttttgatgctctattagaaacccaaattattaaatatttgtaaaacattatgacaatttatcaaaatttaaaagattctgaggattttcccaaaaagcctcaaaaatcccaaaatttctcaaaaggccacaaaaatcctcaaatcctcattttccaaaaaaaaatcctcattgacctatcaaaaagccacaaaatgaggataaatcctcagatctgggaaccctggttataatagttttttgataaaaagcctattaaactattaaaataaaggatttttggataaaaactcgttaaatataataattttacaacaaaaataacgaaaaaatatataaataaataatgaaaataataacgctttatctatttgataatatataaatttatgtttgcattaaggcattgaaactccaataaaatattttaaattctctttaattattaaacgataaaaaatttagaaaaaggccaatattttattaaaaatcaaagatttaacaaaaatttacaatgctaaacaaaatcaaattttcagaaaaaagaataaaatgcttgcctggtacaatgacaaggaaaattttaaaaattttgaaaaacattaatcatttaaaaataatttttaagaaaaaactttttataaaaaaaggaaaaattatggaatgttacatatttaaataaatttaaacttaatcagtctattaaataaacgaaaataaatattaaataaaagaaaataaatttatattaaaaaataataatttactttttttaaataaaaaagagctaaaagtttatataaaggaaagacaaaatgagaatagaagaatttaatattgagaatagaaccattcatattactaatacgcattttcaaacaatacccaaaaacacattaaatttttaaacaaaaaatttacactaataaggcaaagagtttaaacttaagctgtaaaaatgcagaaaaataaattttaatttgtatttatttatcaatatttattcaaacggaatatattaaataaatgaagataaacgaagatgctcagaactaaatttttacaaaatatataaacgtttttgtgaataatgaaaataaataaatttgcattaaaagcacagatttaaaataacataataaatcaaagttattttacctaataaaatgaataaaatataaaaactatcacatagtaacaaatattatgatgaaaaaaagatgtagccaaaaaagtctaagaatagacactcttttggaacaattttgaaccacggacccaattattgccattttatccattttttaactttcctcaattttcactaaaatcttataaaataatccactgagaatgcccgagggcacaatacagattcgaggtggaaggaaccgaaaatagggaaatgttagatcttttgtgtcttggaaagcatagctaacttttattattaaaatatctttggcatcgattaattgaattgaataataattattttgaacaaaattgtacaatacgattgggactggattttacaatatggctgcatttttgcatcgcatgcatttgtaattttaatttggtatttttgtgaatttataaaacgaatttttattttcccgtggccctttcagtttttaaaaaatctgaatgataatgacccaattgaactcaattaacaaacttaattatgaggaagagatttttgactcttttgcaagggaaatagtaccctttgcttgttttgttgcaagggttcaaatgaaaaagcgactgattgaactgtggtagagtccacgggaacgaaaaccaagaccgtggttttccgaaatttcaatagccgtgaccgggatttgggaatttttcttcctggaccgggataatcttggaatatttcaagaaaaaaaccaaaaagattaattaatgaattaattatttacacacgaaaggtaagcgattaaactaaagtaaattaaattttagtcgtttctaaatatttttatttttctaaattttgctaaaccttttatggtattttcaaaaaccatctcttgccgggatcccggttccggactctccaaaaattgtactgatacaaaatttctgaaactcttaagtggccataccctatcaagttttcaaagtcgagctgcgcgtacagtctgtaaagaaattataaggccactanagattttttcatttatcatacttcccatgtcccnaccgagctgaaattttaccaaatttaccctcccatnaatattangaatcacactaanaatgaaaatgtatattataaggtcattttattaaacacaaaaactgtaaaaattt

SEQ ID NO: 10655 - DNA, 1562 bp, Heterodera glycines
  misc_feature (301)..(302): n is a, c, g, or t
  misc_feature (316)..(317): n is a, c, g, or t
tctttttaattatttattggataaatttattgttgcttttgtgattgattttaaaagcatgagatgcctaatttcacatacaattgtccctttgttcgcaaaatttggaagtgcaaaaaaagaaaaccccggcaccattccttttcgtttccaacagtttgatgttcatatagtaaatgatagaaaaaaatagccataaaatactcatatgtcatatataataccagtgtgttgtagcctgaaagatagacataacagataagacatatgatatctgagtaaataatcttaaaattataanntttattatatatannaaattcttatttatgcataaaatgacattacatcctataagctatagactttaccactgtaagtcgaaatgttattcagtcttcggtattaaaatgtacactcttcaagtatgctctactacttatgtaatttttaaaaaattagtaaaaatttacaaaaagttgtaagcaagaaagctcaaaaaacttagagtgaacagttttgactctaatttttttcaaattcaataaaatttttcgaaatttagcagaataatagagaaatctttgggctatcttttcgtattaagcacggagtcaattaatttaagtttgaacaattttcatgcatttaaacgaccttacattttttggatgaccataaaaatatgacactattaattctttcataacttttttctgaacgaacgaattttaattttgtttatataattagatagcccaaagatttctctattattatgttaattttcgaaaaagtttattgaacttcaataaagttagggtcaaaattgttaagtcaaaatttttcgtacttttttggttacaattttttttaattttactaattttttaaaaaattacataaatagtagagggtactttgagtgtcgctaaatactaaatttcattaatttgacaaagtttaagctatttatgattaattatttagccaatttaattaaaataataattaaatttaattattacaaacattcagacttttgtcacttcggctcaccacgaataggagattatgcgaaaaagaaaggaaaaggagaaaaccaactaagagaaagaaaaaatgagaaagagaggaaaaaaagtgtaaaagaaacggtcaatgacaaaagaaaagcaattggcaaaaaagaaaaagcacttcagagaaggagccaagcaaaaaaaagagcaaaaaaggagaagcaactcaaaatatttacatcaatggcgtcgtctgaaggtgaactttccacgtggcgagactccgactttccggcatcgaactgaggaaaagcaaaggaattctgtcgtaacggcataaatgccgaaagaagccaaccagtaatgacgccaaaggcactgaatcagtcgggcagctggcacgcgccttcgaatcaaatgcttttggcgctgatgttgttgaactttcagggcaaaacccgaaccgagaatacccttacaaattaggggacgtaaattagcaaaggggaaaaaggagaggggggggggaaaggggggggg

SEQ ID NO: 10656 - DNA, 2667 bp, Heterodera glycines
cagggcatccgcaaaagtggtgtacttgtcgttgtactcttctcacaaaggtaaccaaaaaagaggagaaaatcaggccaagaaagccgatgtaaagtgtggtgagcaattcctaaagagtgccgtggcattggcaaagcaaaacaaaggaaaacggcacctgtcgatgggcccaaacaacagacccaagcagtttccaagtgcctgctcgccggtcgatgcgaagcattcgcaaaatttggaagaagcgaagtccgcggatggccgacgcggcgaacattcgatggtgaagcggactggaggggagctgagcctgtgcaaatgcgacctttgacattgacgtttcttataattgaacattcccctcacttccgaattaaatttttaaagaaaatttcagaatttcttttccattaaaaaagtgagaagaatggcaattttagaaagatgccaacacggcaattaaaattaatttaatttaacaaataaaaaatattattttaaaactttcttttttcgatctggcaccctccactcttccatccttctcaactctctttctcttcccctctctcttatctctctctctcttctctccttccctttctctctcctctttctctctctctgttgctctctcattttcacctgttcccttgcacccatacaaaggacaataagtgatgcagtgatcacgatgatatcttaagagtgtcgttagcttataaacgcaattacttttgcagctcgttcccaccaattatgcaatatgccgaagttgcgaatcgaattcggccggcaatgcctgcgggggatggaaatgcttcgacgaaaagatggcactgaccgcggtaacgactgcgacagccggcactccaaacgcggcaaatgtattcgatggcaagccaaaaaacaaagataatttcctaaattttatttaattgaaattggcaaaaaatgaatttatgtcaattatttgtccaaaaaagacatacaatgtaataaaggatgagcgtggactgctcctcaaactcgggcattgtggagaagacactcagtgcaagacacgtcagaaccatgacgagactgtcgggggagggggataaagcggataaagtggggagcgacgaatgcaaaagaatgccttacacagccaaatggtagctggccgccttccatccccggggccgttccaaaaagttgtgcattttggactgaactcgtcgaaagcgttgatcggtactgtagtttttgtagaccaacggcttgccaaccaaggacattttccggaccgaaaagaaatttcaaaaattaacagaaaaattgagggggcaacttgggaatcggaacggttgcgggaaaagcggaggggaggcggctgaagcaaagaaagggcggggacagtggcgagggaactcttcggttgacgcgccgcctccgcgggaaggggcgacggacgcggacggacgacgaggccactctcacaatcgaagacagaggccgggccggaaacggacgcactgcacttacagaaattgaattccaaacttttcagaatgtcgtggaaaacgacacgccgatcattagcgatttgctgagtgccgacggcgggagagtttgtgccgccggtgatgggactggtggcatttacgccctacataaaagagattagtgggcaactgacgagggaagtgaagggaaaggcaaaggcggatttggcggggatttggcacgaaaagcgattgggcgaatcaatgcgaagagaaagagtggaagcatttaataagtgaataagtaatattggtcaaaagaaaaaccgcaaaaagaatgaaaaaacgtcttctatgaatatttcttatcattttgtaatttcaatgccgaaattgcggagaacggacggcgtaagttggcaaattatataattaaatttgaataaaacttaaccaattggtcacttttgttgccttttttcgagtttgccgcgatgactcaccgtttcaaaaaacgaatcgtttggcgaagtgttcgcaccggcgaagtgcgccaattcccttttttgttccgcggggcgttttggagacgacgaattggtcgagcggcggcttcggcgagtgaatcggcgcgaagaaagcgaagcggcgccaaattcggcgcattcattggggccgacggccaataatttctgttggagtaaggagaaagtgttttgacgccataatttctcaaattattttaataatattttaaattttaaataaaaattgcgttgagtaatttttcaaaggattatgagttttggtccgacggcgaccaaaattaattagcaattttaagaaatcagaaaaaaaaaattgcattgatccagaaataagggcaaatcttacaaataaggaataaatttgtaagatttggacccttcaaatcgaaatatttttttataaataaggacaaaattgaggcccttatttagcaggaaaatttaaaaagaagaaaagggaaagcgaataataaaatgaccaaagataatctcattgttttggtcagccgatgattaaaaagaaattaaacgattaaaaaggacagaaaaagagggaggggggagaagcatcaaaaaccttttaattcgagggagtgccggaggcgaagagctgccgaaagagcgacgga

SEQ ID NO: 10657 - DNA, 1121 bp, Heterodera glycines
  misc_feature (35)..(35): n is a, c, g, or t
tcatatttcgtttagaattcgaaaacaaaacactntcgaaaaagcacagaaagaagccggacagtcaaatcttttctttgtttatattcatattttacaatttttgccatattttttatacgtatatttcgtcccttttcatcagcaacaacaattgcttatgaatcggcgtttgcactttgaagagcgttcatttccgtcgattgtttgaaagtccttccatttccgtcttttttttaccacccgcgacaaacgttcattgtcctccttcaaaaagtttgtcgtccttgctttttgttcgaaaaaagtttttgtgacttccccccccccccattttcaccgttgctctccaccccttccattttccccttccccattttcatccccccccccctcccgcacctgctgttttctccccccttcgtttttgcagtgatcgcgaaatggaagaacaatcgattaagctgacaaatgagctgagttattaaatgcttttggaacgtcgggtaaactgatcaaaagcaaagaaacgttcccacacacacaattcacggttattcattcataaaaataaggataaataaattccatcttccgctgctgtcaattactttgcccatcatgtgaatgtgtgcaattcagcaactactgtagatgcccgaaagtctgcggaattactattatatcgaaatgcttattttaagaaaaaaatttagcgggatcggagtctcagtttttcccgcgagaatccgttcccgcccaactcttaatttttgctttcatacgttttatgggaattacgtaaaatatacgtgaaatcagatcagaaatatcattactattttacgtttacactggcgcttaaataacagaaaccagaaaaaaaaatcggaaaaagttgtcatgtaatttgtgacttggcgactaacaatgcatttattttgcatttttgtggcggtaagatgttaaacgacgcaatgttggtgaatttgatgagattttgcgaaaagcagaatatgcagcttgttttttctattttcacctttattttcatgtataaaaataataaacgtcttattcgtgaccaccttccaaaattagctagaaaaaataataccgct

SEQ ID NO: 10658 - DNA, 2940 bp, Heterodera glycines
  misc_feature (43)..(43): n is a, c, g, or t
ccccccccccccaatgtccgcttgtcgtcgcccccccaccccncgaatttgttggtgtttgtccgcatgaatcaatctctcctctaccataagtggttaacggcgggaatgaaaaagggcatggaattgacgctgcgcgagtacgaacatagcccccctttccccccctctttcccctcttcccccccccttttccccattcccccgtccgttcctttagtctcctcatttgcacaaggtgatcggttggctgttgtttaattacccactcaattttaataccctttccctctatcaaaatatatatttatatgttttattttcacttgcttttcccccatttcagcttttttctgtgcattttattttgttccaattagctctaattatccgtcaattaagtaaaatagaaatttattggataattaagcaatttcctccaaatgtccattagtgtcaacatcaacgacccacaattcccagccgaactttatgagattttcttcgctcgaagtcccttcatcttccatcgatggcccatttggtctctgagaaacgcctctcgtgtggcaaaccaaaggcaatggcactgtccgacactttgccttcttcgctttcccagggacgacgacattttgaacatctcaatggcaattagtggcagaaccataagacgaagcgaccgccaaaggcttttcgatcgcatttcaaggtcgaaatgacaaatcactggccccaaatttgctaaagcaattatttttcgccaaccgtttggatggccagtgattacagagataatccatcggatcagttcacttcacttcatctcatttcctccctaagggatgtgcgaaattttactttctcgtaaaaaattgacttcgtgagtttcgcacatcccttcggccaaatagcgctttttgcattgtattatacaggtattaaacagaaaaaaacaacaacatttatttccgcaattttgtttcgtttcctccattttctcgccaatttccgtccgtttcgtttgttttgctcaaatggccgtccgtcccctccttccgtcctcctgccattttccccgccactttgccgttctcccaaacccccgtgcgcatttgccgcgcccgtgtctgatcagcaatgatcgaccgcatcgtctcgctggcgtagttcagtttgggtttccgtcgttggcgaatgaatcgtcgcacaatgccacaaattctcttttggtaaaaagtgacacagcaaagagaaaggaaggcgtggaacagaggcgacgccatcagaagacaatgcgaaagctgcaaaaaacaaaagcaaggccaatgagaaactgaatttttagcagtgccatattagggtgtaatcattaccgaataataaaagccaatggcaccgggttgggccttttcatctgcagcaccagtggtaatttggatggacaaattggtactgagtaattgaaggaaaatcccgaatttgccgatggcatcgacacaaagaagacaaaagaggggaagggacaaatggtcgacggagagagagccgaaaaaacggcggagcaaaagccgatttaggaagagaccgacgagggcacagccggagaaaaccaaagagaggagaagcggacaaaacaaagacaaaagtctgaagggaagcgaagtcaaaggcgcagaaagaagcaccgactgactgaattgacctgatcagattagctgttctgtgctctgtccacaaacacagcaaatggacgtccaacggaaggaatgccgccacgaaaggaattgtggaaacgatggcacacactgctgcagggttggcatcggcggagtaatgcttgaacagcgtcaaatatcgatcaattgaaacaaaagaaggacaaattgctgagcaatcacaaatgtatccacaagttcagtttggatgaaaaactaaacgaaacacatttggaaaagcagttcaaaagtagctaaaagtcactttggcaaattgccaaagtgagttttttggatggggcggtcgagtgagaaaaagcaaagtgtcgaaagagtcaacgtcgtagaagacatccagcaaaagtgtatgaacaagaagcccaagcgagagaagtgtgttgcacacggcgagagagcccacgagaaactgaaccctgcaattggggggggggggcaattaaagtctgttaaaaatgcaacacatgtgggggtaaattaaaacaagttaaagtgccatggggggaaaggtcagttgcaagagcaagtttcgatcaaagagatcccacaattaggcaccaattctcaatttcctacttttgaatgtgaatctgttgtcgactttttccaagagaaaggtaaaggacgaaaaagttgagtgcaatagaaacagtccaagtcaaaagccaatcgagagaaacgaaaagtcttttgccgacatcggaccattctatggcatcggacatgatcagaaggcttctaaaatttaaagagagcgcggcattcacaacgctagcaaagcaacagaaaaagacccatccgcggcgtatttaagcgaacgattggaacgatggaagagcaaattgccaacccaaatgtcggaagagggaacgacgggggcggggggtggaggaagcggagaggagccggcagaggaaggcatcagccgaagagcatgtaattatttaatcataacaggaacattgatggatggcgtgaatgattggcagagagtaaaaagcactcacaatcaacagagatggacagagcaaaatgtacgggtgcaaaggctttttgcaacttgacgaccataaaaataacatgaaacttacctaactaacgcttcataactttttcatcaaagatacaaaataaacattttggtatcatttgataacttaaaaaaggagtattatgtagtctataaatttttggtcatttttta

SEQ ID NO: 10659 - DNA, 1457 bp, Heterodera glycines
cctcagaatatccaatcacacagtgattatgaggtcttaaccatgtctaaagtaaaatctgattacatattcgtgatcagcggcccaaataacccctaaagacatatttttggaggatttttggtgaaaaaaatttcccactcaaaaatcatggtcacacccatttggtcccgaaccccaaaatcacttttatttctataacttttttcaaaaaagtgataaaaagctaaaataaaatttataaaatagagcaaaaaattgcggattttttgagtatatcatttttataaaatactttttcagaaaggagttaggaatttttttctgaaaaatcgaaaatttccagattttctagaataatttttttaatttggaagatagaaattccaaataaatctcataaaattctcctaattttttgctatttttcaaactttattccactaaatttgaccaaaaacaaagagagttatgaattttcaaaatttcactggattttccggggctcaaattttgacgatttttcaaaaaattttaaacacttaccaaaaagtctgaaactaaaaataaagtatataatcaagttaagcaccttaaattaggccataaaaatgcattttggctaatttaggagcaaaaaaatttttcatgaaatgcaaaaccatggggtcccccctatggttttgaatttcaaaatcacaattaatttcataactttttttaaactcgtgataaaaacatgagataaagcacattagattgggctttaaattctctacaaaaaagctcttagacgatttttttataaaatcaactcctgacgagttattgagccagaactgaaattgaggcctagcaaccaaaattttctatttccaaaaaaattttgaaaattttttctgaaaatgacaccaatcgatagagcatcaaaaacggttgcttgaaagtggtctccgttttccccggaaaaatctgtaaaaaatactaaaattcaaaaacctcaaaagtgatgagggggcctagctcgaaaatttctgaaaatttcagaaaactaaaaacatggttggatagagctcgtcgagctgtacaataagtacgctggcgccgcacagctcagcgcaatgcccagcgagttattcccgaaaaacacaaaaaccggaaaattggaaaaaaatttttacaattttttgcaggccagggctttggtgctaggggctaggtcaagaagaaaaaaatttcccaaacattccaacttagtcgcctcccagcagaagttttttgctccaggttcccagaaaaaagttatggccccaaaactgcatgcatttttcctcaaaaagccgtttcagcgccgctggcgctgaactggcccccagatcaaaaagtctatagttttcccagatgcgccgtcaaaaaagtggttaagcaatgtcacacttaaaacccaccctcggcgc

SEQ ID NO: 10660 - DNA, 1953 bp, Heterodera glycines
  misc_feature (16)..(16): n is a, c, g, or t
ttttcctggggaaaanatcggcaaaaaataataaaattcaaaaacgaaaaattttcgagggggcctagctcgaaaaattttgaaaattttcaaaatctgaaaacgccatcggatgcagctttaaaaactgcacaaatgctcaagcggcgccaacccgctccgcttaacccccagcgagttattcccgaaaaacgtaaaaccggcattttgagcgccgttcagtcgccaatttctacaggctcggcatttgatctgatcaaaaagtgatcagtgacaaagttgtagccaacatgtctggggtgtgccctctcagcagactttttccgctcccggtttccaggaaaaagttacagcccgaaaacggcgaccatttttcaaagttggccgtttcagcgccgctggcgctcagttggcttccggaccggaatttccttatttttcccagatgcgccgtcaaaagttacccctgcctgcaaaatttcagccccctccgggcaaaccacgggcacttataattttttctacgaactgcaacattattctatatatatataaactagcgtgaccagttggaattgatgggggtccggtgcaggcagtttgcttttggatgaagagaaaatggacatgctcatttgttattttaaaacatacaaaacattaattgcattagtgtgctgttttaaagcgctatcgcgctatgggacgcggcttcgccgcgtcgctagaaaatgatgtaatttagaaattcatcgcagcctcaggacgggcgctttgcgcccgttttttaattttttgaaggacattcggccgcttcgcggcctcaggacgggcgcttcgcgcccgtcttaattttttgagaacattcgtccgtttcacggcctcagcacgggcgcttcgcgcccgttttgtaatttttttgggagacgttcaaccgcttcgcggcctcaggacgggcgcttcgcgcccgttttgtaattttttgggggacattcggccgcttcgcggcctcaggacgggcgcttcgcgcccgttttttaattttaatcacacagggattctgaggtcttaaccatgtctaaagtaaaatctgattacatattcgtgatcagcggccaaataaccctaaaatcatatttttgaagacacacccctttggtcccaaattacaaaatcacttttatttctataacttttttcaaaaaattgataataagctaaattaaaatttataaaatagagcaaaaaattgcggattttttgagtatattatttttataaaatactttttcagaatggagttaggaattttttttctgaaaaatcgaatttttccagaaattctggaataacttttttattttggaagatagaagtcccaaataaatctcataaaattctactaattttttgctatatttcaaactttattccactaaaattgaccaaaagtgaagtgaattatgaattttcgaaattccgcttgatttttggaggcctaaaaattgacgatttttcaaaattttttaaccaccttccaaaaagtcggaaacgcaaaataaagcgtatatacgtattcagcacctcaaattatgccataaaaatgcattttggctaatttaggagcaaaaaaattttcatgaaatgcaaaaccatggggtcccccctatggttttgagtttcaaaatcacaattaattttataactttttttaaactcatggtataaacatgagataaagcacattagattgggcttaaaattctctacaaaaaagctcttagacgattttttgataaaatcaactcctgacaagttatagccacgagaactgaaattgaggcctaccaaccgaaaattttctatttccgagaaaaattttgaaaattttttttgaaaatgccaccgatcgcgtgtgcgggaaaaacggttgctgaaagtggtcttcgtttt

SEQ ID NO: 10661 - DNA, 5088 bp, Heterodera glycines
atttgtgtacttcttcggcgggtggcgccgtttctacgtctccaaaattcttctgcggctgactttgctccaccgctgcgactttgtcactatacgaacgaatggacgaagtcatttcatttgcgattgaaagagacataaacacaaataatatggccatctttcgcaatttaaacgtttatatagttttctctccgtcaggacgccgataatgttggcagtttattgggtacttaggcactttagaccataaaaaaaatttctttttaaatcatataaaaaatttctagggggttttcggggtcgctaatcacgaatctgacatctatttctaccaaattctaactccgaatctgtattcgagttattttcgcaccataaaatgattttttgaaaatttgaattttcaagtttttgttcgaatacgggtcggggttcgaattttgtcgaaatggatgtcagattcgtgatcactgatcagcgaccccaaaaatcctttagaaaatttttatatgatttaaaaaataattttattttttatggtctgtaaagtgcataagtaccgtttattgcgctgtgaaaacgagtctaggtattctcggttgccgagcttaaaggttcttcattcgagctgggattttatgtaaataaataatttttcctggatttctacacgctctaattcccggattaaaattagagatttttcatcggacgaattctagtgtttttggcaaattttatttttacaccttccgtttttcggattgatatgcgaaaatcggatttgaatgattcgattaaattccaattttgactacataggtattttaactaggtataatgctggcaatcatggagtttactggtcccgttttttttgcttttgaaaatcttggaaaatttttctaattgttctctttgtatagcgccgctaagcctatgtgcaaattgtctgtgttgtatgagttgctattgtacgttttaccgtgacaccaatttcacaagagagcaatgccatcatcgttgaattcaaataaaaaaagaaatgctaattaccagggcacttcctcagtcaaggaaatcgacgaatcattaattgaaacgacggtaattagggcacagagaacaaaggtccatattcagttcatttgtaccactttttcttcactctattttgtttcatttgatacaaatttagccaccaaaaacccccaaaatcgacggcaatggcagtgccggacagacgccgtccccttcgcgccctcactaccaaatgaacgcactcgaggccgcactgagtcactatttcagcccaaagaagcgctcccccggccgtccggcgcaaaggtcaaatcgaacggacaattgacgatttttggaaattgaaatataagtcaaattcgctttttgggagttacagctttaaaatttagaaaagtgcaatttgatgatacatcatcacattcggaagggtctgatggggaagaagaagttgaggaagaacgaaagtcggaaaaatggaccaaatgcgattccaacagaagcgatttcgccgctgtcaaatgttgctttgaagtcgtgcctttttatttattggacataatgtattcatttagaaattggacaatcatttgccttggaagttcaaaaggaatctaaacggagaaacattcggcagacatttctcccaatggtttcactttttggagagcggccaattcagtattttagtgagcagttagttcattattgtttttcacatttttttgggatttaaactgttattccaacattcatttttagctccatgggcttggttcaaaacgtcgaattttggaggattttcgcgactttctgtccctccgaaaccgtcggtcgttcgtcggtgatggtctcaacccttccgacacaatgccaaaaatgattgaccgaatgacggaagagctaaaactgaagggaatggccaaaacgaaggaaaaatctgtcgaagcggcggcaaaaggtaaaacaatcagaaaatccgtcccattttttctcttctgttatcaaattaattttgttaattgggctggtccgccactttcctttctcaaaatgccatcctttgctgtggttttggctagaaatcgaaaatattgcgaaagcgaatcattcgcaaaaattcttttttttgttcctcacgaaatattttgctttgtaatacaattttatttttgccttttcccttcgtttagctttacgaaatgctgtcgatgctcagctgcgttttccgattgttttcattttgctgaatatcgactcgccccaactgaggcccgtcagacaaatgccctttttggtagcaccaaactctgttcagatctcgggaacatcagaaggccctttccgtgttggccaagtcgagcaaagtccaactgatcgcttcggttgaccacgtcaacgctgcgctcatttgggaccaagtgcgacattctctcataatttttttcaaaattgagctatcaaaaagggttttttgtttgaattttcactttttgcgcctctttttgccttttttctgtccaccgtttccccatttccctttcagtcccttcgcgatgcgttcgcttggcttcacttcccaatttcgactttccattgctattgggccgaagtgatggccagtggaactgagttgctcggccttgacgacaagggaattgcgaaggtaccattagtccaaaagtgacggccatcgaccgaatggtcggactttttcgtctctcttcctcagcacactctttcctcgttggacgccttttggggggcgaccacttcgaacatgcgcaaaatcctagcccaactggcgctgcacgccccgtccagggaggaccgtggtcgcatggatgcgctgggcattccgaagttctgtcgcattttacggtaggcagatcgatggaaatgccaatatttctttaaatttaacggcaattcgaattcgtgggttcagagatgagttcgccaccacttcggagactgtgctcagacagcagctgatcgaattttgtgaccatcgcatcatccaattggacaaaaacagccacattcacttggtacgaacattttaaatgaacggaatgaaataaatggcaaattgcaatcaaaaaaaaacagctggtggaccgtcaattgctcaacacttttctcgactcgaaaattggcaatgaatgaaaaaagaagagaaaagaactgacgactcaatttactctttccttttatttgattttgtttactcttctaccgattaactctttgaactttaatttttcagtttaaattctctgtttggtattatttgtatttattattattcggtaacaaagagaaatccctaattttgtgaaattattaattaatatttgaattgtaataagtgaaagggaatacatttttgaagcatttataacaacaaaaaataacaaagatttgatcataaaattggccaaacttttaaaaaaacggaaattctccccccgtccctccgtttataatgagcaaatgaaaattcaattgcctaaggcggtgactttattcttccgtttgatttgctcccgaagaaaggcaaatgtaataaaaccaatagcaggcattgaaggcgatgaaaagagcggggaacattttggcggagagcttaacaaaaagcacaaacattggacaccaaaagagggctaaagcatggaaaaggcgagggaattgagacggtctccggggagaccgaagcaaagccccccaatacaaaaagggaatgagcggacaatccgctgggacttccctttccgatcggtccgacccaatccctgccacgggcgactgaatgccggggaggggccgaccgcccgactcacatcgtcgatgaattctccgttcagcatgtaccaactgtcctcttccccatcctcggccattgaacgcttccagcgtggtctgctcgtctttcgttccctcgtgccgctcactttcagtgtcaccgatttggccgtgccgttgtccattgatccgccgtttgtacccctcgaacctcttttctcggccatattttctgctgctgtttggcatggcattggcacagttcccaattgcccccccttctgatcagtgatcacctcgaaatgcgtgggtattgggcatcgattggcgcgaaaaacggttcatccgggacagccattgctgctcgctgtccgagttgaccatcagaaactcttttgtcctttgcgttcggcgtttgcgcgcctccaatttgtcaaaaaagccaacgacggccaactttaggggggagaaactttcgaattcggaagtgccattttgttcctttcataagtaatcaaattcttttgccgtccccccccccaattccattggcacccgccgtttcgccccctccaaattttgtccccccccccctccctctgccccacttcgacaagcgaaaggaaaatgaagcccatgcagccgaacatccaaatgtccaatgcctttacataggaaacgcgcggcaaactgagaaaagaaatggcaaataatttgaaaaagccatttcaagtcgaattgctcactgattggacagagttttgaacattcacttactttttgacgatatttccgaactgaaaagtcagtgccatcagtgaactgacgccgagggtaatgcgagcgggaagtgccgaagtttggatccaaaaggcaatccaactgatgaacacggacagataagtgggcatgaaagcctatgggaaaaggggagggggaggggagacggattggcactcgaagtgacgagccaacttggagaatgtaaaagccgtacagacgacgaaatttgaacaccacttccaattggtcccaaaggcctgaaaaggggggactctcaaaagcaaaagagcagtgaatggcaccaattggacggatgacaaagcgacagagaagggaattgaaaatcaaaataatgatgacacttttttggagcaaaaccattggccaattcttctgccgaccgttcgcccgtggcgattcatttggcattttcacacaaaaggacacttcattccg

SEQ ID NO: 10662 - DNA, 1188 bp, Heterodera glycines
  misc_feature (1009)..(1009): n is a, c, g, or t
  misc_feature (1097)..(1097): n is a, c, g, or t
attccatgacttggtccatttttacttctcacgtcttctttcattacatttttaagaccacttcaatgggcgcgtgtatttatttttttgccgaaatgactaacaattttacacacctatactccctttttttcactcgtttttctaattgccattttttaaatgttacccccaaatttgatggccttaggcattccatatgagctgaaggcccatgtgtggggcgtctgttcgggcgcgctcgtcgaaatgcgcatcaacgagggcgaatacgcggcactgttgcggcgcagcaggcacaacagcgcggcattctctgagctgacgatggacgaaattgagcgcgatttgcatcggtctgttttattttgcatattcggtggcacattttttgattggcacaattagggaacaggccccaatttttgctaattaccaattatttaatggtccgtgaatctgtcatttttaatttcagttctttgcctgagcatccggcattccaaagtgccgccggaattgatgccctgcgccgaattctcacgggtgccgatgcctaattaaacaaaaaatatttttaacaattatttttcagcgtacgctgtccgaaacccaacaattggttactgtcaggcgatgaacattgtgcgttttggcccggggttgtcactgttcgagagttggtcttgaatcccttggaaatcgattgggatgtacgagatagagtctctcgtttcccgggtctcggttctcgatctcgataaaacgtttcccccaatcccctaacaattctaatccccttttcaaagcttgggggcatttcatagagaccggggttttattcggggctgaaaatttgtctaaaaactagctttaccgtatattctcccatcactgctcacagattacgtccgttctgttactgtacgccccggaggagttggctttttggctgctcgttgccgtatgttttccgcccatttaataaaatgaaaaatggatttccctnaatcttcgattgtcgtaaattttaggtctgtgaacgtttgttgcccgactattaaacacaaaagtggtgggagcattggtggaccagngtaagtgactgatctcttcgctgatcacccattttgatcgcattattcctattatttttgtcgttcccccccccccccccccccccccaag

SEQ ID NO: 10663 - DNA, 3261 bp, Heterodera glycines
gcgttggaaatgttgcgcgaaaatgcggaaataattgtccgggcacgggacgagggcgaagcgctggtggcactgaacgaattcaccgacaaaatcaccgattctaccgtcaaaaattccacgcaggtgaggggaatggatcaaattggtacataattgttgggatggatggaatttggcacataattgcgagtgatcaatttgcaattttttttttttgcagattttcatcggcgatctgatcggcaagtcgtacaaacactttgcggacacgttcaccaacgaaaccattgagaagctgaggctgaaacatcggctgaaagtggtgcagaatttggaggacagtcaggtgggcaattgcacaatttgatgagtgccaatttcgaaggtttttggtcaactttttttcatttgcatcatatggcggtgcctattgacaccgctggagggaaatttagacgaattttataagaaaaattccctaaattttcaagaaaaaatcctcctatttttctgttgtaaatctccgctgaacagatgaagtccatcgtgaagagtgtgggccgcgagtgccgtctgctggccgacgagctgtgccggctgtacagcgtggtgcgtcaggaacagctgttgacctggagaggcgtccgtctcactggaagcagcgcgacggggaacggcgacggaacgcaacggcacgacaaaaagacggcggcggagcgcaaggcgagcagcgccagcggtcgcgcgggcgtcgaacggtgcgaaaaacagctgaaaattaaatttaaaacatttaattgcttaatagaagactaaacgagatttttggcacagtttatgagactgggttttgtgatataacttaaaagtaacacgaaaaattcttaaaaaatatacgaattttttccgtcattgcacaaatttctgatgtcaattttatataaaatgaattgggtaccaaaaaaccaataaataaataaatatttggtaataaaatttcaatatttacactattttattaaatctaatggtgtataattgaacaataattttccttttattttttcgcctaaagattggcaaaaaaatggtataaaaaaagtgcgaaaaaataaaatggattattttaattatttccacaaaataaaaatgtttttcccttttagtgctcctccccgtgtcgacccgtgtcttcagtcgtcgcagcaccaccagctggactttgacctgttcgcccaaattttgagccgttttttgccctggcgacccggcgacgaaattttttatgtccgcgcttttcgggtaaaaaaaaattcattttttttattgccaaaaactgagtctttaagcttttggatgcgaatgagacgggcattttgacgtttcgcgacttgtgctgtttccttggcattctgttgaggggcgacccggccgacaaaatcacattgttgtacaggtggcacatggcaaatgattggggcggttgaaaaacattgaaaaaaagcacggcacaataacttcctctttttcttggtgcaaagatgccacattccgcccgccttcaacatgtccgacttggacgagctaatcagggagtcgccctcatttggtaagaaattgtaaagtaaatttttaaaccccaaatttcggcatgccaatttaaaatgctttaaaaatatggggaaatacggtcattttatcttggcaaatcccatatctggcaaggcattttccaaagctttcctcctgccaggtgccgccgagttgggcgtcgaagcggcacaagcgttgggcagcgcggacgcatcgccggaacatggcaccgccgctggcactttggctgcaacttccgtcgtgccgtcctccggcattggcaccgatggagcgcctacgtcgccaatgtccaccaccgtttcttccctttcgtcatctctcgcaacaacggcagccaattcaccgctcaaacattcggtcagcgattcaacggtgtgtttacaattgaattattaaatgttcgagagtctcgactcgagaaaattcccggcatttaattgcccctcccccttcggtttgtcagattggcaagtgctcctccgccaccggctgctgcgcctcctcgtcgtccctctcctcctcccttcgaccgcccgtccgttgtccgtccgtcagtgcgttgcactccctgaactcgtgctcgtcgttgcccagcgatgcgaccaccgaagcgcgcagcgaattcagcggtaaatgccgcaaaaatgcccattttatcaatcgacaccgtaacacgcttatttgttaagatttctcccttttgaacgccaattgcaacgcgtccgacctcggcagaagcaaggacagtgttgcggcaacgacaatgacgacggatgtgcatgttgccgcttcggaacggcttgcgcgccgtcagcgattgctcgacgagtcgccgcagggcgggtacgttcagcagaggatgatcatttaaatgaattcatttatctaaattttctttgtagtcgcagcagtgtcggctcgtcaagcgccgcaattatgcccggggcacgccaagcgctgcaaccgattacacaggtgggtgacgctgtggacaaaacaaacgggaaaagtgccgtagggacaggggccgggggcgatgtcccgagggtgatcttggtaatttacccaacaaaatatcgcaggttcaattcatccaattctggaaaacattctacgacatggctggcagcatcagtgccatcgctgctgacagtgttgttcatcccggtggtggaggtggcggcattttgccatcgtccacgacatcgtcgtcgtcgatggccaaccatgacgtgtcatcatcatcttttgtaaaacaccagcaggacgatgccggcggccacggcactgtggcggatgtgtgtgagacggcggtgcctgcggaggaggcggacgcgcaactgtttcacgcgctgtcctacgtgggcactctgctgctgcagttgggcgaggcgcaccgaagtcggaggtggacagcaaaaaatgttaaaaaagcattataaagcagccctatttttggcatttttgggggggggggattgtaattgtactccttgccttctaacaatggaaaacaactttcgaagagaggaaatcgagcgacaaattgtcgatgcattgggtgaagaagcgaaggcattgttggatttgacagcagcgaaaacaacggaagaagacgaaattggggaggagcagcagcagacg

SEQ ID NO: 10664 - DNA, 1654 bp, Heterodera glycines
  misc_feature (18)..(18): n is a, c, g, or t
catcattctctgactgtncattcccttgtctcctctcattttcccaccctctctcgccgtctctctttttctatctactcctcgcaccgttaatgggactaatgaaataccttcaaacttttaattgagtcttttgccactttactttattggcattgatggattttgttgaatgcttacaatttcaggtttccaaatgctctcttctgtcccaattttcaatactctgctgatggagatgatgatgatgatgatgctgcttcttttggttgtgatgtgtgttatgccaaaagtgaccacattttgtgtccccgagggaatggaatcaaaacggcgacttcgcaattaccaataatttaatttgttccttcaaccaacaccaaaattccttcttctatttttgtatttcattttgtcggcacatgcaatttttaggaaatatttttaaatgtttgaatttgccttattccaatttatttgtttattttttgtttcgcttgctctctctttctctctccgcactttttgcccatttattttattattattattttttagtaaaacggttttcgtttgttccttttccttaattctctcccctctctctctctctctttctattcctactgtaatgatactgtaatgtgtttgatcaggttgtttttatcgtgccgagactcgatcccttttcattcaaattttaaatttttcctaccgacaaccttcttatacagtatccattacagtagtattcacctttatctgttgctgctgctgatgttaacgcgagtgtatactgtaatttgttctgtgcctttgttctctttctcttctttctctctaatttacaataattgtcagagttcagtctccctattacgcgttgtatacttttaggcacaatttttgcaaatttattttaaaataaaaaaattctcctttttggccccttctgacctaacacacacacacagaaattgacatgccaaaagcatctcccctattgctttaggctggttaattgcgctattattgttatttaaaaccaaaatgtcgcccttaggccaatgtctccaaattgaaataaattgataaaatatatattttttgccaataaagaaaaagtccggaaaacccgcttacgttgaggatgtgaacaaaaattaaaatgtcctttcgaaaatgtagtaaaaaaacggaaatcaccaccgaaataaattaattaaaaacttaaaataattaagtaaatcaataattatttctttttaaattaatttttaatttaaaaaattatttctttttttaacaatgaatattttatgttatgatcgattgaccggcagaagggatgggctaaaggaccgatcaacaagtggatgaatggataatgatcatcccacacaaatctttcccgaaaccaatcatttctatttttaagggatggactcaattactaattgccaaaaaaattattattagttggcattcaactgttaattgaaatttcaaaaccaaataaaactaataaaattttacgattttaaaataaataagctaaaatttaaaactaaaaattataaaaaattcgaaatttatttaaaataaattaagattagtcttttcatttcttccactttccttccatcctcttaag

SEQ ID NO: 10665 - DNA, 1215 bp, Heterodera glycines
ggttattattctatggtttcacaaatttttcgattattttgagtattttaaaattggtttttgaaaaaaataaatgataattgcatttaaaaaatttcacttcacttttttatttttattattataataaatttttatcgaaagaatttatttttatttgaaattaaatgaagaaattaatgataatgtgaggtataattgagaattttcaaacacaactaatcaaacaaatttatgaatgtcatttatgctggattttaatagaagttttggaggaaaatcatttcgggggattccgaatgtcccatggattcctaagaaaaatggtttcctttttacaaaataagcccggtgccgagttatgacgtgccaaattttatagttttttatgtataaaaaaaaatttgcatgtattttatctatttcaaagcttttaaaatgcatttcatatttttaataattttcattgcttttaaaattgaatccggcaaaatccgaccaaattttggcgaaatattcggcaacgcatgggacaataataaaagagaagaaaaagcgatcaaaattgaacaaaatgagcaaaatgataactcagcgacagttgatcaaatgggtgagggaaatggaacgtacccaaatgatcaaaagaaaagtgaaatcattagcaaatttgatgcaattaaacaaaagttaagagaaaaagaaaattttcacgaaaagaacagaaataaaattgctagattattaggcgcaaatcgccataaaatatataaatggaaaaaagaattatatttaaataaaaataaaattttttatgagaagaaaaagagagaattcattgaacgatttgatgaatttaaaagtttatatggccaaggaaaacagaaagaatttgtgaaggaattgggcatttcttatgacacatttcgcaaatggaaaaaagaattggtgccaaaatacaataaaagtaagataatttgtttttctttttttagagaaatttgagtgaatttattattctccaccttgcgcagcgggtttcaaaatttggtcgacttttgcccggattcaatttttaaatcaatgaaaattactaaaattaaaataccacaacattcaatttataattatttttaaatatttttttgaaatgaaaatgagtttgattaatctttgagcttaattaattaaaaataactgaaaaagaaatatttt

SEQ ID NO: 10666 - DNA, 1786 bp, Heterodera glycines
ctaattatccataaatggcataataatgcccttccccaccattttttgttggcgagaatttgaggcggagaatttctcggcttttgctactaggctcttagtaggtttttttgaaatttatcaggtattactttcacagggctcatttttttttgcaaccccatatgaataaaaaaattttagttttaaaaattttcctttttcgaaaacgttataaaatatttaataatcatttaaatgaccaaaattatgttttttggttaagttttacgtgttttgcgccctaaaaatccttaataaaaaatttttaaatgccttttttcatgccttttttgggattttcgtgccttttcatgccttttttcaattttttggtgcctattataagtgcctttttttgcgagctctcattatggcagataatttgcaaatgaaagatttaaaacaataaaaaataataaaatacctaattacgacgttgactcttcgataagacgactcatttcatataaatttttttggaaaattttttgttaaaaatcttagtgaaaaattgattgcattgctcagaattacgcgacaatttaatgttggaaaagatttattatgagaaaataaataataaaataaatattaatatttaaaagcaaataaaacactaaacatattcatttactgcaatatctttaaattttataaatattctaaatactaaacatgaatttgtggcttttgttatttttaataattttcattgcttttggaattgaatccggcaaaattcgaccaaattttgatgaaatattcggcggagaatgggacaaaaatgaaagtgaaaaaatgttgataaaaattgaacaaaatgagccaaatgtgaaatcacaagcagcagttgatcaaatgggtgaagaaattggaagtggtccaaatgatcaaaagaaaagtgaaatcattagcaaatttgatgcaattaaacaaaaattaagagaaaaagaaaattttcacgaaaagaacagaaataaaattgagtggaaaattggaaaattattaggcacaaatcgcgacaaaatatacaaatggaaaaaagataaatttaaataaaaagaatttttatgaggacaaaaagagagaattcattgaacgaattgatgaattcaaaagtttatatggccaaggcaaacagaaaaaatttgcgaaggaattgggcatttctaatgaaacatttataaaatggaaaaaagaattggtgccaaaataccataaaagttagaaaatttttgtattatttttaattttttttttcgttttaagcacaaaataaatattccaatgaggacaaattgagaaagatgcggaaatatcgcaaaattaaagaaaacaatccaaaaattagtgacaaaataattgctgagaaattgggaatttcattttcaacactgaacaaatggaaaacagtttcattttcgaattgaatgattttgaagtgtttagaggatttttgatttgaatggctttcgtctttatattatttttttttcttttccgatatttttatcataaataaaatttcgctgatttccaattttcaagtgcccgtttttttaaattttctgctaattattcaatgttttaataaatttttagattgaatacttttaaaataaatttaacacaacgaaacaagagatcgtgttttagacagggctcgcagatgaaaattttcaaaagcctaaattggcaagaaaacgcctcattttgggttaaaaagcctcatttttataaattt

SEQ ID NO: 10667 - DNA, 2319 bp, Heterodera glycines
  misc_feature (2197)..(2197): n is a, c, g, or t
  misc_feature (2234)..(2234): n is a, c, g, or t
  misc_feature (2241)..(2241): n is a, c, g, or t
cctttattttcttaaaatttgctcaaatccgtaaaatttggccatttttgtggacaaatctgttaacaaatcgtattaaaaatcacaaaatttttcccggcggcgcctatcggcaccgccccggctccccttattccccaaaagtttttttttttttgaaaaagcgccggaaaaaaatcaacttcgggttttcatgcttagaatttcacaaaatgtttacctagttctacaaaaaattgctcaaattgatcatggacaatcaaaaatagaatatttgaacattttaaacgtgttttgaataaatttctaaaaatgaggctttttaacccaaaatgaggcgttttcttgccaatttaggcttttgaaaattttcatctgcgagccctgtctaaaacacgatctcttgtttcgttgtgttaaatttattttaaaagtattcaatctaaaaatttattaaaacattgaataattagcagaaaatttaaaaaaacgggcacttgaaaattggaaatcagcgaaattttatttatgataaaaatatcggaaaagaaaaaaaaataatataaagacgaaagccattaaatcaaaaatcctctaaacacttcaaaatcattcaattcgaaaatgaaactgttttccatttgttcagtgttgcaaatggaattcccaatttctcagcaattattttgtcactaatttttggattgttttctttaattttgcgatatttccgcatctttctcaatttgtcctcattcgaatatttattttgtgcttaaaagataaaataataattataaatttaaaaattctctcacttttataataatttggcaccaattcttttttccattttataaatactctttcagaaatgcccaattccttcgcaaattttttctgtttgccttggccatataaatacttaaattcatcaattcgttcaatgaattctttctttttgtcctcataaaaattctttttatttaaattcaattcttttttccatttgtttattttgttgcgatttgtgcctaataattttccaattttcacatcaattttgtgtcggtctttccgttgatattttcctctttccttaagcttttctttaattgcttcaaattttcgaattatttctcttttttgttgatcatttgggtctgtccccatttcttcacatatttgatcaactgctgcttgtgatttcacatttggctcattttgttcaatttttatcaacattttttcactttcatttttgtcccattctccgccgaatatttcatcaaaatttggtcgaattttgccggattcaattccaaaagcaatgaaaattattaaaaataacaaaagccacaaattcatgtttagtgtttagaatatttataaaatttaaagatattgcagtaaatgaatatgtttagtgttttatttgcttttaaatatcaatatttattttattatttattttctcataataaatcttttccaacattaaattgtcgcgtaattctgagcaatgcaatcaatttttcactaagatttttaacaaaaaattttccaaaaaaatttatatgaaatgagtcgtcttatcgaagagtcaacgtcgtaattaggtattttattattttttattgttttaaatctttcatttgcaaattatctgccataatgagagctcgcaaaaaaaggcacttataataggcaccaaaaaattgaaaaaaggcatgaaaaggcacgaaaatcccaaaaaaggcatgaaaaaaggcatttaaaaattttttattaaggatttttagggcgcaaaacacgtaaaacttaaccaaaaaacttaattttggtcatttaaatgattattaaatattttataacgttttcgaaaaaggaaaatttttaaaactaaaatttttttattcatatggggttgcaaaaaaaaaaatgagccctgtgaaagtaatacctgataaatttcaaaaaaaaacctactaagagcctagtagcaaaagcccgagaaattctccgcctcgaaattctcgccaatcaaaaaatgtgtgggaaagggcattattatgccatttatggataattaggctaaaacttcagaaaaattgaataatttaagaattttattcgagttttgaaaggtcaccaactaattataatttattttagatgacttttagctctttgctanaatttgtgaatttttttttgattttccatattggttnctttccntttacagtttccctctcccaatttttcattaaaataattattcgtaaatcctaaacaatgagaaaatttcgaaaattt

SEQ ID NO: 10668 - DNA, 2864 bp, Heterodera glycines
  misc_feature (24)..(24): n is a, c, g, or t
tgctgctaggcgacgactcaacanttttgagtggccaacgtgatttgtgtatcagcagatgacacactgtgttgcgaagtcataattgactccgctccggcttttgggggtcttccccttcttttacttccaatggaagaagccggtgtgcttaattgcaaagcactaatattgggcgttgtggtgcccgggtgtgatgccaccccattctcatctgcacttccgtcagggacgggtgagcgaccagggctgacagatttctccatctgcctttggtaccgctcttgctccttctttcttttagcgtgttgttttgaaggcatctgaaaacaaaaatgaagcaatgatgtgtacatgcggcaaaatatttggggaaaacaaccaataaaccacattaatcaaatatttatcaaaaacattgaaatgtgaaaaattaaggtccatcttccttgtttgccacagtgatgccgctgcgaatcaaacatgtccaatttcgcacaaaaggtcattgagtgcagaaattgatcgctcacacatcccattaagaatgcagataaaattatgcattttttgtcgaatctttccccagtaggggaaagatcagcatagtgcgaactacaatcctttaagggactggccattgaaccacaatcctcaaaaggcagtccacatttattttgatgaactcagatttcctacgttacttctcaccagtccactggtcttgacaaagtgcgggaccagcttcgcaccggctgttggccagcaacgataaggaattcatggcgccaccattgagcggcccagccacatgcatctcttggcgagagcaagtctgggcttgctttccatatcatggtcgcaaagcagaccgatatgtgtgccatggtcgcgaagcagaccggcactgtgtcatggtcgcaaagcagaccgacacggttggctatggtcgcaaagcagaccagcctcgccatggtcgcaaagcagaccggcgtgagcactacatatcatggtcgctaagcagaccgatatgttgccatggtcgcaaagcggaccggcacgtgcacaaatctcatcatggtcgcaaagcagaccgataagatttgcaaacaaataaaaaatgtaagtctcaaaatgggaataggacaaaaatctttacaattgactcaactgacattttttttaaagtttactttttttaaaagtttacgtacatataaagtttaagtcaactgtaaagacttcttaaattcatagagcttacacgtgccaaagtgtacgaaacttatttcctaactaacctcagatttgggttagtaaaactatttactaagtgtacactttgccataattttgttatatgtgtatctgaaaatattttgttgtattcaactcagtcaaaccgatgaattttatatattttaaccggccaaggaatttccttagaacattttttaatttacaaaaaattagtggaaatggtttcgcccatcaatgcttatttcaaaaaatcacaataattgattttaatagaatgcaaccaaaagcttttcagctaaaaacatttgaccggttaatttgagaaaaattgaaacatgcacaacaatccacctttgccattgaaatgttagtcctcagcgcatcgaaacgttgcaaaagcagtgccaatttgaggcgagttcagcaaggccacagaaggggaaaatgtccatccaaacgtcgttgcgcacgtgctgaaagtcacgaaaatttttataaaattgcaaaaacacaaaacaatgaaaaaagcttaaagtaccaggcacttttaaagaaaatacataaaatgtttgttgaatttttaaaatttttattttcagagccattttgataatttgaggccattataaactcttgacaagctaagtctaaaaatcaaagaattagtttggccgatgccatcagagcactgggacatctgagtcgaagtgaaaatggacatttcagttccaaagaaataatggatggataaaataataattaattttagatttagctcgtcaagagctttcgaatgataccaaatttgagcgtttaaagggtctagagccccccttttccttcaatttttcgagttttaaaccggttcaaaaaccggtttaaatgcatctccgcatctaattttaagcttttctgtcattctcagcacctaagaaaacctataaacatgtttttaggatttttttttgagttggtaccgtattcggcaattttaccaaaatatctgttggattagtaaactttttagtattttcagactcatttgagaccattaaacttttgtgcacaaaatccttcaaaaaaaacaaaaaaattcacttttacaaaaaattggaatttgaaaaaaaaatttctgaaaaatttttgaaaattcgggccgttatgatttttcgggccgtggccaaaaaaacagaaagaaaacccaaaaaaaacttgccgaatttataaaaaaaattcgttggtccatcaaaatgtttgtccaccagcgcatagaattggagcgaaagcagtgccaatttgagccgagttgagcatggtcaaaagatgggagaatgtccatcaaatgtcacatgctgaaaaatttatgaaaaataaaaatcacaaaaaaagattccagaaaaaaaacctaaaaaaccccctgcattttacaaaaaaacgccgaattcggaaaaattttttattatgagccatattgaaaattggagttcagagccatttgataatttgaggccattaaaattttgtgcacaaaaacgttcaaaaaacaaaaaaaatctatttacttttacaaaaaaatgaaattggaaaaaaaatttcagaaattt

SEQ ID NO: 10669 - DNA, 974 bp, Heterodera glycines
aaaaaaacaaaaagaaaacccaaaaaaaacctggcggaatttatacaaaaattcgttggtccatcaaaatgtttgtccgccagcgcatcgaattggggcgaaagcagtgccaatttgagtccgagttgagcatggtcaaaagatgggagaatgtccatccaaatgtcacatgctgaaaaatttatgaaaataaaaatcagaaaaaaacagaaaaagcctaaaaaaacccccggcacactttacaaaaaaacggcgaatttggaaaattttttattatgagccatattgaaaattggagtgtattttttgcacaaaatcctaaaaaaaacatataaaattattcacttttacaaaaaaaataaaaaaaaatttgttggatttgtaattaaaacaaaaagaaaacccaaaaaaacttgccgaatttataaaaaaaattcgttggtccatcaaaattgttgtccgccagcgcatcgaattggggcgaaagcagtgccaatttgagcccgagttgagcatggtcaaaagatgggaaaaggccaccaagtgtcgttgcgcacttgctgaaaaaagtaataaaaattataaaatcgcaaaggctaaaaatgatatgtgcaaaatgcctaaaaatccgctttacaagaaaaaaatgtcgaatttggaaaatttttatttcggtgcaattttttgataagtcggcatttctatgaattaaatttaaccaaaaatttcgatatggattaaacacaaaatttatgttcaaaagcaaaaagaagtgaaaaaatagaggccttcatttgtaagtctcaaaaaaaatgaaaatttttagaaaattttgcaatttttcttatgattatgttttttttaattgaaacttacgtcaattcgttttgccattgaaaatgtttgtccaccagcgcatcgaaacagggcgaaagaagtgccaatttgaggctgagttgagcatggtcaaaaaa

SEQ ID NO: 10670 - DNA, 1515 bp, Heterodera glycines
aaagataaaaagttatggctcattgacagaatcgaggtttttaattatttccacaacaaagggtgggtgggaaagtgtgacaaaaatgactcagagaaattgaataacaaaaaccaatcgatatcttgtcgtacgtaaagaaatatttgatcgaaaaatgtaaaatttgttttttagttaataaagggaataatttattttaaatcttttgttttattttgtttttaaatgaattattattatatgcatccaatttttaaatctagttttgcttaaataaatctaaagaatttcttatttattatttaaactaaaaaaattaatttaaaaaatacatttagatattcattattaataaaacaaaaactattttaaattatttaaaacactgaaaataacacaaaaataaatagaaaaaaatgtacaccgtccggattcgaacttgcccctagcacataaaatagtgatgagaataggtacaaaagtgattagaagacgtacaaaagtgatgagaagagttaaatagtgatgagaagaggtacaaaagtgattagaaaaggtacaaaagtgatgagaagagttaaatagtgatgagaagtggtacaaaaatgatgagaagaggtacaaaagtgattaaaagaggtacaatagtgattaaaagaggaagaacagtgatcagaagaggtacaacagtgattaggagaggtacaacagtgatcagaagaggtacaacagtgattagaagaggtacaacagacagtgattaaaagaggaaaacagtgatgagaagaggtacagcagtgatgagaagaggtacaaaagtgattaaaagaggtacaatagtgattaaaagaggaagaacagtgattagaagaggtacaaaagtctaacttgttatgagatgtacaaaaataatttcataattttaaatataattttatagagttaggtttatttaaaaattaaaaaaaaactaaataataaaaaatgtaaaagtttattttttaattaataaacggaataatttattttactttattttgaaatgaattattatgcatccaaatttttaaatctaattttgcttaaaaataaatctattcatcaaagaaaaattaaatttaattaaaattattttgttattaataataaaacaaaaaataatttctttaatttaaaaaaaataaatttaaataatttaaaacagtgaaaataacccaaaaatgcatagaaaaataatgtacaccgtccgggtccgaacctgcctctcccctcctcataagggtgcctcagaatccccaatcacacagggattctgaggtcttaaccatgtcaaaagtaaagtctgattacgtattcgtgatcagcgtcataaatagacctaatgacatgtttttggaagatttttggtgaaaaaaatttttccactcaaaaatcctggtcaccccccctttggtcccgaatctcaaaatcacttttatttttgtaacatctctcaaaaaagtgataaaaatg

SEQ ID NO: 10671 - DNA, 5595 bp, Heterodera glycines
  misc_feature (5513)..(5513): n is a, c, g, or t
aacttgagaattcttaggaaattatttaaaggaggtgaattacagtatcatcaaaattttgagcggttcaaaacggtttttacagacccgagaattgaatatatctcattttctcctcagctcggctatgtgttgggttttgaaaatcatcagaatgtaagaaataatgaaattggtaaatatggaagtgatctccgtggtggatttgcaagctttgccgtctacgcaaaaggtctaaccgagaatatgattgttggaaactcgttgagctcacttcttcgtgttgtatcagtgtcaggggccgtaccaggcgaatacacggaaaaaatttacgactctccgctctatgcacgtgttttaccaaaagaagtattagaaattgaaattgaattgcgaactatgactgacggacgactggtaccattttcctatggtacagtgctgatcgtattgatatttaagaaggtgataaatttttgaaatcactcatttttgttaccactataattgataaaatggtgcacattctatacgacacatcggtttcgggctatgatgcattttttgtgcaaaatggatgtggagtcggggatgactcctcctaccaagtttttcgaggcgcgcaaccgtttcagcgagggtggggcactgcacaaacgggtgcaggaataggagatatttttcgtggtctctggcgctttttcctgcctttaattcgcagagctggagatactgtagcagacgaaacaattcagactggaaaacgctttataaatagagtaatcgatgaaaaacccggcttaaaaggaagtatagagacattgacaactgagagtaaacggggagcagacaatgttttagagaagggcggatttcgacgtcaatttggcacaggaggacgaagaaagcgtataaaagctaacaattctcccactctatcacatcagactttaatcggaaaagcaataacgaaaccattaattaaaagcaaaaaaaggcttcgatcagacgcgtttggtctttattaaaaatgacatttcacaaaattgacgtgagtagcatcgattcgattaccaacgccgtggattttttcagtataccccctacaaatgttacagtatcatcgtcaaaggttttcgagattttgccgagtaatcccctcaccgacacaccttaccattttaaaatacactcgagccaaaactacattgacctgtcaaagtgttaccttttgaccgaatttcgaatgcgaaaattgacagcaccaaatggtgaatggggatatttggatgctactgatcaggttgtaccgatacaactgatcggacacacgttcatacgagacatgaaaattgcaataaatggtcgtgaaattttcaactctaattcactgatggcatacaaaacttatctttctcatgagctttcgcaatcacttgaagctaaagtttcgcatttaactgctgctggatatgaccgtgaagatgctaacaatttacaaaacgcaaattccgaagggttcaaaagtagaagacaacggtatttgggaggtcgaacagcacaatacattgcaaaaatcgatgccgatctgttcaatgtgccccaatatttgattaatcattgcgaaattgacataacgatacaaccccatgacggcaattttttgttaattgacacattagaccccccgggtcaaccatatagcattgagcttgttggattgaaactctactgcaaaaaagtcagtcttatggatggcttggctcttaagttggcgaaaaaattggaaatgaaaccagcacggtatgctgtacgaaaaacaatgatggaagcactgttcataagcccagggcgctatgaatttaatgcaaacttgttcatggaccaagttccacgccgcgtaacaatgggtcttgtggcaaactcagattatgtggggaacatcaaaaggagtccattcaactttcagcactttaatgtacatgagttgagtgttgtggccaatggtcgctcctatccccaggccccgatgacattgactgtgaaaattggaaatttgtccgcccctacaatgacacgcaagaggcgcttggttttgccaactctacatatggaaatggaattgattatttttctttttgcacactcattgtatttatgtgtttaacatgactaatagtggagatgatcatggcggtttgttcgacctgatcaaaaagggatgtacatcagtgaacataaaattcaaaaagccagtgcccgatgggggaattacactgatagttatgggagaagcagactccatctactttttagataaaaacagaacgattgcaactgatacaaccatttgatttcaaaaaaaatgtttcatttattctttattgtcttgttttttcaaccaattttttgtttaattgttgaagaaggaataaaagctgaggaaattccccaatataatgagtggaaaagacttttggggtttaaaaattcttcagaaattcaaaaaaatactacaaaagcaacgctcgcctccactttagttaaaaatgtttcaacaacccgaaaaacgacaacccaaaattcaacaataaaaataaaagttactacaacaagtatagaaacaagcagtgccttaaaacaacaacaacaacaacagcatcatgataactttaatttcccctttgtacccctctgcaaagaattaccaaaagaggcaaatgtctatgcgcatattttttgttggtctatgatcatcctttttgccttgtccgtcatcagcctcatcatctatcagcttcgttcaattctttggattaagctaacgttaacggaaaagggcaataaggcaaatggatagcaatcagattaccaaaatattgatgttttcagagaaaacaagccggacgttccttggatgcttcccatgcgaccaattacctgacccaaattcattaagatttccttgctcattgactgttaatttagatgttctcactgggtcgcaatgtttgcatatggattaaagaagaaagtaatttattttgacagtctagcgctaccgataaacggatcaattgttagctcctttctcaattcatttcccggagcggtgtataaccaaaaagcctttcaaactatttcatcaaagtcatgtgctcatttttgcatttgttttgtttactttttatcatcaggttccacatttgatcaatttctaaataaatttaatcatttaaatagtcccgaattgtatgttcaacattttgttcacaattttccaataaaactttaaagaaatgactcttttttttcattgtataattaggtctatctcacaaacgaaaggaatgaaaagtaaagtaaacacaaggtaccgtctagtgtctagcaccactggctgccgaatggacctaaccaatctgcaatgacccattgaacgctgattggttgaatatccattcacccattatttatataaccctttcctcctgcacaaatttaggtgtatgttgtgaaaaggccaggagaaggacaatttactcgtatttccaatgggtgtttactttccacacagctattgcaaatgatgattggtcgtcccttctcatatgtaggtcccgctgaaatctcggcggacattgagaaaggaccggggaaggtcaatatattcgtatttccaatggatgtttaccttccactcgcaaatgatgattggtcgatgggcatttcccttttcatttgtagcttccgcagaaatgttgaacgatgattggatgaaagagtagaatggtcttatgactaatattgttggtcctttctgcataaaattgtgaaacaataattctgtttatatgtcttaatagtttccggtataaaaaagaattgaatatgctatgaattcattttattattggaaataataacaaaaagtattttagcaaaataaataaaataaaatgccaaattctcctcctccgtctaaacgtccccgccgcttttttattgaagagttgctccgtgagccattcaatcagctttcgccaccgcgcaaatcaccaaaagattacgtaaaactgctcaactccgaaactgagcttgtcccaaaatttcaatggctgaaaaataagtcgaactttatcatcgagaatgtgcctgctaatccagaagcccttctaattggaatatttcaagaatgcatggatgaggcaatgaacgcgtgttgcgctttcgaaaactcatcggagaacacactcagggcctcgatccctttttggtgtcttcaacagctgctggtctggctttatcaacgctccgacgttgttttctaccgttcaaccgtttggttcacttctgagggaggatacctccgtggacgacgagcttccgccgaatcccgccgatacatccggttcttcgagcttgaaaaccctggagcccaagtgcagtgcgcggattggtctgtgggagagtccaacattgaagacacaggctatcgtgtggacggcctctggcgacgagagcctccgcatcgtccactggccatcgagtggatgggttgctactatcatggtgttttatcgtcttaattttcaaataaaaatcttaaacgattaaaggatgtcccgactgttttccaaatcgaagacaaaagttggctgctgggagaactgcggaggatttatacgaaaggacgatgcggcgactctttgaactcgaacatacccatggatgtgagcttcacgtcgtatggggttgtgagtggaaagaacggctccgacgcgatttggagctcaagcagcgtttcgaagcagtatttgtcccgtgtccattggatccacgaaacgatgcactccgtggtggtcgtacggagcccttcaaacttcatcatgtgtgctcagacgatgaagagatattgtgcattgatatagttagcctatatccctacgtcatggtgctttttctcaataaatttgaatttaaatttgaatttagaaggtgaatcctttcccagtggggaatccacgtgttctcacgcgtgaggtattgcttcatccacccacggccccacttccctggacatgttcgtcaaataacatgttccggggacttttacttgtacgagtgctcgcaccgcgcctaattcgtgtcccgttgctgggctatcgcaccaaagatggacgattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttnaaaatttttaattcctttttaaacaggccaaaaagtttaggcttaacttttttttcagaaactgatcagaagcgcaccaaac

SEQ ID NO: 10672 - DNA, 3213 bp, Heterodera glycines
tcgcctctgctgctgttcatggtgttgatctttatgtaaacaaacgatttttattgatcgttttggaaaatgaaaaatttgtttgccagaataaaagaaaaaaaattcacagttatataaaaaaaaaaatctggcacatcgataaatgttgcgttgttttattttgagcgaaaatcaatggaaaatagtaaaattggtgggtagtgggattcactgacagccttcggcggaccgaatttcgggacgcaatttttttttttttgagggggggcctcgaaaaacccggactgaattccgtctgttttcttgtaaaataaagaaagtattacattggtcacactgagttcaaacgggtggatccaccgggtgtaacattggcgcattgtttggccggcgttgccgcgaaagcccaggcatttggcaatgtgtgcccagcggcgcgagtcattcacgcgctttaggccgccctcctcgtcgaccatctgaaagcgggaaatttcaatttttttccaaattaaatttcatggtaagaagggtaatagacaacatgaaaattaatacggctgaataccgcgtctccatttggattagggcgaaaatggacccaaaatttattcgaatccatgacttaaacacttgttaaatttaatagttagcggattttttcggaaaatttttccatgtttcgtggatattgtgtaccaggagggcaggacattcatggaaatgatagttttttcagaaatctccgtatacagaaatgttgggaagttagaaatctccggatccaggaatcttggtaagaatactcatggcggtgacatcattttatgtgaactttgggtcccggaaatcttggtaaaaccattaatgagtcttcgctcatatataccatggaattgtaaaacattgattgaatttttacggaaaaaaattcttggaaacctgacgaagccggtacaagtcaatgtacttgttgtcaatgtacgggatgcggaactgctggtccttggagtacttccagaaatggaccaatttgttgatgtaaatgatgcgcaagcggaacagcgcgtcaatttcgttgagccgttgcacgcgcggcacaaattcaaacttggccggctcaatgcaaaaggggggccgaaaactctgcaaaatgattaattaattaattgaatccaaattctgtaaaaatagtaaattttgattgaattgaatgccaaactctgcaaaaatgactaatttaattaactgaatccaaattctgtaaaaattgcgagtcccgggacgatccccgtttttatcgataatgcacttgatttcgaaattttttggtggcaaaataaattttcaatactatttttgaaatctaataattatggaaaacaatcagcagccaagcggatttgaaccccagagaaaaaaaattgttttgaaagaatcagataaaatcaatgattttgtaaaacctgagttcgcattgtttgtgatgattagcgcatttttaaccaaaaaaaaataatgcaaaaaaatttttaattttatttttcatcgggccaaaattctctctccaattttaccattttctaatgtcagggggaaaggtaagacctgttttttgtcccaataaaagtccacaaataaaaaaaaaaattttggattggttcaaaacttgtgaatggcatagaaatcgtcgattaatttcgttttcattcattccataaacggacgagacgactcaccggtggaggaatgattttgatgaggccaaattgttgcgcctgtggcttaattttggcaacataactgatcggatcggcaaattctaaaaaaaaaaaaaaattaaaaatgcctaattcaagaattattgcttccccccaccttcatccgtgggatgaaaagtgggcgcgaacggaggccgcttaaaatcgttgtaatatcgctccaaatccttttccatgccgttaaagttgtgccgagaagatttttttgagcaggtgaaggtggtggtggatcagcagtgggccaggaaattgaaatggtcaaaaggtgaaaaatttagaatttgaaaaaaccatgacaacgtaaaataattgaaaattggagattaatctaaaattcgataaatgagaacatatatttagaaaaataggtttttatgtgtttgatattcgggaaataccaaaacattatgtacatacttaacacaaaattagtattacgaatcgcattaaagttgaacccaaatttataatttctgtagatattgattttttgattttttataaatcgcaataaacattacgccaaacaaaggcaaacctaaaaaaagtaaaatcaaagcgacatatttttcctcgctaaatgttagtctccgttttttgccatgttttttaggcgtttggtgttataccatttccaaattggtttttgttttcatcggccgttgccaaattgagtctggataggatcaacttattatgttatcattttcccggcattcctttactgtttgaacctgacattagaaatgccgggctctactaatttctctaatccaattgctataatatctaggtagctagtttacttacttcctttgctttttgattctgacattgaaagggctctactaatctatctctaatccaatggttatgacatccttttaaaaatgccctgctttaatctttctctaatccaatagctatcatttatccttttaagtttagcaaagattgtgaaagaatggctgcgcacaaaacatttatcatcaaacgaaagttggccaaggctgccaaacaaaatcgtccgcttccccactgggctcgaatgaagacgggcaatcgcattcgctacaacgcaaagcgtcgtcactggcgccgaaccaaactgaagttgtgagcgatggaccccgagaaaacatcggaagacgccggacgggcgttgattttcgacttttttgtttgttcatggagttaattttcatacatttttgtgtggactattgttggtaaaattgttgaatttgtgtcttttcccggttttttttaactaaaattttcgggcgcctccacaatttgaggtaatttttgaaaaatcataacttatgactgagttgctcaattaaattgtttaaaagctttagaaatagagaaacatcaggaaaattttatgggaattattttgaatttaaatctctaaaagaaaaaa

SEQ ID NO: 10673 - DNA, 1820 bp, Heterodera glycines
gtttttaaatgcaggtctaggttaaacacgaaaaaaacctggatttcctggacaaaatcttagaatttattatttcaaatgatcgaggagagggggaggagtcgcggatttatcgttcaaaactggggttgctcatcatcaccctaatttggcgatgaataagtggaatgtccatgttaatggcattcaatgaattggcacttgaatttgtttcgcccagcgccatctgagcgatgcccatttgtgcgccaaacatttttaatctaccaatttttgttcctttttattttgtttgtatttattttaaaattatcaaaccaacaatttcatacacaaaaaaaaatggttgacctaagttttttttttctaacaagtgccaaaaattcatttccacataatcagacggcgcccttttcgctgctttgacccgcttttgctgccggtggaaacaaaggcctaaaaattgaaacgcaaaatttttgaattgttttcaaaaattgttgctcctcacccaatgcaatttttgttataaagcaaaaaaacggtgacattgttcaaacgggacaaaaaagggcacaaattttcgtctttcttctgctgctgctgaaccgtcgccgccgtctccccaaaaattgggcaccgtttcaacacccaatgactaattgcaaaaaaggaagcgacttcttttgtgagtgtcagcttctcgttggtccgttcgttcaccaattcaaatggctcaattggcgtttgctcataaatatcgtaatgaatttcatagctggcagcagaagcagtgttggcaccgagaaatttctaaacaaaaatgggggaaacgaaaattgaaattaatccccaattgtgtttttatgagaatgtggaccatctgtgaaaaaaagagaggggttaggaaatttttcaaatgagaatttcaagggaaaaaattttttaaaaaatcgctgaaaaatcttcaagattgtttttcaaaaaattttcgtattttttcttttgaaaaatttgtttgaacacctctttgaaactgtcgacccaaccaaggtagtcaaaaaattggggaaacaatcgcttcggttggccatcgctgctcggcgtttgcaaccatttggacaacatttggccagcagtcgcatttggcccatcattattgtcaccaaacgcatcggcgaacagcagaagaccgagaccgattgaattcaactgattgagatcggtgagaattgtggacgaagtgcggcgacgcaaacagttcaattgatcacgatcaaagcttaaatggcgaatgtttggcgcaaaaatgggccaaattccatcgacaaaaacatcccaaatccgttggacttcagctttgctgcaattgaggagttttaaacatattgtgtgacttttggttccgtaaactgcgcaaatactacttggacgatgaataaatcgacagatgcaaattggtgcctcttctgtcgaagattggctgattggaacgaaaaaatgcgatgacggagtgatcgatgtacctgacagggaatgctttttgaataaatgctttgcaaaatgaatatcaatcacgcacttgagctcaaacaaaaaggcgaaataattttttttttttgtggtaaagttcagcgacctttcaaaaaaattttagacgaaaaatgtgaaattctaaaatttgaatttttgactttttgttcaaaatcgtgttcgggaattgatcgaactgggtgtcaatgcgtacaggctcttgtgcagtttaggccccatatacaaaaatttttacattttagaataaaagaagcaaatctataggt

SEQ ID NO: 10674 - DNA, 3155 bp, Heterodera glycines
actggtttaaaattttttaaatttaacaggcggcgccctattggcactgcctgacaccaaaatccacctaagataaaatcacaaaatttggtttttggacacaatctattaacagtcgcattaaaatcataaagttttctacgccggcacgccccatgttcagcaaaatttctttcaaaaaagcacgccgtaaaaatgtttcgagaagaaaaaaaaagtggttgcatggctttacttaattccaagctaaaatacatagaagaagactatcaaatcgcccatgcccggtcaattgtctaaactcggccccggtacttagctttaccgctttgtacagattcaaacatgccgtatgctataagaacacaaacaattgcaaaaaagcgttgaaagggttccatttagaatttgcctaaatataaaacaaaattaggattaatattagtaaaaataatttttataaaaaactaataaagtgaatgtgtaaagaattgagaaaatccaattatgatgacattttgcataaattacataaatgcaatctttttgtttaaattattctttttgttaacgtaagtcatcatcatcataatggcattgtcaaaatcgcatgtgtttaaagaaatagtcgataaatggccaataaagaaaaaaaattctaaaattgaaaattctaaaattttttgtaaaaaacgtacaaatttaaacatatttagaatatagtgtgtctttaaggaaagattttgaattaatgaaaattaggtcatcttcgctctaacaaaaataggatttaaaaattccaaaatagaacttaattgatacttagctcgaggtccttggtctcgtctaaaaattgttcggcctttttggtttctgtttcgggagccggaaaatgcgacaccgagagaaagttttgcatttcaagaaaatgcgagcggaaaaaatatgatactaaacttagattcaaattggcgaaaactaaatccggcgggcggcgcctattggaatcgtcactcatcactcatccgtaaaatatagacaaattaaaacatgtatttaacatgaaaatgaaatcacataaaaacagaaaaatatatactcattcacattcaattattgaagaaaatcgctaaaatttttaaattctcggtctcgatcttgccttatttttaggaccttaaaaaatgctcaatatttgacttcaaaattaatggtttttctatgattaaccaatttaattttttaaatagaatatagaaaaaaaaacttgttgaaattactaattgcattaacccaggggtccgatttttttaaagaatgttccgatttggaggtacaaatcttacaaaataataatgtcttgttgtaataaattttgaattttttggggtatagattaaattatgttctgtttttgataatttaaaattttatgagaaaaggtaaaggtatttttatagctaaattaatttattcactgtgcagatgattcatctttttgtaaggaagttttgtgaacagttgattttattaaaagaataaatcaatatttgaaaatattttcttttttcatttcatttttaaaattaaataaaaatttacggcaaaaaatacaagttcgattcaggcgtaatttcagggaatccaattaattgtgatgatcatcatttatagttggcattcgttaaaagcgatacagtaatggatttctgtgccgaccgtttgccattcattgcggtcatttattttccgtcatttttgtgcagttcgcttccattctcatcggtgcactcacgtggaacatttttccatgccccggcaccacataatcggccgtgcacaaaatcattcgccggttatgcgactgaacctcgtcattccatgccaatggacgccacatcatcggtcgactcaaatcttcggcctaaaatgtttttttaatccttaccgaatatagaagtaatgaatccgggccctattaatttgaataaaaacatgctgagaagatttaaattttaattaatttatactatttttaaaaaagcatttatttgactgtttggtaaattaagtctaactatttttctctcattaaaaattttaataaaaaaaaatttactgcaatgaaaacatcgccggcaacaactacagtaccgtaacgaagcgtattctgtagaaagtaataaaaaacatttattacaaaaattgttttcttgtaaaattttaattttcgctttaatattaaccgtgacaacaacactgatatcctctgaggtgtgtccgggtgtgctaatcaatgcgacattttctgtcaattggtgtttgacattctgtttaaaaaaattaattaatatgaattaaaacattattttttacttcaaataaattcgagaaattaaatttagtccgataatgtgacataaagccttgaaaatggacggcatcctaaaaattgtaaataaaaaaagaaaagaatttttaattattttttaattactggaaaatcatttgtattccctgcatggtcaggatgtccgtgtgttatcaccacataatccaccgccggaggtgcgatttggttttcactgagttctgtttaattatgtataattgcatattaaaattatgtatattgcaaacgcataattttatcacatttgaaaaaatttgtaaaattcacccaaaagaatttagacacaagaaaaacggtattttaaaatagggttcgagccccgtggggcgggggtggcttttcgcgggggcgggggttggcgggggtcagagtcgcgggggcggtggcgggggcacgataattccgcccccgcgggggcgggggtttgatttgaattagctccaaaaaatctcacaaaaaaaatatcttttatgaatgatttcttaatttagggatttttgagtaattttttaagaaaagatagttttttttggtgggccggcgtgccgataggagcgaattttaaatttatttaacagatattcaccaaaaaattaagattttcccgataaattttcgttttttagctatattaaattatcatgatttactcaaggaaaattggaactcagattttttaaaaatttttttcttgcggcacattttccaaaaaacttgatgaatgtgcgaggggaggaggtcc

SEQ ID NO: 10675 - DNA, 1720 bp, Heterodera glycines
aatttctcaagatggttaaaaaattcaaaattgtataaattttttgcctgatatcccacgaatatgccattcctaggggagtattttcgcccccgcgggggtgaaggtcacgggggcgggggtgaggccaaaaaacctgtcccgcccccgtcgggggcgggggtgacgggggctgggctcgaaccctattttaaaagatacttttcaagttctgttgattatatttgtcaaatgaaaagaattctttatcgaaatttcaattaaacatactcattttgagcaaattaacaaattggcagaaacttgtaaagaacatttgaaaaaagagataataggatattcatggactaagattctttttgtttaaaataatttagtttgggatacaaaactgttaagagaatttaaatttaatggttgtaaaagcaattattatttactatttgttttaccaacttctgatcagatcagtcctcccgttgatgtcagtgcccattcccgtgtcaaccaaaattatttttgcgccatctctgatcaacgttatgctggccacaaacacataatcagcgtccaattgtcgcgcatatccctttatcataattaccttataattttgggtctaattaaaagtaattattttacctcacgcaatatttcaatatttgcactttgtccaattcctccatcattattgccttggacttggtagaaaaatgactgctctttttcatcgtcattaaactcaatttttctaaatgaaaaaatactttcatgtaatatgcatattgctaatcgcatcaatgagcagaattttatggaaatctgaattaaaaaacccggattcggaaccaaaaataacgggattgaccgtgaacgatattaaaaatatttgggaggttcataaccccttcataattttacaattagtgaaaaatattttaaaatataattagtatctaataagattaattattttttttcgaaaaaataaattgcgaatattatataatttaaaattttatagttgattgctattgatataacccatatcataagttacacagataagagacaaaaaagtaatatttttgataattacttttagaattttgattgtttgataacaaatattttgtctttatttgtattttaaagacaatttctgacttgcagatttatgaaatgccaaaaatgcccatgttggcggttttaggaacgcccaaatatctctaaaatgatatctacaaaagataattgcccaccttaattaattaattatacaaataatttaccgatttgtttggtttggtttctgttcttcaataattatccgtccaaataattgcttctgaattgacctatcagctgtgcttgtgctacgatcagcagcagttgctggtgctgaagaagaagaagtactcaacttcaacgtggtcactttctcaacacttccgtcccaacttttggcatcaacagtctaaaaatcacatatatgcttagatttaaaaaatgataaacaaaattatgattatgtacaggatcgtagttagaatttttacatattttttgcaggtaaattttaatggaaaatttacgtgatccccgaggtttttgggtcgctgatcacagatcaaacactctattttggccaatatttgggcaaatcaaaattataatttaaccttaaaaataggatttataaatttagggacaataggaa

SEQ ID NO: 10676 - DNA, 1796 bp, Heterodera glycines
tgagagggggggggggggatgagaaacgcaacataattggaatgggggcaagaaaagtgattatgatgtaatgtatagttagttgggtagcaacgtagcaacagctattttagggattggcacatccggtgggtggcaaagaaaatgccaaaattgtgcagtgggaggccaagaataagtggaggaagggaccaacaaaatttccaaaaaacggaggggattatggcaaagaatttaggggccaatgccaaaaatcggaggaacgggtaaatttccaaaaaattggtgggtcgctggccaaaaatttggagaccatggaaattttcaagaaattgttatgggatcggtggccaagaaattggagatcaatgcctaaaactcggagacattggccaagaattaggggaccatggaaatttccaagaaattatcgggggatcgctggccaggaaattagtgacaatgccgaaaactcggaggaacggattaattttcaaaaatttggggacaaactaaaggcccaaaaattgggggatcacaagaaattggggcccaataaatccccccccccccttttggggggaaatgacattacgccaaaaaaagaccatagaaatttgaacgaacaacaaattcgaacggggggttctgtatttattgcaattgatgtttaggtgatgctgctgggtgacagttgcaccggcaaaacatgccttctgatccgcttcaaggacaagtgagcaatggagaaattttaaggcttcaaattttttaattcggtgggaacagaggtgtgcgaaataaaaaaaacaataattcccataaaatgaaaacgaaaattttaaactcgaaaacgaaaacaaaagttttaatttcagttcgaaacgaaacgaaaacgaaaattttaaatctgaaaacgaaaccatgaaaacgaaaacgaaactaaaaaacgtgccgaatacactaaaacgaaactcaaaaagtgcgaaaatgacgaaaacatgaaaacgaaatttcgcatgcgccaccgtggagggggggggggggggggggagctttataatttctttattgaacttctgtactacttaccacaacagcacgttcatgaacaacaacttcatctccacagttggcatcgacttcagggcaatttctaaaaaaattcaatcccccggcttttttgtgtgtcaaaatttagacaaatttcagaacaaattggtcgaattggatggatgcaaagtgaaactgcaggtgagaagcagaaaaaatgattgatctggtgtggtattattggcggatggcgtaagtggaaaagatcagcctgcggtgggattcgaacccacgtcccttcctttccgtggaatgctctaaccactgagctacacagggcgccctttgcattccttttaatcccaactttagaggaaagaaagctctcttcattcgtttgagagagtcgcatatcacactgggggaaatccttgaaaatttaattagaaagggttcccaatagtgccaatttcggagaattagatttggcaatgtggcaggattcgagataaggacaggtcccaataatgccaatttaggaaaatgagattttggcaatgtgccaggattggtgatcatgtttgtactttttttagtgtggcaaagggtttgaatcactattttaatcactattccggcgttaaaatcccggctattttccggactatggactatggcacattttaaaggtctatgtaattgatttgtcacctcgttaaacactgatcatgaatatgcttttt

SEQ ID NO: 10677 - DNA, 4702 bp, Heterodera glycines
aaaatgcatggtatacaatttttaaccattgtaaggcaaataaaaaatggtcatgcaattttcctaattttcaaacgttacgtcgaacgtcgaaatctaacagcaccggaatccggattttcgcagattttttgatggctaattgatcaacttgcaatttaaaataattatgaaaatctatgaaaaatttaaaagaatttttgattttttgagagcatctgtctgataagattttttaattgaaatattaattaaaaatggaaaaaatttctcgattcgatgttggcttagaattgcatcctaattaggcttcctaatggcaaatttaatttgtcataattcacggcacaggattggctggcccaggtgaaggaatatgccaaggacagtgtacagcttgtgcttgtcggcaacaaaatggacatgtcatcgcagcggaaggttcacgcagacgaaggacgacggctggcaaaggtcattaagtcaattagtgggcaattaaacggaaccatagctaatgaggtatacggtaccacaaaattttgaatggtagatcattacggtatcactggtataattttgtgtgtgtgagtgaaacgattccaaaaaattagtgattatggggcatcacaaaatatttggtgtgagtgatacggtaaccaacatttttgtattatgattttttcagatcataggtgaaattttgttaatttttctatcaaaattattgaaaatttaccaattttttaaatttagaggcatttatctagctggctaaactagaaataagtcaggaacaaatttttagtcttttcttcaaaaattgtctgaaagttttcttcttttttcggttttgtctctgccatggtcccaatttttcattttttttccccacttcaaggcgtacaacatcgatgtaagtgaagcgttttgtgcccaactccatgtgccatttctgtccgccaatccgttgttgttcatcccccgcgtcgtttcccccgccccaaaatttaaaaaaaaagaattttcaagccgagaaattaaaaaaatcttaagaaagttttaataagaaaatttcaaggaaaaattgaaaaatttctcagcatttttggtgttttttgaaaattcatcataaaattttgagaaaatcgctgaaaattctcgaaattttcttatgggaaacgacgggggcgggaaacgacctgctaccccactttttcaaccagttcatggagacgagtgccaaaacggggcacaatgtgcatgacgtgttcgctgaactgagccgacgcctggtgaaggcgtgcgacccgcagcggcggctgcgaccggcgtctgcaaacggaagcggtggtggcggacgcaaaagcgcagcagcagcagaggcggacggtggaatcccattgaaattggctaataatgctaatgacgacgagggcggcatggctgagcagtaccagcaacaacaggcattgtctctatttgggcattggcacttttggcacggggattcccccctctgcgggggtgtagcacatggtatccggactttgtccgaaggcaaaaatattcgggtcgcgattcgggcggcaaccgaattccagggcccataacatgcggatcttgtccgaccattttttagtccacctccgatatattagacagatcacgaaaatccgccgcctatctccgaaaatcctgtcccagaaaggtcctggtcatcggtcaatacggtgacgggacgttagtcaaaaaccatcaaaatgggcgttagtcaaaaaccatcaaaatgggcgttagtcaaaaaaccatcaaaatgggcgttagtcaaaaaaccatcaaaatgggcgttagtcaaaaaaccatcaaaataattttatgcgtagctgatcaaaacgggcgttagtcaaaaaaccatcaaaataattatacactatacgattatgccctatatgcatgcaccactcaattaatgcaaccacttccaaaatatttgccgcactgattattaataaatcccaaactatcatcaccaaaccaaacccaaaatatttacgcactattattactgcttaggttttttataaagttatttaaattttatttaaattcaacaacagataatttttaaatccaacaaagttaaattgtatttaaattttttcaattcaacaaagagaaatcctaaagttgtcttttttgacagcgtagtacataaacatttcgatttggccggtccgcgtgtgcctcttccgagttccttcgtgatctaaaaatttttctgtactaatttagcttttttttaaataacctatgaaacaaatctcatcaagatttggcatattccaaatctccccaatctttttgaagaggtatgcattgttgaaattttgctgatcaatgctgaaatcaaagtccccaatcgacagccgaagcgggaagaaaattttcagttgctctgcgtctggggattagaaattttttagaatttttactttgtcatttctcccaaattttgattttaaaaataaatcccatttttaattatttttatttaactgacatcttccattgtgtccgtgaatattatatgatataatatatcccgtgacaactgaaccaacgacaattggagttaagacgagcgccaggatgctgccaagggccaaggctgtcaggatttctcgacgctttacaggccttggctcagtttgaagacattgaaagagtatgagatagcaataaaaaaatattttatggaacgcatatcacagttcgggatttaattaatttttaattttttttgaatcttggccttgcagacaaatcgtttaaataatcataattgaccgaaggaattctctttttatcagttaattaatatttctataaatttaaattcctcacataattgccaattgaacccaacaaaatgaattgtgcacgttatcagtcattttatcaaccattcttgctaattaatattttttgcagccgtataaccaaagattatcaaatttatttccaaagaattttgcaaaaaattataagaaaattaatattttacataaaaaattcccaaattaattgtttaaaagaattaatcataaaacacataacttaattctcttttctttttcatttcatatatttcagtctgcagttggtattggatttaaaattgcttcaaaatggccacttccatcataataaataaaaactgacttgtattctggatcttggtctactaatacctagagaaggaattatttttgcaaaatattttctttaccgtgtttttttttgaattcggtgtataaacattccatacgaatttaattttgtttttggaattttgtggatttgggctacaaacgataacatttaatttgaacaattttgcagcacataggaagtcaagattagatgcccatttaaaatgttccgatgcatccatagcagggtgtttgtggttattaatgtactgtgttagatttggcaaagaattctcaaacatctgccaccaattgtgcccttcaacatttctattatgtaaatcgatttcggtttccaaaaattccattaagtcaagcctaatttctttagctgtattgtaattatcataccagtcagcaactctgttttgatttgctacaaaataagcagctccaagactttttttgatttttgccatgtagcgctctaatgttggtttactaattttcaccgaagattgagcgttaattagatctaataattcattaattgaatgaatttgtcccttttcatatttaatcagcaaatttttgatcgtttcattatttataaacgaatcaaaatttgaagttctacctcctccagatattatagatggattttgatttcgctttatagagaataaaacgaataaaaaaaataatagttatataaacagattttggaatttccatcctaaaaagaaattatttaattttttattcgttatatttaataaattacatgaataactaaatgagagttttatgcttatttacattattaatgaaaaatcaagaataaaatgtttatattttttggtgatttggagattggttggcattatcgaatattttaataaatttgtgccgtcatcatttgcgtaaatatttggttttgttttgttgatgatagtttggcattaattaataatcagtgcggcaaatatttggaagtggttggcattaattgagtgttgcatgcatataggccataatcgtatagtgtataattattttgatggttttttgactaacgcccgttttgatcagctacgcataaaattattttgatggttttttgactaacgcccattttgatggttttttgctaacgcccaaaaatcgatatttttcttatgatgaaaattattaatgttaaaaggcttaaaaactatctggacatgtaaaaaacaaaaaataattatttgcagggtgggggaattgaactctaaaagaagaaaaaaggaatggaaggcatacacactgggccagagacgctcacattggcttttctttctttgggaatgacattaataaggcaaaaaggaaaagcttcatatctcggccagaagcttcatttagcaaaaataaaaaaattttataatacaaaggggggtaatctacctacactgtaagtttcattcggaagtcccaccgtcacttgg

SEQ ID NO: 10678 - DNA, 3859 bp, Heterodera glycines
  misc_feature (1352)..(1352): n is a, c, g, or t
tttttaaagaattagtttttcacatgctttcgaacacatttagaatatttcattggttgagaaagaaaaaagttatgccctaaaaattcgtccggtgacgtttcggctggcgacgttttttcctggtccgtcccgctgtaccgttaggtaccaccggggaaaacttagaaaattttcaataaattgagtaaaattaaaaaaaaattacccattgatattttctgaaaaaattagcccaactggttacgggcctgtaatatattgatgtttttgatgcatattttatgcggaaattttgctaaaattttcaacaaaactatatttactaggcgatcggaaaattttatttttgaaaatttgattttttaattctgttacagcaccggaattgcttctgaagacactgtaaactttgaggaccaattgcgtctttcatcgtacaatgcatttaaagaaatattctttcgctacaaatggaaggtaattaattaattagttaattaattaaaatgcaaatccaaattcaacaattaaattcctttttttaaagctggaaaatgaaatgaaaacccaaaaagtgcgcgagtataacgaggaggttgaaatttgcataattaattcattaaatattttttttgccaaaaaatcaaaattaaatcataaacaaacaataaaaaaaacattttttacaattttaatttattaacaaaaaagggtgcatttttgtgaatttaaatttttttcttaaaatttttacttggtattgcctatttttttaaatttcaaataaattatgcaaaaaaaaatcggtcaaaaatttatttttaatgtgaaattttttgcaaaaattttttcacaacagtatgacgcttggaaagtgcagcatggtcgtaacaagataaccaaaagtgtgtgggccatcaaatatgatcagttgaaggatgatcaaattgcggacaaagtgatcaatgcgatggcattggcggctgatcaattagcggaaacaattaaaaaaatgaaaaatccatggaaaaagccaaccgaagaagaattgagaaggggaaaaaagggaaaagcggaaaaacaaacggaaattacacaggccgaaaagcaaacgtcaggaaaacagatggtgtttctgttcggggacagaccgacaccggtaaacagcaaaaaagacaattcctgggaaatgagtgcccattttttgcgccaaaattgtttttcgaattatttttcgatagtcctttgcagggcaggatggcattccgaggccccaaaaattttcggaaatcggaattccgaaggtcaaaaaatttttcggaaatcggaattcccaggcccaaaaattnttttggaagtcgaaaatcggaattccgaccccaaaaacgtttttctgttcgggaacagaccgacacagataaaaaaaaaacaattaggaaaaatcttattttttgactaatttttttaccttgacaaattttgaattgtttcggtagccctaaatgttctcgattagcctataaaattcaacaacaaaaaaaagttatgggcaaatatgttggaaaataaataatttttttttttaattttttggccacaattcttttgaaaacccaatgaaatttttttgaacttttgcaggttaatggagaacattttcgttttggcacttttttaaaatttgttaactgtattgggaatttttcatgactaaaatctaacccttgttgttagcatacactttttattcaaaaaacactaatttaaataaattaatttgaaattggcaggccgacgcctcactgttcgctcaccttgtccaactgtttgagacaccattgaaaattccaaaactggaaaatcacataaaaacggtgaaggaacagtccaaccatgcccagcatgtactgctccaatatgttgaagaaatcaaagagcaaattggatgggaacaaatgaaacacagtagtgaaaaggcggtcgaaaatccattcaattttgaatgggtggaagatgcgaaaaaaatggaaaaatataatggcaagtttttggggaggcgggataaaaataagtacaataagtgcacatatgtagttccatttttaataaaccaaggaggacaacaaattagtgagttttgatggtaaaatgcaacaaaaaaaggggtcaaaaaataaaaaagtgtgggtcaaaaaatcaaagtatagggggtcgaaaaccgaaggattagaaaccaaggatgccaggcattccgaggccctaaaaattttcggaaatagaaaatcgaaattccgaggctcaaaaatttttcggaaaccggaattccgatcccaaaaacgtcggaaatcggaagttgaaagcggaaatttttgaaaaaatataaaataaaaataaatacacagttctcatgatgttcaaaaaaaaaaaaatttatttcaagctgaatttggctctgtgccatcatcactgttcaatttttaaattcagcctattagcgacatttggcgggatttttccatttaaaaattactttttttttaatttggccaaaaagcagcatgtacaaaaattaataaaattattttttacattttaggtccatttgacatcaaattttaaaactaaaatgtgattctaagcctatttgggtcatttttatggcatttagcgcctattatttttccaaaaaaaaagcatttaagaattttatttacatatttgggcgcttttttttagatatatatatatgtacaccagggatggcacggaattccgacttccgagttccgacttccgacatttttggagtcggaattccgacttccgacttccgaaaatttttggggcatcggaattgcgacttccgacttccgaaatttttgatgaaaagtcggaatttttctgagttttttttttcaaaaaattagcaatttttgtacaatttatgttaataaattgcatagaaattttcaattttttttccgacggcacctatcggcaccgccggactcaaaaaaaacttaattttcttgaaaatttgctcaaaatcgctaaattttccattttttggacaaaatttgttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaaaaatccaaaataatgtaaaattacttaaaatattttgatctttttaaaaaatatagaaataaactaaaaacagtttgaaattaccttttacatggttaaaaatttaaaaatttagcctattaaatatttttaaaaatttattatatttttttttgaaaaattccgacttccgagttccgacatttttggggttggaattccgacttccgacttccgaaaatttttggggcatcggaattccgacttccgaaaatttttggggcatcggaattccgacttccgacttccgaaaatttttagtgcctcggaactccatccctgcttggtaagagagacactctctagtcgaatgacacaaagcaatggaaataataccaattaaatgcaattaaaaggtatcagcaaacgcgatcattttaagtcccaatatgttttattcagggctggcagatgaaaattttcaaaagcctcatttggcaagaaaaaaagcctcattttgggtcaaaaagccgcatttttacaaattttgttcaaatgttatatttttgattgtccatgatcaatttgagcaatttttttgcaaaaaataagctttttgtgaattctgagcacgaaaatcgaaattaattttttt

SEQ ID NO: 10679 - DNA, 1332 bp, Heterodera glycines
ggatttgcataacaacaaaaaaaagttatcgcccaaaaacttgggctggcgccaaaaagtcggcgccaaaacgatacggaccccatacaaacactcaattttaatatataggattttttaatacataaatacatttatatttagtaattttgatttataactttaaagttaacttatgaaatattttaaaatttctgtaaaatttttcaaaaattccgagttccgaccttttttgggtcggagttccgacttccgaaaatttttggggcctcggaattccgagttccgacttccgaaaatttttggggcctcggaattccgagttccgacttccgaaaatttttggggcctcggaattccgagttccgacttccgaaaatttttagtgcctcggaactccatccctgatgtacacattttgccaattttcttaaataaaattgccagccctaataattacatttttgctaaagggttttccattaaaatttagtatacttttttttttctaatttggcgtttattttgtaggcccattcgacttgaaattcaaggaaatgattgagttcgatggaatgttcatggtatttcctggtgctgaacggatgcatgaacgggaagagtttggtgcggacaatgaagaggagaaggaggaggaggaaaacgaggatgaggaagatgatggaaatatcacggaaattagagaggaaaaagttaagacagagaagtcagagcaatcgataagaatgcgtacaccaaagagggaaaagaaaaaaggagcggcggaaaacactgggaaaaaactgtcggcgggaggggaaaagaagacagagaaaaaaatgctgagaaaagatagtagcggcagtggtagcagcagacgacaagagcgaccagggaatgagcaaaacccggaggggcaagagatgcagactgtttataatgagcaggaactcaagtccttcgcaatgtactttgaagagaaaacatggacaactctcatgaataaacagatgttattcgaggtacagtatatgtacagtatgggattatatgtggtatttggctatagccatgggcttctaggccaatgttattgcatggcttctagctcagctcaaagttatccctatcgtgtcttctcgaccatgttttatgttatacatgtccacctaccgtatttgctctaattatagcccagtctctattaatttcgcagtctccaattatcgccccctttctgaggggtttgaaaaataatcccccagtctctatttatcccccatgggatataaatagaattttaagaaattgtttggcaccaatttttttcaa

SEQ ID NO: 10680 - DNA, 572 bp, Heterodera glycines
tgataaactatgaacaacaaaaaaattatgcgaagggaggagaaaaaagaaattattattttttttgtttgttttttgaggggcaataaatctcagcgactttttgccttaatttttgcactttatgacatcaaaaaaaaggaaaaaagagaaatgttgggaagttttccaattttagtcatttatttaaaaaattttgcaaacctgaaggcggcgccgcaatcgaaggccaatttcgcgctgatccgattccaaaagttcaagccgttcattaaatcgcatccctactaattatatactatctgcaatcggaattaaatgtatgccgatgatattaaatttacatttcgcgtgaaaatgatttgaaaagggatttactctcgttagcgttggctagccaaatggtctaatgacaatggcatagccattgcgcatgagaaatgcgcagtattacatattttatgaaaaaatattctaaaaatgagtataaaattggcaagaaagcaattttaggtgtagattaggtatgtccgtgatctggcggttttagttgaccaaaatctctcatttaa

SEQ ID NO: 10681 - DNA, 3963 bp, Heterodera glycines
gtatgtatcatcttttaaaaatattaaaaacaagaaataaggtaaataccttaatcctagcatataaaagctatataagaccacacctcaaatacgcatctgaagtcgggttaagaacattaacatagagacgagcaccataatgtaaaaattgcgtgcttacacaatttaacattctaaccatttgaatccgcgaccccagaatttttctgtccacgcgccacctatgcttttgactcgaaacccaacaaaacccttcggacccaaaaaaaaaaaattgggtcgggaaaaaagccgtgtttcgagtaccccgaaacattgcacccgacaacggagataatgcaaatttattcagttggtggcgagcccattcagagaaattaaacatatgcaagtgaacattatttatttatttgccgtaatttcccaacgaaatcaaaaaagaacggtgagcagatttactaaggaagcaattggctcttcggtatcattaacagaatgatgtttgtttttcgttttgtcaggaaaatcaaaaataatttccaagtccgtccggcagcacacttccgctcgcatccgttgaccgaacagatcagtagccggaaagctcctccaaagggatggaatgattgtcctcttttcctcatacaatcattattcacctggaaagtcgagtccaactcctccgaaattgctttgtaccgctccttctcgtggaccaattcgtctgcaaaaatcaaacaaatttcaaattgaactcaaaacagcaaaatattgttgcagaatgtcaaggggtggacacacgacaatgacaaaaaccgtcggaaaactaattggcccatcaacgaaataacccaatggtcacaaataaacccaaaaaataacgataatcacgcagttattatcattatttctttttattagtaattgaggatttatatatttttaaatattttcatgaagctttctttgttttgctgagaaatgcaggaattatttttttagcgtaggaaattcttcgctttcacgtcaatatccataatttatataaaaaatatatatatatatttttaggcctttttaaaaaaaacatacttcggcatttttttttagcaatctttggtaaattttccgtatttctcgaaattcagaatttttggaactttaaacaatgaataatttttgattgtgttagcgtacggtttctttttttttgcactgcaacctttttaatttttgttcaatattttcataaatatttttgcgtttttcataaaatttatttaaatattcttggaatttcaaaacataaacctcgccctaattattggttaatcgatacagtgaatctttcaaacttaatgggttagaacaaatcccatcgaaagcaaaggaatacaaatgaattagtgacaaaattaattccacggtggccgttcatcagcagtcgacgaattcatgcattaacaaaatgggggatggatgggtgccaaaaggcttattaatgcccccaatcaaattcatttggcaaattatccttccgttttacgactcaaattggcacccatccgtcaacagaagagggaacccctcaaacggcatgcaattcatgcaccaatcggtccaattcttcttgcacaacgttcccgttggtcactgcctgttcacgttcatctgcaaaattgttaatggggttaaaagcaatggcacggcaattgggacaaagattaattagttaattgccaattaaatacgagagataaagtgttaggaaaaggagaaaaacacccaatttcgcgatagtgtaaattttacgcaaaagaaagcaaaaagctagataagctcataacgaatgatggacaatgaaagtcttaacgaaaatttggacataggacagtcggccaaaaaacggacaaaatgccaaaaagagaacggacgaaaatgacaaatggccacactttgacatcgtcacaaattctgaagaagccaaaacagttcaagagccctgaatctcctgcacagtctgttcaatttctgctgtcaaattgcgcacgcgttccttctccacgagcaattcatctgtcgaacggacggacaaaagttagggaaaagcgacgaaaaatgaacgaacggacgaaacgcaaaagcaaagacaaaaggaaaagacaaaaggaaaagcggaaagcaaaacgccaaatttaaacgaagaagcggaacccattcacaatcagttgatccgttcattttctgctggtcattcccccgcgtaattttgcctctttttgtcccatggcttttccctcccaaagcattgcaaaaaaaggcaaaggaaaaaaaagtaaaaaaaatgggccaaaagagcgcaccctccagtctgtccacttccttctgcagcttttgtaccgaacgttcagcgaattccgcgcgagtctcagcctaaaaaggaaaaggccaaaaattaaaaccaaaaaatatttttaatcccctaatttttcttacaaaaagcataagcgacagcaaacaatcactcaaaatattttaagaaaaccttatccaatatcgaaattgcaaaagcatagcaaaactgcttgtacttcgaaacattcgcattttgtaaattttggtttttaaattttgtttttttgtttcgaatgctatcccctaatgataatccaattagcaattcctcattttgttgattggtcaaagcctttgtttggctttaacagatcgaaagcaacaaataattaagcaaaaggcgccgaattgtcagattgcccgcgggcattgtgccacctccttaagacgggcgctgaggttgcgaatttgctcctcgtaggaatcctcgcgttgcaatgccttctcttcgctgacctccaacgacttcaaattgttaccgacgacgcgcaattcctcctccaattccacaattttgctggaagagaaaaagcgcacttcaaaacaaaattaataataatttatttttagtgaatggcaaatgcaaaaataattaattaaaaaataaattaaaaaaagagacgaaaaagaaaagaaaaaacaaaaaaacaatcggaagaatgttaataaagcaaaggacacgcaaagggaagtcatttcgaatggttagcataatgaaaagcgacggattaaacactcgcgaaaggccaaactttgcaattattcgctttctttccccaaaagttcgggcacacaatgacagacctccttcagacgcacttccatctgacgcacttgctcttcgtacgcttcctcgcgttgcaacgccttttggggggaatttggagagaaaagaggggaaatgagggggtgggggaaagttatgagcatttgtgggagggattagcaccaattgggtatgaaagggacaaaagaaaaaaattagagggcacagtttgaaaaggaaaaaatgccaaggaaaagccaaagtctgaggggggaaaagccaaagtttgatttgtgagggggggggggggaaagaggcggcgtctcccaaaaccttttcttcgctgagctccaacgacttcaagttgttgcccacaacgcgcaattcctcctccaactccacaattttgctgtaagtcggggcaacaaacaaatgaatgggaaaaaagagaaagacggggagaaattggcaagtgatcagaaaaaggaaaagaaaaagttagatgagagaaagaagaaagaaagagtcggtgtttgcgctatccatcgggcgaacaaagcccgggggaaagaattacgaatggtcctttctcatccaaacgaaatgccaaaaaagaaattgtgccaaatcaaaattggatatggtaacacaaaaagacgaagtggaggcgattggagcagaaaagagattttaactcataatgcaaaaacatatttaagcattgccaatggactcacttatcgccggcctctgcgcgctcctcggcacgttccaagtcg

SEQ ID NO: 10682 - DNA, 1842 bp, Heterodera glycines
  misc_feature (78)..(78): n is a, c, g, or t
tagtcaaatgggttaaagtgcaaaaatgagaaaatgttaaagggttacattcattggcataatgaggccataaaagancgaaagaaaggccagtccggcaatgcgtaaaagtgctaaaatggcatttggcagtgttaaagtgcgtctaaaaatgctgccattggcattggcgatatttgccgttggcatttccattggccatattagccattggcattgccattagccatattagccattggcataggcattgtccaagtgcgtctcgtctgtctgtctctccctccaccgtcgcttcccttcgctcacctcttcgtatttgcggtccgcgtcctccgcgatcactttcgcttcctccacttgcacctccaaaatgtttgcgcgttcttcgtccgcctgcgaacgcgtctccatcgatttgcgggcgctgatttggacgacggaaaggaattggacaaaaagcggacaaaaagcaaagcgcaaaagcgaagaaaaaaagcatttgaaaagcgacgggcggaatgccaaggaattaaaaagctatgccaattcaatctaaaatcaacagacaaacaaacacatacacaacacatacacacagcaccacagtaatacgtacagtacgcaaaagtacgaatggacccctccctcctctgtcaaataattaattggcccaattagcggagtgtttgtcccatttggccaggggttctcttctctctgtccgttggctctgtccttccctttcctttgaactgaccgttccgattcgtcgcaattggccgtcgcttcttccattttttcggtggcaagtttaaggcgctcctcaagcttgtccaactcctcttccaacagaaccatgcgacggttcagtgacgccacttcggcttcagccttaagcccacgtcattggggcgacaaagcaaagccaaataaaaagtgaggaggggcggcgggggggggaatgaacccccggggaagaaaccgtagcaaatggaaattgcccacaggggattttgggaggagggactgaccaatccctccggcacattcggccaacttcggcacacaaactctgcagattttcattcaatttcacactcgcagctctctcttcacattggcactcattttaactatttttttggcattttttgcattttttcgcggttttccgctcgcgcgccttctcaccgttccgcttcgtccgctgctttgctcgcctcctccaacttttgagtggcgattttcagtcggtcctccgtgcgttccaagtcctcctccaccaacacaatgcggcggttcagtgcggccacgtccgcctcggccttgacaagttccgtttgatggattgtctgtcattcccattcgtttgatgccctccccccaatttctccggaataaatggcactttttcccatttcctttccattcccatttttcttacgtcctctcgctttttgcgctcctcctccaattgccgcttcacttcgtccgcttcgtccttcgcctgctccgcctcctctcgcgcctggcgcattttcttcttcagcacgtccagcaaggacgtctgctgagaaccgcctttatccatgcgcgacattttaatttttagtgccgaaaaataatcgaaacaaagcgaaaataacggacaaaaaaaggactaaaggacgacaaaagttttgtgttcaaatccttttctgacaatgggaatggacgaacatggcaattgccattcaaatttaagattttctatccaaactgacaaattgagctgatcaaccgaccattcattcattccctcttctttttctgctcaaatttaaggcatttgttgcctca

SEQ ID NO: 10683 - DNA, 990 bp, Heterodera glycines
tcattcagataaagccattgcattttgacaaccaaggcattcttttggccgactttatcgagcatcagtgggccaatttccctttggatggcgttttgggcttagcgtggccctaccacccaatgattttgggccacaagcctccgttgatgaacatgcttgaccagcttgaccagcccgtcttcaccatatggtcggactggtgagcataatttatcattgaaaataataattttatttgttaaaataatttttggcactgaaatgatccatcctcggcaattatctccatcgcacccatacttttagtcactttggcctagcatcgggtgatcaggacccgatcacttttcaagtcaaaatgaaaatggatcaatccattcatttaattcttttttaaaatcacaaaaattgccaaacatttcttaaggcgtcgtcctgctgaactgggcggccccggtggcttcatgacaattggtggcccggacaatgaccactgttctggaccatggcataatgttccacttatatctcgatggaatagctggacatttcgagtggatgggtgagagacaagtttctaggcttttcgaggtcgctgctcacgaatcccggcatctatttcccttatatccgaatcccgggctcaaattttgactcattaaaattcaataaaatcatggatcatttggttttctatttttttttaagggctaggctcaatgcccctctatgcaaaatcatttttattcattttctcatttttccccgatttatgcaaacctgaaattgggcgaccaaaaagcagaaatccggcacatcggatacaatacgaaatggaaacgatgccttccaagaccacggcacgagcgaagaaagctaaaattggaaatttaattttttttttacctttttaaacggccacattttcttttctctcttttatttttcctaaatttcaaaaaaaaaaaattttttttttttctttcg

SEQ ID NO: 10684 - DNA, 2942 bp, Heterodera glycines
  misc_feature (26)..(26): n is a, c, g, or t
  misc_feature (33)..(33): n is a, c, g, or t
  misc_feature (2931)..(2931): n is a, c, g, or t
agtgggtgggttctgctagcaaacancgataanttcagaatttggaaaattacaaagttaaacggaatgtgaataaatattagggtagtgcagaggtcgtttaatcgaaccgaaaccgaaacccggctttttctgtccaaaaagcgaaaccgaaaaccggcttttttggccaaaaagcgaaaccgaaaaccggcttttttggccaaaaagcgaaaccgaaaaccggcttttttggccaaaaagcgaaaccgaaaaccggcttttttggccaaaaagcgaaaccgaaaaccggtgtccggatcgcaaatgtctgggccgcaatgtcatacaatcttttgtacgacaatacttaatgctacagaattttttttttaaatatttttatcacacgcattttccgggagccctttttagcacaatttaattatctgcgcgtttttaagcagctaaaaatcattcatatccatcatgtaaattgttttggtataaaattcaaattttaatcctttttagttgctgccacaaatgctgattactgcgaggaggacaacctgtacactgttcaatgtgatcaacgacccaaattggcaccaattgtgttgaaagttaatgggaaagacattgtggtgccagcggaggaatatataattgatgtgtgtgtgaaatttgatttaaaaataatcaattttaatgaatgaattaatcaatagttgaatttgccggatggaaaatgtgcccttggattgtttgggcaatatggcgccggattcacgacggtaaaatttttagaaaatttttatgtaaatcggtgattttgggtaaaagaatttttatgcaaattgtgattatgggaattttgaggaaaattcgattcttttttcaggaaaatctcttaacaaaaatgcaataaacattaaaagaaatggtctttcaattttgttacaaaactttttggcacttccactttggcattttcagcccaatctgtgctgattgagctgttgattcattcaattccaggattggggttgatccataaaactttccggcacttttggcatttctacgtaaatctgtgctcattgtgccgttgttaagtcatttattcccaggattgggtttttcccaggattggcttatccctaagactttttggcacttccattttggcatttcactcacaaccaatctatgttcattgagctgttgactcatgctgattcaattccaggattgggtccttggcgctcttttcctgaacgcatattgcacaatgttcgactacgacaagggccaggtgagcttcgcgagctccaaggacacaatcccgtacagggatggcgaggaattcaacgcgtcattgcacgtccattcacgccaaattctcctacatgaacataaggaggaattgtgaagtgttagaaaatcgggggaaattaaattttcaatttcccaggccccaatttcttcaaaatcttgtccccagatttgagcatttttggactccccttaaatctgctgctggtgatctccgaactgtgaggagagcaacaggcttttaattttaagccactttgtttttaatatttaattggatttaatatgcaacaatgtcaaggtgaaccattttaatgagactgaataaaccaattggcaaatgtaaatgtgtcagagtgacgtttaatgcaaagtttcaaatccataccaatttaaatcagcaggttgatcaagcctggtctcgtttaattacatcatttcattaatgggggaagtgagagtaaataattagctgcataactttaaattttatgtaaatgcaagcagtcatactagtcacatacatataattgggctaaatccatgatcaacaattgctggctcatgggacggacaaaaacataaataaaaaaggtcaatgatgatcaaaatgccaaatttggtctcaaaatcatccgtgatcaatgatggtgaatggtgggtcaggtcagctgatcatgggaagaatgtgggatttattacataagtgccaatcaaaatgccaatggtccaaaagtgccgatcattcattcacagtgccatccattattattgttgtttgtgtgttaagctcggttgcacaatccgcgctccaatcggccctgccacagctgctcaatgactgcttcgtccaccagtgttgaagtgtcgcccaagtcggcgccggtgtcgccctcggcaatttttcgcaaaatgcgccgcgtcactttgccggaccgggtcttgggcagtcccggcgctttctgcacaacatctggcacagcaatggcaccaatctgaacaaacgcctcaaattacccaagaaaaaaataatattaaaaaatttttaagagggggtcacaaaaggtccaagctgaaggatttattggctgaaatttaaaaaaagcaaaaattaattttgtaataattcaattaaaaaagtgacacctcgccaaccgagccgatcacttgaagcgatgaacggtcgtgttttgtgaccatttcgtctgaaaatgccatcagcgcacgcacagcggttggcgcagtgtacagcttggtgatctgtatggaaaaaattaaaaaaacaaaaaaaataaaggaaaataaaaatgttaaaatctttttaaataattttcaaaaaataatatggattatgttagatttttatatttttacacattttattttggtagataaacatttttatgagtgaagcatgaaaaacttaaaaaatttctcagaaaaaattttcaaattctagacgatatcacgaaaatttaatttttatttagacttgttttactaaattattgaaaaaattgttatttataaaaattgtcaaaaaatatagcataaaaataaattgttataattcttttgctgaaatggcatttttttgaaggttttttagcaaanggtatataatg

SEQ ID NO: 10685 - DNA, 4189 bp, Heterodera glycines
tcagattttcgttctccatcagcttcagctccttcagccgtttcaattcgtttttgttgaaggacaaactgcgcatttggctgtaccgtttgtacgcgcatttcactccgttggacatcgcttgtttggcggacaaacgcgcgtttgcctttgccgcggagccgaggcttccgcccagggaggacgagtcgtgggacaacgttttgctgtgcagggagcccgacttctgcaagaagcgtaaaagcttactcattaagcggtgttttatttggccgagtcggaaaacgaaagcatttcctaattgattctgatgaccgactaccaaacccttttcaagggctattcgtaccggtcaattcaatccccctccaaccccacccaattaatttgctaaatgagtgccaatgccaaccattcccctctcctccaacagtcgaatctgttcccgtgggatgcgccacgtcatgtcgtataacatgcgctccttcctgaataaatgacaatggaaattattaacccaaatcactctctcccctaagggtcaaccgacaacgaattcggctgataatcccagcaaagtctcgcccaacggactttgttggtgccggattttaccattacctcttttgagggctaattcgattgccctctaattgctggtttattgtgcattaaatgccactttttgtcgtgtcggccgatcccttcggatctccctcccccactcactccttcaaataaagcaaatagccgagcggaatgctcacagctaagaaggccaacactccgattgtgatgtaaatgttggtatagtcgcacagattgccgtcaaagccgcactttggcatgtcgcttggcatatatccgtcgtaggagccccaatagtgactcatcgtctcgtgcgccacctgcgcgagaagagagaaaagcatcgccgtcagttgtgcctctgatttgcccacccttgccattctctgatcagtctcagtcactactactctaactatccaatcatcaattcccaaacattcatttgctgatcagtccccttttccaattgttcccgaattgctcacatgctccgaacagtcgttctccgacagtgcgcatttgtgcttgtcgctgagtcgcgcggtcagttcgaccacaattcgcattgtgccgttcttcacatggtaagtggcatagctgggcactctgatcgccttgttgttcatcagcacttgccccgttacccctgaggagacaaattcaaaacggtggaccaatttggccaatatttggcgaattaacaatcatttggctattgattgaccctttccctgatcattagttgattttgccttctcccgaccaataaattgtcgtgcggtcattttcttccaaatgtatcgcccgtccaaaaagatgttttggttgcgcgactcctccaccgaatcccttacagccaacccgtagagaaacagcgcatcgtacagggacatgtaagacagcgtggcgtactgtaagtgttgcaggaaggaatgggcgatgcacagagagttttgggatatttcactgattttctcgatggtcagccggggacggtcccaggattttggtcatgagggtactgtagtggtgggggggggggggggggaacagaactttagctatcataccctctgggcccgtctctttgtgcctgtttcttctgtctggctttctctctaccccctcttttttttgtttctccctcctcacataactgctgatgattcccgtcactttgttgaagcgatgctcaaactcctcaatgaacttcttgtcgtacccatgagctgtgatcacaattgtgtcgtcaaatgccgtctttgtctcctgcttctcaatgttcgtcgcttcccacgggtaatggtcgtgcatctgtcgagacaatcagccaaattcaaatggacaagcaaattttgatcaaaaattttaataaaaaagaaaatataaataaaggaaaagcatttgccgagactctcgccatttgaactgaatccctttccttctcccacaccgtgtgaatccaagcggaaaagactcacatgggcaagccatgggatcagatagacgtagtcattcgttttcatgtgcgaccgatgggcggcgatcataaaattgcgagacgagtgcaggtccatgcccatctcgacgattataactattgcgggaatgacaattttgcccgtctttaattacccatttccaatcattttaattggttttcccgtgggctaatgagtttatttctttgttgtccatccgcccaattctttgcttttgcctgtgctttctctgtccgcttacttctcgcgcgattccgcaacagtttcaatttgcctgtggcaatgatttcgtccgccgtcatatacgggtccaattcgatttcgacatttacttgaaagatgggttaactaattgggtcattaggaggagggagtatcactttctcccctaattcgctcaaatgaattccctcatttaatcgctcactttcaatttgcgaatccttcaaaaaattcttcagcgaatgcaacgaaaggcgttcaaagttaatgctcgccttcaccaaaccgatctgtcaactcattaattgtctgtttgttttattcttggcattccgtttgtatggcctcgtgctcatttccgagtttattaatagagatcggacattttatatccccgagtttcgttaaacaggttaaaaataaaaaatcgtttcatcttccttttgtttaaatgcgattttttcttttcttttaaaattgattattttaaatgcaaaaatttattgattaaaaatcgaattaattacataattaagtcaatttgagttttaactttaaaatcaaaagcttcaactaaaatttaagttttacaaaatgcctaaagttatgtatctggtaaattctgacaaatgagcatttgtaaatttctgttattttttttaattgcaaaaaaaatatttatggaaaaataaatcaggatttatactcgttaacccgggtttaatactaaatccggagatgagcagcagcaggaaaccttcgctgttcacctgtttccacccgtacaattggagaagagtcagcgcggcacgtgccatttctgtggccgaagtcagcgcgacagagccgagggtatcgaaaactgaggggggggggggggaatttttgaaaaattaattcaaaatttcatgggatcaagtatcttttttttggccaacttgttctgtccgacagggcgtcgtcgccggaaaggtgcgcaatgattggcactacaaaaagcaattatcaaagggattaacggggaatgccttccccaccgttccatcgtgaagccaatcgtccgatcacattcatttctgaatggtttttgggtaaaatttgccctttttccctgccaaaccgttgttgcacccgggcccaaagtacacgctggcattgcgcaaatagtggaggaaggcgccgtgttcgacaccgctcaatcggttgcacgactccattgtgatcacttggaaattgatttcatccggcaaaatgcgacgctctttcatgtcgtggtagcacatttccaacacttggggctgaacagcaattcataaatttgggtggactttggcatttcaatagggcgagagaaatgccaagcaaaggcatgcgatggatgctaacgccaccatcggttcgatagttttaaaaccgtaatcgatggcaccctcaactcaccgtttgcccttcgctacggtatgagtttttcagtactgtattgtcctaatcaacttgtgctggtcgtacctcgttgatgatgttcgggttgttgggctgtaagtgtgcgactttgatcacattgcttttggctccgccagtttcacaggaaatgcgcgacggacagccgaggaaaaagcagaaaaagcggagcaatgcaaatgaaagcgacgaaatgccggcgggggattttccacgggccattggacaaatcgacgacagagaaggggagataaatgaaagcgatcagaaaagtgatctgaaaagtgaccagaaattgatcggaaaagtgattggaagtcaaaacgaatttcaatgtattttaaggggtgcctatcatttgggtgtaatttgtaagagtttctcggttttcagaattttcggtccccacctct

SEQ ID NO: 10686 - DNA, 5476 bp, Heterodera glycines
  misc_feature (5433)..(5433): n is a, c, g, or t
agctttctccatcgatcgcttcacccacctcatcgtcgttccctcaacagcagtagccgcgacggatggaggggaacccgccggatgacggtggttgagcatcggctgatgagggaccacctgctgctgctggtactgatgcaaatgatggggcacacctccgcgcgttttcccgccagtcaccgctgcgtctgtgtagtcccctggcgcatgacgctgctgaggcgcaatggacggagttgttattagaggagagccgcttagcattgaattaagcgcctgtggactgatcgttgtgttgtctttgaccgatggcttgggtttcgaatctttcgtggtttctattggatgtacaacggaagcgacccgtgtggaagaagtcgtcgaattggaagaaccaacactttccttcttgactccttgtggttgctgctgtagttgttgcgattgctcatgagaagggaacattttgttggacgtgtcttcggcaacttctgcttccataatgggcgattgacaccgatggacgttcccggcaacagcagcggcagcagaagaacctccggtgatgtcaccattcgtattattttgaccaggggcagcagtgccggtaccaccgccactcccttcgttcagtgtcccgctcgtcgtgatgttggtgttgatttgcaaatatggaaaaaattgaattgctatcacagacagcaatttaacgtgtaacaaatctatgatttaatcaattggtaaatgttatcaaagaagtgcagatttacatgagatgcacaaaattaaataatttggttttttttgttagggtcaaagggaaaattaatttttcagcctcaaagaaattatgtttccacagtttcaactgaactttgtgtttttcatatttcggccattttgcggcgggacagtccgtctggtgagagcaccaaagtttagaaaattataactttcgtaagtgcggaccaaaatgataatttttcggaaaatctttaaaactatgtactgtattagccattaaaaatcaaataggtagattgattcaagtggaaatacattaggaactttcttttttaaggtggtcattatcttttttacttaattgcttagcattagcttgatacataaaataaaacttgtttaggcggaactctccaatcgtttagtttttgagatttttgtaaagactatctattaacgaaaatatgagcaaaaattgcggtttgaaacgactttttcgaagacttcacccctttacctaataaagagttaaattaagagaaagaaaactttccccgtccacttcagcccttttttatccgcaaaaccgtaaaatccctaaataaaaaaagtagaagatggatggggtccaataagaaactgagaaacctcaccaatttcagcgcatatcgtgtctttctatcggctggagaatgagaaaagggaatcgatcgacgagcaaacagccggggggggggggggaaggctttctgtggggtgaatgaatgagtgagtggctgacgactgctacacttccaaccccaacgagcgaatgaatccgtccgactgtctttgtctgtctgtctgttctgtttgcttttacatcactttactattactatttccttactctccctccccttttcgttcattttattttaaagagagcaaaaagaagtcagagcgaagagacgaacagagaagtggaaggaaattaagaactgatttagggaattaaacacaaggggcatatgtagcatggcgaaacggagggcggttcctcctttaaatttctatcacttccgtttctgcatttttgagccatccgagactaaattcattcccgacgccatgaaatttatgatgtatttggcgtccaaattcgactttttatttattccagggccagagaactcggatccgacccatatttaggcccatcgaaccccgaacccggattcaaacagaattgaaaataacaattttaaaattagtgcaacaaattcaataaaccgtaaactatagcctaaatttcgttaaactcgccaatcgtcgtctaccccacacacagaatgttacatgtcattgtggaaaaatttgaaaaaatttttaatattcattcgttaaacaaataaacagagacacggttcgagaccaatacctccaaaaaacccgagaattttctctaaccgtggcagatactctcgaataaagcacctaacaaataagggcactagtttttcattgtcccatcttgtattaaaaattgtctgttagagccgcttaattgctcacaaatctcaatcgaaacaatagattttatatccgatcaatcgatctgctgcatttggccgttctgttcgtttcctctccacttgcttcttaccctacacaatttgtttatcggagttcgttactttcggctgcccatccctcgccgctttcctcccacactccgtcggtccatccgccgcgtgtccttcgcacttcccacggattttcgcgccttccccaccaccgtctttttgtgcctccgtttttccgtcccttttgtgcgcccctcctccgtgtttttgtggcccaatacggtcgtttagcgcgaacattcaatgggaaattccgcgtcggggccttcggttcttccacaagcgaagtgccgacggagttcgggtagcaaaggtccttttacggagttaattgtggagacaaaagcccatttgacactgttttcttaccccttctccgcatgcaaatccttccgggcattctccgtttacacatggtccgatggcaccccttgagtttgttcaattattacaacaacagccaacaattaattaattaattgttttgtgacttttggacccaatttccgaaatcattttctcatttaccctgtagtgataccgacggcacagcaaaagtcatttgaattacaaacgtaaccaatcggacaaagcccattaacacaacgtcctgaaaacggattaattacgaaggcaaatccgaagaacggttttatgagagagattctgaaaagattataaaatggagttgattttgggagtgttcccatcgcgttcatttaatgcaaatgacgacactttgtgatttaattaccgatggattttcccaccggacatcgacagcaaaatttcccgcgctggcaaaagtacccttggccacaaagtccgttaagacatgccgcgaccgcctcctcgccatcacacgcagctaatggaaaagcagtgaattggaatggatgaaacaagacggaggataactcactttttaagtcgggttggcttctggaaatgaacattggccggcaacagcagcggaccattggcatcatttggggctgaatgcactggtaggcttggcaatggatcggagtgcacgagaagcagccgggcgggcagtgaaactgcatcggagaataattccattggcgcttgggccgattgaaaatcggttcggaaaaaaggaaagtgcttggggaggagtcggagaagttggagcagttttgggatgatgatgatgataataataatgatgaagacgatgagggggaaggggaggaggaggcgggagaatggcaatgggcaaagagttggagcaggcaaaggaaagtcagaagcagaaaaggggcacaaaaatggaagaagttgccgagtgccatgctgacaatgaaactgaagcaacgaaagggccaacggaatatttggaagaaagggaaggacggaaagggaagcgaagggaagggaaaagaaggcgaactccgtccgaagcagcagcagaagaagaccgaagaagcggacgaagaagcgaatgcaatggccagcgggggctgagtgattagccggtcattatcgagtggagtcatcgccgattagctgcagcggtggccattgtttcagtgcaaacaaaatgggggaggagagatggactgtggcaagaggccgtgccccaagtgccctctctcctgaaactgaccccggcgatgatccaagcggccggggggggggagacggacttcctccttcacccatcgccacttttgtgcccctcccctccacccgcttggcccatttctgtccccttttcgtcctccccccccccctcgtccatttgtccttaatcgctttttccttcgctccccgccgccgtttcaatcggcttttattcctttctttgctttgcttttcatttgccatcggttgcgaattgaccaatgttcggatgtgattcattaactcatcgaagaggaatgaatgaatcatcattctcattgtttcacaaatttatttaaacaaatttgagtttaattgaccgatggaacaaaaagaggttgaaaatgatgaaattgaacaatataattagcaatttgaaagcaattaactgtaatttgatgagataaatgaagaattttgaagggacgaccaacgaaggaataaaataatgaaaaaataataaaacaaacaaaaataaaggtgtggatgaaaataaacaattaaaggggaagaaatttgcacaaatgccggaaatttttgtacaaaaagggaaatgcaaaagaacaccgtttggtttgcaggtgcaaatcgggcggcacaaaagcggccgttgtgccgtcgtcttccgtcccttcttcgctctccgcttcagccgagactgttccccccgctgcccgtcacggggtaacacaaattgccggcaccgcaagcgtagcccacggggcattgctgtgccaaaaaacgaaatcaatcggcaaaaaagcttttgggaaagataagcaaaacacccacttcattaacgcacggaccaagtacagaaccggagccaagggaacagcagaaattgttggtgttgcaagcatagccggggggacaaaggttattcacgcagggacctggggaagtgatcaggagataagcaaactgatcagcaatttagaagccatcgaaatggtggattgacatagaggagagagagacggaaagtgggagagactgagagagaagtgagagaaagtgggggagagagagagagagacaaagagagcgacattaagtaaagggagaaacggaaaataaaacctggcgatgtgccggactggcatcggcagcaaaagttgcgtgcattgcagaagtatccttggccacaaaggccatttagacaggcagcaactgcggggtctccgtcacatgcgcctgaattgccatttcaatagcaaatgattaattaattaattgtctaattggccactgacttgtcagatttgtctgtgccgactgtgcggggcaacaacagcccaacacacaaacggtggccaactgatagcgctgacattgggccgagttcatacctgcacattaagcagccttttggcccgactttacattaacagaaggaacttacacggcgaanagcacgcgcttgggcatccccactgccttttgcttctgagcag

SEQ ID NO: 10687 - DNA, 1397 bp, Heterodera glycines
attgtcaccaaatctgtaattaaatatatatatatttttaaattattacaatttttttaaatttaccggcattttgtgccaaacatttttctcgcgcagccatccatgactgtttgccaatgttgaattggtattttttgctgcggggccccgtgatccatggcacaagatcgttcggcacggaatcgcgcagctgttataagaatggcattttttataattttaattaatttaataaagattttaaaaaatcaaaaaaatttatttgtttcagcttaaaaataagaatatttctattgcattaaaaattataattttgcggatttttttatttaccatttcaggaccctcttcctatttaaggacaaaaatacttctctgattttctgagattatgaaatttttgatttaaaaattataagaaccattgtgtgtacttgaatgtttgtcgcgtcataatgctccacaaagctatgtcgattggctattgatgaacctaaaaaataaaattttaaaaatattttcaacataaattaattattatcttttacccgaaaatacggcaatcgccaaacacgctattactaataaagtcattaaaatatgaatgaacagattttgtgcctgctggaaacaaaatattaaaatgcatgaaataaaaatgaaaaatggaatgtgtgaatttttaaaatttattttaagaaagcttaaacaccaaaaaaaaaaaataattatgtgcaaaaaatttgttaactttttatgatcatataagaaaataaattgacggaaaaaggggtgaacggaccttttgaatgggttgaaaggttgttaaaaaatgattttaaaaagaaataaaaatttacatacgatttatttattttatttttttcatcattgtttattgtcaataaagaaaaagtccacaaaaatggaaagatccgcttacattgaggacaaaactctaattaaatgtaaatagcgaaatattgaaaattacttataaaatcgaaaataaaaaaaatttcgtgctactttttccggacccaatagaaatgatacaaatgtgaacccttggctttgggggggggggggagggctgaagtcaaaaattcgatttttaggggtgtatttttcttttttaagtcgattttttggggtgtatttttggttttttgaaatcccgaattatggggtgtattttacaaaatttttcgccgttttcgccaaaaaattaatatttttgacattttggcctccatttttcaaaaatatggtaaaatggaggtccggcggtgccgataggcgccgccgggaaaatttttgagtattttaatgcaagtttgttaagaaaattgcttacaatttcaaataaaaatttattgaaaattttttccttt

SEQ ID NO: 10688 - DNA, 3867 bp, Heterodera glycines
  misc_feature (3818)..(3818): n is a, c, g, or t
  misc_feature (3848)..(3848): n is a, c, g, or t
aaatttaaacaaattttccttttattccgtacatctgttaaaggaatggtgatttggtttgtccttttaagcccctccgctccgctgacggaaaagagaagccgccgcatggcgccgcccgctttacaggagaacaacccgcccgcccgaatgtgtacacacacattttgggtatgcatggctgactctggctgtccggctgctgtaccatttgccgcccgatttaggcgagcggacggtgaaatttaatcgttaaaatttcatcgcccgaggggaagcggcagccgacgccacggcggagctggacagagcggctggcagcagccaacgccatcaataagccactttttacattaggggcatggtgggggagggggtatggcgaggaatgctttttcgcaagattaattgggatcatttgagtcgcgccgctcgccgaatgggtggctggctgactgccgggataatgggtcagccagccagccgctcggctgtcattgctgacagccgccgatggggcggcatgggggcggcacagtgatcggcggaggatcgctgattagtcactgcggtgggtcattaggtgttccaaattaatccttttcgtgcctcccgccatcggcttcatgttggtcattagatcagagctgatcagttaatggttattcgcgctgcgcaatgactgcgacggggttagatgatcaaattaggaacattgcgccgtcggcgatagggctaatgggtggtggcggtgagggaacaaaatgatatgatgatgtgatggtgattaatccgatcaaaactgatgatgcgctttgatcaaacaaacgaattgggataaccggggagcatttgtgatggcatcatttcatcagctggcagaaactaatgaactgtgctgatcagaaagctgaatgtgcgcgatcaatttgtgccacccggtgattgggtgggtggcggcgatggtggaaaaatgccctcgggcgtttcgggaatggaacacagagatttttaaaaatttttgtttgtacaaataaatttttattgcggaatttgacctcgtaaaaatgtgatttaattgacacaaatgtgtaatgaatgcttaaaatgtcttcgacggaccaatttaggacgtttaacggacgaacgcagctgatgtttgtttttctgtgttcacaaattagcctatttttaaatataggtcagtcaaatagagagttgaaaattttgggattttaattttccaaaaaggtgcgaatcaaaaatattttattttatattccattttcttcttttctttattttttcttttcatgaaaattttttttttaattttttttattttcattgaaacgaatttagtttgaaaacgaaaatttaattaacttttaaaaattattttctgttaattataagtttctgttgcataaaaaagatatttttttttgaattttcataggcaaaaaaatctttttatgaaaaaatcctaaaattcataaaatatttattttaaattagtgacatgtgatttgagcaccggtgactcacccactctttttagttttttttctattactgatcagaaaaataatgatttatttatcacatcgattgataattacatggtgattacaattatcagactaggaaaaatagtttactcataggcttcgtcatggattaaaaattgtataaaactgaaaattgcataaataaaatcaattttcttcagtccgtcattacaaaatcgccctcaaccatctgctgatcagaatcgtcaactccgttggaatgatcaaagcaaagtgcgcctccccttacgcaatcgcgcacttgaggctcaattggaattctagaaaaatttttggaaatttaaaaaaaaaatcaaatttggttagctcatttccgtctttggcctgcgcaaaaccaacatgactttggcccacatcaaacaccgtgtagtaacgacctgaaaatttggataaattttggaatttttaaacaaatataaaaaaataaagtttcaatttcaaaaaaggaaaggtatgagccaaatggcaaatgtgaatttttttttaattaagaaaattaaaaaataatgaaaattttgtaagaaagaagaaaactttattagtgaaataaaatattgatttaaataaaggaatttttgtttttgcataataaaaaattattgaaattaatgaatttaaaaaaaaatttcttttaaatccctaaaattatttgataattttttaactgaaataaaaaattaaaataaattctataaaaacgtaaatttataatttaaaaaaataaagaaaaaaaaacgcttttgcaccaataaacacatcgccaagaatccaaagttctccgacacgttccggcaaatcaatgcccataaaaccggaactaaaaaattaatttatttttacaatttcaaatattttgcccatacaggcatatgcttttgcccatgctggtcattttcagcacatagtccttgcccttcaacgtgtacgccttgccaccgatgttgatcgtcacatcgggcagtgtgggaatacgttcacatgatatcatatactgtatgttgaaaataggatcagcatactgtataattttgttgcaataaaaaaaatgaaacaaaaaagggttacgaataattaagcatatgtgtttgtcagattgagtccaattattagaaaaaattggattaatattctctataattccatatactgtattttgaaaataggatcagtatactgtataattgcaattgcaacaaagaatttatggataattaagcatactgttttagtcagattgaaaatccagatccaccagcttcaatatgaaatcccggtccatatttaggtccaggctttttttttaattgagaactctaaatttaaactggaaaaagcctaagtaattttttgcggaatcggttgaattatatggcaaattgtgaacttcagttttgtgccaggatttgcattttatggaagcttgaagctaaaccaagacagatttatcatttttgttccagtaccaagatgccaaaatatgaaaattttcgaaaagtttcacctcgccatggaagagcggaattgctccaatgtgtttctgaatcttttcaatgtcatttttgggcccagcaagcagggaagtgccttcaaattaaaattgctctttaatttatatttgaaaatttaattattttttaccggtgtccgcaatggcttggcacccattttggcacgcaagtttgccattacctccactgatcgaatccatctgtaaaacgagagagaaatggagacagacatttttgaattggcataaaacaaatggccaagaaaaataaataaaatttctttattatacaaaaatactgtaacattagttttcagaaatccaatatgtaaagacaggcatatgacctagtaaaataaaattttctgtcgtgaaattttcaaaaattttaataaggtttccaaaattttcactctctgatgggtttggttttgtataaagctacagtatgatggcaaactaccataccttgaattgccagtaggctttgtgtgtgaccggtgtgtaagtgattggggccacaaatcgtcgctgatcagtgccgccaatggtgatctcaccaccaaattcagaggtcgggtcacttcaaaattttcatggattttatggaattttccaaatttcagagcaattttctagacaaccaagcgtaaattttcatatcgtggcaataataaggaagaggcaattatgaccggcactgagaataggtgccgtanaaatttagtcattcgtaagaattttctttnttaattcaaactgattttt

SEQ ID NO: 10689 - DNA, 1414 bp, Heterodera glycines
tgccaagaatgccatcaaattcgcagccacgaaggtgaggccaggctcacttaaaaaggaaattttgttgaaatttttaggcctagcattagacatgcctggtcgcttcagtgaattcctgtttttgtacacaaatgtttgccatacaaacaatgtctttggaaacaaatctgtacaataatattttaaattaaatttatttaaaattttttatgaaaattataattataattatttgtattttaattgaattttataataaaaaataaaaattgttatttttatttttttagttaaaaataataaaataaatctcttaatttatgcattttttaaattttaaaaatttctccaactagtactttctttttgtaaattttgtcagttttttttttctcatttggttcgcgtactgtctctaccgtaccctttcattgagccagtgccgtactgtattgccacctttcgcccatcgggctgataggaggttgatttggcgccatcatatttgtggtgaaggcctcaaatttcacaaaaaatttatgagggtttaaaaatttaaaaaaaaacatactgcaagcgatgtcataaatgggacattttttggacggcacccataggtttgatgaaccggtgtcgaagatgacggtgaaattttgcgccggtgaaccgatggaaatgtcaccgtaatattgggcctgtatcgaaaaataagaaaattcttgactaattttttgataaatatcgaaaaaatatatcaaaatcttcgataaatattaaatcggtcgttccggtctctaatgtcagctattttgatttttacatttttcaaaaatgaaaatattaaaattcaggatcaattaaaaacaattgggatgccaattagagattttgggaaaaatttaaaaatatcggggtttgggttcggtaaataaaattccaaaggaatggctttcataatcccattttttgtaaagccaagtttcatttcaaatccaaatatatcagtttcaaatgtggcccgactgctcacgtccatgtagttgcgcaacagttcgtcaatttccgtgccaactctggccccgttttgtgccatttccatctgttcctggtccgattccgcgctgctgtactcttcattgttgttgtagttgttgttcattcgctccacggtacggcgcaacgactccgtgcgatgcttgcggaactgttcaagcgatccggtgagcgccagacgggcgcggacggtgtccatgcggcgaagcggaacgctacaaagagtggaaaaataaatcatgttagatcagaaaaacaaaaaaattgaattgctcggtcctgaaatacaccacgactcgggaacgacaccgagtctaaaggaaatacccaagacttttttgactcgagactcaataag

SEQ ID NO: 10690 - DNA, 1477 bp, Heterodera glycines
  misc_feature (1459)..(1459): n is a, c, g, or t
aaaaaaattagacagaaaaaaatttatttattaacaattttaatgaccctaatgatgaatgataaaatgcacgaaatgttttttaaaacaatttaaataaaaaccaatttcaaaatatttaaaataaaataataattaatttcaaaatattttaaattttgtgaaaaagatgaattggacatataaaaatattcattttatacatttgtagagtaacaacaaacggttgatgattgttcgtcaacattcggcatccttaaagcttggcaaggcgacaatccatgcgacggatgccaaaaacaatggcataataatgccatcatcagcggcacaacaaatgaacaccgcaagcaatgccagacaatacgatgaacagcacaatcaggaacatctgagtattgatgccaagctgcaaaaacaggactcgggcctgaacttgttgccgcctgagctgcaacggaacatgaccgttatgtcggatgaggtggtggtcattataatgattaattaatttatttattgggtaattaattattaatccagggattaataattcttgaaaaagtcaaaaagattattctcaaaactaataaattgttaaataattaacccagaaacaaaaaagtaaaattttataagaaaattttaagaaagaaattttttaaaattttcaacgatttttagaaaatttaaaaaaacagtaaatcatcataagcctttggtaaagttgctaaaaaatcttaaaaaaggatacttttctagaaattttcttaagaatattttcaaaaaaaattttgaaaaatttctatttgaaaatctttttttgggggtgcaagcaatacatatgaatgaggttggggggaggtgaaacaagctgctcccgcaataaaagacaaatttatgaattttgtaagatttttttgagaaaaaattgcaattattagggaaaattacttattcagcccacaccatattagatcatcaccactaatctttgattaaatgccctaataagaagacattgtctttattaaaataatacttaattttttatacaaattattgccgatccaatagtgatttgatcatttttttggcatttttcagtccgttttcgaacgggagaagcgcatggtggtgttgctggtgaacaaccaacaggacaagccgtcccaattggctgtgattgatgtggactttcagagcccaggcttcagcagagtaaagaaaaaagataattagaaaaatgaaattaaatttatcaattaaatgaataaaaaagaattttaaaaaagtggaaaaagtggcacggaatttcatacagggaattaattaaatataatttttatgttttctttatccagggaatattaatgaaccccacaggttgggaaattcattgcaattttaaaatatttaccctaattataattaatttataattttttggctttctggngggagggaggcgcctgct

SEQ ID NO: 10691 - DNA, 2053 bp, Heterodera glycines
tgttttttcaaattaatcaaataattattcgtaaacccccaccgaaaaaattagcgtcctaaatttttttttaatattttctctacgaatcatgttctgttttaaatgttaaattagaatgaacattgacaaatgaaataaattttggaaaataaatttaatatttaaaaatttaatttcaaataaaatttaaatttaaaataaattaggctctgccaccattccaattgcgacccgatttcccaattttgggggtgccatggctgtccacatgcgacatgcgcttgcattcaccacggaatggggtgatttggacaaaattctgtgccaaacgccaaatataaaaccgccaaaaatgggtacaaaaaaattaattaattaataatttaattttaattatttgtcaggttcccaagatttgttgcaaaatgatgatttccttgaaacattcggaaacaaagtgaatgtgtgggacatgcgaaggcgaacattgtttcaaacggtaaaatatttaataattttaataaaataattatttttattgcattcagataaagcttgagcctaaagaggatgggcgctggccaatttgcattcgaatggtttttgagccaaaaaatttttaaatttaattttttgataaaagaaaaatttattttttaggtacaccaagctgaactaacacacgggtaatgtgctttaggaaaaaaattttattaaaattttttttgtaaaatatatttgtaattgtatttttcggaacccgtcagttgggccccgccatgtttgggcccccagcggttttttggctataactttttttctttgccaaccaaatccaatttttggcatcattcgaaagctgtaaatgtcctctattagcctggaaaattttgaaaaattatttaaaggttcaaaaaaaattatggccagaagaacccaaaaaaccagatttcccaacttttttggccataaatttgttcaaaattatcgaattttttttgcaaatttgcaggctaattgagcatctgaagtgctttcgaatgataaccaataattaatcattaaaattaagaatttaaaataatccaatcactgtgagcttttggaaaaaatttattccaatattttatataacatatctgtctaattgtatttttaaaagccttttaaattcatccaattttcaacaatatttaaaaaattaataattcaaaaaataagcaaatgtcagttaatataataaaaacattttaggtttatttgtacagcattgggaagctcaatgtaagggtgaaaaaatacaaaaaaaaaatttttttgtaaatttttatgcctttagatttcatttacataaatctaccgtacgtaaaagagagtattaccataatctatggaattgattatcaatttctcagaaaacgggtcttttttctgctgatcgtgttgtcaaattttcatctgtcactgttggagaatggcctggtaggtgtgcattttttttcattatgtatgtatcagggatgggcttttgcgtttcgctttcgcatttcgctttttttggcactttcgcgtttcgcattttggcgcgaaacgcgacttttacacccctaagattggattaaattccgctaaaatttttttaaattttacccataaattggctaattttcagtgaaacttgtttataaatgatcaaaatttccaattttcccccggcggcgcctatcggcaccgccacgcccccaaaactcctattttttcttagaaaaatggcccaaaatcgcaaaatttggtaattttttggtgaaaatctgttctcagcggcgcctatcggcaccgccgcgccccaaactcttatttttccttagaaaaatgatacaaaaattgcaaaatttgatcatttttagtgaaaatctgtcaacaaattattcaaattttcaaaaattttcccggcgacgcctaccggcgccgcctgccccctcttcccaaaaagttttttggaaaaagcgcgcttcaaaaaagctttttattgatttttaaaatttggaat

SEQ ID NO: 10692 - DNA, 2396 bp, Heterodera glycines
  misc_feature (9)..(9): n is a, c, g, or t
tatgtatantttgggaaatttttgaaatttaaaaacaatcaaattctcaattctttttggcatactgaattatattttttataccaaggcgctgaacttggaaaaatcacaatccaatttaaggtgatgtgcccgatgtgccagcattcctgacagatatggtgaacagtaaaaaaaattagatgaaatataatgaatttaaggagtttttttagatatttttcgatttttagagtaaattatcaatttttttaaattttatattgcaaatattatttaaagtaaaattttaaaaaacaggtaatttcaatggatgatcagcatctgtatgtgtgtgctgctttccatggatttgtggcacagctgaacatttcggacccattccgaccgacactaacccaaaaagcaaaaaaaaaaaaaaaaattttataatttttaaatattactttttaacaggttttccttggtggaattgtgtatcgaaccatgggaatattacacggagacaaaatgccattgggcaaagacagtgccatgcgagtaattatttaaaaattaattaattttttaatttattgaaatatagaaattaaattttataacaaattattgcaattttcgaattccgtcaataaacatttcttacttttaatacatatcatatggaaatctttaatattaaaaaaatattttttaataattattagaaatattatttgatttcttttctcaatattattttatttctaaattttttttttgtaaataaattattgcaatttcaaattttctcttttaataccgtatgcctctttattattaaaaaaaacaaaattttttaattattattttttattttgttgaaaattgtttaattcattaatatttcaatgtattttattttattttggtgtatatacatataaaaattttatttaaaaaatcctaattttttttttcagagttacaacaccgagaggcgttttttcgcgggtcgacccttcgagggtggacctgcccggttgcaattgtcgttggatggtcgacgattattcgtgtccaacggttttctccgaaattgggatgaacacttctttcctcagttgatggagtaaattaaaaaaaattttaaaaaataattatttttattttcttagacgtggttcactgattgttctggtattttatgttttaatgagcagtttatttcttaattatatatttttacatacatatattttaataatatagcaagattcttgtaatttatttaaatatatatttatcataataaaaaaatatatatctttttatattagttgttttttccgaaaaaaaatttctaaaaatctttaaagcaaattttctgaataatttttaattaaataatatatttttttattgttaatagttttgttcggcaaaatactttcttaatgttaatttaattattaaaaataatatctaattaattacaaattttaaaatgaactttctaaatattatttttttaaataattaaccaatttggagtgaagttttttcaaccaaacaggttcacattgacccagtgggcacaaatccgatgaaattggacccaaacattggcatcaattttgagccggacgaacaacagcagcagcagcagcattctgtgaacgatcatcggaaacgaggaggaggaggaggagacaaaaacggaccagcaacacaaccacaacaacagcaacaacatttttatgcaagagaaatgcgctttctgaacggtgattcgacctctgatctgctctgatttgattttttcatgaaaaattgtgttaaattttttcttgttaaaagaatatatacacaaatttcttaaatatattttcggttaaagtttgaaattttgcaattttttaagacaaatgaatgtcctttttcaaggacgccaagaaagttagtgcatgcatgggctttcatgcgacagaaaatggaagttccttttaagggcaaagatttatttccaaattttatgtacaattttaaggtaggtacttgaacttgaaaatgaattctccaatcttgaaatgtacttgaattttttttttgttttatttagaatttttaataaatttctgtctctcatcaccttctgctgtgctcttttcatccatctttggagttgcagcatcaatcacaatgtccggcaatgaaatgtgccgttttccgtggacagccttttcatttttgtgatcacaagtgatcaggatgatgtcatacgccgtgtttattcttgatctcggctttgctccgtgttcgttgaaatcctataaaaatttatttaatattatagtatttgaaaagatgcctttttgtagatactgtattgattacagcactaattagccaattac

SEQ ID NO: 10693 - DNA, 1547 bp, Heterodera glycines
tcgaatgctgaaaattgaaacagaatttacctaaaaactttctaacaattctcgcgtgaaattaaattaggtaaataaaagaagaaaaaattaggcatcccttttggtattgcttaactttgtgtctctcatattttgctatttttaaagcaaaaattgtaattcggaaatttgaattttcaattagggattcgaaagctctcggttttttcttgcaattttcttaaacaaattttagaatttcctggttgaattttcggtgggtaaagatagggagggggaaacgtgctccaccaaatattgcagattattttaaaattctaatttctcaaaaatgccaatgccatcgaatcacctgaagaatggcgcaccgaacagataagcaaaggtatagaagaggatataaactgcgcacgaccttttgagatgggcgaaaagcacgcggaagggcacccggtagatgcggagtttcgtataaaatggcagctaaaaattgtagagaaaaatgaattaactgcaacagacaaatgtgatggcaaaaaaacggcatggaaatattggcatgaagcaaaataaaaagcaaaaaataatgtgaaaaatacaatataaatgtatcggcaaaaaattaaaatttgaattaaaaaggccatttgtgtgcctccaaatttgaaaagcaaaaaaaaaaagcatgggaaaatctctgtcaaatcacaatgtccaattcgggcagttcaaaaatgggctggcgatgcagcggaatcggctccgcttccttgacttgctgtatttggtggtgtttgtgctggtggtggtcaacctcctcatcgggcaccacaggttcacgctttatttcacgcaaattggcatggtgatgaacagctgaaggcacacgaaaatttcattttttaaaaattaagtggcaaaaaaacaataagaacaaattatttagggaaaacgcgtgaaaaataaatgacttttcgaattaaaaaagaattgccgtgccttgcggcattaaatttcttttcaaaaaaaccggaattttgtggcctactgtgaatacctagtcatacaaactgaaacactcacccgctgaactggacgaagtccggcgacgccgagcagttcggccggtcggttgttgttgctgctgaccttttgcggttgatgtggacgcttcggacgagcaaattggctcacactttgttgggcaaatctatgacatttaaaaaaaaattgttttttttagataaattcgattaattttgttgcaattcccatttctttcttgctgacctgtttgtcactttgccgcacaaatttgacgggtttctgattctaaaaaaaaattttttttttaatacatgcaaggtaatataaaaaaattcgttgacctgcaacagcttgaacatgccggtaccaatgcccatcggtgtgccaataatgatgcactcgctgacacccgaaattcggtcctgttggccaaagaaggcggcctcgtaactacaaaaattgtgtgggaattttgcggttgagcctcagcgcccccc

SEQ ID NO: 10694 - DNA, 2354 bp, Heterodera glycines
  misc_feature (2344)..(2344): n is a, c, g, or t
atcccaaaacagctcaacaatgatcacccccccccctctcacaccttctcgattaacttcacgcacttagcccccctaattacccgtgaaaaattcgcgcactccccccccccccccttaaacaaccccctccactcaattaattatcacccctcccccgaaacctattaattaccagctgcccccccccatgattaattagggcggcaagatcaaagggaacccctcccccgaaaacccattaatcattttcacacgtgacgatgaaacctggagggtaactactaatgcaatagagccgaaacggtatgtatgtaggtgtgtgttggtgctgctcgagagtctcggttttgggccgagaaaagccaatctcacgtgttttaggctccgataaattgtaagtctcgaacagcaccaccaccagtaggtggacgcacaaatcccaacgttcacgtgccggaaatggatgaatatttttcaaatttcgaaaagaaaacagcaaaaagttcactccatgcaattcagtggaccatgccaaaaattcatattcaaaaaatgatgggtgatgaaaaaatgatcggaaaacaatgtgatatttaaatacgtgaattgtgtgtgtatgtgtgatcggacagccaaaaaaagagacatgcagacaatctcccggtaaaaaaagtgattcgcgtttggaatggcattcaaaaaatgataaattttaatttaaaatgtcaatttcaatggtggggtgggtggttacggtttttgaaatttgtttctgtctgactgtctgcatgctccccgggcatcacgggttttaaccgtctctccgcacatctctctctccctctcgccactctgctgtttgcacacaatctctctccccaaaatccatgttctttcttcgttccctttctctcgcttcctctttctctgtcgttgtcgtgtccacagtgtctgccgtccacccaatcaatgccgtgactttttgtccggtggaaaatcgccgcccatcggaggcggcggtggcggaatgcgcccgcccggcggcggcggaccgcccaaaacgccgttgggcccgccatgggacaaaaagccggcgccaaacggattcggcaaaagctgttgctgatgttgttgttgctgctgctgcagcgggacgcggtccaacagagaagccaaagcgggctaacattttttaaatttttccatttgtttcccccataattattgttttttaatttttcaaatgatggcgaatttttgaaaaagtaagggaacaaatgccttcgtaaaaaaacataccggcaacggtccccgaaattggcccatttggttgtgaggcggagcgcggaatccctgcaacagtttgcgcacatcgggcccttgaaaagaaagcaaatttacaaatttaaaatgaaacatttgccagcagtaacttgagtgattaaaaaaatttaaacttttgaaacacaaaattaaaccttaaaaaatatttgaagttttctatttttttacaattagattttttctaggaataaaaaattttttcctgaaggatttctttaaaaaaaaaaactcatttttattatcttcaagaaattttcttagaaatcaattattttacaacaaatcaggattcggatggggcactgttgttgtacagcttaacagtgaggccaaagagaacacacacaccttgcggagacggtccacgcccattttgctgcccaggaccagcattgctgcccggccgaccgccctgttgttgttgttgttcagcatcgtcaccagcaccaccaccaccaccacgatttgccaagcccatgccgctgaccaaggagggcggcggtgctggtgcaccaccaccaacacctccaccgccaagtccaaatccaagaccaagtccgggtggcaaattatgacgcgacaacggagacggcatgacactgttggcgttgctgctgctgccaccgttgttggtggtgttgttgctgctactgtccatcataatcaagggcatgccaattccaccgccaccacccccaccgccgacgccacgaggaagtgggggcaaagggccagcgccgctcccacctgttaaatttagcaaaaatttgcccgttttccttgttggtatcccccgtcatccccttcaagaaatctatcctcacgcaactcaaaaaatttagctaaattctcaaccctaaatgctatttcccaaaaaaaaagttgggaattgacgagtgtccgagaacgacaatttttgtcctagtggtttacgcacttaacacttaattaacggttgggctcgaatgctttccgtgttggttgaattttttttcanatttaattag

SEQ ID NO: 10695 - DNA, 2041 bp, Heterodera glycines
  misc_feature (477)..(477): n is a, c, g, or t
  misc_feature (482)..(482): n is a, c, g, or t
  misc_feature (491)..(491): n is a, c, g, or t
  misc_feature (2008)..(2008): n is a, c, g, or t
  misc_feature (2013)..(2013): n is a, c, g, or t
cacagtgcgcatccctcactggtagcaccggatggttctcattttgggaaacgacccatcattgacgacgaagctgagaattgggtaagctggcagaagtttttgggaaatctccctggcctgagggctagaaacaaagacgtgtacacgcaagtaaagaagtctgattttaaaatttgtccgggctagtcgaagactaaagggacttaaacaaagagaaaaagaggtaattgaatgaatttatataattttcaacaaagtttcatttttttaaatttttccagattttattatttcacttcaataatttggtggttttttatacataaacgccctttttgatgggttttatataacaactcagcaccattcatttaataaaaaagatggatataattatttatctataataataattgctatagcgtatcaatcaacaaattataaaacatttgaattttaatttgaacacttatntgttnaagatagtnaaaagatctttcattactcacatgaattctctataaaaaattttcagcaatttcctatttattaccaaatatttatttcattttttcgtcggaggaaatccacgtcttaaaagtggcattcgctgccctttcattgcatatttaaacggagacgatttggcaccccgtattaaataataaaaattttaactaaaatttatttttatttaaaaagatccgtgctgtcctggcaaccaacatgtcgtctcgatgatgaaaaatcataccggcactttctccgcttcgatgccaaagccttcgctttggcagagtgccgaaagagtcgccgctgcagtggaaaaccaactgaaaacaatttcgtgctctggcaatggtgatcaagctgatcaacgagatcaacgcagctcaatcatcatctggtaccaatggacaattaaatccctttaaaatcatctattattttttaattgaaattcaatttctatcaatttggttcctaattagatgagtgtgctcgctctctcggcttcgtccgtgccatgttcgaaattgccgcttcccatgccggtgtcaacgccgatttggctgccgagttccgagaagaagttggcacaatagacaccaactgtgctgagcttggcattcatgttgggcaaatcagcttggacaatcccaagagtaattaaatttttattaaaatatttttattaattttaatgaattattttttcaggacagcatccgcaagtgcttgacccagagagtgtgtttagtaaccctggcatcagcggttctcacaagcgcttttaagtgaatttcgtagattcggataatgtcgtcatttgttcattgatatgctatagaaattattttattaaataaataattattcatttttttattagataaaaatgataaacacaatgttgcctgaattaattctattgaaattatcttttaacttttttaaaaaatgcttattcattactttttaaataaaacaagtaagttttttaattttaaagcgctttccagtacttagtagccataaaatcaaaaaattacattaactgagacacaaaactatgaaaaacctcaaaaactgaattttttcttaattcttcgcttttcgtttaaaaatgacaacaatttaatgaatgtttagacaaagaaacaaaaaatgttactcgggaccgggaattggccggcttttccagtctcggccggaggccaaggaaaaaaatatgcgtttttcttgtttatcccgacgaattaaatgcgaataaaaaataatcatttgcctaaatattgaaccctacctttaacaaagagttaacaaattttcttcaatttttttacagaaataagatgaaataaactaaagtaggctaacagaaaagaaaagattgtttgtcccaaaatttccaagaattgccaccaccattcagtcattcattcatcctacaggcgatccgtaagttttacgccgtcgagtcaattggatggtcccatctccngcaantcgtcgtcattccctaaacgtccctttt

SEQ ID NO: 10696 - DNA, 4054 bp, Heterodera glycines
taattaaatttttattaaaatatttttattaattttaccgcccattttttcaggacagcatccgcaagtgcttgacccagagagtgtgtttagtaaccctgtgcatcagcggttctcacaagcgcttttaagtgaatttcgtagattcggataatgtcgtcatttgttcattgatatgctatagaaattattttattaaataaataattattcatttttttattagataaaaatgataaacacaatgttggctgaattaattctattgaaattatcttttaacttttttaaaaaatgcttattcattactttttaaatagaacaagtaagttttttaattttaaagcgctttccagtacttagtagccagaaaatcaaaaaattacattaactgagacacaaaactatgaaaaacctcaaaaactgaattttttcttaattctttgcttttcgtttaaaaatgacaacaatttaatgaatgtttagacaaagaaacaaaaaatgttactcgggaccgggaattgaccggaaaatgccggcttttccagtctcggcaggaggccaaggaaaaaaatatgcgtttttcttgtttatcccgacgaattaaatgcgaataaaaaataatcatttgcctaaatattgaaccctacctttaacaaagagttaacaaattttcttcaatttttttacagaaataagatgaaataaactaaagtaggctaacagaaaagaaaagatcgtttgtcccaaaatttccaagaattgccaccaccattcagtcattcattcatcctacaggcgatccgtaagtttttacgccgtcgagtcaattggatggtcccatcctccggcaaatccgtcgtcattccctaaaacgtcccttttgccacgccctccccgttgcaactttatcaaaaatggcttcttgttcggcttctctgaaaactttcttaattaaaatgcactctaaaaaggtaattaaatgattttattttggtggataattaattataataaacacttttttgatttcccttcggcggctgtttttcctcgtcctttgcgttgtttccatttgcttccattttttggccgggaaatgaaaacttaaaattgtttaaaaatattaaaatttttaaaaattttcaccaaaagtcccaagggctccaagtttggctgagcaatggctcctttcgcattatgttcatccattttaatgccaattataagcatagccataacgaagacaaaaaggagaaaagacaaattggcgcgcatttttgcaaagttaaatatttaaatacaaatttaaatagtatttatttttaaatgtcagtttaaaatgccaatgatttttatgccgaacattggcattttataccgtttgatttcactacaaatatgcactttagtatcatcatattcatgcacttttgaaggttttgtttggacagcttatgcgtaggcaaagtcaaagaaatccttatttttaaatttttgtctctgttttttaaattttaactatttaaagataatttatgaatttaggcaaagctattccaaatttgacctgaagcttttcattatacccagtgtcatggacgtttcaaatcattatgcgcaataaatgtctcaagttgagcagtgcaatttttttgtccaaggcttctatgtcaaaacacaaaagccggacaaaattcttttaaaaaccggcatttttagccggtttcgcaatgccaaaaaccatagaaaacattcaacaaaacatttatctccctttttaccggtttgtttggtaaagaaagaagcaattcataaaaaaaatctttttccatcaggttgcctgttcttagaaattgaactcggtcacaattctgtcattcataatacatttttgtattttttttcagataacatttaacatgagaggtatactcgcccaattatcgaagtagagtaacttttttattgcaattaggagttcgaaatttgtcagaaaataaatatatttttttataaataaagaaaaaattaaaaaattccttttttgtgtgtttataaacagaagaataatttgaagctaaattaaaacattttggagaaaaattctcaattttacacaaatttttttggtgtgaaatacctaaaaaagataaaaaacaaacattgatgagccgaaactttatgcgaaaatgcattctcctcccgagactttcagcagaatcatgacattccgttataggtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataattttggatgctgatcaaaaaaggtagcaacaccaagttgatcagatcactccttcatggtgatctgatcagcccattttggctgggaacgagaggtaaatttcaaaaaaaatttctagggggttgagaaaatttttctggaaattttgagtaggcccattttatagagcacaaaatttgctaccgaattgcttttggaatagtgggtctacgatttaggcccgctgagatacgtcgacttatatttcggtgcctataaaaagtactgtatttcttaagaaaatagtgcattttacactacgtcaaaattgaggcagaaagactaaatcgttcgataattgaaatgttacggaaaacgatcaccagtccttgggaatgggacaaacgaattccttatgttgtattttcatataatgcaaccccaaatgagtcaacgggacattccccttttactatttttttcggacgtactattcagtttccaaccacgttaacagcaccaaaaagagttaatcctgcaaatcatttggatgatgtgcctattaaagtgccaattgaacatttggtttcggcaccaattgaaatttccgatgaagttttcctaccaaaccaaaaaaggaaaaaatttctaaacaaaatgccatttttgccggaaaacaaattagaacacagaaaaatccaaatcaatttatttacaaagaaaccatcaattttagacccggaggagacctgtggaatgtgccacaattcgttgtgcagtggaatcgaggagcacagcaattgtgcggcaatcactttggcggatcttcaccctgcttttgccgtgatggacaaacttcgaaatgtcaaaattgagacgctcggggagctgatctcacttatgatcgcaaaggatgtcccaattgcgcaaattcgaaattgggcaacaaacagaaacacacatggacctgattttcttttaaaattcagttcaaatctgtccccatcttcccaggaatttatctcaatcatttctctttggattgaccggtgcgactttgcttttcacaacctccaggcttcagggtgcaaaaaaataaaatttttaatccccaaagaaaataagggctatccattccaaaaagcgattgaaaatgctattgaggatgtgaaagctcgatctgtgttgggtctgtcgaaagtaattcgaagtcctttcattgtgttcagtgattcggttggagaagtaatgaaaaataagttggaggcggaaatatttttggagaggagctacacggcactctcaaacgaaattgtcaccacctattttggtgaagaagttaaagaaattttgattatggccggcaccgatgacattattggaaatgtgccaattgaagaaacgaaaaaggccattaaaaaaatttcatttcatttatccaagttttccatcaaaacttttattattccccacgcctattcatttcaaaaaaatcaagggcacatgaaaaatttcttgatttgttggatgaaattgtg

SEQ ID NO: 10697 - DNA, 2198 bp, Heterodera glycines
tccgcaagtaccgccgaaatcggataaagcccacccgaatgggccttgcccaatgtgacaatgtccggccgaacgccgtcatgttcacagcacaacattctgaagaaggacggcgatgatgggagaggaatttttgatcgaaggactgactgattaagcccgtgatggtaaattgtcagtataaaaatgcgtcagtgtttttgaaaactgagacacgtacggtagcatgacgaattgaagtggttactgtgaattgacaggaataaatttacagtaacccgttttacagtatgttttatcaaggtttgttgaatgtttctaagaacttaattgttgtttccaggattaaattcccatatgatttgaaggttactgtgaattcattttggtgctagtttagcatcatagtacagtatattatttgaaaaaacacagtatcaccgacgcattttgccactaacagggagccattaagccaagaggaaggcattttcactccgtttttcggttttcccgccattattagccaacactcactttcccgttcgaccaagcccggtctgcacttcgtcggcaatgaacaaaacgttgtatttggtgcacagttgccgcacacattgaaggtatccaggagatggcacaattacgcccgcttcgccctgaattggctccaccataaaggcggcacaattggggtcggaaatcgccgcctgttagtggtgaaaaatgagcaaccgcttcagcaaaaaaaaaaaattccggatttcgaaagccgggtttggaacaatcaaccgtccgtcctctatcactaaataaatgtaaggggtcacttaatttccccctccccgcatcgtttcattctgagagaaaatttttcaaaaatttaaccaaaacttcagaatttttcaaaaaaaaaaagaagtatttcaactctaacaaagggaggtggccaagtgtccgtgggatttcaaaatgaaacttggttaggtggatagagcaccaatgggttcttaagaaaaatggttttattttctgccaaatgagcacgagtgccgagttatgacgtgccaaagtttttagttttttataattaaagaaaaggaacaactatttcctttcttcaaagaaattgttagtgtagaggtaattcgttagtcaaaattttttttgggtcaaaagttcgaatcccctatgtgtaaattcattttgtaatttttatttttgctttttgtgagcaattcaattatcaaattttatttctttatcaaaatatttattttaattttattccattaaaaatcaaaaattgcattaaacataaatgtaatacatattctgtcaaattaaaaaatatttttttggcgaatatttttattgaatattttgcgcattaaaaaatttaaaaaaaattaaaaataaaaattttttcataaaataaatttttataattgacttggcgtaaaagacaaaaataaaaaaactaatttatacgtaggggatccgaaccctgggctaaaagatgctgactagcgcactaccgctacaccactggacaccgtgctcttgtgcaaataggtatttcttttatttaatcattaaaaatttggcacgtcttaactcggcactcgtgctcatttggcagaaaataaaaccatttttcttaagaacccattggtgctctatccacctaaccaagtttcattccgaaatcccacggacacttggccacctccctttgtcagcacagtaaaatagccctaaaaaatttttccatgatttttaaagaaaaaaaaaacgggacaagtaaactccatgattgccaaaacaaaaatcacaaaaatgttgggccacacctccttgaaattgttgacccaatcgaagttcgtttgttcgtagtaattatcgcaacgcaatcgcttgggttggccatcttttctcggagagtgcaaccatttggacaatgcttgaccagtagaaattgttgcatttggcacatcaaaatcatcaccaatcgcctcgggcaacaaatcaaatgaatggattgaaaccaattggttgagatcgatgagaattgtcggcgaaatttgacgaagcaaatggtccaaatgatcaccattgtaaaagcccaagtggcgaatgtttgtcgaaaaaaagtgccaaatttcacggggtaaaaatgtcccaaatccgctggccat

SEQ ID NO: 10698 - DNA, 1230 bp, Heterodera glycines
gctttttttgttgttaacctaatccagcagtcttggtatcaatcgaaagcttaacatgtttagaagatatttctaagctattgcttcgcgattagacaattaccaaaaaagttataacatgaaattccaaaaaagtcgaaatttttgagtttttttcttaataacttttttagaagctaaaatttttgtttgttttttgtaaggctaatagagcttctgaagggctttcgaatgataccaagattgttagatttggtcaacaagaaaaaaagttataataaaaaaactgaggctggcgccaaaacgtcggcgccaaaacgacccagtccctgaggaaatatctaacaattactaattaaattaataatgccatgattatttgaaaggaagcttcaaagtgtaagaaaattttaaaaaataccaataagaagtaaaaaattttcaatggaaaatgaactgtaaaatttcaaaaaaatttaaattcattaaatgaaatttactacaaatgggttactgtaagtttgttccattcaattcatgcataaaattaaatcaccatactaccgtacctcattttcaagaaattctaatgaactcgctcatttttcactgtcgctttttcagttttttcgttatctcgcaaagtaccgtaggaatttttaccgtaggaattcatgcaaaaatgtacaatttggcgatttaaaaatacacaatttggcgatttaaaaatacacaatttggcgatttgtttgtcccaccggtgttcatcggcaacacccgttggtagccgaacagcttggtgacatactcctcgtaatggcccagcgcgtctgtgaagaaggcgcgtgaagtgagcgtgagctgttggcactggcgctgcatcgtctcaacgagtcgcggatgacaatggccttggttgagcgcagaataaccgctcaaacagtcgaagtactccttgccgttcacgtcccacacacggcacccttttcaattaagggcattttgttaaatgacgtcagatttcgtgatctcaaatggtgctaggccaacgaatgaatttgaatcagattattaaagtgaaaaaaggaagatttcgagcatttaaagagaaaatttggtctttttttgttaaaaaagtttgttgatcactactcaatcggggtccccggccctcgacattttgccccccccccccaggggtcggggagcaaccctagttttaagaagaat

SEQ ID NO: 10699 - DNA, 1045 bp, Heterodera glycines
atttcaccgcccattaaaaatagacatttgcgcaacctctgaaaatccatttgcaccgttctttccaagatcagaaaattgcaaaataatccaacaatttttttaaataaaatctacaacatatatttattttaatattgactaaatttgcctttgcttctgatgtacgcattgacaaaaaacaaaaattttgatgtctaactttgtgattagttttttttgcatttattttaattaaccttttttgttgttgttgcactgtaatttgagtaaaattcgttgaaaattggtaaaacaaaaatccattaaatattaattattgtaaaaccctgccgatttgtatggagttccttttttatttttattttttgcacatttgtttgggcctaacattacaggcaattacaatagtatttgatcttctgtttgaagcttcgtggatgcgatgcgttttatttgctatttccatatttttccaaatccctgttttatttatatttcggcatttcgataattgtcaaaactttttctcatatttaaatgtcctcgtaaataaattttatttgaaaattattttttctcaatgtggaaaaagttattttctcaattaaaaacatcaaatattgaatttatttatatgtttttcctgaatgaaattgttttttcgctttaataatggttaaattttcccgaaaatgtgaactcagttttttcgaactttgttagtataaattttattagttctctctctattcgctttcaaaatttcaataatttttttatgtttcgaaaaattatttgatatttcgattttttggtcataatttttacaataaaattaaaaattttgcacgctaatagagaaaagcgaattatttacaatatgtacaatataattatattttcatttttttatgctattttcactttttgtgcgcatttttattcggcaattttcattaatttccgtcttccccagcaatttttccatctccaaattttgagaagcagcagcacccacaaatgattgaccatcatgagtttg

SEQ ID NO: 10700 - DNA, 3908 bp, Heterodera glycines
tgaaaggaaggaaggggacaacaattagctgctactgctgctgctaatgatgcggaacaattaataataattaaataaacaaataaaaatgcgcgaataaataccgcaaaatgtttttggagtggaacccccggggaaaagcgtcgttggtcgtcactttcgctttaataaaatatgtgaactatttgcttctgctcattaatttgtgcttctcttctcctccttcggtttggttccgccaacacttccctttgaccgcccattaattaattagttaattaataatttttgggtaataatttaattctgatcatttaggtatttatttttcctcattttgttttttgacattttaatttattccgtaagcattttttggtcgttcgcctcgtggtaaatgtcagtcaattgcttttctgtacattctttcttctccaatgttcttatttatgtacacaacaatctctttttgtaaacattttgcattatttcagtaattttttaattaaaaaatttattcgattttatttattttaaataaaaaatttcacttttgaagaaacaaatattttaaatataaaacaatggagtagcaaaaaccacaatgttttttttagattttcagtttgatgaacttattaatacataaaaaactttaaaatatatttaaatttaattttttttttgtttttgtcaattattcaataaaataaattttgaaaaatttgccaaacaaaattcataaattttattcaaataaattcataaattttattcattttatacgttcgttgttctgatcacgctgcctttcaaacaataagtacgcattttttgtgatcatttgttcggcgtgtcatatgtttgcacaatcagtgccttacatttgatgtgatgaataataataattaacccatccgactcaactaattacccaattaactttttcattttaaagcacccactaatgacgcgcactgcgcgacaaagggaggggggagggagacatgtgagtgtggaaggggtgcatcatcgagtttgtggttggacatgaagagaatgggttcggggatgaccgaccatttccaaactaattggatatttagtgataatcactcggttcattaggaaaatgaataattctataaagaaaatatacacgttgttctggttgttcacagtggcagtttttaataaggaattacgggatcagatattaattctcgagacttgagagaatggcaccgaaaacatcccgacacttgacaccttgaaacgtgccaacgggtttgtggcacaagtctcgggaccagggctgggcgaaacttcggcttcggcttcgaaaacttcgggttttttgagcttcgaacttcgtgcttcggcttcggctattttacccgaagtttcgggaaaaatacacccctaaagattgagttttcaatgtgaaaatgcaccactagtgattgacttgcttttcttctaatttttcaaaaatattcattttttcgacagaaatttaataaaatttaacaattaaaatcgcaaaattttttcatttttggactaaatctgttaacaatgcactaaaaatttcaaaattttcaccggcggcgcctatcggcaccgccggagctccaaaatttcctttatttttgaaatcgactcaaaaaccgtgaatattctaagaagtataaaaatttagaaaatatattgctcaaaaagttaattatatttatttatcgaaaagggttggttggtctctagaagtagttagtccaccagatttccgttgttaagttcaaaccctcttggctgcaaatgatttattggtaattaatttcgtggggggagttttaataaatcctttgttttttagtatttcctaaggatgttggaatagtttccatttaaaataaggtgtaaaaacaatttttaaaatacgtttgaaaatctgggaaaagttttttgagggtgtgagtcaatttttcaaggattgtgtattttttcatatttctaaaaaagaatcaaatagtttgaccctcctaaaatgtaatatcatttttatttttctgtttgaaatcttcaaaatttaaggtccccctcaaatgtcaggtaccaagtatcggttacataaatgttaagtcctcaaatgtctggtccccaaatgtaataaggtcataaactgtgggtattcaaatgttgtatgtcgagggtccgtaaatgtagggtcctcaaatgtctggtccctaaaaaaatgtagggtcccaaagtgtcaagtcttcaaatgtcagatccccaactgtagggttccccaactgttgtcccactgtagggtcgtaaaatgtagagtcctcgtcaactctgcaaatgtaggatccccaaatgctcacaagtgtagggtccccaaatgtcagatccctaatgtcaagtcccaaaaaaagtagggtcccaaaatgtatggtcctcaattgtaggggttacaaatatcaagttttgggtttctaagaacgtgaagctgtttttttgaaatcttacatatttttcatttaccaaattgggagtaaattttcaatttaccttggaaatctgggacagttttcaagggtgtgacatatttttaaccattaaaatttttaatattttattcacattttttataaaattttacaaaaaaaaaaaataataataataatttattctttatttttttcttaatccattaatgttaagaactgttacagtaatgacaaaaggtgttccataaatgttaagactttttcttgctacactttgttctactttgataaattggttgaagactgcgtctgccacatttgagctaataggtgttatcggcacaattatgtctccttgatctaacatttctgaagaaataactactccggctttatccgcgccacccaaagttctcttagcatcttcgatagcttcattaattgacgattttatacattcttctaactccttagtgggattatcacattggtctatattttgaacgacaaattttgattttgaccttaatagttgaaactttttactactagttgtatattcatctatttttttgatacaattttgacttttttcttgttgtttttcttgtcttagcgaatccgaacttcgggattttttattttctctttttgacgcatttctcgtagaccgtttcattttttgttatatatcttcctaagtttttttccttttcaatttctttaaaatactttgctacacccaagtctaagtttcatatctctgagcaaacatatttatattttttcctatatcccgtcctggacaatttttttttttggtcaaaattgtgataaagacaaaatttctaaaaaattttccaaggtggtgcctataggcaacgccggtgctaaaaaaatatggaagaaaattcattttggagaaaaacaactgaattgaataaaaatgttaccctttttattcttttgataactcagtagatacaatcctggttttactttaaaatagaaaaaaaagcttttttgagtgaataagtgcataaatttgtttaataattattttgtacctatttagccctattattataataagtttccaataaatttaatataatttttcctatagaaaccaaaaaaaaatgtcagacaatgtattcgccttgttggatgatttcgacatcgaaaacagtaattaaaaaatcattacatatatatacatttattatatatattatattatttttagtcgacccgagcctaaattttgcaaatgatgactggatggaggaaatcggtgaatccgttacggtaaataattatttaaaatgttttaaataaattaaatataaaaaaaatgttttttggtctaaattttttcagaaggtatttttt

SEQ ID NO: 10701 - DNA, 4389 bp, Heterodera glycines
tcagagtcctagtttttaaaccgagtccaagtcatgaaatcttcaaacaaaaatctttaaaattttttcatgaaaattaaaaaatattttcatgaaatatatttattttagaaacaaactttattatttgtccattttttccacctttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttttattttttgtttttaagtcgctttttttgtggcgctgttttttcaaaaaaacttttttggaacattgggtgcggggtccggcggtgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaaatttcaattgaaaaataatttaaagaaattattaaaaaaaattctgtgccgttggggaattgaacccaagataaaaataatgaaaggcagaaggtttagccagcaggccatttttaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagtaccaaaaatggcgagagttggcgagagacgagagttgtcccacccctgctgtgcaaccattttgacaacatttggccagcagaaattgtggcatttggcccatcaaaatcatcaacagtcgcatcgggcaacaaatcaccggaatagattgaattcaattggtcgagatcggtgagaattgaaggcgaagtgagacgacgcaatttgtcaaaaaggatgccattgcaaacgcccaagtggcgaatgtttgccgaaaaaattggccaaatttcacgcataataacaccccaaactggctgctcatctgctttgcaaacgcagtcaagcgcaaattggtgactttgttccaaatttgctgattggcgcggagaaatgcaatgacggaatggtcgatgtaactgcaaatggaatgaatgcttttattgccacataatgaatgcttttgaattaccaaatccaaacggatttaaagcaaattttgttgggcagcggacggttgggcaacggaaatggcacagtttttccaggaaggatgcgcacagctaattctggcaccgctgtggcactgtgcttgcgaatgatgatcgttctccaaattgtcaattcccttttgccatcaaaatgcgtgtccaccagcaaattgaaacggggcgaaagaagtgccaatttgaagccgagttgagcatggtcaaaaaacggaaaagtgtccaaccaaacatcgctgcaaacccaactgaattgtggaaacagtttagttgaataaatgaaatcaattttgtaacttaattaaaattccttaccgccggttcatttttgtggcaattagcacaatttgtcgtatttcaaatgatgccacacaaagggcagaattagtgcgttggaaatgtttttttttgtaatgagaggaaaatcgaaaaaacaaacatttttatagtcacaaaaaaagctggaaggactaaaaagcacgaaacatggactaaatagctcaaaaatggccaaatatggaccaaaatgtggattaaaaattgctcaaggttgcagaaaatggcctggatttggatttaggaaaaagccaagctcggaccgaggtccaggtcaatctttaactgatatgtggaaaaaataatcctcttaacaacctaatgtaagtaacaccaacacttaattaaaccattttgacaacatttggccagcagaaattgttgcatttggcccatcaaaatcatcaccaatcgcctcgggcaacaaatcaccggaatggattgaattgagaattgtcggcgaaattagacgacgcaaattgtccaaatcatcaccattatgctttcaattcgtatccaaaaataatgtacggttttgttttgaaatggacagaattatggtacagtaaatcaagaatagttagaattgattggactcataaactctcataaaatgccaatgatgagttataattgcaattgaatcatcgtttttttcagtcttctcgacgccgcttctcccgggccgagtgatcagcagaagaaagatgcatgaattaattaatcaattaattaatcgattattgattgattgatgcgattatgtgaccgaaaatgatgtgattagagctcggcctggacctggatccaggcctggatttttcctggatccaggtccaggtccaggccatttttcggcaacctggatttttcctggacctggattttcctggatttttgtccaggaaatcaaggtccaggtcaaatgtgaaaaaaaatccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaatatttttttttcactgattgcagttgcaaatgagggtacatttcttttccaatattttcttagcaaatattgacaatttttaaattaaaaattttgtcaagaaaacaaaatttgggggagaatttttgaaaaaattttccaattcttagtggtgtatttaaaaaaaaaaaaaaaattatttttggtcgattctaggggtgtatagggaaaaattttaatgctgaaatgcgttttttgagctcctttcttcaaatcaatcgagcaaaaaaaaaaagttttttcactagaaatcgcggccctatttatgtttatgttgtaattaattcattaattgtgagtaatcgttgataaaattgctgatgataaaatggagttgatttaactgtgccaacacaataaatgccatggcacaacaattttagccaaaattttgaaaaaatcaagtacttgacgaaaaaacatagacaaatgcaatgattttcaaaattcgagctcgtattctttatcagtgcattttttactagagtgccacgggaccgtgaattttgggcaaacccgggaccgggaccttttcgggttgaaaacccgggaccgggaccttttcgggttgaaaacccgggaccgggaccttttcgggttgaaaacccgggaccgggaccttttcgggttgaaaacccgggaccgggaccttttcgggttgaaaacccgggaaaaaaccaggactagtcccggtcaaaaccgggaccttggtactcagttgtactcagttgtgcgctaccaggtcccggtcccgtggcactctatttttgaccatagaaaaagtgattttgtaagaaattttttttaatttattttttcgggcggaacacccaattccgaaagattaccaacaaaaagatacaaaaacttcatcaattccttttaatgactataaaaatgtttgttttttcgcttttcctcgcatttgaaaaaaaataaattttctaacgcaataattctgcaattattcttccctctgtgacgacgacatcattcggactcggccaaaattgtgttaattgccaaaaaatgaaccgacggtaaaagaattttaacagtcacacaaattcatcatttatttaactaaactgttttccataatttcagttggatttgcaacgacgtttggatggacattttcccatcctttgaccgtccccaactcggcctcaaattggcacttctttcgccacgtttcaatgcgttggtggacaaacatttcaatggcaaaagcgaattgacaatttggagaactatcgaaattcgtcgcaaggacaaaggaccagaaccgaaatgaaatttggccaattttttcgacaaacattcgctgtttgggctttaccggtcgtgatcatttggacaatttgcgtcgtcgcacttcgccgacaattctcactgatctcaaccaattggtttcaatcgattcatttggtctgttgcccgctgcgtttggtgatggttttgatgtgccaaatgcaacggctggccaagttctgtccaaatggttgcactctccgcgaaaagatggccaacccaagcgattgcgttgcgaagattacaacgcacaagggaacaccaattgggtcaacaaattcaagaaggtgtggccccacc

SEQ ID NO: 10702 - DNA, 1393 bp, Heterodera glycines
  misc_feature (1215)..(1215): n is a, c, g, or t
  misc_feature (1310)..(1310): n is a, c, g, or t
ctttgtacaaatctctccaattcacaaaatttctccagtttttcgcttgaatcacctcctcttttcattcccattcaatttttgcgcgacctccgccaatccgtccatcaacccaaatccgcaaattcacagctcaccaaacgcacacaaataaatgcgcacacacacaacacagcactaactgacatcaatcaaatgattccgcaaatagagatttatttccattttaagtttatgaataaaattcacttttatgcgagtaaaatgtaaaactggcacatttagccatttttgagattttaaattaaataaaaaagcgactgatgaaatttttgaggagttactctttttggaattacttttaagattattaaaaattctttattttatatttaaacagtatttacatattttataaatctcaattcacattcgttcataagccttgaaaatctcatacatttccaatttctgtgtaatgaatgcccaatcattgatcacaacatttaattacgcttttttgttggttgatggcttattgtatttgcgcactattcaataaaaaatgaacaacccaacaaaaaacaaattgtatgaatgaattcatacaaaaattaccggaattttcttcctttttccccaaactcaccggcccctcttgagcacataccacggacgattgacgacgaaatgatttttgggtggagagttttgtttacccctcccggaaaatgcacaaaaaaaagacgggggaatagtggcggaccaacccaaaaacattttcattatgtgtgcactttttgtgcgcgttctcgagatgatcgcatccatcatcttctgcagcagcggggaacgggaaagtcgtcgagggttgggctgatcagcgttttcccgggcaatccgattgatctgtcgtctgatttgggtttgaagacagagtgttgttgtgatcagtcgctccaattatatgagtgaacgatggatgctatgactttatccaaaaaaccatcataataattttttcttatgactttgacccagaagcaacttaataatttaacattcttgagatcgttcgatagaccttaaattctttattaatcataaaaattacagtttttgttttaaaaaattattgagaaaagtgttcaaaaacccagattttttgacttcttctggccaccgactgaatgatgttctgataagtaatctaanatattacatttaaactcgtaggattatcaaactgatatattgaaaaaatcattttttactggggaaatcttgaaaattttaataaattttacatncaaaatggcatttttttattgatttttatcgaaaagaaaaattattatttaatttatgatcaatcaaatcatccttaagctgc

SEQ ID NO: 10703 - DNA, 1994 bp, Heterodera glycines
  misc_feature (1978)..(1978): n is a, c, g, or t
aagccttgaaaatctcatacatttccaatttctgtgtaatgaatgcccaatcattgatcacaacatttaattacgcttttttgttggttgatggcttattgtatttgcgcactcattcactaaaaaatgaacaacccaacaaaaaacaaatttgtatgaatgaattcatacaaaaattaccggaattttcttcctttttccccaaactcaccggcccctccacataccacggacgattgacgacgaaatgatttttgggtggagagttttgtttacccctcccggaaaatgcacaaaaaaaagacgggggaatagtggcggaccaaccaaaaaacattttcattatgtgtgcactttttgtgcgcgttctcgagatgatcgcatccatcatcttctgcagcagcggggaacgggaaagtcgtcgagggttgggctgatcagcgttttcccgggcaatccgattgatctgtcgtctgatttgggtttgaagacagagtgttgttgtgatcagtcgctccaattatatgagtgaacgatggatgctatgactttatccaaaaaaccatcataataattttttcttatgactttgacccagaagcaacttaataatttaacattcttgagatcgttcgatagaccttaaattctttattaatcataaaaattacagtttttgttttaaaaaattattgagaaaagtgttcaaaaacccagattttttgacttcttctggccaccgactgaatgatgttctgataagtaatctaaaatattacatttaaactcgtaggattatcaactgattatattgaaaaattcattttttactggaaaatcttgaaaattttaataaattttacatcaaaaatggcaatttttattgatttttaatcgaaagaaaaaattattatttaattttatgatcaatcaaatcattcttaagctgcagattagatatactaatcattgatctgatgttttacagaatcagatcagcatacttttcactctttcagggcagatgatcacactttctgatcaaaccaaatatgattttataaacgggcaaataattcagcaagattaagattcaataagtattgaatattttttttctccgattaaaaaataaaattttatgaaactgaaaaggcaaacacagagcgcatcgtatcgcaacttttttttctttttttttaatatttattttctaacccataattacgcattgttctcataaatatttcaatttcacagatcataattaaaaattctttttaatatcaaaataattactcgcgcatatgtttgtcatatgatcattatggtattcattaacgaaacgaaataaaaatctttttgaattttaaccgatcacaaacaatcacaatctcagagcacaatttcgggcatttcgctcactctaaccctaattggtcccattagttcctatcccctaattttttggtccccttcccccaagcacatattcgtcgaattctcgagaaggagaaattctcgagattaaccccactctttccacctgttaacggttcctcccccctcttgaaatttcgccgctcgacgaggccgtccaattaattaaattattttcgttgctcggccgttgatcgatcacctgttgcgctgctggtcggcgccacttttgatcaaatcattcccatgtttttgctgtttgtccttcgccttcccgcgcttcatttttcgaaatggaccactttttctgatcacatactgcaacttttttatcaacagatcaaagtccatatcgtcattttgtttaatgtcatccaactgtaatttcccgttatttctcttttttttgttgtattttttcctttcaattttttgtcctaaaaacaccaaccaatcggacgactgaattttattaatcaaaaatccattaggagcaaaattttctatcgtttaaagatggggccattggacacactgntattgcatgacatttt

SEQ ID NO: 10704 - DNA, 1015 bp, Heterodera glycines
ggggcttttagcaggaacttttagtgagtgagtgctatgtgacaattctccccccgccgggctcttcaaccattccccccccccccactaatggcttcgtcagcctcacagctttctgttcaacaaatgggacaaaggaagtgcaaatgctgcaaaaagctacttatgcaatttgtatgtacttataaactatttataatattcacattgcattacattataatgtgttgcaaaaatattttagaaaaaatttttagcggctttttatcgtaaaattcactgacaataatttttattttgaaccaattccaacaaatgaaaaactttaaaaacttttaaatgcacaaattgaaattgaaaaaaaaactattgagctttctgcattaattaaattcaaaacttcaaaatccaaaaaaatttcattattccatggtttcttttttaacacatttcttttttaatttctcttatgtcccaacaaattggcctttagaaataaacctttttcagaagtatgtttttgaaaaattttaccataaatcatgccattgtaaagtaaatttaacttaaaatgatttcagtaaaagttttatttaaatttatttctcaatccctcttttttaattgctttattttaagtttttcttttttgttttcaatttatttaacgttctccctttgtaaaggcgaattttaaatcttcaaacaaaattgaaatttgcaaaaaataatgttgttgacaaattgtctccaattatttgagcgtcttttcaaccggaaaaacgaaaattttctcccctaataaaccacatgacaattgtcggtgacttttctccaccaaaaagtgctcctccgccccctccccccgaaaatttctgtttgaatttgacccccgaggagaattgctggggggcacttgtgttcatttttaagtatttttcaaggagcgcgaaaacgggggcaacttctgctggggaaagcatttgggcgagaagaggggggggggggggggggg

SEQ ID NO: 10705 - DNA, 1248 bp, Heterodera glycines
  misc_feature (1134)..(1134): n is a, c, g, or t
actagaattgagcgggaccgggaattttgggcatacccgggaccgggaccttttcgggttgaaaaaccaggaatttttggctgggaaaaccggaaaaacttggaccagtcccggtcccggccaaaaccgggacttcggtactcagttgtactcagttatccgtgtttaggtcccggtcccgctcaactctaatttaatcattcagtttttagtttttgaaaagatgcttgaatttcaagtggattgcttctaaccgagacttgagattttttgaggtaggcttatatatatagagaagaatttttaatcattttttcattttctatcagtgagttcagttcatttctcaggaccttctttcatatagaattcagatccaagcatatgccgtgcttaaaacccctttattttttgtacctgttccccaaacatggctcgcgaccctttacattactgacagacgattcccgaatcatcaattcttgctgatcaaagcagagttgggcaaatgcgatttttctgtaactgtatccatttgctaaaaacccatttaaaagtaattgaaagtttttgcaacaataaattttacggtgccgaactcttcttgcggttagtctctaatccgagtcggtgaaatgtgttcgatttgacctttttcgaacctttgcatccatccctgaccatggatattatttatatttcgtgcccagtctccgccgatatttcttccccaaaaattggtgatcatcagtatttatttattttacagctctttataaaacttctcaggtcctttatgtttcccttacagattagggaattaatataaatcattcaattcgtttttgtctaaacttatcaatcacccattttatctgtcctttcgaactcgaaattgtaactggctgatcaattcgattttttgtcttttaatgacactttttacgtccgcccattccgcttctcctccttctctttgtatccgtctcattttattcacatttattgctttctgcgcaactgagcagagcggagatcaaagggtgactgatgggggggggggggggcttttaggatttggagcggatcggctggcgctggactaagcagcctcagcagagcagagacttgagncggggtcgttttgtcgctgtcgtcgtcgcccggaagcagttcagccaggattagaagagtggctggttcccggggggaggaaattggtggggggggggtgggggaggagaagca

SEQ ID NO: 10706 - DNA, 3885 bp, Heterodera glycines
  misc_feature (3821)..(3821): n is a, c, g, or t
  misc_feature (3860)..(3860): n is a, c, g, or t
aaaaatgtctggagtaattaggagtaaaatccccctcctaaacagagttataaaaaaggaaatagagtcggccaaaaccaaattggaggagggcaaattcgaatatgatcagaataacacagacgagtgcctacgggtgttcaataaaacaaaagaaattatacaaaaaattgagccaaactttgaaaaattaaaaactttgcataaaaaatggcaaaatttgatgagaaaaatggacaaagaacagtggaacaccgaatggaaaatccagaaaatttttcgcgaaaaacatgattatttaaagacaattaaggaaacagacgaaatcctcgacactctgaaagacataaaattggaggtaaaaagaagacttaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgatcaaacaaaccgtaaacaaacaccttttgtcaattatcgatcgagaataaaacttccaccccaaactctgacacacttctccggaaaattctcccaatggcccagcttttgggacgatttcaaatcctcagtccacaatgacccaaacttagagaacatacaaaaactgaaatacttgcgaggacttttacatgacgaaccataccgaattgtgtccccttaccccctcacaaacaaaaattatcccataatcgtcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactttactcgacaaaagaattaatgaattttctcaattcacacactcaagctcgtgaagacatagaacgaatggaagattcaaacagacaaataagaaatttcccccctcaccggccacctcaaaacagaccacaaaggcaatcatatccaaactattcccaaccccagctaaaagcaaaccaccgaaaccatcaaaatctgcctctctcgccctatcccatcacttctgcattaacaaccaaatcaaaacctgtccgtttggcagaatttaaaccaaaaccatcgcaacccaaaccacaaacaaaaataaaattttgtcgattctgtgaaagagacaatcacttgagcaaagaatgcaaaatttattcaaccacggaaaaaagaagtaatcgagcgcgcgaattaaaactttgtctaaactgtctgaaaaaaggacatcatttgagagaatgtaaatcatcattttcatgtttcaattgcaaaagcaaacacaataccctcctatgcacccgaaagcaaaaccaatataatcaaagagaaaaatttacaaaagtaaacgtcacgcaaaaccccgaggaattcgaagaaacccaaacatttatgtcaatggattccgatcaaaatcagaaaattatacaaaatgatgaagaagaattgcttatgaccacggaagcaccagtcttaaaccccgaccaaaacaaaacacaaaacgaagtaattttcttcgataatgggtcgcaaaaaagctatataacagacgaatgtgctgattctcttcaattacccacaatcgaagaaaaattattggccatatccacctttaaccaaaataaacccaaaatcatttcatcaagactagtcaaaattggcatcaaaacactaaacggtgaaatcgaatacgtaacactacagactgtggaaaaaattactgaaaaaatggtcaatagagagactgttgatatattcaaaaataaaataccgataaaccatgcctatccacaaattctaattggtatagaccattcttggcactttatgctgccgaactcacaaattcaaatactcccctccggattttactcaatcgatacaaaattaggaaaaatattatccggaaaaggtacgattgaagacacaaatgtcaatcttgtgaaagaaaaacgaaaaaaggatgagacaaacgaaatccttcaaaaattttgggaattagaaaatatcggaattaccgactctccgcatttgacggacgaagacgcagctctcatacactttgacaaaaatgtcatttttgaagaaaatcgataccatatccgatggccatataaacgagaaacaccgaatttacccacaaattttggattatgtttgggaagattaagaaatgtcgtcaaacaattgatcaaaaataaacagttggaaagttataataaaatactgcaagagcaaatggacactaacgttaatgaaattgccgacttcaaatccaaaaatttaattcactatctcccacatcaccccgttataaaagagagttcaaataccacaaaaattcgaccagtttttgatgcttcagcaaaattaagaggaagcaattcactcaacgacgaaattcaccaaggaccaaaattattacctgatttatgtggaatgattctccgattcagactcaaaaatttcgtcttattaggcgatttagaaaaagcttttctaagagttggattaaatgaaacagacagagatacaacacgctttttatgggtaaatcaatcatatttggacgaaataaaccaaaaatatcgagaaatcgaaatgagagacgtagaattaagacgtttcacccgaatacccttcggagtcaatgcttctccgtttttattaactgctgttgtgaatcttcatttatcaaaaacagatgaaatgtttgaaaagtttaaaacacagcaaatagacaaggagttatgtcttaatggaaaagaaaaacaattcaaagagctatgcacagaactgaaagaaaacgcatatgtcgacaattttgtaatgatgtgtgatgacgaaaatgaaataaaattcaaacattactggagcaaagaaatattcaaattagcatccatgaatttgagagaattcgtgtctaatcacgaacaaagcaacaaagaaattcagaaattggaaggatctgaaataccaaaagtgacaaaaatgttagggataaaatggaatgttgataccgatgaactcgaactccaaataaaaataccgttaatgagtagagagacacgacaaaaaggcaaattttgaccatgatcgcaaaaaatttcgacccaatgggttggctatccccagtaatactcaaatacaaactatttttccaaaaattatggagatcaaacaaagactgggacgacaaattaaatgatgaagaaataagagaatggaacaatatttcaaatatagacgaagtttccataccacgctcaccatttacaagtcaaaatttaaaatgtgcttctttacaccttttctctgacgcttctgaattagcttacgccaccgccgcatatttacacgcaaataataaaactgacttattattcgcaaaaacgagacttactccactcaaaggactaacaatcccaaagcttgaactattgggactattgatagccgcaagagccgttaaattcatcgttaaagaatcaaaattaaaatttgaaacgatatatatctggtgcgattcaaaatgtgtactaagctggttaaatgcaaaaagatttaccaatatttgtanaaaacagagtggaagaaataaaacgaattgtatcagaantccatatcactttctattacgtaaa

SEQ ID NO: 10707 - DNA, 2000 bp, Heterodera glycines
  misc_feature (27)..(27): n is a, c, g, or t
  misc_feature (1992)..(1992): n is a, c, g, or t
aaagaaaacgcatatgtcgacattttntaatgatgtgtgatgacgaaatgaaataaaattcaaacattactggagcaaagaaatattcaaaatagcatccatgaatttgagagaattcgtgtctaatcacgaacaaagcaacaaagaaattcagaaattggaaggatctgaaataccaaaagtgacaaaaatgttagggataaaatggaatgttgataccgatgaactcgaactccaaataaaaataccgttaatgagtagagacacgacaaaaaggcaaattttgactatgatcgcaaaaaatttcgacccaatgggttggctatccccagtaatactcaaatacaaactatttttccaaaaattatggagatcaaacaaagactgggacgacaaattaaatgatgaagaaataagagaatggaacaatatttcaaatacagacgaaatttccataccacgctcaccatttacaagtcaaaatttaaaatgtgcttcattacaccttttctctgacgcttctgaattagcttacgccaccgccgcatatttacacgcaaataataaaactgacttattattcgcaaaaacgagacttactccactcaaaggactaacaatcccaaagcttgaactattgggactattgatagccgcaagagccgttaaattcatcgtaaaagaatcaaaattaaaatttgaaacgatatgtatctggtgcgattcaaaatgtgtactaagctggttaaaatgcaaaaagaatttaccaatatttgtaaaaaacagagtggaagaaataaaacgaattgtgtcagaatttcatatcactttctattacgtaaaatcagcagacaacccagctgatttggcatcaagaggtacaacaatgaatgaaatgaaatacaacgaattatggtggaagggaccaaaatggcttaaattaggaaaagaaaactggccagcccacagtttctatactcctgagcaaaatgattcactttatgatgataacataatggaaatcgaaaacactcagacaaatttagtcaaaatggactaccaaggatttattgaatggaaaaaatgcaattcatgggataaagtgacaagaatttgtcaaatattattaaaatttgtattttttacattaaaagactctcccgaattcaaaactaaattcaaaatacagaaatttcaaaacgaattgagcttaaaattcatggcacaaaaaatgctaatacgcataattcagaaagaaatggaaccaaataatgaagaagagagacaattaggaatttatagagacaatgacaatattttgaaatgcggaggaagattgaaaaatgcacagataaaagcaacaaatccaatattcttaccaagaacacattttggtactcatttaattattatggaccatcaccaaagaaatttacacgctggaacaatgacaacattagcagaaattcgtaaaacatattggatccccaaaggaagaagaattgttgaccaaataaggaaacagtgtttctattgcaaaagatataacgcaaaaccatatcagcaaccaaaaatgcctcagttgccaaaatcaagagttcaaataacagagccttttcaaaacgttggcctggattacatgggtccacttcaagtaaaaagtttcactgaaaaatgttggataatccttttcacatgttgcaccacgcgtggaatacacctcgaattagtgacatcattatcagtacaacactttctcaatgcatttcgcagatttatttcaagaaaagggacacccaaaaatatttggagtgacaatgcatcacaactgaaacttgcctcaaaagtattacctgaagtcctaaaattaaaggaaatacttaaagacgactcaattaaaacttatttcgaaaaggaaaacataaaatggattttttcaattgaattagccccctggaaaagcggagcaattgaacgtttaaatcaaaatgntaaaatca

SEQ ID NO: 10708 - DNA, 2070 bp, Heterodera glycines
ttttcatgctttttgttggcttttctgtttcgcaggcttttcttttcttagctattaaaattgtttttatttttcatggctttttgttggcttttacttttcgcaggattttcttttcttagctttaaaatttattttttcatggtttttcgtttaagggcctggcttttggtttacttttctttctttttttttttttgcctgcttttcttttcttagcttaaagttttttcatggctttttcgtttcattaattgtctttacgattcgttaaagaaaacggacaagaaatcaatataaaggggagaaatggaatgaaaatgatgggctggtggatgagaaaagagctgcgggaggggagaaacatttgaattgttgaagaaattcagacggggcattgggtcgtctgtgcagcactccctaagctgaatggcgaaagaatttcgcctcaggtatcattttgaacggtacgctcccaacgccccgccccctcgcgaaccccaagacttgcgcagcataactcccgcaccccttgccctattgacttcacatttcgcacgccatcattgcaccaccccctagactgaacggtgaaagaatctcacctctatcgccattttgggcgaaggtatcacgacgacacaccctgtagcaaaaaagaaattgataaaacgaaggcaaagacttgttcattcgaaatagcttaaagatatcgactagagagaagacaggccaatgtcgcgcccagttgtgggtaaaagtgtgttgtcatcatcgtcctccgtcgaattggtcgaccgttccagtaattcgccggtttcctcttgctgcgtagtcatcaagcgctgtttgcgtttcactctttcgaacagtccgttcgttgttaacctgtgaaaagtgccgtaaaataaaacaggaaaaagaaacttacgcaacgccggcctccacatcgcccccctcctccaggtttattctcaaatatgggttacttttccggggcctgaacttagctccaacgaggcaaaagaaaaacaaagacgcaagttcagcagccgcctcggaaacccaacgcttttcgtccggcaaaaaatactaaaaaataaaatgcttgtgagtaatttcttttttttttactttatgtgtataaaaaatgatttggacatttaaaacattccacagtacttcaagagtgaatttggcaccacgagttgtgtaaatgtaagcaatgacatgcaaataaaagcgacggaacagccgaagtctttcaagactaaatgccgccttcccatccgtcgtttttgcggcacactccgtcagaaaggcaatagaccttaatttattacttttcaaatgaatatgttcgccgcttccctatcgtcatttcttccttacttttttctatcgtttttctctcccccctctttcctctgtctctctcatcctctctgtccctcttttctctctccctacccttcttttctcacttatctctctgtccctctttttcttcattttctctgttcctccttttctttttccctccctctctctctcctcttttgtccccaccacaaaatgggcaaaagaatgctcatgcagcagacaatgtccaggaaggtgaacatctccagccagaacagatagcgttggtcgctgaactccgattcttccagaattatcattgcgatgttggccaaaatttgcaggggcaacacgaaaatgaacagtcgcctgtctctgtcactcaaaaattgctgtaaaaacactcaaaataaacgacaaataaaatttgaaaggaaattcactttgaaaaaagtgtaaccggagccaatcagaataattgtgccgaagagaagcgcacctttaagcctaaaattacgaaataagacgaaaaagaaaatgccattctcacaaatgcgtgacgtagtaaatgatggcccaaagctcacgttcgtggccataaacagagacaaagtaaaagttgacgccgtggaaaagcaaagtgagcgatttgaggaagacgagcaccaacatgagacgatgcactttgaaaatgttgttgctgctaaa

SEQ ID NO: 10709 - DNA, 1876 bp, Heterodera glycines
gaaaaataataccaaaacagcaaattttattatcatttaaaattttcggtaggaaattaaggaaaactctcagaatttctgaaagggtcggtcctaattttgtgattaaggagggacattttctcataaaatgcgattgaataaaaaaaacaaacaaactccgatttgcacaataaatttgcccacaaaattgtggccaacgcgaaaagaaaagcgaaataaacgtaaagagacggcttgggaatgtccacaaccgacagaaaagagttgacatttttctcgacaattatcgccttaaacatttaattattttcttttttcccaacggaaatcaccgccaaatcgaccgccacgcggtcgctgtatccatgttcacgataattgaagcaattgtggaagaacaggaagaaaaagcccttctgttgttcgttgaaacggacagcgaactgagagaaaaacagtcaaaaaagaagcgaatggcggaaaataacgaaaatattcaatttttaaaaccaaatccatttcctctcctccttcccttccccgttaatcacctgagtcgaatattggccattatgaagtccgattggcaaatagtcaaagtatggcagcttcaaatcgttgctggaggaagaacccccaaacaaatgggaaagaaagcccccggacgaagccacgacggaagaggtcgaattgcgctgaacagaaattggtaagggagaaaaaagggggggggggggaaagaccgtttcgccatcctccgaataggggcagctgaaaagagcaaatccgtgacaaatattaaattttatgtcctttttttgtccttgccttgacaaattcgtgcacaatttgatgcttttgatgtgtccagaacgaacaacgaccaaccgttgggcggtgaaatcgaaaacgaagaacagcgagtcaatgccctggtcctgctgttgcagttggcacaggtgcgggttggtctgcacgccattggccaattcccggccccggctgagggtgaaaccgatgatgccctaaagcactgccctcggagaaataaaaaaaatgcttcataaatcagtcaccaatttgtcctcgcccccgtctttctgtgtttgtttgagcactgcgtccggaacagtgaaatttgtcagcgaaaaggacaaagtgccgttggagccgaagccaaacttggagagcaaaatgttacgccgcgaatcgtcggttagcgaaagggtgtgaattttggacaaagagaaattgagaaggcaaaagagcggcaacaaatgcagcaaaagtgtcgaaatgtgcatgaaattcatacactcattcagatgaataaactgtgtaaaaaaaattggtcgggaagctgatgatggtcaacctgacccgatgatttttcggccgacccgacccgaattgcgacacgatatttggacccgcggcacccttggttcttaggggtgtatttttcttttttttttgcatttttgggtaataaatttgggcacaacgccaaagtaggttttttcaaatttttcaggccacctgggagcttaggaaaaaattggtcctacacctcaaaattttaaaaaatgtcaacaaatttgtgtttgtttctttggcgcgaggactataaaagacccaagtggacccctgtgaagaaattttgcttcagatgttgcatttaccgtacttgctcgattagacccccctctcgaataaagcccccccccttttgaagggggttgaacaatagggcccccctctcgattagaacccccctatcgattatagcctcccccaaataaaaaaaaatttttttcccaaaaagaattcaaatttcctgcctatttttaagtaagttggtacactatgggtc

SEQ ID NO: 10710 - DNA, 906 bp, Heterodera glycines
  misc_feature (39)..(39): n is a, c, g, or t
taaaattttgaatttaaataaaatttcagattttttggncctcggaaatttcggcgaatatttgaaaattcataacttgcttcaatgtggatcaattatagtgcaaaaaaactctaaaaaatatagaaaaatctatagaatttaatgctttttttagaattttctattcaaaaataaaaaagttgttacataaaaattcgatttttcagaaaaaataatacctaacacagttcttaaaaggattttggaaaaaaacatacctaataaaaaatccgcaattcttcctttataagactgacttaattgaattcatattttcatagatttttgaaaatgttacaaaaataaaactgattttggacaaaaggggtgggatgggggagcacatggtttttgagtggaaaaattgttttcaccaaaatttagcaaaaaaaacaactttttattggtaaattataccgtaatcacgaatctaaaatcaattttcagtaaaaacttagtaaaagtctcagaatctattcgtatctgtggattctgagtggatgggcgggggtcaggttcggacccagtctatgtaataatttttatacattttggttatttcttttcgatttcattttgatttaaatttttacgacagttctaattttggcgtactatttctttatctctgttaatagagaaaccccgaatttacttcatgctgtttaaaattttttctacttgttaaatccgcttcaaattttgcataacgatagagaacaaaattacgaacaaataatctaagggtttttaaaagcaaaaaagaagggttagctaaaaagttattcaaaaaacaaaacttcgaggcctcatatctttttcccaatactattatattgcttagaaattgcttagaaaaagctt

SEQ ID NO: 10711 - DNA, 2701 bp, Heterodera glycines
tccaaatttagcaaattctggccaactcatagcaatttcttcccattctttaattgtgctgctggccctaattaggacggacggcctgagtaaattttgtggtgtgtgctgatcagaatgttgtttttttgctcatcacaaatcattatattactaagtgtgttggtggtgtgtgatcaattttctcccgtcggtgcgagaaagcgaaaattaaaccgcctgtcgcgctgtctgcacgcaccgctggggcttcgattgggcagcatttgtgtgatgatgatggaaaatgtgaattcaaaaaagtattccttaatctttttttggtgtttttttgaaatcttttgaatatgatgaatttatgggttttgtatactaaaaaacggttacaatgctataaatttgtttgcctatcgccagacgcccttgtgaaaaagcttgttttttaagaactttagtcaaaattaacgaatataaacaaaaagaaatgattcaacaaaagaatggctcaaaaaaagcgaagaaaattttcacagattttgacagaaaatgttcaattttaaaatgtataataaattagatttattaattttttacttaaaaatgattagcaattgttagaatttggtttttaattttaattttttaaaatcaaattaaaaaaatcattgaataaattttagaattttcagatttatggcattttaaaagtaataaaatttgaatttaaattaccttacaaagcaaataaattcaacgagcagttgggcactgcttcgcggcgccaaccgctctgttttaatttttcaaatgatttacaaatgcttctctctccctttctctctcactctcctgctctctcacatctctctctcctcccctctctttccttgcacttttccccctctctctcacttcccctctgtccctttctttctcacgctctcctcctctctttctccctcagtctatatccccctctctcggtctctctctcgtccttctctctccctcttcccatccttctctcctcccctccctctttctcctcccctctcctcatcctctctctacctttctatctcactctcctgctctctcacatctctctctctccccccctctctttcttttcacttttcaccctctctctcacctcccccctctctccctttctctctccctctgcctcattccatccttctctctcccttttccctctctctccctttctctctcactctcctgctctctcacatctctcttttactccttttcactcttccctacgcactctcgcttcctctcttttccttctttctctctatctctctttctttctttctctcacagtcggtctctttctctatcaatcttccctctctttttctttcggtctctcttcactctctctctctccccacctcactcattctctcgtttactccttttctctcgactacaacactcgcttcctctctttcctttctttctctctctctctcctcatctctctctctctctattttccttcttttctctctcctctactcactctctcgctgcatctctttcctttttcactctcttactctctatctctctcactccatctctttctctctatctctcttccctatttttcttttctttttctctctcttttctctcttcactctctctcccctcctcactccctctctcttttactctctttcaccctctcttccctcctcactctccttatcctttcctttcttctctcatcaacacactctctctttatcattttcttctttcataactctctctctatcttttcctctagcgttccttctctctattccctcccttctctctttctctatttgtgtccctctctatatcaacgttatatctctattgtttttctttctttatattcctttctattcccctttatcttttttcctgtttctctctctttcactctctctatatatatcttttcctcactatatgtctctcttacttcctttctctgtctatctctttcgctctctttatttctctttcattctcttttcctctctctttatcgcctcacgctcatacactctctctctttctagcttcctttctctttccttttactttcgcattaatccttcactttacaccagggatggagttccgaggcactaaaaattttcggaagtcggaagtcggaattccgatgccccaaaaattttcggaagtcggaattccgaccccaagaatgtcggaagtcggaatttttcaaaaaaaaatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttgggaaagttacacactttttttgcggcgcgctttatccaaagagaatttgagaaactgtggggaaggaagggtccggcggtgccgataggtgccgtcggaaaaaaaattgaaaatttctatgcaatttattaacataaattgtacaaaaattgctaattttttgaaaaaaaactcaaaaaaattccgaaaaattccgacttttcatcaaaaatttcggaagtcggaagtcgggattccgaggccccaaaaatgtcggaactcgg

SEQ ID NO: 10712 - DNA, 1233 bp, Heterodera glycines
cctctctctacctttctctctcactctcctgctctctcacatctctctctctcccccccctctctttcttttcacttttcaccctctctctcacctcccccctctctccctttctctctccctctgcctcattccatccttctctctcccttttccctctctctccctttctctctcactctcctgctctctcacatctctcttttactccttttcactcttccctacgcactctcgcttcctctcttttccttctttctctctatctctctttctttctttctctcacagtcggtctctttctctatcaatcttccctctctttggcgcctttctttttttgagtgttttcctttttgctttaattcgtttttcattgcaataaacatttgtacaatttctaatgtttcttcatcagtttttgatttataacatttatttggcttttgattaagccctaattctttaatccattcataaattttgttacgatttgtgcccaattttcttccaatttttctttcaattttattccattctttttttggatattttcttcctttttgcttgatattttctttaattttgtaatatttttgaatgatttcacttttcttttgatgattttccatctctttttcttcccatttttctccaaatatttcgtcaaatgacttttgttgcatttttttcttttctgttccaattttttcggcaattaaaataattaaaaataataaaagacataatttcattttcaattgaacaataaaaactcttttaatttatacaatttgattacggaacaaatttttgttgtataaaatgaagaaattcagaaaattattgccttcggatcgattacaaatatctgtacaaatataaaaaatttggacaggcagaaaatttcattaattacaacaaaataatgaaattgaaatgctttgccccaggacaaacatgaaaaaccaggacacattttgaaaataagaaacgcttttgattggaaaagtcattttttcgcaattaaagcaccgaaaagttttccctaagtttttattttcaattttatcaattagtagttagctttttggaaaaatttggcacaccttaattctagtaaaatgatcaaaaggtgctcaaaaatcatcaggattgctgctcccccaattttaaaggggtaattcagagagaagggatgaacttttttttgagtttctgacctggaatcaa

SEQ ID NO: 10713 - DNA, 2082 bp, Heterodera glycines
  misc_feature (2063)..(2063): n is a, c, g, or t
taaaaaatcatcattttcaagcttcgtgaattttatttgcctaaaaaggaagcaatagaaaatgagtgccagaaactgattcttcgacctgaaaagcgtataattcaacttttcattgaaaaccttacttttttaatcgagttcaaacttgatttttttcatccctgatagccagggcccggatttttaccaaaagaacaagttttcttaaatttaatgctgtttaagaagtttgaatccgattttggacataggcgcaaatgttggggctctgcgcacactgctggtgctatctcattactcaaaaaccatcaaaatattaaaaaaaaatttgttactgctcaaaagcaaccatatgtattttaattcttgatatcattcgatagccttaaaatgttctctgttacatgccaaagttcaaaaaatttgttaactttccacaaaattatgaccaaaaatgttttaaaaaactatgtttttcctttggccataactagggcatacaattatatgcacatgcatattttttcctgaactgcgggaggcctgaaacgcatgaaaaacatgtttttagcttgattagaagcttctagagtggatttccatatgcatattttgcatatttgtgcatatttcgcgatttatgtgcatatttgggcattttttcaataaatcctctattaaaacggccccctctattaaagcggccatttgggctctaatgactgaaaatttttcaaaaatatcagatttttgggtatattttctgataaaaaaagtaactttttaaaaaattggaactttatgccaaaaatagtcagaaaatagaaaattctccatttttagctcaattttcttcaaaatatataaatattacttttttggttttaaaataatcattcatattatttttagctattttcgggatttttatgcttaaatttaacaaacttgaagaaatttgaaaatttgccctcaatttggaaaaatttatgtacatatttttcactttttatgtgcatattttgcaattttttgcgcataatttgcgattttatgtccatataattgcctgccctagccataaccctttaaaaattaaaatcttttttgaaattttgttggctgagaatatttgttgctcttttaaaattcaaatccggatcaaaaattgcaaaagtatggaatagaagatttccgattatagtggctataaaattttaacaaatcccgatttctccacctaaatacagccgcgcctgcattgtgaagagtctgcagttcagcagccaatgtccggtgtgtgacagtgggctggacgcgaaaagggcacgaatttgtggcacgccggcaccaaattcggcgacggcaccaccaaataataataattgcaacaacaataataataataataataataatggcagtggtagtgccaacaacaacaacaatagcaacacggcactgattgtgaacaacaatgttgtgctgtgtccaaactacacagttgctgaactgtttgaacaccagcaaaaaacagctgatgtgctgaaggcaaaaaacaaataaatgaaaaaagcaagccgattcacgaccgatttggccagccctgaaacccgatcccgggtcggggttctattgcactttatgagtccaaacgcatattttttaagagtccaatttgagtttattagtccaatcaattaaccatactgctggtttaataactttgttcatgttcgaataaaccctaaattcttggtatcattcgaaagtattaagtctgaagaaagtaataatacgagaaaacaagaaataaatgctgagtttttacatattttagcttttttataacgccataggactcataaaagtcgattggattcataaatctgggtgccaaccctattttaattcttggctagtgaaaataataatgttgatgatttaactgttatgtgaacaaacttcaccttatttttcaaaagtttcctggcttactcccggctcaaactagccaaagtgtacttcataaagcaaaaaagggtctttgcaatctcaangttcctccaatttccgtac

SEQ ID NO: 10714 - DNA, 912 bp, Heterodera glycines
aaataaattaatctaaaatcactttcgctgcagtaatttttgtctgaaaattatgtcactattcgtcactatttcggactttttgtcactatttcttcactattttggcatttttactcactattttagttaactattttgggatttttcgtcactaaaattcacagccctagtcatcacatagtcatttcattatgtataaaataataataataatagcagccgactgtaaaaaatataaaactcgtgggtgaggattcaaatcggaaaaaattcttgccgtttctttaaaacctatgaaattttaaaaatctcctggcgattggtgaaatttttcagaaaactaaatcaaatgatttccttagaaagagcacaaaattctctgtaggaaaagagcagaagaggcttaagacttacatgaaatggtacactgattgaactttcattcgttgtaaaatttcccattttattttgccttcaataatttttacacaattttcgaaatatttggtctaaccttccgtttgcaggagagatttgatcatttttgccaaagaatatttactttttaatggacattaattatttctttcaaaaataactacatgtatctgttttttgcttttgtaattttctccaaattacccacacaacggcagcatatttgatgataattaatacttaaatgatcaaattgtcattgtcgatctgttcagaggatgggaaaattaatcgcaatttgttcgctgcaattcaaaacctttccgttcattttcctccaccaaattcgccaatttaataattcgccaattttgtgcggccttttcccgctcgttttacggctgaaagtttcccgcgtcataaacgatttggtcggtccattaatcagccccctccccctcgccccccccc

SEQ ID NO: 10715 - DNA, 2020 bp, Heterodera glycines
aataattcattataatagaattcaagcatataaaatgaacgataagaaataatggcatttcgagcactcgatttgatcaacatttaaaatgaactcgagaaagtcgcattttggcaattaagaactaaattaattgttttgaaatgcatgactcaccggtggattcaaataattctgacaacaacagcagtgttgtccaacggaagctgtacaaagcggacgaaaacccaccatggccgctgacattgcttttcggccttcaggtcagacattgagagggacggacggactaaatgcttaattaaactcaacccatcgattaattcaattttactgagtctcgtaatattcaatgtattttttttaatttttaaataattaccccccccccccctccaatggttttagcaagtgatggtgtccgtctccgtgcttgtctccattccgtttctgatttcggacgaagtctgccctggtcaggaccgtgatcagcttcgggtccgtctgattgccggaacttttgttgtttgtgggcttggcaccattttgcaaactgcgctcggactgaggtaacgaacgtaaataacttttgattatgcaattaattttctaattattttaatcgcaatgacattttggaaaattatatttttaattttaatttaaatataaaaaatatgaataacaaaattattaaagataaagaaaggggacgccatatccctttaatttattctatttaattttaaaattaaaattaaatgtttgttgttgttttcaggttagcgctgctccaaggggttgcattcgcctacattccatcagtgctttttttgaatgtttcgaatttaatcaaattaaaaaaattatttggtattgttaataaataaatacaaattctttttacaataaatattaaataatattttcattttcaggtgagggcgtatatgaatttggaagggaacagatgcaacgcgacaattcacgattttgtgccggccgaagtgtacgaaaataaattggcaattgttcgttttgaaaaataacttttttaataacatttatttaatttttatttaaatttttgaagattcaaggcactttggtggtggtttctgttctcaaagtgctcgttggggccaccggatttatcgggaaaatgaccaaagtaatgtgttcacagagaatgtaaaattggtgcaaggaaaaaccattagcatattacagtacattggcccgatgaccgtatcttcgcttctcatccttttgatggttgagtcggtgacaattactgtgaagcgaatggaacagcattggatctcattaatgtataatatagcaattaattatttttattcaccaaatcattcccctatcattcagaatggcggtcgcacttttcgccaccgtcctttaccttccccgtgtcaatgtgccgtgcccggcctatgtcaacggcaaattcagttttgtcggcttcaatgtttttggccaatttccggtaaaattaatatttttttcaatatatttaaattttattgctaatccatagtatctgactgccattctattctcctggttcctctgctggctgatgaccgtttttgagttaatcccaaaggatagtgtggcacggacggacaaaaacggcacaatgatggccattcaaaacgcaccttgggccagggtgccccttccaggtccatcgaaaataattataatttgaaaattcaaattcatttccaggacagtttggaatgcccaaattcaatgttggtctgttcatggcattcatcgtttccggcctgaccacaatgtttgaagcggttggaaattatcacgcggttgcgcgggtatctgaggcaagtttaattaataaattttgagtttttcaattatattttattttatcttttttaaggagcgtcccccgccttcccatgcaataaatcgcggcattgttgctgaaggattgggctgtttaattgctgcgctaattgggccatgtgttggcatc

SEQ ID NO: 10716 - DNA, 1039 bp, Heterodera glycines
  misc_feature (32)..(33): n is a, c, g, or t
  misc_feature (138)..(138): n is a, c, g, or t
  misc_feature (169)..(169): n is a, c, g, or t
ttccttttttcaggtcggcggtgtgcaaatgnncaatgttcaagaagtgaatttgcgaatcactcgcaaccatcgccatttctcggcttctcactaatgatgggaatggtcagtcaatgttggacacagggacggacncaggatttcggcggggggggggggtaatccnccgggccaggcgaggactttttttttgctttttacaccactttgtttggggtggttttatcaaaaacattctgtggaacacggggtccggccggcggtgccgaaaggcgccgcggggaaaatttttttgttgattttaatgcgattactaacagattttgtccaaaaaatgaccaaattttgtgattttgactcattttttcatcaaaaaattgtggatttttcagaaattttagcgaaattctttgggaattttttctctgtttaatatttttgattttttcactttttataatttgtaattatcaaatggtaatttaaggtcattcccgagtattacaagcgaaacccgaacacggtgaagacgggcgttttggaacttgaccaagtgatcgaagtgtgaggagcttttccttttgtttcccttgccaaattagcaaatgctaattgcccacgccttttcgacaaatttcaattaatttaaattaattaaatatttatttttctaaaaatcagtctgatgactttgccaatgttcgtcggttcgttcgctgcctttgtgcttgacaatacggtgggcggtgccacgcgtcagcagcggggccttcgcgagaggggcgtcgtgtgggaattgtcagccgatggacggggtcggcataaatttaaaaaataaaatttaattttgatacaattttcaacagatgtttacgccttcccgggcccacttcagcgaaccgttgaggccattccgttgctcaaatatatgccatttatgccaaagcagaaaaaggcaaatgccaatttaagaaacggatttggagagaacaaattctgattgtgagcagattatattatattattattgtattga

SEQ ID NO: 10717 - DNA, 1010 bp, Heterodera glycines
ttcattcttaacatttgcaaatcttaaacaaaattggtcaatattattactttacaaaatgtaatttctattttatcttgttaaattatttatggtgtgcatttttaaaaattgtcgataatattttgtaattttgattttttatcttaagaaacaaaacaatattttatttaaaaacaacttgaaattacaaatcgatagaaataacatatagaaaaaatgtttttttttattttaaagataaatagactaaatagtgtacttgaatttaagccaagtatgaatttatgtcttacattttttgatttcctaccccttggaggatttaagaaacgacccatcacgcttgcgatcatgtaaagaaattttaatgctttatataatactaaattagaaaacaactatacatgaatacatcctttcatttaatgtgcaaccttatgcagaaggttgtggaagttgtacgtgatctgaaaaatatttaaaaaatacctatctatcggtacttttccattatgctgttcaccagaaattcaaaaaaaggtagaaaaagcgccaattttggcgagcaacggttatttagaaggcataaaagcagcgaatttgagcaaaataccatcgaatgggtcgtcgtcatactttaaaaggccgcaaaaaattttaggaggcataaagccgcaatttgagcttaaatggcatctaaggtcgtcgtcgtccattacgttcttcgtgcataactttatttgaattgaaagtatttgggttattataaacaattttaaaaaattagactatttttaataattttggctaatcttcgaaattattcttgtagacatggctgtttatgtagaaattctgtgccaaaaatttatttatatatatttatcttttgattcataaaagaattaaggaatctaccttaattaatgattatttttacttttcaaaatagttttagatatatttttaataaacaaatttagactggctaattgtttttagatttt

SEQ ID NO: 10718 - DNA, 2438 bp, Heterodera glycines
aataggtcgcagattctattaaaataatatttattattattttctaataaaaaatttattacaattcatttttctagatttcggataaaaatttcaaaaattattgtatcacatcgaccaatttgattatttaattagatatttttttttattaaaataacacactcttcgaattatatataatggtttttttctaagctttatttatgaagaataataaattaaagaaaactttgaatcttaaaatatcaaacttgtagaattagtagtatttaatgggcttcttcattgcttcttatttttagttaaggtatttgcaaaatttgatatataatttgtttatttatacatcaatttcgttataattggtataaatttgtagaatttaatatataatttattccttttgcataaataccgttatcttttaaaatttttatataagtgtaagaatcgtttttgatctcatttgtttgcagttaattgacaaggcaataatcatgctcaaagtaattttttaaggatttcaggcattttataattgtttatttaattttcaatatttgcatttcgtaagtaaataatatttccaatttccttttaaattcttgcagattgatactatacacctttagagcattgacaataaatcaattgattgttattttaaaaaattattgcatattgcggactcgggtgtgtgcgggtgtgggcgtggtggagtccggcaatagcctgctctcgttggtgcacggaaaattcacaccaaattttatctcaaacttgggtaattaaaccatcgaatggggagcaaagggggaagacatttgagggggacaaattaagccaattgggccaaaaagtaaaaaatgtgaacaatttggccctattagcccatcacaaaaaaatcgtattgaaattggacaaaatgggggaaattgggagagcaaggagttggagcagtacaacaacggaaatgtgaaaagggggcgcaaacagtgcatggaatggcttgggggcgccgtgttggtgattgatcggtgagcgggaccctgataaccattaagttattcataaaattattaataaaatatgtttttttgatttcatatgcaaatcttttaggtgccgatattaaaaagaatataaataattaatgtcatccataattagaattattatagaaaatgcctaattttagaaaaatatttcaaataattacaaaaaataattatttaaaattttatttaagttttgtaaattttagtaaacatataaaataaactgatattataaattatcatctaacaattccaaggtatttatttgatcaatattttcggttcaataaattaaattgaaaaggatataatcttctgacttacttattttatattgttgcatttttaaacttttcttccaatatacataaaaaatccaattatattagtggaattaatattaagcttatttctcgtggttaaattgtatttattgtttttcgtatttaaaataaatttaactattccattgatgatttattgtgtcaggtgataaaaatataggttactagaatataaagttattgcaattttgattttataaatatcttttaagaattgttggattatttcaaattcaggtttttctgccgattatttaaatataagtcaattaaatttcctttataaaccatttaaaatgaaagtaatttaaaaagtatttgtatataaaaataaagactaatttactcaaatttatgatttaattatatataattaaattaaaaagcatttaaaagcatatttttgaaagataaactatttaataagacaaattaataaactaatatatcatttatgtggctaaatttataaagactttcaaattaaaaaaaaaacaatttttgaataaattacgccgacaccatctgccacgattctcgtcttatggcatttaaaaataaattatttatattaagattcatatgagaaaaatattatacatataaattattaaaacgttaaaaattgattactttattgaaaacaaattaaaaaatggttacataaatgggcaaaaataaaaaatcatcttgataatatgactaacattcaattttcattcttcacaaatttaactgtacttatcgcaaataaaataaaggtcttaaatcatctttttaaacgattatatgttttttttgtaactcatagaaaaaaaactaatttttttttttgtattttgcataaataaaaatattttttcaatattaatttaaaatttttttagcatttttatcaataataaataccattaaaatgcaaaatttgcaagtgcatgaaaaacatttagtaaaagattttctttctttttatgaatcagataaaataccatagagggaaaaaaaataaataacggttttcaaatcagaaatt

SEQ ID NO: 10719 - DNA, 1395 bp, Heterodera glycines
ttaaattcacccgctcaaacctcaaaatcattttataaaatgtcatcattatcattatctcccgaaaaaattatgtctcaagctccgtcccctaataaggcaaaagttgaccaacgagctctctggaaaatcttcaagggcaagtacatgctggcaatttatctctgcgacgatgactagcgaaaactgtacgagaataaagagaaagtcagacgactagaggacgacgacgacaatgtgacccttagtttccaaatgtgtgaggattgcgtgcgcgtgaattgcaatccaattgacataatggcaccaccgaagaaacgaaagatcgagaaagcttaagctcgactcattcgccccatcccatctcgtccaattttcgcccaagaacaactcctgccatcaacatggaagctaattcgggatctttgtcggcttcgttgcaagcagcagaagctgaaattggctccctgaaggaaatgatcaagctacagaatgagaaaatgaaggacatgcggcactgttttgtcaacttccgctcctggctagatcagctggaggcctgggctagtgacgtaagctgttaacaccattttttaaattattacagtatattttagaacaaggaaacgaaatttgtgcgtcccgacacacgcaaacgagcgttattggacgattcaccagaaatgccggcaacatcaaatgctgcttccggtaactttttttgattgatacacatttctgactttatcctcactttaggcggacgtcagcaatgctttcaagaagaattttttgaggttaaactcaaaaaattcatgaaagagaagttgtaggaggcgaaggtctgcgcggaattcgcaattgcagcggctgagcgcaaaatgcgcggtgccggcgactggctcttcaaagcttccacgccgcaaaagaaatggtggagaagaaaatgggatgttcaattttggacaacgactaaatttttttttaaaatctacctcccaaaaattgaacgtcatcctactcctcctgcatgtgatggttttgtagttcaaccaactccatacaccgtggggttggcaccacgtcttcggaagatgaatggcgtcggcagtatgggcatgtgccgggaatcaattctccttcgggagtccaactaactgaatttttgagtttattattattgatcttatgaatttttttaacttgtatttgcaagatgcctcctaatacactgaaagtgcgacgctgcgcatctgcacggcaaaaatacagccctatgttgatggttgagcgcttcgccttctacggggtataaagggtatgcgcaaaaacaatcatcttgattcatgacagaaattgaaaaaaaaccaaaaaatttttatgggttccgtcctt

SEQ ID NO: 10720 - DNA, 1909 bp, Heterodera glycines
taactattcagtttttcttgtcatcatcaaaagtcaaatgcaataatgaatgttcatcgttttttaatgtgctcatcaaaaatattaacaaacgaacaaaatagtcaacaaataaaattttttgggagcgaaaaattaacttttattatgttttcatttttatgcatttttgatacggtaaacaacagaactttttagatcgcttgtttttaaaaaattcattttattttaaaatttttgttttttccttagtaatttctttacatggctgaaaatctttgtattttgtaagaccaatagagcatgggaagagcttccgtatcatttttagagataataaaagtgaaatgaataataacatttaacaatgttttaatgcctttttgcgttgtttattttgatcacctaaactcgccttgtccctgattaaaccctataattttattactagagaccgagatttccaaatctgccggaccggactgatattttcaaaaacgaccggattccggatccagtctcaaattccggacaatccagattttcaaattgccggatccggaaccggattggtaaacatttaaattttcaaatattaatttgggaaaaaatccgcaaaatttcctattagatatttgtagacatttggtgcatcagaaaatgtcgccactgaaaagacaatgtcgccaaaataaaataaaatttttaagtttgaaaaatttatttaaagttttttatttttgaaaacctacctatgttttattgaaaaaaaatttgctaaatttcacaaaaaaaaatatatttttcttcattaaacttttttaattaggctaggtaaacgaaaatttgaattttcaactttctggtaagagaatgaaaattttcaaaatcaccatttttctaaaaaaatcatcatttggggtcaaaattcagcatacattttttggcgctactgtaaaagtggtctcttttgaaaatttttttcacttttttttaatatatttttattatttttttttattacaattatccatccttcctttgacttcgttttatcagagccatatagtcccaacaattttggcacaacaatttgttttggataagtccgttgtgtgcctaaaattgtaaaatctcttcagtttttggaaaaatgccatctcaaatttatatcatccaatgttggaaaagcgatgagcggcagattgttggaatcattaatggaatatcttgaaactttaaccatttgctaaaattgcatgagaaaaatcatttataaaaaaaatatatgaaaaaagtgaaaaaaattttcaaaagggaccacttttacagtagcgcccattttttcataaaaattcttatattagtaagattcaaattttttaaaaactttcagcgattttttcgaaattttatgaaaattgtcgttttttagaaaaaaatttccaaaaaaattctatgtgaatgtgaccacacacacaaacacacacctccttgaaactgttgagccaagctatgtttccttcgccgtccaattcttcgcaaaacaatcgcttcggttgcccgtcttttctcggagtgtgcaaccattcggacaacacttggccaggagaagttccattctgtccatcatcagcaatcacaagtatcagctgatcgaaattgattgataccaattgatcaagatcagtgagaattgtgggcgaaatgcgacggcacaaagcgtcaaattgttcgtcatcgaaaaagcccaaatggcgaatgcttggtgcaaaaattggccaaatttcgcgcgccaaaacatcccaaatcggatgttcatcatcatcattatcgcttgaacacagagtcaattccaaattggtgccacttctgtccccaaatgtgcttgttggcatggagaaatgtg

SEQ ID NO: 10721 - DNA, 730 bp, Heterodera glycines
ctctagagtcagacaaaatgaaggttcatgcataatcagagcttagattcatgatcagaatatttttaatccaaaattcaggcaatcattaagaattggtgtcccgacgaaaaaaatgttaaaaatttgtcgggtattttttctaggcttaaaaaatgcgctgatcacgaatctgagctcagattttgaaaatcattgatttttatctaagattttttgtcaactacttgatttttttcaattttttaaattatttttaaaaaaattttagcaatgaatttgggttaaaaaatgcgctgatcacgaatctaagctctgactatgcatgaacattcattttagtctgattttcatcaagtgtcataagaaaaaataaaccgctgccaagcggactctaaccccaggacccccggtctcatacgacccctagggattatgatttagtcgcagaaaatcaaatcaattcaagacttgacttctcattgcgtccgtagatgatacgacccttgccaaacaatcgcacgtaattgtcagttaattctgtaaggtaagtgaatgggcctgaattgggcaattaaacaaaaagaaaagcgcggacggaccatcggcgaaaaagtcgaacatcggaagaaggagggggacaaagtcctagggagaggagtagactgaagggaaacaatccaagtggtgcaaattgccattgctttacgattgttattccgtgaagcag

SEQ ID NO: 10722 - DNA, 1783 bp, Heterodera glycines
tagggattagaaattagtcaaaatacatgtcagattcccgtttagcgacctttaaaaccccggataaaaaattatcatggttttttatcttaaaaaaattttgcaaaacaaaagggtcctccccccttttgtttcaaaaactgtcactttccatatagtgccaaaatttcattaaaacaaaatgatgaatggtgtagatagccaataaaaaacggtacaaaattacaaaataaaactttttggtacttttccgttttggggccaaagtttgaattttttttaaatcaacagcgagacagtagaattgcagatccattcgtagagatattaactcaaattgtgttatttatgcctccaaaataattttggcgcgtagctttagcaattctacgcgcccgctgttgatttaaaaatttttttttcaactttggccccaaaacggaaattaccaacttcttaattcattcattcattgaatctaatataataaagttgagtgtctgtgtgtatgtgtcattgtttggggttcgactcgtttccttaccaccgtttccttaccaaccgtttccttaccaaccgtttccttaccaccgtttccttaccaaggtatttggttcatttccttaccaaaaattttcgaaaaatttccgtaaaaattgatcagttttttcatccctaaaaatcagttccctagtagtaaatattgagattaaaacattcaaataaaaaaacactttttatcagtttcaaatcatggtatcatctcataattgcgagaaattccggacaaaaaagcaatgataaattgatggttaaaaggctgatgaagtggaaaagtattggggtctccgttgttaagtggtaaataattttgaaccatcgtgagaattcggcggtctgcgttgcgatatttctttgccttttgcggtggttcttgtccagttgaacacttcgcgaagtcatcatcggataacttttgatcctttcgcagaaggtcaatgaaacgccaaatcgatggatgtgaacaggcaaatgcgcattgcaggcgtctgttcgcggcttctgaatggttattcgtccggtcatcgctttgcagtgttcgagtgtaaacactccaaatgttcgggtcaaatcgcgggcgtgttcggcttccatcatgcttaagacgacccgtgtagttcatgatgaacctaataaataattaaagaacaataaatagtaaacaatttctgagattgtcaatttaccagtcaaggacgggagtaagttcgtcgggaagagccatgtccagagcaattattccaggggtcaaatctccaattgggagaaacgctagcgatgtgacacatcgtgccatttctgcgaatgtcgggtcattttgatagcgctaaaattttcgaaaattcaatacaaatatttgaggaaacataaaaaattatcacttgttttgtcgcctgtttggttgggagttgcgcaaggactggcgtggccacattctgcagtgccaaagagcgaattgtcgctggtggttccatggtttgttccgccctgcgtttgattccactgatcactcgttgtgcttccattcgagctacacttggttcacactggtggttcccaacttcacgtaaaatgcggttgtcgaggtcagtgtgaaggcgtcctttacaactgatgtcttttgcgtgatgatgttcacacgcccaaaagcgagcttcaccgtcagcactcggcttgtgaaaagtgtatgaatggccattgtgctgaagcttggtagacctgc

SEQ ID NO: 10723 - DNA, 1690 bp, Heterodera glycines
tcagctcactgactagtccaacttaagcaatcagagattttttatggataaatttttgccagtttcagctcatgctctggcaacaatctttgatccgccctctgttgatgggcccgtgtgtggcacctcatttcgcgaccagcttaagaatgctgaccacccaagaagcgattgctgccgggatggcacaagcaatcggcacaacaaggcccaccgagacagaaggcactgatggggccggctgcaaaacgttgaggcccacctgtggggctggccaagtggtaagccagctaacaaatgagtggcattcaagagtcgcacaagtctttacatcagtctcggtaccgtctttaaatcaatctcggatcaagaggtctcgagataaaactcagtctcgagctgggacattttcccgcgttcattcaggttaccatacatgtgatcttggcaaacggtgacactgattttggcaactacgatttggtgccatcacgttggattgcaatgcccaagggctcgtgagcattcccttaatcttaggttttctcaattagactgcaaattttcaaaaagttacggccaaaaaatcatgaaattttgggttaggtgaactttataatgaatatccattcccaattttgacttttttaccaccgatgaatagtccacttgccgtcaatggcacttcaacaccgtggctattgctcgttgaattgcctaattaaggaaattaaaactgctcataggtaaacatttaaattctgcgtccttgaaaaaccaggttcaaatttcaactttggcattcgtaaccttttggcttgctatcaattatatttaattaatatgattctggattcttgaaaacttgtgagtgtccttgaaaaaccgtgttcaattttcaactttggcatttgtcaatgtgtacctcttcttcggtacggtacaaatggccgacgccgacgccaacgcctcgccaatagttgactcgcgatgaattatgcaagaaaaattgaggaaaatttaaatttttaatgtaaaataaaatttatcgtaaatttaaaaaaaattggaatggaaaaaaagagaaaaaaatatttgaatttgaaaaccaaataagaaaaattatagtgcgaaaaatataaaatttttatttgtatgtgcgtattttgcagtgctttctgtaccggaaacaaactgttcattatccatgtccttgtccttagccccaaaatggcacgtgcatttctaatcatgggagaccggggcactcaaattggcacggaactcattgactttgtctggaccttcattttcacactttgctttgggatcatttgcatcacgagtgaaacaactccacatgttgccgtaaaatccatctgacaatatttttgtatttattttttgaaatgtttggataaatactatttttaataggaattaatattaagaattattaaatttaagtttttttttattcgcatgattaaatttttgcaggaaaatacttagcataagctacatgcgactataagatttcaaaccatacgatttttttacatccgtaggttttttaaacttgaaaatttgatgtcgcgttttttgacgtacaattattctagccttaaaacacgtcgaatgtttattttacttccgctataactgcatgaaactcgtatctctatttttc

SEQ ID NO: 10724 - DNA, 1204 bp, Heterodera glycines
ccagttctcgagaaatgtcgtggacctggagccaagaaaaatccagacctggatccaggtctaggttgcattctagtgaaatttaaaaagtctaaaagtgatcaagttgttttttcgtgctttttcatccaaaattcaaaataaacaaccgaaaatcccagccctattaatcacttgtaaattaagcactttcagcggatgaacaaaaaattgctgcacaatgcgtaccttggggacatttgcactgttttttgaatttcaatgtctccgtttccagggcgaccttgcaattcaatactaaatgaaggtgtacggacatttcgccaacttgacatctcgccaactgacacttcgccaactcagccaaaaacattcatttcgcctactaagccaaaatctgacattttgccattaaaaaattagctgttttaatatcaaatacagccctattccagtttacacgtccaatcagtgaccatcatcatttcttatgtcctaacttttttcatatttgttcattccaaccatttttggatcaatcaaagcttaagaattaacgacgacaacggtacgtcatcaaagaacaaaatgtggtgcggatccttgacgaggccgactttgaatcggaagaaggattgacaaacgccttgcacctgctcgggctcgtgatgcagagctttgtggagggacttcacgtccgtggaaattcagagagtggtgaagaaactgaggccgatgaaaattgattttaaacattttcttattattgtttttttattgatattttatatattttatgaagatttcaatgcttgaagcacttttataataaatttaatatcattatatagttaaaattcaattttcgactagttggcgaaattagttggcgaaacgtcatgttggcgagatgtaaagttggtgagatgtcagttggcgaaatgtcatgtagcctatatgaaaagtgaaaaagaatttaaaaatgcattaaatatgaggggagggggggggggaggttttagccaaaaattatccaatgagcttcatttcctttataaaattctcttaacagaattttttgagaaatttttttcatttcttaggagtgtatttttgaaaattttagggtcgatttttaaggggtgtatttttctgaaattttataagtcgattcttaggagggtgttttttaaaaattttaggg

SEQ ID NO: 10725 - DNA, 1523 bp, Heterodera glycines
cgtaccccccatactgcggttttgacgattattttaataaaattttgttatacagtaattaccgtgactaggttgcaattgaaaactactttttttcaaggacaacttaggtattcattcaagaacaatggttaaagcgtctaaatttgcctatttttatggtatataccgtgcccgtgttctagcaaagcgctgatgaggaacagcagaagaacggcaaaaatggacggtaaaagtgagcatttgacgaccatttttggagtttccaaattcattttttgcattactagttacataataattcaattaaataattattcttattttttgcttcaattttttatttactgtttttcgactggataaaggcaaagtgatgggaatggatgaaacaaggattttaagcgaaaagtcggaaaaatgaaaagccaaatcatcgctaaaattagaatgccatttccgttggatgggaatggacggattggtggataattttcgatttaattattccgtcataaattattcatattctaccgatcgtgaaaaaaaattgacaaattgacgaaaagcgatgtaaaccaggaaaagcgaaaaaataggaagtgccaaaacatcgctgaagttcagcttacttaaaccgagaaacctgcacttctgcttcgtgatcaacgaaccccgaaaaaggttcaagtccactccacaactttaattttgttcaattaaattagataaaataaattatatttttaaaattattttttaagcatttcccatccaaatagggcaatctaattagcatcgtttgaaagctctcgatgagaaagaaagaaatggcatttgaatcgaattgaaatttattggatatacatatagtgagatgatcggaattggggataaatggcactttgctaaatgattgggactgggcgataaattggttaatttgaataatcgattgatcggaatagggaggaaatctttaactgatcagcagggattgaaattttcattatttcacttcttcttctcccattgtttcacatcccactcgatgatccttagacaaaaagactttttttacttttttctaatttttgggattttatgactttttagtcgattttttaagtggtttttcatgatttaaaatcacaccctttttaatcaaaaattactctcgtcgtctacctccctccctttttgtgtactaattcgtttctaaaattggttccgaattttttggcatcttgaaattaaattgtaaaaattcgaaacaaaaaactcggtgaagatttttaatttcacctcacaatgcttttaagccccaacgtgaggcgggacagttccaagattttttaccacattttactgtggaatgtccaattgtacaaatttaaataaacgactacagtcgcctttggccccttatggaacagaaaaggtggaatatcagatggggtgcgtcccttcctaaaaagttctcttttcgtctacccctcccatccttgtgcactatttctttt

SEQ ID NO: 10726 - DNA, 4878 bp, Heterodera glycines
ctttttgggcaatcccccttattttggcattattccttgtcatttcagtggtatgaattgggaccgtttctcgtcagaattggacgattcgctgctgaacgattcgactacgctgaaggtgaagaaggcattttggagtgcgaagcagttgctcagggaaaagctaggcaaacgcgaggacgaacacattgtggcggctgacgccgagttggacacgcatttgcagacatttcgccaaattcgcgactcgacccaaaaactgcttaatctgatggagacgcaccagcgtgaggtgatcgatcattcattgtttttttgatgaaaaaaaaaaatatatttttttaatttacttattccttgcattttttttcgaccgatagttgttttttagatcatattacccaacagggtaatcatcgtaaaaatacgatgattcatacagtagtacctaaatatcctattgtattgtatattgtcgattttttttaaacagcttaacgagctggcacaattggagttggacattgcggaattgttgaccgaggaacaaaaggacgaaaaggcgcacctgcgaaaagtgcttcaagtggccggcaacgcggaaacgaactcgtcgaaacagaggccagaagacaaaacaggggaaaataagttcaaaatcatactgtattatggttacagaagaaattaatggtcttaaaggattaaaaacgaattcattgccttttcaggcatattttgcttggctatgtgacacaatttggcaatgttctttatgtaataataatggtaaaaaacattgtgaccataaccaccaccactaaatttaggatttcattgagcgcgctgtatctgactgtgaacaaacggtggacgcggtaaaaacatttctcttttcattgtcattggccatcgtttgtctaattgtcattttgtgtttgaggtgggccgggcacggcttgcttaccgtggctcactgttgtggttgaaaaagtgcagcgaaacattggaccctggcgattcgtcacacatggaagtgagaaaagcaatagcaaaatacaaaacaattttaccgaattatttaaatttaaatttaaataggattttcgtaaagtgcaacatgttgtaaagtgtcaaaagcaccgattggatcagctgaaggaggacatggccatgaaagtgggccttaaatatgatcattttcacactcaacttctgatcaaatgcaaaatattctttcatgtgtctgtgttgcaaagtgcgcgaaaccgcatcttggccgacaatttggaggagtacaaaacggcactgctcacctttcacagcgaaaatgcggctgaattttgtgcttcttcagaacaatttgacggattagaaagctatgaaattgatgtgttgaaagtgatttttaaaatgcaaaaagaaacaaaaataataatatttgaattaaacaaaaaacaaaaatttcattagctgattaaaaattttggtttaattttaattaattaaaattattattatagattcttaacgtttcgatcggatcagcaatggaggatcaacgcagatcacacacaacagacggagtgtcaaagccagacaaattgaacacttcgcgcccgtccagtgccagaagaagacaactttccgctggcagtgacaataccgagtgaataattaattatctaattagaattaatttacccttttaaaagattggtcgagctggaggaggtcgaacttggagtggaggcgtgcgacccgtccatgaaaagagtgcgcgaactgctccgtttcgaggacgatgccatgattggaatggcacaaccggcggaccaagtccgattgaaatgcccagcggctacatcttcggaaagcatcgggttgaacttgctcaagcattcctcatcttctacagcgaatctgcttgatgaccttcaacacggatgggactcaattggctgttcatctgcagcacttaacgatttagagcacaaaaagaaaaatgcagagactaaaagccaattaaattgtaaatggtcaattaattaggcattattgtttttgttcttcagcttgtgacttctttataaatgcgcaaagtgcgaaacactttaaacccgaaaaaagcggtggtgcacttttggaagaaatagaggtagcgagaaacattgctggaaaatgcatcactaatataaatattacggtagtataaagagctgccgaaatttaagcttaaatcgatattaaaagaatatactgtattcccattacggtatatttgtatttcgcgagttctaattggtttacaaatttttcaccagcttaagatacaaattaaccattttttatttcaaaatattatattctgaatatttgacaaatgaatttaggaccttttgttcgaaagctgtccttcaagtccaaatatgcacgaatttgggacgaataacaatgggaatgaacgaaaaagcttgctaaacattgtggacattggcgggggcgctgaaaatatgccgaaattggcaccagctgcaaatgacagcgcaacacacggcaaaaggagaaaaggtgatcggtgatagattattatggtttcggttattaaaatgggcgatgtgcgcgtataattacgaaaaaaacacaaaaaagcttccctcaaaaccaaaaatttaattaatttattgaaaaaaataattaggtaattaagattaatggggcaacgaacgcattgcatcaaatgaaaagaaaaagcgaattatttgatcgacagatgaaattaataaatggtccaattttatggtttattaatcaatgaataaatatatgcaaatatttatcaatcggtcctttctttcattcaaaaattcaggcgaaaatatgcaattgaacattgaagaaaagaatgtcctacaataaccgacgaaatttaattgtttattgttcaggataaacaacaaaaatttagcaaaagcctcatcatttggcgggcaaaaaaaattgtgaacaaatttgaaattactaaattctatccttagttttatttattctatatttagatatttgagagaatttaaagaaatttcttatgaaaaatcctttttatacccataaaaaattttttccaaaagagaccaaaaactaaattttaaaatatttaattcaaagcctaattaggacatttttatggcatttttattgtttttttagggtgggggtcggtttacaagggaacattccgagctgtgactaggaatttagatataaatgaaataccattggataggtgctgggtcgttacttaaaaaccatcataataagaaatcaatattcctttaattaattatatgattacaatttgaaattacatgagttaattacaatttgaaagcaaataattattatttaaattttctgggtaccttaagagctttccttgctttccttttatatgggcaaattcatattctcatagtcatttcgttttataaaaaaaggagtaaaaaatacagattagtattggagtatatttaaacaaattcattcttaatttcaattattatttaaattcaagaaagtatatattatatttttatttaatagggtttgttgaaaattttatagaataagaggaatgaaaattattaaatgaattgccaaatattaaatttacattgcttttatttttattataccatttattaattcatcttttaatgatgtatttccggcactaaatctaatgaattttttaatgacgtattttcggcaattaaatcatgtaattagttgcgcaaatattgattataatggtttttttaagtaacgcccattatgatggtttttaagtaatgaaatagcaccattgggtagaacagggtcgacttctagtgtgaatttttaattttagcggtgcattttgcctgcttcaaaagttatagggcctcaaaaatcgaaattttgtgcatgagggctcattttcaacttttttcacattatatccgtttttctccactttacaatgactgcttacatttattttaggcagagaaataattttaatgcatttttcatatttaaaaatgtattttctaaatttttaatttgctaaaaattaaattaaattaatttatttttacgttggattcgaacccggaccctcaaaattaggaatttaaccaactgagccaccaattttatgtgaaaacacagccaaaatttcaattttcgaggccctgtaacttttgaagcaggcggaatgcaccgctaaaattaaaaattcacaatacaagtcgaccccgctctatccaatggtatatagcttatatgcattttcccactcacagctcggaatgttccccttggttagcctttttcagactttgcattcgttggcctacgcgacgctgtgccgtcgactttgcaagctgttgctcagcgacctgaccagcgcggacaccatggagagagtgctgctggtcaagtgccaggttttgtggcagggaaggtcccaggatttcggcttacaattagacaaaaccaaccccatgggagatgtttttccttagtcgggacaattttacgaaattttttttgcaaattttagaaattacaatattttttttttttgcctaggatgagctgaacgcgtttgtacggcctcggggcgtttgcgttgagcgcgtggcgctcactcgactgaccgtgctcagacgggcggactcgagcggctcggccatgtcagtgctacgcacgttggcacgctcacagttcggccagcagctgttcgaccagttgggcacctcttttctggtacaaaaaaattttggcaaaattgaaaagttaccttactaaaatttccaaaacataggtaattgt

SEQ ID NO: 10727 - DNA, 1247 bp, Heterodera glycines
tgtgcatgtttcactgaacagcgaagggagcggaagaacggcgtgcaaatggccaaggaaaatttcgaaggctttcgattttgagaaggaaactggcgaaactgagaacaaattgctaaattaataaagcaaaagatgaataatgactctaccaaaatgaagcttctgaatatttgttaatctgaaaaaggaattcattaaacgatcattaagcaaaaacgaccgtatccatttcactctttgcccctctatacggtaattaattcattgtccagcaaatggtgccaaaagtgttcttaccgtacgctctgttccatcccatccgagcagatcagccaaaccttaagcaattccgatcattccattccccccccccccccaattttccgacaatgttttgcatttcttcgtctggccattcctgcatggaatggtccaaagagaaggagctgagctcgaccacatcgttgtgctgctgctgtcccccctcgtctttctcctcattttcgctgtcatattcttcgtattcgtcctcatcactttttggtccctcgccgccggcgaaatccgtcggtggaagaaattggggagaaaatgggcgcaatccattggacccattcaaatgattttgtggctggaaaatgccggaagaaacgcccttaaaacgccaacaattctctgctactgtccaattttcattttcatttcttcctccatttttcctttcattttgcccacctttttgctccttcggctgtccttttgctgctcaattttccataaattttgcaccaaatgtttgcattcttctaatgtttcggtacgaaatattctaagggcaggcgaatgttcgaccaattggtccgaaatgcgctgaatttcgtgttggaccatcaaaggactgcgatttttgttgttggggggcgattgagtcggaaattgagacgaactttcgctatcatcgaaaaaatcgaattcggccagaaattttttctttgagtggtacggctgacaattagaaatgttagcggatgaacggcgcctaaacgatttgtggtcgaagagagaatgtctgagcaaagggactgccactgaaaagagaaaatgccaaacgtaccggacaatttcggcatcgatttcgtgcccaattacggcgatcaatcgttgctccacaatgccaaaagggaaggactcgccgactcagtgcgaacaaaatgccctaacaattggcgaaataaattgccatc

SEQ ID NO: 10728 - DNA, 1179 bp, Heterodera glycines
atcgcccaaccatcaattatttttatttgtatttgtaatcaaaattaaatttcttaattttgatttaatttaattagcgtgttttcttctgattgaataaacacaacattcattcgcttcgcttccctttgctgtccttttgcccattgtttctcttttctttccaaccgtcttttttgttttttctgtcaatgatttcggcattttcaaagtcgcttttttgtcgtctcaatgtcaaaacaatgaaattgggccttgacaaaacaattgtaagaaaaaggtgaacggattttgttaaattaagcaatttatcccactctttacactgtaaaaattaattttagctccgtatggttcagcaatgttgagatgggaccgccggatgcggtttttcactccttttttgtttttaaaaacccatatttaagattttgggcattaccgaggcatacaaaagggacactaacccccaaaaagtgaaccttggcgttggtgcctacagagatgaccaggtcggctgcaagtattttatcccgaaaatcatttcaataatttttctttccttagggaaagccttttgtactgccgagcgtaagacaagccgagcaagagataatcgcagcgaaaatggacaaagtcagcttttcaattgcaaattgactctcccccttcctccgtccccaggaatacgccggcatcgccggtttgcccgacttcaccgccagtgccatcgaattggcactcggcaaggacagcgaagtgctgaaggcgaagcgaaacgcgacggtgcaggcggtgtccggcacgggcgcgttgcggacgggcgccgaatttttggtggacattcatttgcagacatttaatgggatggatttaaatgaactgactttaaagtactccagggtcgctgatcacggacatgacctttcattacgaatccaaaaatcaaaaatacgatttttgctttgaattagggctccggtgctcgtaaggtgccaaaaagaaggtcatattcttgattagtaatcccgtagcaaattgttattagtgccattgtttaagtaattgcgtaataattccaatttccctccctccccaaagtccaaatggttcccgcatcgcaaagtcgtctatcagccggcgcccacttggggcaaccacgtgcccgtgttcaagtgc

SEQ ID NO: 10729 - DNA, 1479 bp, Heterodera glycines
  misc_feature (1426)..(1426): n is a, c, g, or t
gggggggggggaatcccaaaattaaatacttttcgtccaagtctttcaccgccttttaaaatagaactcattcgtgatcatagactcaaaatccagatttatcactctatgcttaacaagtgtccaatcccaatatgttttgaggctgggcgatgtgaagggcatggccgaccgaatcatcacaatgcgctcccaactccgcgatttgttggccaaggctggctccaagcgcaattgggaccacattgtcaaccaaatcggcatgttctgtttcacgggaatcagtccggaacaagtccgacatttctttgtgctattcccaatttccaatgattcaggtcgaccgactcgccaaagaattcagtatttatttgacgagggacggacgaatttcagtggccgggatctcatccaaaaacattgactatttggcaaatgcgctgcacgaagtgacgaaataggcgagcagtttatcaaatatgtcccaaatggccctcggaagtgctttaaagttatgcgatcgaatgtagaatagaacactttctacaggtgataagaacaacccgtgactctgcccccctttcatttctctgtttttacgtttcattttgtaatatgacaggtttatagtaaagaatgcattttaaaaagttttggatattaaaggaaaagcaaaaaaaagcaaacgactaaaaatttatcggattctctgtttgaatgcgaataacacaataaaacagtttaaaattgaggctgaataatttcctagtcagcgtttgtattcaaaacaaaaatgttaaaaaagcacacacagagatcaaaaggattagataaatatcatccacgggacgcgccaatggtcgaaattgttttgggtaaaccccgcccaaaatgaacctttccgacccatcattgtctgtttttcaatcccttgtttattttttagagggagggggggggggaggatcgacgcaccccttggacaataattaacagatatagaatcttaatttgttgtggcaagaaacataaaaacaattataaggggggggggggaagggagaatgttccataaaatgaccgggcattgggagaaaaacgcctctgaatgatgaggatgattggttgaacaaacatctcaaataggatgatgatagattgattacatagctggacacttcgaatcacattgaggattgatcatttaagctgacgccacattgaagccataaggcggcgggggttcagtgggcaccgaaaaactcactaaaaaggggatttataagttaataacagcgcattaaccagcacatttattgttttaacatcactaaaaaatgaaattttacacctttcgacctctaatgacataattaatgcttaatgtgttgttaattaagggctgctgcccgtttccctgttggtncttcgcgcgctagaaggtttacgcgtccctttcgcgctttttgtcgtaaaaat

SEQ ID NO: 10730 - DNA, 4897 bp, Heterodera glycines
gtcaaaatcaaaacatatttctcgggcaactaattactcttttaattgacctatcgtagcggttttaatacacttaaattacggtaaatccatttcaaattcgcagatgttggcccaatgcgaaaacactttgatgagttaagccgagagcttccgcatattttggacgcaaggcattcgctgcaaatgcgactgctgcggttgcgacaggcgcgcgacaaactgcgcgagtgcgaacggaccgccaaagtgcgttaaataacacaacgccaaaaaaccatactattttttgatttttggcggataaatttctcatacattaaataaaaaaacaaaatttaattgctgaattaagtttttatttccaactataaattaaggacggcactcgcgttgccctctgccaccaggcgaaacaggcgctggcgccggtgttgcaactggcgggcggcgcggaagcggaggacaaaacgggcgccgattgggaaagtgtggaaagggcacgcgaaatggtgggttttgttgtggcatgtgccggcccagccaaaattgggtggctgatcattgattaaatcaatcatttgcaattggttgattgatcctgcttagtccgatttgttgcctgagggagtgccgccggcgttccgcgccatcgaacaattggacttggaagcaaagtttgcgccggccaacgagggaatgctgctgctgcagcggggcgttcagcaggtggccgactcgcgcagaagcggtgaatatttgaatttgatcctttttgagcgattcttgttctgatactttgtccccttttctctgatcagtgcaaaatcccgtcagtttcctcattcccttgaaatttttccgttacggcttaaactcttatgattattgatcattccagcttatctcttttttgtcatgctactgatcaatcttcatcagtgagttgccaattttacctccgctggtctgaatttcatctgctgattgttttctctgatcagggaacttttgttatttgtctgatcactatactcttttgtctgtctgatcattgctaattgcttggctttatgcttcccttttacctctgatcagatgccaacgatcgcttgcacgcgttggaccgtacgctgaacgctctgaatgatcagctttcgtccacaattaaaggcattgatttgcgcattttggacgagcaaattgtggacccgataatgcttcaccgagaacacttccgacaagctgttcacatcgggtaagctaaagaactttaaatttaaaaattaataagccttaatttcctataatttagttggatcggcgctctcgtggttggtttttagtttaatatttcttttaaaaattctaccattgttttgatttgccaggtgtccggactgttcgcctttttggcattggcactttttctcggcctttgctacggctgttgcggtcggcagcccaacgaatacgaagatgactgctgcgtccgatccaccggcgcttcctttttttcatggtccgttcactgatcagtaaattgatcaaaattctgagcgatcaattatttacatcgaaaagaacttaattagtccaacccaacaaagcgaatgatcaaaaaaaggaaggcactgatcgatgatcattgatcactctgtcaaaatgcattagaaacttgatgatcagataattatttgttctttctcagctccatttggctttcgttggctttcatcagtgtgtttggactgctcgctgcgcttgccatgcttttcggtgccaatgtctcccatttggtgtgccgtcctttggaggagccgctgcaacggccggactttctttcggtgtgcaatttgcgagttttaaattagttgtgttattaccatacaatcccagctgctcgatcggtttgtccatctgtacggtttggaccgtccttcgtccgtctctccccacaagtcctccccgtccgctgctgatcacttctcgcttgatcagcttttctcggctaaccgtcgccctgctgacctgatcagcgagtgtgcccagaagcacactttgtacacaatgctcgggttggacaagaagttcaagctgatcggacgtgaaggtcttcaggacgactaccaatacttggttaatcgggtgaacaaattgaaagcgtcgatcattcctttttcatgccattttttttgggggggggggaatgaatcgatggcatttccctaatttttgttttttccatcctctacaattgttgattctctgttcagcaacgttccatcatggacaacctttcctctcatcagctgatcgatgaggcactctctcgcggcattgtgccggacgacccgcggctgagcgctcgccaatggcactttttcagtggaccgatgcgcgacgcattgcaacgccttgggcaagtgcggatgccggaatggaacagcagcgacgtggagcaggtaactaattgatcagcagagatttgtttagtttgtatggtgatcattagcagggaattcttccattttgggaccgatcgattacttaaaggctggacgaaattaaattccgtaattatggagttttttcaattattgaaacccgtattaatttggaggatgccaaatcaccgctagtcgcaatttttgcagataaatcaaaaaatgtttcaattgttatttactttttggatttttcaaattttgctttatcgctttctgtgactgtcttttcagttttgtgcccaacccaaacgcttcgctttggagggcgtcgtcgccggccttcgccaattgtcccaacaggcgcaagccgaggccaataatagcggcgtcgacggcgaaaaacccgcgggaactgtcgcgtccaatttctccgagttggacgcggtcatccattttttggaggagttgcggcccgacacggcaagtgaacggaacagtgatttaatggcatttacccgtgacgagagtgatcagactgtgttacggtgctgatcagcccttaaataatcccaaaaaaatcgggagaaattccaaaatcatcgagactcttgagcagcacctttttctgttcaaaaggccaatttccctaattaggtgcaaatgcgtgctcagctcgaaggcgcgtgtactcagttggagcagctgcagagagaagtgaggcgaataaacatttaaaatttctacatttatccattacttagtctaatcaatttgctcctacatgctaattgcccctaattatctcattagcattttcctttgcgcagattttcgcgttgcgcttcaacgcgtcccttcttttggaacatttgcagcgggcggaaactgaactgagcacaaaggaccgactgcgcgcgcaattgcaagcggtggcggcggaggtagcggacgaactgttggagagagtgcgcatctacgaacggcacgtcaaccaatcggcacgtcattcaaaatgctttttgccctattggcactttttcacattctggcattttctgtagatgaccagcgaagtgtccagctgtgccccgttggcctcaattgcgacgaatgttcgcctcgccctttgcgattacgcgttggaccctttggtcgctttttcgctgattttccccactttatcagttcattcgctttctcagaattccctgtgggtggcgatggccgtcggcttggcccttctccttccgatcattttgctggccacaactttgaacccgctttaccagcacatccatccctacctcaaatagtcagtttcaacagtttaatattaaattcgaaagataaaccaaaatttaaaatcggaatttcggcttctttttgttgtcggcttatttcatccacgccaaacgctaattgttttcaaatggatttaaatttaaatgttcattcagtccgctgctgcacaccggcaactcgtcgcccagtcacgacgcgttcgccaccgacatttacgcgatggtcggctcgcagcagcagcaacagtaccatttgctgccaacgcagcagctcaaacacaacgggaacaagcagtacacgacacaacaacaacagcagcaacagttcacctcgccgtacgccacctccaactacggttaccacgagctgacccatccaccggcctacagtatgagcatggtcggcggcggaggcacggggcaacgacgatagacaatggagatgaaccaacaaagaatggaagccagaatgaacaaccatgatcacacagttattttcatgtagatatgaggagttggagcctatctcttgccggaaaattgcaaattcattgtctggagcaaacaattttccagagtgaggaactttgaaaaagcacgggttaggtccgggtttccgagatgaaccggaacagaattccggattgaagtactgttttaacatgatctcctctagtccaaagcgtcttttaaaacatacataactctgagccaggaccctaaaacactaaatctttcggttattttctgacagatattttccgattggagccgaaaacccaataaattgaatttttgatctaaccgtcccaaagaaatttcaacacaatgctttaccgttctccgactttttgggtagggcagtttctggagatttaaaaaatgtccgtcctattccttttaaacgaaatgccatttaaatttctttatgtttttatcattgcttattttccattttgaatgatatgtaaaataaaaaaaaattatgaatccaagcgctgataggtatgtaaattcttataaaatgctgtgaaaaattaataaggatatagaaaactatttttgtccattcggtgccttttttgatttctcatttttatttatgtatgctccgcccattccccaaggcttttttttctccccccc

SEQ ID NO: 10731 - DNA, 2911 bp, Heterodera glycines
cgcattttcagtttcgcaaatttcgcttttcgcatttcgttttttatttttcaatttggcccatccctggtataaacaattaattgatatttgtaaatagtatctttaacatttataaactaacggaagccagttaaacaaattggtgcagcattttgtgaaaatttgattggctttttaatctaaaatattcaaaattaatttatttattttccagtaatatattaactttaattacggtaaattaatattattttatttttttatcaataataaattactttaattacgacaatgtcattcaaaagcagatgtgcttcttcaaccttttgaaatgcatctaaattcgaaaatgttgtgattttggatgatatttaattgcttcaacgccggatttatgttgctgatttgaagcattagcgctcccatatgacacaaagagtttttctgtaaattattaacttttaaaacagagcggcatcaaattttagcacaaatttttgggcaaaaaatttatcttttttgttatttctaatattaaaaatttgcacaaattttaacaataatcaattgtgatctatgaattaaatttttaataaaattttattaagaaaaatgaaattttttatatttgttaatttttatatatttataattaattctcacccatacataccaaaattttcttcatcaacacaatgcaacgctgtcaacacatgccggggcccaatgattgtcgcagtgcaagaaccaacaaaatattaaataaaaattttcttggaatttctatattttcaggaattttttttcttgaattctgagaaaaattatggttattgattgaatggtctttttttccttaatttgctctcttttacatgatattatttgatcctcctactttttaagatatttttaaaaattgtttatttaaagtaaaaaataaataaacctcctccactgaataaaagttgtgccatccactgcaatgatttgtcatccgtaattctttttgttaattatttaatttatttacatttttcacaggattgtgtcgatttccatttttggagcactgggaaattcgggttcaaaatcggaaatgccgcattcagaaaagtatgaaaaatgctcagcagacagcgaaaatgaattgtatccgatggtaagcaaaagaattgtcatgcaaagtttggacataatttctgaaaaataatttataatatccgaaattattgaagaaattaaatgatttaatattaaatgcattacattgtaatttaaaaaataaataaaaataattttaaaaagtttaaataaaaaatgtatttataagcaattccatttaaaaggcaattttaatgaaagaattatttgtctaatacataaatgttttaattaaagaaattagaacaagtgatgaataagcttttttcagctttaacaaccttttacaagcgtaatttcgctaattgcttttctattccacaaaaaagaaaaattaatgttaaaaataaaaataattgttgttaaagaaactgataaaaattttttattgctattttatgaaattagaatcataaaggaatttttttttgtctatgattgaaaacatgtgtaaatcctattattgatttttatctgtttggatattccccattttttcataataaatggaattttaaaattgattttattaaatcgcacgtgccagcacttaaagggtcgtcgcgggtcggatcaagaaaattgccgagtcgtgcgtggtttggtcgagacatttcgtaaaaaatgggtaaggattcgagactcaattcgagcacaactttaatggtcatcaaaactcaacaaatttatggtcaaattgaactagtaaatcaatataattttcttaaatattttaagtgaaattttgcaaaaattttcatttttgttttccaatgttttctttatcttgggatttttataatttaaattgccgaaaagaaaaactcgccatttttttcgcttgttgggcatatactcagcaattgtgcctgaaaaatccatctccaaaaccgcgtgattggtcaatggtcaaccctcattattctgcccaaaaaatttaaatttactcaaaaatttatgagtcctttttgaattcctgtgctcaaattaacttattttgtttagaattaattatatggttttattttttctgctttctttttttagattcaacaaattcaatcggccaaactgagcctccgaatcaaattttatgcccaataaaaaaaagaataattgaacagggcaaaaaaggatatttttgttggttgaccatagaatttccaatcaatttttttcgaatttgaatcgctaatgagtttttgctgatttgtttaattgctggcgaagttccatctaaaattggtcccaacataccaaatgattttttttttcattaaaaataacgtatactcattttcttttttgaacccttattggtgaacacttctcatcttttttaaaattatttcagacgtttcacgctcatatgccgcaaaaatttcatttaaaggtttcatttgattatttggtctttttaatttgttgtgtttgttatatcttttttgtttatgctttcatttccttaaattgtgtaaatcaattaatcttttaaataaaatatattatttttaaaagtaatttttaataattcatcggttttcgacaaattaaaaattgtaaattcttaattatgttataaataaatatatttgaatcttgccttcatgagtataatcgtgtttcttttgttcggaatgtttaaattggtttccaacaaattcgactccatcaattttgggcaaattaatgatcggcgaaagtttacccaaaattcgtcatcaagataatcatcatcaattat

SEQ ID NO: 10732 - DNA, 3250 bp, Heterodera glycines
  misc_feature (169)..(169): n is a, c, g, or t
tttttcgcttgttgggcatatactcagcaattgtgcctgaaaaatccatctccaaaaccgcgtgatgggtcaatggtcacccctcattattctgcccaaaaaatttaaatttactcaaaaatttatgagtcctttttgaattcctgtgctcaaattaacttattttgtntagaattaattatatggttttattttttctgctttctttttttagattcaacaaattcaatcggccaaactgagcctccgagtcaaattttatgcccaataaaaaaaagaataattgaacagggcaaaaaaggatatttttgttggttgaccatagaatttccaatcaatttttttcgaatttgaatcgctaatgagtttttgctgatttgtttaattgctggcgaagttccatctaaaattggtcccaacataccaaatgattaatttttttcattaaaaataacgtatactcattttcttttttgaacccttattggtgaacgaacacttctcatcttttttaaaattatttcagacgtttcacgctcatatgccgctaaaatttcatttaaaggtttcatttgattatttggtctttttaatttgttgtgtttgttatcatcttttttgtttatgctttcatttccttaaattgtgtaaatcaattaatcttttaaataaaatatgttatttttaaaagtaatttttaataattcatcggttttcgacaaattaaaaattgtaaattcttaattatgttataaataaatatatttgaatcttgccttcatgagtataatcgtgtttcttttgttcggtatgtttaaaatggtttccaacaaattcgactccatcaattttgggcaaattaatgatcggcgaaagtttgtcccaaaattcgtcatcaagataatcatcatcaattatgtgcttatcatttttatgttctgtgccagcttctttttgtattgttttttgactgttttcttcattattaccgtatacaaagcataaaagcacaattaatatactgtaacgcaaaacggagcaggccatttctgtaactgaaagaaaagaaccgaaaaagtttttgcttaaaataaaaataatttatttttaatattttccaatttctacgtgttctaatcgtaaaataagcccaagtgaagagcaaacagaagaaagaaagaaaaaaatttgcaaatttttaatgtatgaattgatttaaataaatattaaaataatatatttccatttttgaatatattgatcaatttattgacgatttattatgctcacatttattttatagttttattctttttttaattaaatttgattttttagccaaaattatcgcgaggcatacaaaaaattgttgaagtgcacctcatcatcagcagctgttggaccattattcgcaaattgagaaaagttgaggaagaaaaatgcaatcattttttgattgggaaaaaataaaattgtcttgtgaatttcttttaaatttcttttaattgtattgaatttcgttttaaatgaaatttgaaatgtgcaaatccttgtggttcggcaccgagagaaaaaattaaatttttaatgatttttttttaaataatgaattaaaaaaaaaattaaaaaaaggagacaactaatatttttgcatttacgtaaaatttattatcacgaaaaacttttcaaattaattattaacatggaaatagcaaaaaaaaaaaaacttatcgatgtccaaagtaaaatctgaaccatttgtgagtttttcctacattattgttgcctaacttaaagattttctgaaaaatccttaacaaaaatttaaaaaaaatacacctctaagaatttacccgaaaaaaactgagaaaatacacctcaaagaaatgagtgagaaactatcagaaattcatcccataaaattttattgttcacatgaatttttggtttaaaaattccattatacgaaaaaaacattaaaatataataatttcattttcaatagaaatataaccaacattaatttcatgattaatttttattcaatttgctacctaaattcgttaataaataatttatctagttttttaaaatctattttcgtgtttttatacatgtttattatttttgttttgccatccatcacttccgtaaacaacattattaatataattttgtggcatataatttttgtctattgattttcaataatttatccggaaatatttgtttatcgtccattgaatacgggtggattagaaaaacaatataaaatagtataataatattttagtatgacataattttaatgaaattttattttgttcacaatttctcaggaattttctggaaaattaaaaatctacttcaaaatttgtaaatcataaaatgcatacgtactaatattaattttgctaattgtccataaattatattctaaaaaattttttctgcgtattaggccatccatcgcaaactaaaaaatgctattttcagataattttacaattttattttataaaaagaaaaaatgaatattgaaaacgctcacaaatttttttgattttaattttgtgcattcgtttttcggaaacggcacatcccaaaaatgcatctgctggaaaggagattagttcgtcaagtttaggtgatattaaataattatcgctaaatcaaaaatcaaaaatattcaattaccaaaaattttcctttttgaaaaataatcattaaaattttttcgattattccataattctgtgcaaaaatcgtgctgagtcgtttcctaaaaaccgccaccatgggcgtttcctaaatccgccaccatgggcgtttcctaaaaaccgccacccgaagtgaattaaagacaataaatataaaaaatagttattgttatacaacatatataataaattaatataaatctctgtatttttaaaagtttcttattcagacttttgttaatgaacattcagcactttcatacaaacatttgcaaaagtttttgtcgcaatcgtatcgttttatagatttgtttatatagcataaatcatggtaataacagcaatcatcgactatattattaaaaaatgtataataaatttaaaatactttattaaaccttttttaaagttgcaaaaccatattactggtgctataaagcatgagtcaaaaaatgaagtgccacaataagtgccacaatatttctttgcaactttcaaagggaaattctaattaataaaaaaaaaaaaaa

SEQ ID NO: 10733 - DNA, 1313 bp, Heterodera glycines
ccccttttttgaccatgcccaactcggcctcaaattggcacttctttcgccacgtttcgatgttttggtggacaaacatttcgatggcaaaagcgaattgacaatttggaaacgaatcacaattcgaaaagacactgacacggaaatgccaaaactgtctgtgtttattggccatgccaattcaattgattttccattgcccgaccgtccgctgcccgacaaaattcgctttcatctccttcatattttgtaaattcaaatattctatgtacaaaaaaaacaacaacaatttatttgtcactttcaggtacattgattattttgtgctcgcttttctccgtgccaatcagcaaatttttgacaaaagtggcaccgaattgtatttgttggtttctctttcacctgacattgctgcccagccgatttgggatgtttttgtccgtgaaatttggcccattttcgtgacaaacgttcgccaattggacattcccgacggggaacatttggacaatttgcgtcgccacacttcgccgacaattctcactgatctcaatcagctgacttcaatacaatctggtgatctgttccccgatgggaatgatgatccaaatgcaattccaactgctggccaagcgttgtccaaatggttgcacactccgacaaaagatggccaacccaagcgattgatatatataaattacggatcagaaaacatttacgaatggatcgacagtttcaaagcggtcaacgggactaatcatttttatgatttcaattaaaatatttggattaattggcatttgcttttcgtttcccattgtttaggcatttctccgtgccaccacttctgcctgctacaaaattcgaattgaactttttgatttaatggaatttgagccatttgaattggtgaacgaacggactaaagaaatgctgatactggagaaagaagccgattatgaacaattcatttgtagtgattggctgttgaaacgatgccaaattggggagacggcggcgattcagtgggagtataaaagtcggcacaatttgaactatgtcaacttttggctttttaaggattgcattgggtgagtttgatgagagaaacagtttttgctttaataatcaaatttaaatcacacttcctcaaggccgttatctccaccaaaggcgagtcaacagaatgcaaaaagtgatctgaaaatgattctcgggcccagcgaaagaaaaagtgaatggattagtgggaaatgaaaaatgatcgatcattatgaaagaatagtgatcggataattgcgcctcacatttat

SEQ ID NO: 10734 - DNA, 3145 bp, Heterodera glycines
cggtgcggtgaattcactctgaataaaagactaaaatttcttttaatttttttatgaaaatttaatttaccagcacagttgtttttttaggcaatgataagtttttcagaaaattttcaagaatttttacaatatttgtagctaattaatgcccgataccttccgttcttttattaacgtaattccgttattgttctctttattactaatcacaattacttcttttgacagttgtgggtttaaaagatgattctcaaatgatgggttgccgacttttgagtaggtgcgcatgccggcggggtcgacaggcccaattttaaaaatttagaaaaccctggtattattttcataaaaaaaatttaaaaaacctcaaacaatttccaaaaatttattttaccatttaaatgactacgatacaacacacacactcatgcgctgagataaatacataaaacaacacttatttacagtatgagacaccatgcaaaccgataatacagtacccatacactacagtgcataagaatagggcggaaaaagtttaatatttttgcgaaaaacggctaaaaattttgtaaaatacaccctctaattcgggatttcaaaaaacgaaaaatatacccataaaaatcgaatttttcgttaaaattctgaaaaattttcctcggcggcgcttatcggcactgcccgcccccaaaactcctaattatttttaaatattaactccaaatcttagtcatttttagacaaaatcttatagcaaattgcataaaattttcaaaaatttttccggcggcgccgcctgacaaccccctatcttccccagttttttggaaaaagcacaccgcgaaataagctgttttaaaaatcaaaaaaatgatggtcgtcaatttatatagccgggatgggatcccttcacaaatcattcccaaaatcaatcctcaaaattcaaaaagaatgaatttttacgtcacaaattataatttatttgcctttcggcaccgccaaaccaggacaatctttttaattttgttttaaaatggcttctaaaagggtgagatattgataattaatgaaaaaaattttgaaatttgcgaccacagctctgaatctgccatttttacccctatttttgctatttttctcccggtttaggcccatattttgggatttccactagagaccggacaagagggtaggttggtcggtttcggtataaaaaccgaaaaaaaccgaaaccgaaacaaaccgaaaaactcaaaaaattttcggtcggtcggtttcggtataaaaaccgaaaaaaaccgaaaccgaaaaactcaaaaatttctcggtcggtttttttctcggttaaaaaccggaaccgaaaaccgaaaaataccgaaaaaaaaccgaaaaataccgaaaaaaaaccgaccggtccgatctcatttccacctcaaaaaacatgcagatcttttattctgatcataaataaggatgctaattttatgtaaatacatacttttttcctagattctccatagcctaattagtaggaaaaacactttctttttttgtgtttgcgaacaaaagttgggacttttatttacattttttacatattttggactttttcgtacatatttcgcaatttttcgtacatatttttcatttttttacatattttgaggatttttgagaatttatagaaattttttgtaaaaaatttaaaaatttttttttgaaaatgtatccctaaaaaatcgatttttttcaaaaaatgatatatcaaaattaattttttaaaatactaaaatgtgatgctaagcctattttggtcatttttatggcattttgtgcctatttcactttttacgaagaatttttttccaaaaaataaccattaaaaaattttatttacatattttcgtacatatttgggggttttgtacatatttcataaatattttagctttttttatacatattttatttacatatttcgcaaattttgttacataaaattagcatccctaatcataaattaatcttaaaaatttatatatagattgggtttttaaaaaaaatttttttttttgaaaattacggattacgtattacggattacgccaaattacggtctttttggacctccgtaatgacggattacggatggccgtaactgaaaaaattgccgtaattacggattacggatttccgtaattgaaaatcagttaatccagccctgctccccccccccccccccgaagccaaccaagggtcgggctacgccctctgattcgacttagatttccatccctagtaattaatctgtgaatgctaacttttcttttgaaatggaatttaatctgttagtgctgtccgtctatgaacagtttagccgactcaataagggaagggaaaatgttgaaaggtcaagcttaataaatgcatttaaaattatcagaaattaagtcttcaaaagttaatttaaacaaagacaactgtaaattaaaaatttaatagtttatttttaactaatcattttagtttattttattttttcaatttcataattaaaatttgttaattagctatttgtttagactaaattaaaattatttttcaatggcaccgcccgtcgaaaaaaagaaaaaactttctttcgtcgaccaccgcctcatttcttctgcagcttttggtgaaaatgaacagcaaccgatgggttcactcgtgacatcaagcaaaatgaaaagtcctttaagaaaaatgtgtgcaaaacttttggaaaattcattcgattgggaatttaatattaccatatttcccacactaattagagcccccccccccgccactaaaacaaagcccccctttataagaaggttggaaaaagagccccggggctcttttttaggaaatacggtaactcattgtcaggccaactaccgtagttctccgattattcgactctcctcaagtataaggccccgtttgaggggagttgaagaataaaatactcggctctaataatcgcggagaaacacggcaatagaatttttgaacttttcagttggatttgtagcgatgttttgatggacactctccccttttttgaccatgcaccaactcggcctcaaattggcacttctttcgccacgtt

SEQ ID NO: 10735 - DNA, 2965 bp, Heterodera glycines
ggggacgggacgaaatctcgccgccggaatctcgccaccaaattttttaatttttttcaaatttcaaaattattcaagaaaaaataaaaataaattccaattttgattaacaatttttctaacattgcacaataattaacgggtcaacaaatttaattcatctcgcaataacatcaataaaattcccattctattttgccctttccattcttttttcgacatttgagggtcgtccattgcctttccgcatccccaaaactaatcgtgtggggagctctcaaccaaaacctttgaaccggtttttataagcatttctttgagcggctcgttctgttggaatttttttcgaaggcctcgcatcatcagattttcacagacacctcgccaaatgacaaaattgaagcatttaatccggttatttttcccgagttttaatttctgccggagtttttgccttcataattgaacaagctgcttcaaagtcgcggaaaaacaaagctttttgatgctgataaaattgttcagtcgacgaataaatgatcccatccaattcaaaggcacgttaaggtttaaccatttccaatcgcaggcctcctcgtggccacgtgctggaaactctactatcttttttttacttaaatagagaggctaatcctagtcgaaaagcgactaggaagcgaacaaatggttgttgattaaatttaggcacttgagctgggaagcgaatttgttaaatttattttttcttgaataattttgaaattagaaaaaataaaaaaaaatttggtggcgagatttcggcggggatattttgtctcggcgagatttcggccggcgagattttggggtgcacccatttactttatatattttcgaatcaaatttgtttaaagacttctcccctgcataattttcgaaacattttatataacgaaataaatggcgaataaagaagcctttttttcaattttcatgcgtttcttccatttttctccatgtcaaaagtttagaccctcggaaataaaatcttctaattactgttattaattaatttaacttaggtaatagtttagacagatggtagccccctttttcaaaaaataaaaattttgaatatttttttcgtgaaaagattattttaagggtttagggggtcagaaaaccgaatcaaacatttatttcgacttatgtcgaaccccgaacctggatttgaaagaaaaagtcgaaaattcaaattttcgaatttcgcatttttggtctaaaaatggttcaaatgatcatttattagtagattgttggcttttactttgtttccatatgtataagcaattttaagaccaaaaattcgaaagtttgaattttaaactttttgttcgaattcgggcttcgacataagtcgaaattaatgtcagattcggaatcgccgacccgctaaacccgtctcgaaaaaaaaaattaaaagattttattttttgaaaaaggggggctaccatctaaactattaccttaacttattttcatccctttataaaatgacaatttattgagcggcgaaaagttaaaattttattttatcgaagaccattaaaataggtggtaaaaaatggtgattgtaaaggggcagaggacaaacacaaagaaataatgagcggaaaaagaattaaatgggtatttggattttaaatagagaaagcagcgacaaaagcaaagtgaatcagtccaaataagcataatgataataaaatatcatgaggaaaatggtgatcaattttcattatacagtaatcattcatcatcataacacacatttcttccaccaccgcgcaactgtaactgttgccgaacggacagttcacgctgcaacgagtcgatcatgtccagcgcgtcctgcaggcgttcacgcgcggtttgcagtcgcccgaccaactccgcgtcggagattccgcgcagcgacgaagtggaagcagttgcctgtgtgaaatttgaaattaaatcatgtattttcattggttaaagattcgaaaagtgatgaaataggcaaaattaaaaagaaaagttaaatttggccagcccgccttcaaaatacggggcacaacaaattcttcagactcaaaacaaacaaacacaccaatgccgacgacggcattcgtctggcaccgcggctggtggtgctgttgttgttgttgttggtagtgctgctgccattttgagacgaagcaacacaaccgcggccaccaccgttcatagtgccgctgttgctgccgccgttggttgcggatgatgatgctgctgcaccaccggcagcagcggttgcggcggaggagaacaacaccatttgatgaagacgctcctggctgctcaccggcgaattgaactgctcgccaccactgctacggttgttgtgttgctgacggaattggtgcggctcggtggcgacctcaaattgaacattttttttaaaccgaggatcaaatgcaaccagcacaaaaaactacctgctgctgctgggaagacatttgttgaccgtccatgaactgttgtgcatcacctccaaaagcatcgtcgtcgtgatgctgactgttgttgctgttgttgttgtagtacatcagctgttgctgctgaactccacggtgcggctgctgctggtcgtggtgcgggttatgatggttggtcagcaacagtttcaacgagtcatgcaacgacgtctccaggccgggcgacaactgctacaaaaatgatggggttttactagtaaaaaatgttcgaacaaaaaatatgtgtatatttagttgtcacccgccctcaacaaattgtccaaaaagatttaattcaaaaaacagaaattttcaaaaaaaaaaacaattttttttgttggaatttttaaaactctgcacccaaatcggactttcatcagacttacgggatcgggaatttccgtcttaattgcttgacgagagaggcgcct

SEQ ID NO: 10736 - DNA, 1131 bp, Heterodera glycines
ttatttatttttgtccaaaaatttttaaaaatttttcaaataccgaatttttaaaagctctttggcaaccaaatttttcaataatattggtataactctttagaaaatctagaaaaaaatattttatatttcttaagaaaaaaacttctaacaataagaaatttagaattaaaaaaattcatttcttaaaaaatagggtggggacacccatttctccccccattgtgcgcaattggttgcgtcttgcttgcctcatccgcggatgtcatgttgcgcactcggccacgcttgtgaaggcgcagcgcagtcgcttccgcggaatccgtctcctcccactcctcgcggtacattggtagtggtggcggtggtgccaatgccagcgcggacgcgtcaccgccgctcctcttggcacagcctccgctgctaaccaccacgtgctgtctgccatgttcatcatgcacattttgtgggtggtgatcaaccggtcgcccttgctcctccccctcctcatcaccgtcgttgaacatcacttgttgctgctgctggtggtggtggtgttcgtcgtcattaacatcaatgccctcctcctcctcatcagcggaatagtcgcacttaaattttttttgttgattccctttttgtgaccatttaattgagtcgtaccgaatgataccaactataatttgaattttgtgaatgaatttttgggcaatggttaagaattgaggtccctaatttaacttttttattttggacgcaaatgcagtttctgggtgttttcgagggtgatgattatgaatctgaactcggatgtgcccaaatccgaccccggacccgaattcgaacaaaaagttcaaaaatttttttcaaaaatataagttataaccggtcaaattttggcaaaaattgcgcatttttatccaattaacaattaaagtattgttttacatcaaaaaatagttgctaaatgaattagaagcttttactacaagcaaaaatttaattcttggaaaaaagtttcaactttttgtttgaattagggtccggggttcggaattgggtaaattcgagttaagattcgtaatcagcaccctcgaaaatccattaaagttggtttcgagcccaaaataa

SEQ ID NO: 10737 - DNA, 1448 bp, Heterodera glycines
cctgttttgaagctaagtcggggatctgacggctaatatgaaaataaagtgcagttcgctctttaaacgaacctgattttatgccccctttctataaagcaatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgcgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttcgctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacggcgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccggcaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcaatggcggtcgctgtatgac

SEQ ID NO: 10738 - DNA, 1305 bp, Heterodera glycines
cactttaggagtgagcaatttttagataaatccgttttcaattttatggtcttgtaaatttttcaagaccaagaaaatcacaaacacaaagtgattagacattcgtttatcattttcttttcactttagggttgccacgatttgatcaaggcgtacaaagagcagaaggctaagcaaatgtaaataataccttttaactaaaatttaaaattccgacttttcaagccacacttgtgccgagtctgacattgaacgtttcattacgaatgatggtgacgaggaaatcgacattaaggatgaaaatttgaagaagaagcgacgcaaaaagaggaaagaacggtttgcactttcattttttgaaaaatgacagacatatgcgatacacattatcagacagttgcatttctgcgccccagatttattagaaattcactatagatcgaaatttccgaatggccgggctgatacttccaaaaaagacttgttccgagtctggtctcataaaaagcggatttttctaaaaaaaaacattggttcctgtaaaaaaaaccgggcctggcctgtctctatcgctaaaaattcacacacttttttccatcaaaccaaaaaaagctctccagatttatttattgcttctaacggcagtatttttatacattacatcgggcagcaaaagttaacgcacatacctaactaaaaaaagagatttttttggtaatttctaaaaatagggcgtcaattgtttgaatcacaaatatatgggatatggtacattaatgatagccgggtactcattatttaaaattctctttcgttcatctgaaatgcatttcatcgggttccaattttatttaacccatttttcaaaattgccacagttctccatccgcgtcaacatcatcaacggtcggcaaacccaaaaagacgaagaatatgcggtcggcgcgtgacgagaaaagcggcggcggcgatggcaataaacggcgtgccaaagtgttggacgaattaaaggagaggcgacgcgcaaaacgccaacgcgaagcattggtaaaaccgaaggtggagaaggaggagctgcagtcgcccgaagcatccgctgacgaggacaatgccatgtaaacgcttcaaataacaaaaatttcccacacttttcccggtttaataaatgcaagtaaagtgtcactttttgaattactcgcgttttttttcatttttcccactatcaagccaccaaagtttgttcaccagtagagggctgatgtcccaagggttacgtcacaggtgcgcctatgcagggacggcccc

SEQ ID NO: 10739 - DNA, 961 bp, Heterodera glycines
ccccccccccccaagaccccccgggtccaaaaatttttaaggaaaaataatattttggctgaaaattttaggttttccttgctgggctggtacccccccccccccagacctagccacacccaaattttccaagaaatgtcgctaaatttttcaaaaaatccacaaatttttaatgaaaatctgctaaaaatggctcaaaatcacaaaatttggtcattttttggacaaaatctgttaacaaaccgcatttaaaaccgcaaaaattttcccggcggcgcctaccggaccccctgtcccccaaaaaatttttttggaaaaaccgcgccacataaaaaacgggtgtgaaaagcaaaaaaaaaggtcgtcgcccggggggaggtgccccccccccaagccaaaatcctgggaccgtccctgcgcctatgccaaaaatcggtttaaactgaagcgaaaatctgtgcacgcggtcgcaattggcccatatttctgtgccatttggcatagccataccgtatttcctagggtggattggtttaggaaatgcgatattatggatgccttgatgatatactcgccatattttatgtctgtgaacgacatattttctaggggtagggatgcgtgggtcacacccttgaccccccgctcgccccgcccaaagaggggaaccggggggggggggggggaggcggttgaccctcccatatgcaatcgtttgctagagggaacaactgtgttccagtttcatcatcattcccttttcacccgtaaaaatgcagctttatttgggatgatgacataaatgtgtcgggagggcagggggaatggatgggtggtggctgatgaatggtaatgtttttcacacatttggtccagcgaagcaaaaagtttttttttctcctccctttcgcgggcggtgtgattcatcacaccgcatagaaaacatatttttcatggcaaa

SEQ ID NO: 10740 - DNA, 5452 bp, Heterodera glycines
aggtttctaaaattaaaaatgacaaattttagtataatttttacatatgttcttaacaagaaaattcaatcattttataaaataaatccccaaaaaaatcattaaaagatattcctaaaaatattttagaaaatgcataaaaaacataatatcatccggtagttttaagtttaaaaaaatatttttatttatttttgcctttttcgcctcctccctcaaacggacggattctttcaaatcggcggccaaaaattgacttttgatcacttcaacagggacagagacgacatcgaaattgtcgttgtgtgatttttgttgttgtggagtgagtgtgattattgccattttgaagagccaacgacggcacaacagaaatggttggaatatttaaaaatttgaggattacttgatctgtcggttcttgacgggttttgtatttaatatgcaattataaatattaatagttgggcagctgagaatttactcgagagtagagaccgaggaattgatcacgagactcgaggtcgagaatttgttccaatgctcaaaacactgagaattggtctcgagacggaggaatgatccgatgaaaccgatattgattacaatgctcgaaactgagaatcggtcccgaggctcgagaccgagggatttgatctcgagattcgagatagacattggatcccaaagctcgaaacagatatttgatctcgagatttggtcccaatgctcaaaagactgatacccaaaagcctagcaattttcagactcgagagcctctcgagagtctaacgagatcacctattgtcctgaaatttctgttttaatgcgaaaaattttgcttttctgaaagtgtcagattcgtaatccgtgaccaaaaaaccccccggcaacaaattttcattattaataaaccaaaagagtcctcccgtttgttttttttaataaaattcaaaaccaaaatcgtaaaaaactttgataatagcgcgctactgtcaaattagcacatttctgaaccaattattggaatatgttggagcccgcctttgattataaagcattttcttaaccccaaaacattccattcaaactctgatcacatggatagtaaaaaaaacggtgaaaaaactgcattaatccaataaatcattggtagcgaaaataaaacgcgaaatcatttaattgtgaaacagaagagtgtttaaagtagaaaaatgttgatttctaattcttatgcatttatttctctcggggttatggtaaaaaaaacaataataatttccgatcggcagtggtcaaaaaattacacatctatttttagtgccgaggctatgttcttcaaaaggttacaattgatttatttattaatgaagaagaaaaatgccttatttttaatcaaatttgtttaaattttcatttttcccctctcaatggcattgaactttctaaattagaaaattcattacaaaaaaaaaagaatttttttgtgtaaaaaatttttaaaaattcgattaaaattttctaattttctttccacaaagcccctcgtcacctatttcacaaagaatttttaaattgtatgcgtatgccagaaaattggctatctctttttctgagcaattttgtgtccctcaaatgctccctagaatcataaatttcccaaagaaagcttcggtcatctactcgataaattctagtaacaatttgtgaaaatactaaaaaattttccaggcgaagcttttggcgccgctggcatttccggtctgcccgaaatttttttgaaactaatgatgcaaaaaaataaataaaaatttaagcagtgcttatgaatagttaattgataattttttttttttgcttcaatttgtaaataaattaaaatgatttttaaatgaattcaatgcaaaaaaaattgcatgccctttctgccgttttttttaatattctgccattttttgctattattttcaagttcggcactcctattttggacttttaaccgagtcacaaccaacaggatggacataattacgaattacgtattacggaaattacgctttttggactcccggatcacggattaccgtaatggaaaaaatcgccgtaattacggattacggattttcgtaattgaaaatcagtcaaaataggcgaagggatgtgggctaattgctcgaatgcctattttgacattttcgtaattaaaattaaatttattttttgaaattttattttttatcctctcccgtttttattttgccaacagtgtctcccctccgctcacttcccatcccccttctccggaggggcaatttgtgtgcttttcatgtgtacaaacacatggacggacgctctcgccccatttttctcgtatttacaaacaattacttattttttgatctcaaacattaaatttaacaaatcgtttaaaaaaataaacgaattcagtgaacaaataaatggagagaaaaaacaaaaaacaaatgcccaattttttcgtttgattttggcgaattgtcccttgatctttgattaaaataaagtaaaaggatttgttacacttaaatgcgtattcccaaatggtgcagcggcgcatttaaaaattatctgatttttgatcagcaatatggaaaaaaaaacatttctgcgtcgattaacaaacacagcacgggagggaatatggaggcgtaaatagggcatctcgaaaagctattcaaaaacaaatttgacaaacgctaattagggcagtaaaacataaatattggtggaaaatcggaatttaaaggttttcaaaaagtaagtaaatttctcagaaaatttcttcaagttcgttaaaaatttaagcaaaagtctcgaaaatggcttaatattgtgttaaaaatcatttaacgggagaaaaaaaatagaaaataatgtaaatattaatcagttaatagatagattgggcggcggcggccttaaaggcacaatttcccagtggggcctaattttgaaaattggtaattactaattaaaaattggtattttatttgtttggtcatgatatacgacaataaattatccaatcaatatgggcaggggattggggattggtgagatgaaatcgctgaaaaagcaaggacatcggtcgcggaagggatgaaatttgggtcgtatttttgtagggagtgaaaaatgtgtaaatggttgaaaaatatggacgaaaatgggtaaatttcccaacaaatttcttcaaattcgctaaaaacatcaaaatgacttaaattgtgttaaaaaaaataaaaagaaagcaaggtaaaaatgtattaatctgttaattgatgtgccgtgccttaaaggcagaattttcccaacggcgacgaattttgaaaattggtaattacgaattaatattttatttgtttggtcattgatatatgacaataaattattcattatggcaacaggggattggagagatgaaatcgctgacaaagccccgggcagcggaggggatgaaatttgtgtcatatttttgtagggagtgaaaaatgtgtaaaatggttgaaaacatatggacgaaaatgaataaattctcaaaaaaaaaaaaaaaaattaaattgactataaatttatgcaaaaaatctcaaaatgacttttatccaatcaatagggataggggattggattggggagataaaatcgttgacaaagcctggcggacagcggcggaggggatgaaaaattgggtcatatttttggtggggtttggaggagaagggaggagcagagacacacaaaacactgtctgtctgggtggggcgcaacttttaagattattttaatagattttttattcctggggagcattgctttttccttgaaatgcgataaatacgatgttttggtaagttacttttttgatagagaaaaacatttttcgctcgaggggggggccaaatgaataacaaatgattaattaattaattaattaatgagaccctaattgtcaggggcagagcaacaggacgcacccacccaactgctgctgatcatttagtctggtttttttgcgttgtgtactctgggtgggcccaaggtgtaaccaataaataataaatattgtgttgaattttttatttgtcgatggaaaatttcttagagcatttttgtcaatgatttatcaaatcaattatagcccagaaataattatttttttttaatttagccgaatttgaaataagctaaaaatgagggaaaagcctccaaagggctatcagtcagaaaatatggattttgatttgcttttaatatagtttgttttctaatttttgattttaataattttttttaactaaatattactgcatttgcttaaaaaaaatatttgtttttgatgttatattgtttttacgaaataaaagcccccattttagcggaagtttcatcctacataatagcaatgttgttgttgttgttgtttgtcttctgcagcagcagatcagtcacgattcacccatccttttaatgctgtccccccccccccccattagcgggcgaggggcaattagcggcagtcaacaaatttcacaccgctctctcgttgtctgtcctcttattgattgcacactctttcgccgtctctctgcttttcggtccaacccctagaaaaacatgaaaaaagtaaaagatgcaaaaaaaaaatcccgaaaaatttaaaaatatgtacaataactcccaaatatatatcaaaatatgtaaaaaattttaaaatgaatttgtggacaaaaaaaaattcttagaaaagcgtgataagcacagaatgccataaaattgtactttaggaccagaacaatatttaagctatgttcaaaattaatttttgatttcattttttgaaaaaagtggtatgtatatttaaaaaaaaatttttttcctaaaaatttttctaaattctgaaaacctcagaattttctaacgaataaatttgtacgaaaatttgtgaatttttggattttatttcaagcccgaaatatgtaaaaatatgtgaataaaagtcccgtcccaacttttgttaaacaaatacaaaaaaaaaaacaaaaacagtgctttgtcggagaatacaggaaaaaatatttatttatatgaaattagcaattaaacattgacaaaataaatctgcccaatttgcttagtgttcaaaaaatatgttcaagagttaaaagcaaataaacgatgaaaaactcattttccagcacaataaatgtgtgcaaaatgctgctgataagagatggatgcactgttggtgataggcggtgatagcacagatcgggtgaggaaatgttttacgatattttgatttcataaataaaaataatattttcgggagaaagacttttgatttaaaaatattttttgtaaatctacgattaattatggattaaaaattttattgtacattttgatattctta

SEQ ID NO: 10741 - DNA, 942 bp, Heterodera glycines
  misc_feature (51)..(51): n is a, c, g, or t
  misc_feature (54)..(54): n is a, c, g, or t
  misc_feature (56)..(56): n is a, c, g, or t
  misc_feature (63)..(63): n is a, c, g, or t
  misc_feature (75)..(75): n is a, c, g, or t
tttttagatgtatgatttgctgcgaaattccaacggagccgatagaaaggncgncncgaaaanagaggctgaatncaatctctttctcccctccccgctgttcaccataaacctaaaaatcaagatcagcgaccccaaaatccaacacgggaatgagctcccgcgtttagcgtccacccaaccatcaccctaaatacctccaaaacagccccctcatccatttccaacgatttgggagtgtcgtcgtccgagacgcgtcggccatcaaacaaaaatcgcaaagaagtcacctaaaaaccgagaaagttactctgctcaaccctatcccaagtctggcgaacctggacgcctgtccactcggcaaacaacttttttgtcatggcacttagaattgaaaggaaattacaaacaaaccataaaaaagaattacctaaaattcttagccggaattttgctggccgcgtatttggcgcaaattaatgcgtttgtgttggccggatttcccaccacgagcacctaaacgtttatttttaggatgaaaaatcatcggtagccaccaaatacacactctgactgttggcttggaaaatttggccaaagcttcgccctgcgatttgaaaattcggacattggccgcgagaaggtcctttcgctccatcccttcttttgacgaaagtatatcttttcttaactatccttaattatttaacaaataaacacagcggcccaattttgggctccaagtacaattatgctggatttttcgtcttagtggtctgtgagttagtcaccaaaaaggggctctcaagttcaattcctccttgtgtttgtgtataaatttcaattttttaaagcaaataaataaaataataataaatacagaacgccaaaagaacaaatacaaacagtaaaaggtacacactatattttacccttgatatg

SEQ ID NO: 10742 - DNA, 2303 bp, Heterodera glycines
agataatacataagtacccttttgttttccctccgatttgtcgaattttttttgttacttattgaattagaaattcatcatacaaaaatgaatatgctaaaaccattttcgcatcttaattccatacaatgcaccaaacatttgctggtcagcaaacggcccatgcacatttggatgccggacgcgcagtttatgcgtcagtatcaggtccttcctttggttttgcttttttattttattgcattaatcaatcacacacaaattttaacaatttcaatcaaattttgaggtggaagacagcggaaaaagacaaaacacagccggagaaacacagtcgagacataacgcagccggaatagatttttttaaatttttcaaatagaaatttttcaagaaaaaagtcttactttgttagaaaattcgatcaaaattttttttttaattttccaacgattttttcaaaattcactgataaattaccaagttttttcaaaaaaatcgctggaaaatttttagaaagttttttctatgaattttctaagaaacattttttctaagatttttctaattgaaaaattttttaaaatttattcccggttgtgttatgtctcggctgtatttcggcggctgtgttttggggtgtaccgggaagacagaataatttttacgtaccttacttaactatgatttcttcagttccaagcgccaatcactcgaaatccgtggcaatggctcaactcaaagacccaaatcgacccggaggataaagtcggactgaggaagcaaatcgctagtatggaaaagatttcgcacatcagctggaacgatttcgcctgcgaatttcgcgaagcccaaatagacagcatggtcagaatttggtgcttccaaatttgaactttcttttctgcttctccaattggacagattctcaactttggccccaatcatcccgcagctcacggagtgctccgtttggtgcttaagttggagcaagaggtcgacaaattgtcaaaaaacattacaaacgaaaatcatttatttattgacagttatccgaattttccctctaaaactccgtcatttttaaggtttgcatcaaagcatcgccgcacatcggactgctccatcgtgggactgaaaagttggtttcgctacttttccgttttgggccaacagctcaaaatttaaaaaaaaaaaagttcacattcaataatttgtgcgcgaaatcgaaaaagtcctttatcgctacgctaatttatgctatgagaaattggaaggtttaaattgtcccttaagcgcgctctttgttcattttttaattttgatgtgaaaagtgtctttttatttctatcaaagcttttgtcatttttatattgtaattccatcagatggttttgagtgccccggctttttcaaatgccattttcacttcatttttcagactgatcgagtacaaaacgtacacccaggcattgccctactttgaccgtctcgactacgtgtccatgatgaacaacgagcaggcatattcattggcggtggaaaagctgctcggcattgacatcccaccacgtgccaaatggattcgaagtgggttcataaaaagggaaggcaaaacattcatttctattgtaagatgggcattaagttgggaactgagtctttctttaccacccgtgccaaatgtgaaattgacctcaccccctaaattttattttttaaatttagtccgtctttttctgttccatgggacattaaaccccctccccccccccttctgtagcattgtttgccgaactgacgcgcatccaaaatcacataatggccatcaccacccacgcgttggacgtcggtgcgatgactccgttcttttggatgttcgaagaccgcgaaaagtgagaaaagcgccggattgaattgaaaagccattctgaacagattaatggagttttatgagcgcgtgtcgggcgcgcgaatgcacgcgaattacgttcggccgggcggtgagtggaaatgtcaaaaacccaaattaacacccatttgattcatgtttatttgaaaggcgtcgcttgggatttgcccatcggtctcatggacgacatttacgattggtgcacccaatttccccaacggattgacgaattggaagacactcttacggagaaccgaatatggaagaaacggctcatcgacgttggggtggggtcagatggtttgagaaggcaacctccccatgttcctgacttaacaccaaatctggggtggagggggggggggggggggggagtcggagagagagagcg

SEQ ID NO: 10743 - DNA, 1524 bp, Heterodera glycines
caaactaaaaacatgaaatttgtaaggccaatagtggatttggtttttttaatcaaatttttgaagcaaatttagtaaattcgagaaaaaataaatttggaaaaatttgaaatcttacgaaactgccggccctcgacccccttttttttttaaaaattttgttttatttcctgaaacactcaaatttggtaggaaatgggcaaagtgattaatttttcttattccaatcgaaaaaatcacatctttagtaattacctcaggatagcatggaatcgttgatccaccacttcaaattcttcacggagggcttccaagtgcccccgggggcggtgtatgtgccaaccgaggcaccaaagggcgaattcggcgtttatttggtggccgatgggaccagcaaaccgtaccgatgttacatccgagcaccaggcgaggcatcacatgagtgtcaattaaattcaaaattgttcaggatttgcacacctttccaaaatccacgacatcagctacatgcatttgatcccgggtaatcgcaacttcccccccccccccattaattttacatgtttaatctttattttctgcagatattgtggccattatcggcactttggatttggtgttcggagaagtggaccgataattgtggaaaaggcgggaattgcacattataaatgtcttgaattaggacaaattattctacccaaaatggggaaagctttgttttcttattttgtataaaaaaatcttacattcatggatagtttagaaccattaatgtttataagtaattttttgccaattagaaatttattaaagctccattatggtacgtaaagctatgcgagtcacagtaaaagataaaataacagaaaagtgcaactatcacggcctaaatttaaaaagaaagaggcgaggaggtacagttactagggctcggattttggtaaattgtcaaaaattaatttttggggttttgagactgaaaatctgagcccagccaatcacagttatgcaattatgtgaaaatggcccagagtcaaaaataattaaattaatccattggtcccgcgtctatgccatcggattcttcttcatcagttcgatgtcgctggccaccatttcctttaccaattcctgttatttaaatattttttaaaagtaaagtcgttgtattttccacctcaatctcgactttcggttcccagcccaattgtttcttcgctttgctcgggtccccaattaaaagttcgacttccgtcgggcggtaaaacttcgggttgacgcggacgcgcaaagtgcccttctctttctcgcggccgacttcgtcgacgccttcgccctcccaactgaaaaaggcaatctcggggaaatgtccgatgttttagtgaattatttaatgctgtacataatcgtttcgccgatctctttaaaggccaattcgacaaaatgtcggactgtgtaattccttccggtggcaatcacaaaatcgtcaggcgaatcctgttgcaaaatcatccacatggc

SEQ ID NO: 10744 - DNA, 1076 bp, Heterodera glycines
ttttctacattaatacttattttgacctgacatgtttcttttgtgcgccgattatatcctgtaaaatataaaattggctcttaaccataaaatggtcattttaggtaaatctgattctgatacttttagtccatataaattcatatttgggaatttttgggaatacatttttctatatgttggcactttttaattcatattatgatccataattgaccatttttgagctttttaatccatcgggcttttttagtccatttttatgtccatatttggcgatttttagtccatataatttacaaccctactgataacaaattcaagctaaaatccccaaaaattgtctcggcggtgtctgtaggcaccgaaggaggcaagtttaggctttataagcccgtgctttaaaaaaatgcttatttaattggaaaattttcgtgccatctcactgttaaataatccgggcaaaatgccatgaaaattacaatttatatgcttacagtgttcgtctccgaaacgcaacgtccgcgctggcaaatgccattgtagcacacttcttcgccgttgttaaagcctctgcaattgccgccctggcgcactttggccgcgcaatgggcttggccatgggaacggtcgcagaacaaataccttttgttcagattttaacgcaagttttattcggttaatattttttaatttattttaaatttttcgaaagtaaaaaatcgataattttttttgcttatttataacctaaatttgccaaattttagcaaaatttttttaattgatattcttgaaatgccaccatagtcattagagatgaatttgtaaattcgttttttcacaaaaatatcacaaatttcagtaattttaccgttcaatgaaccaaaatttgacaaattcaatgcttaaagaatatgaataatatttaaatttgcttatttattgaaataaatgtcagaaataagtgctatgccatgcgcaatttattttatattttttaattaaaaaattttcaaaaataaatcttttgccccgccctgcaaaaaaaaaataaatatttcatcatttattat

SEQ ID NO: 10745 - DNA, 3230 bp, Heterodera glycines
tatgtatgttaaatgaaaattcactgccgattatattcttcttcgtctaaaattcataataatttgccccctccaaaaaaggacaaatattgtagtcctggtttatcactaatattttatttaggaaataattaataattttttagtgctaattaattatttttaaataaaaaagtaattaattttaccgcattatccattggataagtcatttcgcggtcatttcgattctgtctggccactcgccactgttcccaaatctaaaattcaatgaattcttccactcactaattataatctaatgaaatatgcctaaaatacgaaaatttcttacggtttaaaggggagggggggggggggaacggaaaatctcagcgatttttaatttaaaaccgatgaatttcagcaatttttaatttaaaaacgagaatttcaggggtttttatttttttcaattgttttttacgcagtccacgaagctgtggtgcaggaagaacagcgggtcatttgccgaggtcgaagtgtccgacatgtgcccctggggctgggcctcttcaccgccgacaaacagatgcacatttccatgggtgacctgtgggaaaatgggaaaaattcaattcaatttattgtattctttttactttcaaagatttattaaaaaattaatttaaaattacaataaataaattgaaaattaaaatattttttgaggagaaaattaagcaagtgtttgttacctttatatgaatgtttttgtttcactttcttttattgaaaattttcattatcctcaatgttcaataggtttattttattattttagcaaaataattatttcattacattttgagctaaaatattgttgcctttaaatgaatgttttaatttgtttagtcaaaaaatgttattctctaattgtaagaaatatccgataattaaataaaatgtagtttaacttggtgctaggtcgatccaaaaaaaactcagtgattgattggtcattttccggaagcctatcgcaccactttcggggcaccaaaagtgcctgatccggaacccggaccggcccgattaagaacaatttttgttcagtttttcaagtgttatctcccaggccgggtccggttcttgacccgttcgcttggaggccgtcaggggtcggacacctctgccggagggccctcagccttgccccgacccctgtcgatggccaacccaagctaagcgtccggtaccagcggcttttttgtgcagctcgattagctctacaaaacggtatcaatggcgtccggctgtgtctactacaaatggagaaaattggcgagaagtatgtaaaaaattgaaaaattagaaaatgacttgcgtcgcgccgttcattaaggttaagcggacggcaccgtgattttgtgaatcgaataattaaatttatttatttaattttatcactcactgagtttttttttggatcgactcagcacgatttaacttgcctccattaattggtagtcaagttccatttggcacaactaaaaatattaaaagtttaaaaaaattatataaataaaaaccccaggttgaggtgagctgtatccgagcactttgtcaatttgttgctgattcagaaaccattggatccttaaaagccaaattcaatttaattagcgataattaatttacatttattgattggcacttattcattaggatttgcatttaattaattggcctgactcgttagcaaaaattaatttacatattgcactgactcattagcgaaaattaatttgcctttaattaattttcactgaaattagcgataattaatcgcatttaatttcattagcactgactcgttttcggtgaagcctttgcctccttgacccacgtgtctgatcacatttggtgtccccttaattggtttataattaaatattcaattatttgtatttttacagtgagggttcgccaccccgcaaatgggccagtcaccaaattgccctcttcgtccgtgtcgcccatgaacttaattttatgttaaaaatataataaaataaaaaagattttagattagtttcgtaaaaaatttaacgattcttatcataccaatggaaaatttctctataaattaaaaaaaattcaaaaaatttaggactaatttacgtttgtccataacattttggaaagtttaagcaatttaaaaatatttatataattatttagtttaaaatcattgaaataatcaaataaaattaaaatatgcttttgttaaatataattattattttacatctttcgtgaacatgtacgaatcgcccggtgttggcaactgtgcctccaaactcgagtcccaatagggcagcgacaccgatgggtccacttgacggagagcaatttccatcctaaaattttcagtaattttttttgcaacaaacgaaatttttagttttttttcttcttcttcaatttatgtctaagaataagtcgaatggaatacattaatgtaaacaaaaatgaccataaatttttgcaaaaattaataaaaatgtgtccaaattagggcaggcactttaaaaggaaattttcagaaaaattttctgaaattttgattataatccataaaattgagctatttatgtaaaacgaggcctcgtctttatttttaaaaattgccttttcataaattcgcgatgccacggcaaaaaggcgggccccgcgtgggccgcgccggattgaccaaacgcggcatggagtcccgcaattttgtcatattcaccactctttttgatggcattcattgcggcatgctaaaaatgattaattttaattgatttacaaaaattgtttaattattaattttttaattaaatttcatataaaattttaattagtaaaatgtacaaatttgattcgttcttcgtcgctgagcattcggtactctttccgcaccgacttcttcaatggttggttgtccgccagttggcaactgtttgagccttcctggccatttcctgtcaattatcaattaatcccattaatttaactaattggccccttaattactgtaccatttaagtatttgcagagacagcccaagtccatgcattggtacggtgttgcggcgattggcgcaagctcagcggcgagtatgcccgctatcaattagttcattagtgttaattacttttaataaagttttaataatgcttaattaatttgaattaaatttaaca

SEQ ID NO: 10746 - DNA, 1573 bp, Heterodera glycines
aaaaaatttaaatatatatatttaatttagtttggtgaatcaaattgcggtccaatcctgggattgccggcattttcgggatcgcttcttccaccggaggcgcttcctatttaaatttattcatttttatttagaattaaattattttttatttaatgtttacttactcgcgcatttttgtcccatcgatgcaattgtgtacagacaattctcagtgcttttgtcggtgctttagcacaagggtccacgtctgacattgatgcattgtctaattataagtaaattttcgtcaaattaaatactttttaatttttttaattaactaatttttattattaaaaaatattagtatataatttatttggaaagaaaactttaataagaaatttacttcagttaataaaaaagttccatttagagctcagtctggatctgtatccaggcccaggcccaggtcgtttttgggaaaccaggatttttctaggcctaggttttcctgtatttttcctggacctggaatttattctgggcctgcattttcctggacctgaatttttctggattttcactggatcaatttttcctggacctagattttcctggggtttttttgggcctaaatttgcctggctttttcctggaccagatttttcctaggttttcctggaactagatttttgtccaggaaacccaggtccatgtctacaaaatacagttccaggcttttttttcaaaaatgtcaagttgctccatttaatattcgttcaatattaattaaatgaaaatatattatttataaataagtaattattacttttgggcggtggcgttggcccagaagatttatccgtcttaatggccttgtctaaaattttagcataaagtttttttttatttgacatattaatttaatatttattagaaatttttagtttacttttttctgcacttaccatcttcggcactttcatcttcggttggaactttctcttcattttttgccacttttttctctgttttctcagcatggtcattagtggaagaagtggtgccattgttgttgttgctgtttgaaatgccattgtttttgttgttaattgccgatttttcatgcttttcttcacatttcgccacatttaaatatgtgaaacataaaaaaacgaataaaaatgctagtttacaattcattttctaaaggaaagcaatttaaaattaatttttaataatctaataaatatgtaataatgattcttcattattttttaagtgaattgctaaattaataacaacaattctttgaaaaattaatttctataaattcaaattattgtaaaattgaacaaatatatttataaaaaatttcaatttaattagggtgagatctaagttctgtcatagtgactaaaaaaaacattcaaaaattttgaaaaaatagcatttttttgatcataaaaaattcaaataaaaatcttaataacgcttttaaaaagcccaaatttttctccttcgaattgcatatccaaattaataataatttgtttgaacggttttaaaaaatccgtaaacaattcaa

SEQ ID NO: 10747 - DNA, 4381 bp, Heterodera glycines
  misc_feature (138)..(138): n is a, c, g, or t
  misc_feature (4062)..(4062): n is a, c, g, or t
  misc_feature (4092)..(4092): n is a, c, g, or t
  misc_feature (4094)..(4094): n is a, c, g, or t
  misc_feature (4101)..(4102): n is a, c, g, or t
  misc_feature (4124)..(4124): n is a, c, g, or t
  misc_feature (4132)..(4134): n is a, c, g, or t
  misc_feature (4155)..(4155): n is a, c, g, or t
ctcaaaacccgcgaaaaccaattgcgttttgggattgattatggtccctaattgaatcataatttaaaaaaaaaacaaaaaatttgtaaagaaatacgcaaaaaaattttttttaaccatttttaagcgaacaagaanaattttttgaaaaaagtctcgggtctcgggaaatttttggtctcggacagcactacaaagtatataaaaaagtttgtattaaaatttcaaaattttttagtttttgaaattctagtgtttaatagattatacaaaaggttttaaactccaaaaagaaattaatttcaagtcattaaaatgcaattcaacgattttttagaaaagttcataattttttatttattaatttacgaataaaaattaattttcccaggtttttataatattccaaaaatttttaaaaatatttttcgttgtcaaaatttttcaagaattttcttgaaattaggggggtggcagttttaagaaacgcactagcaccctttcccgctcactttcgggtaaaattttgccgaaaaatccttacccaatgccattctctgccggtccatgtgccaacaataataataataataattcatccgctttatattaccggaattcagtgtaaaagcaaagtaaaaagagcattgtatgagcttcaattttccttagtatgtcaatcgcgggcgggaagccaaggtgatttcgggcagttttcgtattttttacgccaatttcaaattgggtaattatagcaatggcatttatagggtggattcttatcattgaatttatagggcggattcttaccagggatgggccaaatcgaaaaataaaatgcgaaacgccaaatttgcgaatgtaaaaatacgaaatgaaaataaatgcgaaacgcgaaatccaaaaagcgaaattgcgaaacgcgaaatttttttatacaacttttttaataggcaaaatcatgaagcaaaaatcaacatgaaaagttggacctagaagcctagaaccagggctgccaactcaaaattttcaaaatctgcatttggccgacaaaaaatcagcatttgaggccttgtaaaattttattccaaatttaaaaaatcaataaaaagctttttttgcggcgcgcttttcccaaaaaactctttgcgaacggggggctggggggggcgccggaaggcgccgccgaaaaaatttttgaaaatttgagtgaaatttgttaacagattttcaccaaaaattaccaaatataaataggagttttggggttccgcggtgccgatagacgccgccgggggaaaaatagaaatttaaccatttttaaacaggttttcactggaaattgggcaattatagtcatttttgaaaatttttagggaatttaatccctcattcttaggggtgtaatattcgcgtttctcgccaaaatgcgaaacgagaaagcgaaagcccatccctgattcaccatggatttattaaacgaaaaatgggcggagcttctatcggcaccgatggagtcaaaattttccttaatatttttgaaaattacaaaaagtccataaaattgaaaagccgcgatcaaaaacccattttatgattcagaagaattccggcatgtaataagattctcattttgaatgctaattgtaaaattctaagacccaacatggagtttcactggttcaaccgaaattcgatccatttattcgggggaggcgaaagtctatgatttgaaaaaatttgtgttcaatgccgggacaaccgaattgaattatgccatccatcttaatgaggtttgtgagcagggctgggcgaagctcggcttagcactcgaagccgaagccgaaggcgaagcccaatttttattcgaagccgaagtccgaagctcgaagcccaaaaaacccgaagttttcgaagccgaagccgaagttttttcaaaaaatttttttaattccaaaatttttttcatcacaaaatttcggttaaatatcaaatttatcaattgacagaactgctagagaccaaccaacccctttcgataaataaatataatgaactttttgagcaatatattttgtaatttttataattcttagaatattcacggtttttgagtcaatttaaaaaataaagggaaattttttaaatttgagtgtaatttgttaacagaaaacaactgaacaacatgcatgagaaatattaatgaaaagagggatcaattttaaagaataaatcccgcaatgaaatttacgggattatcccgggcgggattgcgggattttgaaatttcaaaaaaattaggaataaattttaaaaaactccatgaaactaaataaaacttgttttctgctcggcgactatccgcggcgccgtctcacttcttagaattattaaagacttattttcttagtgttaaaaaaaatgaaaagcaagccatgacaaaaaacgtataaaagttaaaaagaaagaaataagtgaaaaaatttagaaacattttccaattcatgacaatggaatgacaacaatttcgtcagctccaatgccacatcctaaacaaattgaaaatgaataaataaataatttataattcgagaccggacaggatcaggtgcttatgtcgcgattttccagggatactgacccagatttattgggacttgaatcccggaaaacaacatgtccctgcattattctcaaatcctgatttagtgttcaaaatcccggcgccggtaatatttccctggcccggttccaaaatactggtcacgacttcggttcaaaatctcggcactgttaatcctacctatcccagggaccgattcccaaattctgctctgatctcgaattttgaaaaatttggtctttgttttaatagtaaaagttttgttttcttttcgaaactaactttcttttctcgcatctaatcgttgctgaagttcatgtttgtcgcacacaatatcacaatcacacagcaaagtttcgcttggctttaaatcgtaacaaccaaggccctcattagccaaagacggcacctttaaatgcaatagttactgtaggttacggtgttggaatggacaggccccatcattcacgaattagtaataaaaattgcttaaaattttcttttttgtaaaaaaattttcgaaatttgcaggtttaatgttttttgtaaataaaaatgcgaattttttgaattttatgaacttagggtagtcaaaatttttaggtatcttgaataaaacaaaaaaagagtccctgccttatgatttagccataggcttggcacaaccctggcggtaagtaataaatttgaccattaaaaatttaaaaaaaattcaaaaccctaccgtctcattggaggaggcccttttcatccgtttgcaaccgatcagtgcatccaattttttcaaaagtccttttaccctgtagcaatctttgccatacatatcacacctttcactcttcccttaaaaacaaacgatttagaagccagggcatagccaagggggaggggggaacggggcctaatttgtgggtgtatttccccaaccattagtgctgttcgagaccgaaaatttccagagacttgagactcgagattgagtcttgaccccctgaccaagaccgaaaccccgagaccaaaaaacccgagagttcccgagtcgagactctcgagaacagcactaccacccacccccacccatttttttaaagaaaaatgtctaaactttataaaaaatatttttttacataaatttcttagatcagttttccttggcggtgcctgtttagcattagcgatttccgtctcccttattcatcccaatttttgcaaaaatgaactagtcttaatatttacaaatacggtaactcattttcacatactccacattctcggatcattttcgcttggactaagccaatgatttgacgtgatcagtttcgaaaattcggggtcttcaatttggaaaaacacgggcattttgtgatctgatgatggtggcacaaaatgaagcagttttgccatggtgccattgatcatctgcggtgcgatgtcattanacactgtgccaacgccatcattcttaattnangttacannattaaagggatacacttttggngaaagtannnttacatatcatagggaattanagggtaattgttgcataattatgaaagagactcattagctaggtaggtcagtaatctctcgtcggtttctaacagtctgtatcgcataacttctcaccgctctcccctctctctctctctctttctctctctctctctatacttcctctctctctttctttcgctctctctctctcacacactctatacttcctctctatatctttctctctctctctctctctat

SEQ ID NO: 10748 - DNA, 1564 bp, Heterodera glycines
aaaaattaaattataaatatttttttcttcattttaatcacaatttaattttttccgtttattttcagcactttgcccaaggattctgtgcccgtggaatgggaacatttttccgccaaggaagtcatcgtcgatccgaagtaaattttgggaaattgcccggggcaattcacacaaattgaacatccgaaagttctcctgctttggtcaacggactgcgaagcaaatcgttgcattaaattagctcaatttgttgtagcaattcctccaaaagtgcaattgaaattttcgggggggggggaaagatcaaagaatacaaacaaattgaattttaaaaaattgttttaagaatggcacacacttatgtgactgaattggccggcggcattccgtccgctcgcggcacaaaatattcctacacttatgagtcccgagttgaggaggaggggaacaacgaattgttggaacagagccaacgaaggcgggaggagacggacgaggaggagatgaaacagcaacagccgatcaccgagttgaggagggaagaggaggagcacgagttgggcagggaattgaggagaggggaggacggcacggaaagacactgtacatctacgcaaaaggtaggcagagaagcagagcgatcgacaatcgatttgatcggacaatgccaaatcaaataagccaaccgatccttttttgcttactgaagatcacccgagtgaccaaaatcaccacgacaaggcaagtgaaacaaatcccggtgaatccggccgacgttttcttcgacgcggacggaaatccaattctgaacggatttgatggtgatcagcaacagataaatgctttattgatcagtgttgtggttcagcacagaacatttcggccagcccggacgacgacttcggcgcggcgatggacggctccgtcggcatcgacctgtcccggacgtacatctcggagagcgagcagtacttcagctccccacagaccagcagctccaccgccccgcatggttcccaaagcgtttcaccgcccagcggtgccaatgacaaacatttcttcacgggtttgccttttgattcactgtgccgctcaatcgcatcactttgtgttctttctcagcaacgcctggggcgcccggtttgcccgaagtgaccgaattgaccgactcgacaatcgcattggcatggcttaggcccgattttgacggcacttcaggaccactgatcggataccgagtggaatcaggcggtctgagttagatgaatgggacccggcacacgacgatctgttgggggagacggagtgcaaaagtgaggggggggggcacaggcagcaggagaaaataatcggccattagtaatctcggtaatactgccgaaggatgattgaaataaaaaatttaggcattttgtcccccatgttatttttggccttttcaacccccaatgatgtctttggacgccccaggggtttttctgaatatttctcttcccttcaggggccttattttttcttttcttcctttttccctcccctccctttccgcccttcaattttt

SEQ ID NO: 10749 - DNA, 2343 bp, Heterodera glycines
agaaaataatcggccattagtaatctcggtaatactgcgagggatgatttgaaatagataatttaggcattttgctcacccatgttatttttggtcatttcgaccaccaaatgatgtctttgatcagcccatggttttttctgatcattctcttctcttcagtgccttatttctatctttcttccttcttccctccttccttttccgtccttcaatttttctgattaacaattcgtttccaacccatccatcgttttgccgtgactcatctcatcagcggcagcctttgcctttgcttttggacgccctcagcattttttcctcgctaaaaatcatacgaaaataatatcgaaacaatttaatgccttttcctgacaattatttcctttaatgaaatgcactttttcaatttttcctcatccattttttgtttgtttttttgccaatgtttttttcattttacattttttttggctttgaaacaatggcagcccatcaattgtttatggcgtcagaaagacaaacttttcaaagttactatagaaggaggaaaagttggcagatgacaaacacttttaagagttaagaaagaatgggtcaaccaacgaaaaaagggtaataaaaaaatgatttttcaaataattaagtcaccaatttggatgccgacgaatggtaccaattccgcgtgttgggcgccaacatcgccggctttggcacgccatcgcccgcctgtgccccgattcagctgagaaaaggcaaagaatggggaagaacagactaagctcgaaagacacaaattgatcatttatttggggttcggctccgctcaaagcgaaagtcgggggtttgtctcgggactaattaaagccaactgatttctcgacttttggtcaaattggtttctcgacttcttaggtagttccctccctcttctaccaattcacccacaataaaacattctctctccccccatctccaaaattcatttccatttcaaggcgttatctttagcgcccatcttaacaaacaccgcagcaccaaagcgacgaacgttcaaagaacggaaaaggaaaagcgagaaatgtgggaaaaaggggaaaagagagggggggggggagaagagaagtaatgtcaaggctaaaagaatgaatatggaaatgaaatggagagaaatgaattgggaataatggcacaacagtaagaaagtgccaacaaatgtccgtccattctctacgcaaattggggaccaactaatcaaagaaagtccatcccacgacaatccaatcccaaatctgcggaagatatctaaaatttaaaattgaattgcctgaccctaaccaatgatttcataaaatgggctcctccacctgctgcaggtgcacgagatgacagtctcccgccaccgggacggccccacgtcgtcgcattggactccgaccgggcgaccatcgaatggcagccgtcgcccctggccaatgctgcgcctacagcaattaacggagtcggccaccattcccctgctggggacaaaatggcgatgattaatggcgttaatggcgggtgggggcggacgacggccgacgcggcgatggtgggatacgtggtgaggaaaaaatacggacacctaacctaatcgagagtcgagacaatttaaaagcatgcgaatgatcatttattgccctttcctcaggtggaacgccgcgcggatagcaccagcgaatggacccgggcaaatgatcggccgatcaacgagcacacattcaccgtgagaaatctgcggccaaacggagagtacgaatttcgcgtattggccaccgatgggttgggtcgacacgcgtacagtcagtcgtccggctttgtccgaattcggccctccgtccccttacggcagcaatctctacggcaacagccgccaccgccccctggacaaccaaaggtgggtgttaattcccttaattaccatgcggtggcacttgagactgagttttctttcggaaattatggccttttcccgacgttcgttcggttttgctgttaattatcccccccccccccaattgttgttaattaccccccccccaattgtcagttggtcgagagtgggctcagttgggtgcatctgtgctgggaacagccaacacaactgcagcccatgtctgctggtccttcgaagattgcctttttgatggaattgcgccagctgctgatggatgggagtcggggcgagtgggtgcctctgaggaagcaaagggtggacagagcagcgccggagggggaggagcagcagcaaacggagacggagccgatgttcatcaccacatcgttggcccatttcattggtga

SEQ ID NO: 10750 - DNA, 4693 bp, Heterodera glycines
atcgatcatccttttgacccttcgtgttgtccatttaaacccccctttcccccattccgtgcattctccctcattcatttgttgtttccatttaattgtgacccgctccctcccttcgctatttattatatttatttgtgtggaataaatcaatattattccattgactgttgaacggacacaacacctttcgtctttgcgctcaaaatttccaactttttctcttgtctccaatcgcctgtgcacaattcaagagtggtcaaatctaaaaattatacattaaaaagaaacaaaaaaggaaatcattaaatgaataaaaacatttgtaagtagttttatccacaaccaaaaaataatttcaaaatatctttaacaaaaaatgatgcataataaaaataaaacactaaaaaatgctaatacgacaaaattaactgagattttgattaaaagatttttttatattttaatattgtttaaattttttaaatattttaacagtttgttagataaatttcttaattttgataatatttttgcaacttctttaaattataaaattgtattaaattgtataacacaatattacttgggtattcttataaaaatggacatgaatgtaaattacttaaaataatttatgatataataattaatatatcatttatttcattttatgattctttcacaaataattataattatatttttaataaaagattattaatttgaagaatataataaagtctttttggctttctagttcagtactagaatttaacattcaattaattaaaacgcaaaatatcatctaaaataaaataaagtaacaaataaataaacaaatgaatgtttaaataataatttatctacgagctcacagtgttcacttaaaaaaaattttttaataataaaggcatattaagaaaataatcataaagaacagttctaaaaaattactgttcacattttcattaagagaaaaaaaaataaattctaaaattcaaacaatcagaatagaatattatgaataaaattttcgttaatatcctcaagcatactccttgcagacagtatttgcatttaattatgctaggagatggttaatagttttggaaattaatatgcaaaaatattaatcaagggcgaaagatttcaatatgataataatatccaattaaactttttccattatcaaacaaatacatttgacttttttcataagaatatttttggtaatctactttcaatccacaaaaatcataaaaataacatttaaaaacatatgatattattttttaataaaatcaaattgtgtgggatttcacataatattgaaataaaaattaatgaatataaaaaaaattattaattgatgaagtaattcaaacctacaaacaacgaaatacactatatgttaaatatagctaaaattatcaaaatgtgatgtcctgtctaaagacaatgctgcagttactgacaatgaagctgtgcgacaatttatttgtgaattataaaattcattttaaataaaaatttaaaaaaggaaaaaactgtttaatgataacaatataaaatgcatttactcaattgcgagcaaatttttacaaaattttaaacaataaaatatataaatacatccatttattaaagcagtattacttataaaaaaccatcaaaaaaatcaacaaaagtgcctgtattttttactaggtccatgtcatcaaaagaattcttattataaattcaaaggattaaacgtgtcaaaagtcacagaatgcttatttaaaaaaaatttccaggcggcgcctattggcaccgccggacctcctttgggctcttattcctttacgcccataaattttttttacatttcaaaattaaacaggccaatttataggttccaaaatcccgtaatcccgcgccggatcccgcaaattttaaaggcgggatttgcggtattaatcccgcgggatccggtcccgcaaaaaattaaggattccagtcctgcagctggatccgcaaatttgaaatttcctgtctctacgctatatcaagaaatatgaaaaacaaaatcgttttacatcccgaacattcttggtataaatccgacgcttatagattagggaatttattaatataaaaaagagcaaatatttgcattaaattaatttaaaaatggcacaaataaatctcttcggaatatacttttatcaacaataattaatattatgttaacaaacttctaagagtaactaaatttaaaatatacttaaaattctaaaataaatagaatcattagaatttaaaagatatctgaaataattaaataagaattaaatttatatagaataaagctttcatcaacatactttagtgtgaaaagtacaattttttcaaattcaacgcaagattttataaacaataagagaatttatatattatcattaaaatacattggattatgattcattaaagttatgtattaatgagctataaattttgcaaacggcgcgccaccaaacatcgcatggaaaatgtaaataaaacaaaacaaaaaaacaaattgaccgatgaccccctcccccctcctccctccagactcctcataaatttaggttgtctttacattaatttacaatatttgcgagcgtattccagttcttaaaacaaaaacggggtggaaggagaacaagaggtagtgtgagaagtaaaagatggcccagaatatgcaaatacgaagaagcaaaataaaggttattgacaaatgaaaaattattaattaaataaaaaacatcaaagagaaaacataaaatataaataaaaataaaaattagcatacatttgatttaacaaatcggaaaattctaattttcaccgatctaacaaaaaaaaattccgctgttaaatgagattaaaagaattaaatgtagaaaaaaataatataaaaaataaataaacaatataacttttttcaaatgtaagctaaaatagaacattatataatactcgaaaatttacaaaaataaaaaagcctgaatcgaaaaatatgtaaaaatattaaatgaatcaaagtttaatttctacgatttaatgtttcgaagaaaactgattataaaaacaatagctaaattaagaagatgttgataaaaacaatgagtctctctgcaaaaatgcgggtaagctcgtcaagaattatttcatcggaaagcaaaaatcttaactatataatttaatgggttactattaaaataaaaaataagtagataactaactatattatatgatatatgaacaaatatagataaaaattaattaatgaagaaaaattatggcttagaaagaatgagagaataattctaaacgcatttttaatgtattatagatatttatatataaaactcgaagaattattaaaaaaaatcaatattaatgtaaatttttaacgaaggtgtataaacccaaccttatcaaaaattataaaaaatttatcattattttgaaaattcttcaagcatatttgaaaattacgtaaattttttaaattttcaaagtagaaaatgttggttccaggttcgaaccctcagcatgataattttatgtaagttcagttaataaaagatttttttatggaaaaatttaggtttaggggacaaacacaaaacttacaaaaatacattttgtgaaatcgacgaacatttgagaagatttagatgggagcggggtttagtaaaaccaatttttaaatcaaaagccttaactttgaatggtacatcgttcactcaagccaaaacactggggctgcaaatttagttaaataattgtaagcttttacataaaatttcttaaataattgataacattgtattaaattattttttgagttttttatttattattattttcaaatttttattaaaaatgaaaaaatataattattagttattacaatttttgaaagtttatttttttatcaaaagatggtttccaaattaaaatatttaaggaaatataatgcaaaggtttgttattttttaaaattttctcttcttttcattctttatttaatattgctcatatatatcattaatattttttctattttcaatatttaattgggtgtttaagcatgtgccgtttcattgagtgaatcgaaatttctgttaatatttaaaaactgctttgttacctgtttgatattttgttctagaaataatttaatttaattttgtattacttttattgtatttatatgaacttttataacaaaatattacattggttttttttattcatgaacctatcaaattttatttaaaaaaattattaaaatttcattcaattttaacatttttattcaatttaattttaaatttatttgaatttctaccttactttaaaaatataaatgctttttgttagcttgctatttgttgtttatatatatataatgcgaaagaatttgtggaataggggcaatttttttgattttatattttggctgattgaaacatattaaaatttatcgtcaaaccatgacatttaaaaatttaattttttactaataaatattattaaaaaacccgaaatttctgaattttgataatttttataatattattttcataattttaaattggaatgaatttaaaaaaaatgtagtttattttaaaaaaattttaaaataaaatactta

SEQ ID NO: 10751 - DNA, 594 bp, Heterodera glycines
agggaaaatgtaagcgaaatttgaaaaaggaaggacaaacaattcgccaaataaataaattaaattttcaaattcttataaatagttttttgaaataaatgaatttacatttgggtttgtaaggggtaaagaaagaaattatgatctggaatttgaaataccgatcatttacaggcatagcgataggcagttttggttggggtgaacggtgtgtcagtgttcgcccattagcgaaccaattagaagaggctattagctgaccaaaaactgttaaactatttgttcagctcaaagattgtgcttcaaaacatgtaaagcttcgatttattgaatttattaaatgcattttctttatttaaaaaactcattcaaaagggtaagaaaagaaatgtaaaatattcaatgacataaatttgatcagtcatttcattttctttttcccgtttctcattgttgaagcaccgtcgacacggtgagaaagtgtaagccacggctcatcgacacatttccactgtctaaaccaaaaaaaagtcgtaaatggttggttcctttgaattggacttaacaacagacaatgccatactaatgcctttc

SEQ ID NO: 10752 - DNA, 3199 bp, Heterodera glycines
tagatttgctttcttttaacttttactttttacgattgcatccgccacttctccttcctttggcgccatcatcaaaaggagttcccctaattttaaattttccattttaaattccaatttcatttccaagtccgtcccctcccctctcaccgtttccgcagttggtgctgttttcccctttttcttcctcctcctcgtcccctccttctctttgtcctcctccctccgtttcttccctttcttttcccttcccttcgccgttcgcttccgatgagttctttttcgcttcttctttttcttctgcgccggacgatgtctctgaagagagccgtccgctttcgtccttttcttccccattttcagttgaaaaatgttcgacggataccgtcgaatcggctaaatttctttttttatttgttgtcgaatttcgagaaatttattctcgaatattattgccatttctttcccctttttcccccttcaccttctctcttccttcgtttttctcttttctgtttgtctttttttgtcgaatttttctctccaaaatgtgccgttgtcgttgtgcaattgttcccgcgatttgccttcgaattaattaaactactaattggccaattagcaagctaatgaatggccacaagctctgttcctattcactttttttgtttcgctaaaaggaatggacgacgcactgctgctgttgatgctggtgatatttgatgaccaattaacggctgtttaaatgataaaaaatgcacaaattaattaaaggaattccaattccaattttaattgtgcaaattataaatataaattatatttgttcccattcacttttttcttctccaaaatgttgtcgttgcttttgcttcaacaataacaacactttctgtccctcgtccttcttatcagttgcgtttatcttcttaaaaagtgccgtctcattcgcttcattttgccctttcgaagtcgaattggactctgaaaacggcactttaattgcctttgttaggcgcaccgaccggcatttaaaaggacagtttggtggtggacaatcagagcaataacggcactgaagatcacaaagttggcacaatgcaagaaaatattcagcgaattcataaatttattcgaagagtcggccaacggcggacagagaaacaaatggacgaatcagaaaaaagcgggaaaagaaagaagcaacgaacgaccgacgcaacgacaaaagaaacggcggacgaaatgcgccggggcgaataatggcgattaaaaagggggaattaaaaggatttaaggacggacggatcataggacaaaacgaaccaccgaatgagagaatggatgaatgagaatgggtgataataagcagacaatcaccgacggattatccttccgccgtatgaaagtgctgttattactgtaatcagaaaaaaaaaacttaaaattaaaaaaaaacacaatgactgacggaattgggacaatcggtaaaaggtgaaatgaagccaaaagggggaaaatgcaaaaaaagaagcaaacactaaggcatatcatataataaatacataaaaaagactccaaaaattctcaaaatatgaaaagcaaccaaaattacagtaatctcaaaatgttttctgttggagagaaacacaaagggatacggtaaaaatatttattgcaaaaagaacaaaaaacaatggacaaatatcgaacacaaccaaagaagaaaaagaaaagtcggccgacgtgccaatggaagaataaacccgtgctttttcttcagtttttgccgtgaaaattcggccgacccgtcggccaattgtgctcgtcaaattgtgcacaattccatgccgtccacagatttggcgggcaatgggaggaaaattcggctgaattcgcttccgcctgaggcaaaaggggcgccgaattcggatgaaggcaaatggcgggacgaagacgcagcagaaacagggacagaagcagaagaaaagccgtaattgcatagatcagaagtggaacagcagcacacctaaaaggaggagagattggcaaatgccaaaatgagaaaaaatggggaaagtgaaagtgcaaaatttggtccttggacttgaatttgctgatagctttctttttgagtttgtactggtccaaatccgtttatgaatttggagcgttggacccacagaaatgtgaccaaaaagtgcggtgcctttttcgcctttgtcctccgtccgtccaactgaccgtgttctgtccgtccttcacacatccgtcgcgaatgttcaaaatgctttcacaaattccgccgtggtcacatgaaaaaacgcttgcccggggcgaagttgtgttcaggcacgggttgaagttgccgcagttggccacggggcccgaaatttggtcgacgccggtgcggcacagaatggcgccggaggggggaacacagagacaacagcagaagagaagcggaagaaaggggacgataagagaagcggcagttgaagaagaagaagcagaggacgaaaatagcattggaaaagcggagaatgggaaagagtgggagaaaaggagaaatagagagagagagctaaaggggaaaagaaaaagggggtaagacacaccaaattaaaacaataataatttaaatttataaataaacatcaatggagcatcagcagagcaataaacattgataaaatggacaaaacgaagacggaagggaaatgggaaatgaaagagtgacccatcggaagaggtcaaaaacggagaaaagaggagagagaaaaagggagaggcagagagaaagggtggggggagagattattaattggtccattggaaatggtcgagagtttggacagagtcgagaaattcgcaaaattaaattcaatttactaatacatttttgtatatgtttggcgatttgatctttctttccattgtagcaaaagaaagtgcgaaaccatgggacacttttttatttctttgccaaaatattaagaaaggtaattaaagaaatgaaaggagagaaaatgagttggatgaatgaacggacgaacgaatgaacgaccaatcaaaacccatcaaaaagggaaagtgcgaatggtcggaggaaagaaaaggtaagttaaggggggggggggggaattggcatgccaagccaagacgaaagggccacaaacaaagcaatgaaagtgggggg

SEQ ID NO: 10753 - DNA, 1100 bp, Heterodera glycines
gagagtcccccgggggaggaacagcaaaacaaattgggagggcgaattaatgaatggaggatgataaaatggggagggggggcagagagtgatcattcataatcataattagaacaaaattaaattaattaattaattatgacaaataacaaagaatcggataaagaatcgaattggaaaagaaaaaagtgatcagatcaatgaattgggaaatgacctccccccccccccctttttttacctttttttgtcttttattggcaattggtgggggagagggaaggctaatctcaatcattaattaggtaataattaatcattaattaatggcagtcggaaatgcgtcagctgtttgaaactgaacgaatgccctgcaaaagtgaaaagcaccgttttgagttgacctttggcatcggcagaacaatcgagtgtttccacgtgcttttcatctgaccctttgtttttattttggccccctttttacgattaattgggttttgttgttttgcgataatttccaattttagccctcccccgtccgccgaatttctcatctttcaccaattcgtccaattaatgaataatagtaacggaaatgggaaaataatttggggcaaatgaaaatgactcggaaattcatcaaaatttttcatattttccgaattgacgaaacgattctttgtcggccatttggaaggccaaaatcagcggaagggagggaaaagaagcgaattaatcggaggacacttttgggggtttattttcggagctttacaaatgaatgcgatccgtccgccgaacaatgagtgaatgagaaatgagtgatggatggaaatgtgcgcattcggcgcatggaatcgttgagaaaacggagaaaatcgatgctaaatgttggagggggaaggcggagataatctcagaattattagcatccaaagcttcgaaaaaaggggagggaggggggggggggggcgaataaggaggaaaagcggggaaagagggggggacggcacataccaaggggcagcaaaagaaggggaacggcacgtggcaagggggaaatggggcaggggcaggacatggcaaagaaaggggggggg

SEQ ID NO: 10754 - DNA, 4814 bp, Heterodera glycines
cagggcgcgtatctgtccttatttataagatttgtccttatttggagggtccaaatcttacaaaataaaaatgtccttatttgtaagatttgtccttatttagggctattgttcttattttgttcttatttgtcgcttgtccgaaaaatctgtcaattttctttataaattctgattggcgtactgtttaagaaaaatatttttaaattttgcattataatttcctttttgctgttaattttgtctaattatttttgtatttgttgtttttctcttttgtttttaatttagcagctgcactaatactaacaaatggcaccgcctaagcgcaaaaatgtttttaaaagtgaatatgccactgaatttcagggtatcacaaaaagcaaaacaggagatgaattcgcgttgggacatttttgccgactatttcacaagcgatgggcctctacttttgcgcaacttttttgcttctgattcagccaaaactgtggtcacatttctcagtgttattctgccaatattcaattgaaaccgtgaaaagtctggcacaaatcaaattgaattacgatctcacttgtcccgaaatgtatgatttgctcatttcctcaccaaaattgttaaaaatgatcatgggaggtgaaaaatataatatttaatgcatttcgatcgaataaattgtaaaaaaaactgatttgaagcaattttgcgaaatgttcttatttttgaccctaaaatcttattttttggccttgatgttcttatcttgaaaaattttcgatacgcgccctgccatattatgaggcattggttgtggtgccgccagcatttgtggcgcaaatgccttccattttggtgaaaaggtcggtgccgttggcattgtggcacaaagtttggcattatttttgtaccaattgtttggcctaacaacggtggtgatggcgcgttcaattttggcaacgctgttggcccatcacttagttgtggcaaaaattaaattttgccattcaaaattcattgattcccaaaaagcaaaaaacataccgtagtaagccgctccaattgaaattgttgtttgagtacggtaatcgtttcctatcatttgttcagcagcaggaagaggattattaattgtttccaatgctattgtatgacagattggcgcaattaaaatacaaagaataattgccgtcattaagaaaatcgcttaataaacctgtttagttttctgactaaaatttaaggaaaatgaaacaaaatttatttttttaattttcgactttaagcaatggcaaaaagtgaatattttggattaaatggtcatatataaaaattaaaaaacaaaatctgataatttgaacaaattttccatttttattcgaatataaaatatttttaaaacacacaaattttttaattataatattacttatgtataagatattatatgtgtttataatgcatataatttttccaattttcacaaaatttcatgtaatattcatatgttatgttgcatattgcgggtgcccaacaaaaaactcaccatcattttatttattattattgcaaaatttttgtatttacaaaaatcctatgtatgtatagcatagtcattattcaacaagatttttttttctctaactcacttcatgaaacgtggcacaatgccacatatttctccattggcatagagaatttataaatttttcggatattagggttttttttattgaaattgtatgtcatagagttataatttctatttttttctctgactttcttcatagaaatgccatcataatacgtgtaatacgtggcacttaccataataaaaagcgatgccaaaggggggaaaaaatcattcaattcactcacttttcattcctttaatattttttaattttaaaatgtatttttaattacaaataaattaataatttacattttgctctactgatcaataagaactttaacaactgtcttcagtcttctgatcagtaggatttattattttcattaatttacattttcctccttcctactggtcagtagaaaattttttgccatttgatggtatttaagccaaataaaagtcaagctcttaattcataattcaactgtttgaaaacaaatattttccatcgaatttttaaattgctttttcaccaaaattggtaattttgtgcatttctgaaaaaataggccaaattttttggtataacgaaaattttcagcaaaaaacaaaaaaaaatttaatatgaggtggggtactttggattcagtaagaaaaggcaaacattttattatttccatagaaaagaggtgatgagaggagatccagttcatcaataaaaattatttttcatacttaataaatttaggaaaaatgaaatcaattttcttaattttatttgcatttttccacgttttaccgaatttggtcgatgctggcaactgtctttctggcaccggtttaaaatatttaaaaacatcttaacatttattttttatttcaaatattaagcgatgtcatgggatgcatattgccaaagtcttggtgaaaatgagtgccatgccaaagtcatcaccccgtgtaaattaagcgataatggccaatgtgtgataaaacgatcgattgggactgtgacaattaatgacaatagtgtaagtgattagggagaggtgaccattgctacacaattaaaagccaatttaacgggatttttggaggaaaaagctgggaccgcgacttgctgggacttaaaaagccggggatttggattttccaccgggaacgggaagcagatcaacctaaatcaaaatatcaagttaaaaaaaatagaaataaaattaaaaacatttgtctctaataaaataaataaaaaatttaaattaatcaaaaattttcaaacaaattaaaaaataaaattaaaatatttttacagaatttaataaaataattgtttttttgtcataaatttaatagcaaaggtatacaaaaaagtgccattttattaggcaaatgttttttaaattttttcagaaaatttggaaagattcttgtcaccgtcgacaaaatgagaggtgcaccaatagtcgctttgaaccatgtgtttggcaagtgaatgattgcgtattttttggtacaatgtttacctttaccactcaacgatgatcataaattaatttttatatccaaaatcggaagagcaaagaaagtgagtggaaaaaaatgatgatttttttgttgattaattattaggcgggaaaattggaccattttttgttgcaacatattcattgttttgttgataaaaaatttatttttcattttgaatacaatttaacaaccaattttttttatgattgtgtgatttatgcagaactattaataaaatatggcgattttctgatgagaaaagctaagaaaagcgatgtgcttaatgtattttattttcatgtttcagcaaaataaataattaagctaaaaatgggatgattattgccaagctcctaatcaacataaatgttgtgaaaattttgtcaatccgtgttgattgagtggtggcaacttaatcacagaaacaaatgtcaaaaaatgaatccaaaattaaaaaatttcctaaataaagtaaatcaaaaaaaaaaaaaaattttttttctatatttctttaacaaattttttttgtgacaaaatgtgcaatatttgaaaaaagcactatgaaaatgtttatcaaccagcaatgacaagaaattgtgaatttaattgctgctacaaacgaaaatatgcttttaatctcataacggatgattgattttgcttgtaatttttggtgtttgtttaaaaaacgggagggattttcatgccaaaaaaatgtttttttagggtttatgttcaatttagatgtttttttatggccataatgagggcagaattttcaaaattagcaggcataagctctgtaattatcagttacttttccatgtctttttttttacggacattggctcaatttttcctcaaatttcattaattttatttgtaattggtgctccttctgtaagtgccgttttatttccgttgtcattacaaccgactttcgaattttgagtgatatttgctaacagatttcaacaaaaaaaggctggtttttgggattacgaggctcaatttgtacggattttctttaaaaaatgataaaatacaattagaaaaattaagaatcatattttgtcgataggaaagccatgagtagggtcgcgacttttagtgacgaaaaatcccgaaatagttaactaaaatagtgacgaaaaagtgccaaaataatgaagaaatagtgaaaaaagccgaaatagtgtcgaatagtgacgtaattttcagccaaaaattaagcaaaagtaatttttattcactgattgcagttgcaaatgagctgctacatttcctttataaaattctcttagtaaatattgacattttttaaatcaaaaattttgtcaagaaaaaaaatttgggggaagaatttttgaaaaaattttccaattcttagtggtgtatttaaaaaaaaattttttggtcgattcttatgggtgtatttttttgaaaaatttttagatcgattcttaggggtgtattttttgattttattgcatttttgttaacaaattttcccaaaaatgtcaaaaagtgaaaaaatagtgacaaaataccaaaaaagtgaattttcactattttaagtgacgaaacgctaaaatagtgatttctagtgacgaaaagtgacgtccaaacgaaaaattttaatgtagaaaacgtt

SEQ ID NO: 10755 - DNA, 1337 bp, Heterodera glycines
acaggcacggggtggacgcggtttccagcatggaaccttcgctcgttgccaacgattggcgagagaaggaggaaaatctgatccaaaggaagcgactacagcgtgaaaacccggtgtattggtcgcgaatattggaggaggaaaagcgagccggtgaggagcgccgcttaagggatttgcggttggagcacacatgggatggctacaaggaaggccacttcgagcgtcggcacaatgacggctcgtttttcaaggcaatgaaaattttttcttgtgtttttatgatttgaatttttcatttaagtctatgtaatgggggtgaggggataaaatgattcacagaaatttacggaaacgcttggaaaaataaaaattggtagtttgagttggtccgtgtacgggcgaccgcctcacacactgagtgatattgcccctcattagatttcgacaacttaagcctcacacccgagcttaatcggtctttggttggtgttatttcatgccaccaccaaactttctcaatcttctcaatccccctccagtgcggcaaccactcggcctatctgtccgcgtgtgggaatcaacgtaagcctcccaatccctcctcagcccctgcccggtgttggcaggtaaagccatgcacccggcctatcaatccacagtggtggcaacttaagccaccaatccctcagcccctgcccggtgttggcaggtaaagccatgcacccggcctatcaatccacagtggtggcaacttaagccaccaatccctcagcccctgcccggtgttggcagttaaagccatacacccggcctatccatcctcgggtgggaagcaacgtaagcctcccaatccctcctcagcccctgcccggtgttggcaggtaacaccatacacccggcctacccatcccgagggtgacgacaacttaagccgcgaatcggatcctcaagctcatgggttggggactttaaagggaagaaagcaaaaaaaaaaggaaattgaaaacattttgaaaagattcgttaaaagacaattaaatgccaaaataaatgacaagcaaaaaataatgtgcattttgcgctacgtcggcccgcgggcgatgtgcaaaaaacgggtgtgactggttcctctacccacgacaatctctgcctttgtacattttgtcgtgggtatgtgacaaaaacttctgtgttcaaaaaacatgagcagtgtacaagcgcctgggggtgtttcggacaaaaacgagcgacggagagcaaaaaactgttgctcttttcatatgagaacgttgagctaggtgccctgagagacgaataatgtttgtgatcggaca

SEQ ID NO: 10756 - DNA, 2383 bp, Heterodera glycines
  misc_feature (2351)..(2351): n is a, c, g, or t
ggggatttgtatctgattttctaaatcctttttcttcatcccccacccccattcagaattgtgaagaggccataaatgattactggcagcgatatcgagaaggcaaagagtacagagagcggaagaaagagaaaaagaggaaaagatgaaaaagacgggacagcggaagagaaaagtctcgggaatggctacggccgcgggagaaaaggagcaaaaggaggaaaagaaagaggacgaaaagaagggagcggaggaagaattgcagcaacagctcccggtaaatgccgggactgagggcacaaatgaaggaaaagcagaggtcggggaagaaactgatggggcggaaacaacagaggaagcgaaaaaagagatgggcgctgccccgggggagatggtggaggacgagactgaaggtcgggaggatgtgtgcaaaaaagggaattcggaatcggcagatgcgggactggaggttgaacagttgaagaaaatgttacgcgacagtggccaaatgccgacggacaatgccccacttcccctacctcgctgggtgaagggttgtggggcattcaaaaggaaatataagaaaatttatgataacatgattaaaataaacaattagtgagctgtattgtattattgttgcgtaataaattaaaaatggtcgattaatttttaaaaatttttaaagaaattaattttaatgtaattgtggaaataaataaatagagaaaatggaaattagaaattgtaaataaggagaaattttaaaaaatttttaaatttaaattggaaattaaattttaattgaattgtagaaataaataaatatagaaaatggaaattaaaaattggaaataaattaataataataaattaattggaatggaatgaaaaaaattaaaaatgaaattaaatggaaaataaaaataaaataaactaggaattaaaattggaaataaattaaaaataataaataaattggaatggaatgaaaaaaattaaaaatgaaattaaattgaaaataaaaataaaataaactaggaattaaaattggaaataaattaaaaataataaataaattggaatggaatgaaaaaaattaaaaatgaaattaaattgaaaataaaaataaaataaaacaggaattaaattggaaataaattaaaaataataaataaattggaatggaatgaaaaaattaaaattgaaattaaattgaaaataaaataaattagtaattaaattggaaataaattaaaaataataaataaattggaacggattgaaaaacaattaaaattaaatggaaaataaaaattaaatacattagaaaatggaaattaaaaatagtgggaaattttgaatttgttaaataaaatttaattaagttgcatagttaataaatgtgaataaaaaatagaaagtttgaaacaaattaaaaataataaataaaattggaaggaaagaaaaaagaattaaaattaaatggaaaataaaaatattagaaaatggaaattaaaatcaattaaaaataataaataaaattggaaaggaatgaaaaaattaaaattaaatggaaaataaaaattaaataaattgggaattaaaaattgaaacaaattaaaaataataattaaaaatggaaacaaattatctcccccgatgggaagggaaggggctaccgccggcgcgcgctgcgaagggcacaatgtggcggtaaaatttacacccacatttggtgccatatactacttacatataaaatatactaaaaataaatgataaatatttacataataaaaacaaataaatttttaatactttaaaaaatttttgcaatcaataaactttaatcaaaactaactaaaaatataaaacaggtgggtaatttttttaaataaataatctaaagaatagattttcattttccacttatgcaagattttgagcactgcggacacataggtccaaattaacctctaacgcaaaatataaaggaaacattaaacataaaaatattattaaatccaaagaccctatgaaatttatggggcattttttgtctcaaaaaattttaatggacaaaaactgaatcgagatgggctgaacgtggcgtgaagatcaatgagaattgtttactaatagacaaatgataataaacaaaactaaaatatttgtaaaaaaaaactccatggaataaaaaagaaaaaataattgctaagaaatgaaactaaaatattttattttttctgtaatatttttttggcttagaaactaataaaaaaaactctaataaatagagaaaaataataaattcatagaaaaaatattatttgataatagaaatattnttatttatatatatatatatatatatatatat

SEQ ID NO: 10757 - DNA, 2304 bp, Heterodera glycines
  misc_feature (2294)..(2294): n is a, c, g, or t
aaaaaagcttaacttccttagagaaaaaaataacaaaaaaaatgtttaaaattttggtaaatattaaatattaatattccacattgatgaaatttttgtctaaggaaccacacaacatgaataatatttatatgtttattgttataattaaacaagttaaataaataacgacgcatataaaagaaagaatataaaaataattcttcaataaattttaaaaagtatcataattcagaaaaataattcatctttagaattactcgcaagcaattaaatttatataatagaaaaaagtaagaaagcttttttcaatttaaaaaaaataagattttgaatttttatcataattgaaaaacaaaattcaaaattaaatttttacataaaaagcaaaatggttttaaaacccaaaaatgatggatattcgcaatatcagcgcaagagaaaataaaaaacgcactgagaaaaaattatcaaaattctatctttttaaaataataaatatgtaaatgatttttttttattccataaaacaaatgaaaaataatttaaatagaaaaaagcaaataataaatatgataaattcgttacttaaaggaaaataccggtggaaataatttgttatatataaatttcaattttcaaattcatcacattaggcaaaaccattattaattaaatcaaaatgcaattttaaatatcacaaattattatattttttgaaaatttaaaagaaataaccaatatcagccttttttgtacaattaagagaacaaataaatcaccggttaaaaaacattgattcaaatatttttaatgagcaacaattataaaaatctataaaacccaccaagatacacatttacgacatagattaaatggaataaatatgccgtttttatcaaaacacttatgacaatatataaagatcaaaatatcctatcgcaatgagccaattttacgatcatgattttaaaatttatttattttttaatttaaataaaaataattataagtttaaaaattaaaataaattcaaatgaaaatattccttccgttgtatggccaaaaaccaagaaaattaagatttaattaatagttataaagaaattaataaataaaacaaaagacggaattcttccgataattaatctcaacagtaaacgattacaaaaagagaagtattgacatcaaagatttatgcccgcaaaatcgaaacatgaaagataaaatggaataatatgccgtttattatcaagacaaaagaccatttaataagatcaaaaccatgctaccaattctaaatttaaataaataatcgaaataaaaatcacataaaaaggaaacactgaataacaacactttgccgttcatgtggaaaagaattaagtaaccgaaacgggtcaacaagagggttaattaataattgaattaaaatttaaaaattaaacatagtaaaaagagcaaaactttaaataaaaatttttaatactttcaattttttcaataataaactttaagctgccaaaatgttagggtcgtttctcattttaaacatattccttcagcttttcctattgcaaccttattaatagcaaatttcatccaaaatttgggaaaattttctcggcggtgccttcggtccgcctgaccagactccaatcgtcgggtcccttcaaaaaaatttgtctgcccatcacccccttttcatgtataccgccagcccctaaatttttatttttatttttttcaaattggttatgcgtatttaaatttaataatatttttcgaaatttccaaaattccacacgtctaggccagctcgaactgttccggcaacgtactgtttttcgaaaaaatcgtcataactttggtctaagtcataaattaaacatttttggtttcattcgatagccctaaaggttctttatttacagcaaaatttttaaaaaattgatcatgttgaaaaattatttgacaaaaaagcacaaagttcgtattcgtctttgaaaatatttggacaataataaaaaaatttatagttttttaaatgattaaatgatctaaaaaaagagcactcgaaaatttttttctgccatcggcggacagaattaacagaaaaacaaataaataaaatttgtttttttttcaaaaaaaattcatttattgttccatttgttttccatgaattgtttgagctcaaaaattgtcgttctgagcccatcaaattcattgcgaagtgaattcatttcgctttcattttccttttcgaataaatttatttttttattatttanattattatta

SEQ ID NO: 10758 - DNA, 1845 bp, Heterodera glycines
tttggttgggtttttctatattttttttcaaatttgacgagtgtgaattttaaatttgcttttttcggtgttaatttttgctattttcccactcagtcccaacacttcgcgaagcgattgccgccgcccgctcggacacgcccgggcccacctttgtcgagctgccattggacgtgttgcaaccgtacggcaaagtgctggccgagaccaacttcgttgggcacgcggacaccgcggaaaaagtgccggatgaattgggcggggcgatacaattattcccccccccccattcccgaccaaaattgttaaaactgaaaattttagaaagcgttcaacgaccgggtgcagtgccatgttgaccgccaatttcacgaggcatttgccgccaccgaattcggcccgttgccggtccgtgtgccgacgccggacggcgcccaactggccacggttgcccaactgcttgccaaggccgaacgaccgttgctgctcatgggcagccaggccatgttgccaccggttgagccgaacacactcgtggacacagtgaatgtgtgttgttttattggaacattttaacgaaaatttcatgaaaattatttaatgctttattttaattaaatttcgtaaagttacattttttctagattttttaatttatttttgtttttgaatttctaaaattttaaaaatcccaatttttataattgttttctgggttggggaagcgaattgcaaaaatgtaaagcatttattcgtatattttgccccttttgacaatgccatatttaaaaaaaataaatttcccagttttgcaacaattttcgaccaaataaataatgaattttggctcaatcggacactcccccgacattgaaatttgtgccattctccgtttttgaaatttgtgccattctccgtttttgaaatttgtgccattctccgtttttgaaatttgtgccattctccgttttccctccaattttcagagtcttggcatccccgtctatttgggtgggatgagccgcggtttgctgggcgccgactcgccaattcaaatgcggcagaatcgcaagttggcactgaaggaggcggacttggtcatattggcgggtttaatttttaaaaaaatgcctaatttcgctttaaaatgccgcttttcaggctccgtttgcgattttcgtctctcttatggcaaaaatttttcgcccaacacaaaaattgtcacaataaatcgcagcgaagaacaaatgcttaaggtgagcaaaatgaatgaatgggtagaaaaaaaaacggcaaaactgatgatggccaaattgagggccaaaatgggcacaaaatgcccccaggggtaggccaacccaaccaaagggtgcactatgtttacccctctctctctcaccctccgaattccaaaaaaaaatttctgttatttcttattaatagagttctaaccaaatcaggcccgcaaccaaaaaaaaaaaattcaggaacggcactcgaagagtttttttttggctcctccggacaaaaatttttgtccattatttttcataaatttttggtgccgtgggaaaaagaggataattttaatcattttcgataattttggccatttaagacataattttggcaaaaatataaggaatttgggatccggcgctgccgttaggcaccattggcgaaaaattaggaaattttgggtcaattcgttaaattccggggaaatcttaaaattgttacaaaaatattaaaattatttcatcagattatttagttctgctattttcaagaattcaaccatacatggaaaagggggggggggggttcaaccgaaatttttgcgaa

SEQ ID NO: 10759 - DNA, 2153 bp, Heterodera glycines
gattctatgatacagtgatagttctgtcgtaggaaattcctcaaacgagctgggaagacctgaaaatatgcacatagaaaagcctgtacaagtggtattcaaatttccgagcagttagctgggtctgtattgaccctctgcaggattttcgcatattttttagaagacctttttggcagctttggaatggtataggcatctgtcatgttactccaataatcgccgagatatgcgcgtccgagagtcagaaaaaacaaatgcggtagcattatatataaaaacactgttacaagatacgaccccccccccccccctttccatctatgaattcaactaatttcaaaattctgatgcttttgctttcccacagaaccatgacgtgttttggcaaagtgccgtcgctgtgcaggcggacgtggcgctcactttggtcggccttcgcactgaaatggtcgcgcgcggatggaaatcgccgtgcgggtgggccgaattgttgcgggagcgtgaggccgagactgaggccaaaaatgcgaaacgaatggcccaacggccggcggatggccacatgaacccgctggtgttgttggacgccatgaacaaagtgtgatggtgttccaacaaattcaatctcttttttgatttcactcattcggtgccattctcgaatttgaaaataccctcgtttccgctctactctcggcggcattattgtttttccgccaggcacggtccgggggagggcgcagatcgtttccccacccacgtccattttttttaattgcaaccttttcaaaaacaatttttttataagaaaatctcaagaaaaaaaattcaaaaaatttaacgacgggtgaaatgaagtgcattcattgtcaggggaaaaaatttttaaggatgatgaaaattcccgtttttcttattggtgcccccccccttccaaggcgtaaccctggtaccacccctgttttcctgtctcacaaattctttttctcttgaacagtcggtctaactatgcccctaatggtattgttgtacgccaaatgcctgctttcggggagagggggcgatttgtttccatgtcgttttttggcattagtcaggcgatgccgacaggcgccgtcgggacaaaatgtttttttaatgaatttgttttttaaaaatggtatattttttggcactttgcttccaggtacttccaaaggatgccattttggtggcggatggtggcgattttgtgggcagtgcggcttacattgtgcgccccggtggccccctccaatggcttgacccgggcgcgtttgggacgcttggcgtcggtgccggtttcgcgctcggtgccaaagcggtgtacccgcagcggccggtggtgatcatctacggggacggctccagcgcgtggggccttattcaattacacataataataatatttcgtaaaattaggtctcaatataaacgatgtacaaatcattaaatcgtctcataataattatttgcacttcaaaaatataattagctcaatttttctattctcacatttttcttgacctaattggtgtcattctaaagcctaatgggtcaacaatattttgatcattcatttttatgaacatttattttaaattttttttattaattttaaactaagggtgttgactcgaaaaagcccgtaaaacacaataaaaatttaaagcaacagatatttcaattaattcaactggcttttctgcgccgaatgataaatgccgtgttcagttattcgctgatggactttgacacttttgtgcgccataaactgccggtgattggcataatcggcaacgacgcgtgttggacacaaattgcgcgcgagcaagtgcccgttttcaagacagcagtcgcctgtgacttggacgtaaaataatcgtttttttattcccaaaattgccatataatatatatataatttaaaaattaaaattttggtctgcttacaattagcgcctaatggtccattttggatcaaaatgataatgcaaatttggtccgatgtttttgaaatgaaatcctctaagaaatttccttctattttccgtctcgggatattccaacccattttttatggtaggaataataatttaaattttacaggacacccattatgagcaatgaac

SEQ ID NO: 10760 - DNA, 1542 bp, Heterodera glycines
agccattagcactttcatcatttatttattttggtattttttcaaaaaatgtctcagaaatcagtcgttgaccctactggctggtggcctatttttcaagaattgatgatcaaatgaaaaaaccagcagaaattcttaatttaatgtattttttcctcttacattttaatgaccaatttgtcatgggttcgaatccgctagacagatggtgaataattttgattttttctttaaaatatttttgcatctaattcttttaattcacttattttttttgctgatcaccttaaaaaagtttagtgactctagaagtatttttaattttattatgattttttttaaaaatgaccagttttattgattatccgaaactttgatcaagtttttctgattatttttggcgcccgtagccaaaaaagaaattacataactaaattgaattcgacagatctaaaatatatttccaattttgtaacttttttttaattattagattttttcattatttttgcaatttttttaaatattagcattaatattatgtatgttcatttttacatatattattttcacataattattttttacttcatttttacaatgagaagaaggccttttccaataaattcgtggattgattgacgtttctaaagaaattttaatataacaaattctttttaaattaaaaatattataatgtaaatgtgaatagactaaattaaatattatttttcttcttttatattattaaaacatatttagggtcttttaacaaaatccaaaaaatgctaaatttttttcggtcattccgcaaaaattttgcaatcgaaatttaatctttaagaattcacttattttaaaataaggaccaaatcatggcttttttctcactaaatgcactaattaatgataatgaaaagtgaaaaatagtgtctttttctttctttttttagtaaataaaatcctggtttattcttacatttttaccatccaatttatacaaaactcatacaaaagttaaattttctctaaattaatagaaaaaagtaatattagtaataatactacataggttcctaaatacaccacaaaatggccacctctttctcgtttcttggcctttattttgccattatttggctttgcttctttaatgaacgcgcaaatggcaccggtggaggcaataaattaaaaacaattggcgaatcctcttcaaatatgggtaattaaataaacaaatattttgactaatttattcaattaagtctctgtcgatcaaatcaaaaaaatgcaaaaacaaataaatgcattggaggaggaagtgaaggaattaaagaagcaaatggtatggaaaacgaaaaaacaataaaaaattagattaagggaataggagttttaaagccccatattcagaggtgggttgaaaataaaagtcacgctgtagatttaatttgagtacatacggtaagtgtcttttactgtatttagaaaataagaagataagcaacttattatattcgccttgaagttgaaccccataaa

SEQ ID NO: 10761 - DNA, 4454 bp, Heterodera glycines
  misc_feature (49)..(49): n is a, c, g, or t
  misc_feature (60)..(60): n is a, c, g, or t
  misc_feature (62)..(62): n is a, c, g, or t
  misc_feature (65)..(65): n is a, c, g, or t
  misc_feature (67)..(67): n is a, c, g, or t
  misc_feature (73)..(73): n is a, c, g, or t
  misc_feature (91)..(91): n is a, c, g, or t
  misc_feature (95)..(95): n is a, c, g, or t
  misc_feature (105)..(105): n is a, c, g, or t
  misc_feature (108)..(108): n is a, c, g, or t
  misc_feature (110)..(111): n is a, c, g, or t
  misc_feature (114)..(114): n is a, c, g, or t
  misc_feature (146)..(147): n is a, c, g, or t
aattgaatgaggtacattcaaagggctaatgctcttctacataggaagncttcatagtangnagntnttcggnaacgctttctcgggaaanttanaaaagatggngangnngtnaaatatgatgaattgattgaggattgcatcannattttttgtctacaatccatgaggcaaaattgatcgaagcaacttccgtgtcatcaaggacagtgaattcagtgaagccaaaccaaagaagggaaagaccaaagccacaatccaagcaaggccaaccaaacgcaactccaactcagcttcaatgttggagatgtgggaaaacgaaccacacccacagagaatgctcgcacaaatcggctaagtgtcccaaatgtcactacaccggccatttggagaaccaatgcgaaaaagtgcaagagtggcgccgcaaaaacttcaaagtgaagaaagttggaacgcttagcattggaatggcactcaaatcaatcaacagtgcttctcttataaagataaaagtcctgctgaacggaaggatcgtgaagtttattctcgactccggggcagagatcaatgtcatcgatgaggaaacttatcgactgatcggacagccaaaaatttgggaatgtgccgaaagaggcagaatgttcgacgggacagaaaaatcttttatcggaaagggagaaggacacttcgaattccaaggcgtaaaatttaaagaaaatttttatgtcgccgagaagggattgatgaatctgttgagtgtccaaacaatggatgcatttggactgttggatggcattaaagccaaaatcaactctccgataaatctttgcagcgcaggggaagaattgagaggcaaaacacatgccccaatcaaatccaacaaagttgccggcaaacgaaacaaggacgccgagaaagaaatcaatcagctaaagcaggagtacaccaatgtttttaaaactgaattgggactctgcaaaaaggtcaaagcgcacttagaattgaacgccaacgcacggccaatatacagaaaggcccgtccggtcccgtacaacgccaaagaagcagttgacggagaattggatcgttgggagaaaatgggagtcatcggcaaagttgagcacacagaatgggcagcaccgattttggtcgtcaaaaaggccgatggtagcgctcgactgtgcatcgactattcaaccggactcaacaatgcgctaaaagaccaccagcacccgttaccattaccggaagacatttttgccaccttaaatggaggccagtacttttcgcaaattgatctccgggatgcgtatcttcaagtggagctggacgaagcatcgaaaaagctgtgtgccattgccacccatagaggaaattatgaagtcaaaagacttccctttggcatcaaaacagctcctggcattttccagtcgataatggacaaaatgttggcagattttgacttcgcgacagcctacctagacgacatcatcatcgtcagcaaggaccaaaaaaaacattctgaacatttgaaaaagatgttctcgcgatttcaagaatggggatttcgcgtcaaacgagaaaaatgttcgtttttccaagatgaaattaaatatctcggacaaataatcgacaaaaacggacgcagacctgaccccagcaaaatcaccgcgatcaatgagatgccagaaccgatggatgtctcttcacttcggtcatatttgggaatggtaaaccattaccaacaattcatcaaaaacatgcgcttcgtcagaaagccgcttgatgatttgctgaaaaaggacgccgaatggaattggagcgataaatgcaaaaatgcatttgacaaaatcaaaaaaattttgtcatcaaaattactgctcacgcactatgaccctcaaaaagagatcgtagtagcagcagacgcatctgatcagggaattggagcagtgatctcgcacaaattcccggacggaacgatgaaagccattgcgcatgcatcatccgccttaactcctgccgagaagaactactcgcaaattgaaaaggaagcactagcaataatttttgcagtgcagaaatttcacaaaatgatctatggacgtaaatttacgctcctaactgatcacaagcctcttctcgccatctttggcaacaaaaaaggagtgcggcaatgcagtgcaaatagactgctccggtggtcactcattcttttggcatacgacttcaacatcgaatatgtcaataccaacgacttcggccaagctgatgctctttcacggctcattgccaaaggaaaagatgctgaggaccgcgtcattgcaaacacttgcgtcgattcggaagtcgagtcaatactcattggaaccatcgagaagcttccaatcaaatttcaaaacatcgtcgagtcgtccaaaagtgatccgaacatcaaaaaggtcatgaaattcatcagaaatggctggccgcaaaatgttggaaacgaaaatgtggaaatcagaattttccaccaaaggaaggaacaactcagcatcaccaaagattgtctgatgtatgctgaaagagttgtgattccaacgcaacaccgagccaaaatactgcaactgctccacaaaggacatcctgggatgaaaaggatgaagcagttggctcgcgaatatgcgtactggccgaaaatggaccaggaaatcgaacaattcgtcgagaattgtcagccatgccaaaatgagtcaaaggcgccaaccaaaacgcacctgcaatcttggccaaagacaacaggaccgtggcagcgagtgcacattgactacgccggaccgtttttcggaaaagagtacctgattattgtcgacgcgtattcaaaataccctgaggttttcgaaatgccaacaaaatcgacaatttccacaatcgaaaaacttcgatacctcttcagtcggcacggactccccgaaactctggtctcggacaacggaacgcagttcactagccatgaatttgcaaaattcacaaacatcaatggcatcaaacacctgttctcggcaccatacaacccgatgtccaatggccaagcagaacgatttgtggacaccttcaaaagaacattccgaaaattaaaaggggaaggggctccgagtaaaagcatcgtcgaaacttttctcgtcagctaccggactacccccaatgattcgctcgaagaaagcaaatccccagcggaaatgtttctcggaaggaaaccacggacaacgttggatttattgaaaccgactcccactcagccaatagagcgaaatgaggagatggagcaaaggttcaaccgacgttatggcactaaaattcgagagtttgccgtcggcgacaaagtcttcgccaaacaccgaatttcacaaaattggaaattcggtgaagtgtccaaaaagagaggagtcatttatgacgtggacttccgtgacgagccgtcaggaagattccatgccaaccaactccgtcctcgacacactcacgacgaaaccgaccatttgcaaatttttctcgacgcatttgacatcggaaaacaaaccgatcgccaaattgccaatgagttggaagctcaggatgagcccaaccaatccgcccaagagcagggactcgagaatgatctgagtcagtcagacaacgacgaatcagtggccgaagaagcagatcagcaagttcagccacgccgatatccgcaacggaatagacgtgccccacaaaggtactcgccgtgagccgctcaaaaggggaggtgttcggatgagcctatttgaattatattggcgatctgtctattcaaatccccgccattttgttgttgtcactcgcccataaatagacggtcattccctccctcctggtcttttcccctcattcattttattttgttattttcctccgaccaaattatcttcgctttttatttattgttcgtcaataaacatttatttattgattgtcttccttaaaccctcggaccgaacacatacctactttcttaattgcactgggatcacatctaaacgactatgctaaaaacggggaactaaactgtattaatatttttaacaaattgccgcccttttcgcctaccctgttaagagaaatcttaatttcactaataatttctcaattttcttctataacagattaactcttctatggtgagtttttcaatttctatgtactttattaagtaaacaataattatcaaacatttttctatgattgcaaagcatttaaaaaatcataggcttgtttattttcattatgttttggaaaggtcaattaaataaacaatttttttttgtaattttattaattgtataaatcttatgcaattttctataagcaatcgatagtgtaacaaatagagaagataaagtctgatcaagcacacacctttcattatttccggttaaatatgtgttcatatttaacaa

SEQ ID NO: 10762 - DNA, 4561 bp, Heterodera glycines
tgccgccgcgttgtccgggtcgtctgatgacatttgttgttgttggttgttgtgttcgatgctttgattgtgtggccaagagaataaatgaatgatgaaaaacaagaaaacagtcgctatttataacacttttttacactgacaaattgaattttctcttttgccgccactgtcagctttttcgtctataaaagcggacattcctaaaggatttcgtcatttgggatttaatcgaaattaaatgttaagtgctgatgctattttctccaaaaatgataaaaaaatgaatagttacataagttttttcgacaattttactaaaaaacaaaaatgaaagcaaaaattagaaccgagatacgcatttttcatgtaagttttttatttgcaataaacaaattatctatccaaatgcgatcattttcccaatcttcgaaatgtgccaatgtgtgtcttgcaattggggcatcggtgttccacgtctttgaaagtgtcgatgaaaaatgggacccatagaaagaaaagtgggaggacaaagagtcccgtgatgagaaggacgaggaaagagacctgaaaagaagggaaagtggacaatgggaggggaaataaaactgccgatggtgggaatgttttactcgcagctttgtggcaagtgatcaaaaaacacaaaacggggcaatggaatacttcgaaatttgtgtctataaatttaatttagaaaatcgaaaaggagttcgaatttgctttcagcattttaccaacaaattttcaccatcggcaagggaaccgcccacttcggcgccggccttttcggcgccgttgctaacaacttttttcctgatcaaccaaattaaaatttttgttatcattcgatagctcttcagattctctattagcctgtaaaatttcaaaaaatttcgtcagtttacaaaaaagttatggccaaaaaacctcaattaactttttcttggctttttcggtgccgcgtggcataacttttttatttttgaatcattcatttctatttttacatgtaaatatagagcacacatagagctttcaaatgatgccagattggctaaagctaactgacaaataaaaaagttatagcatttcaaaatttacggcgccgaaatggtccgcgccgaagtgaccccgacccatcggcaatacatattatcggatttggtgaacgtacccaagtaaagaggccaatgacatgttttaattctgtgaagccatgctgctaaaacggttaagaaaacaatgagttttaagtgtgcgaaagaatgagtggggtggggaaatatcaatcagtgctaaacgaggcaactttggtcaataagtacttggcaccagcgatgtggcggaattttgccgtttcttggaactgagtcggcattttatctgtaactcacaaatgcccaagtgtttgaaggccgagtcggaaatcggcattctgtttgtatgtatctcagttcattataatgaattttcttaatttttttacaaggcataaattcaaaaagaaagttttgagcattttttccttgggaatttgttgagttatagataaattgccaaatcaatatcactaacaagcaaaaatagcgccacatccaatgcttggcaccccaaaaatgtcccatcgtaattcttcaccttacagcgagggcaatcgatcagttggggcctatcacttaaaaatttgttcgcattggcgagcaccgaagggcttaagttgcaacactttcaaaattacttaaaatttgaaaattccataaaacacacgaataactcgcggaacggtgcaacggcactggcaccgacgaagtgaacggccgcggagaagagggagcggccgatttttgggacatttgtaataaaggcacaggcggcaaaaatgctttatcgcgaaaagcggaggggggggggcactgtttgtgtgggtgggcgagcggcggagggacggcagaacggaagcgcagaactgcttttgcccctcgtcctttctgtttgcttactcttccttctcttgttattaagctttttagcaaaaagcgcatttgtcaaaaccaacaaaaaattagtgggcgcagacattcaaaggatttgtgaagacggagcaaaagtgggggaggggggggggggtccctttcgtttagataaattcctctgtttcaaatccaaccgcgccaaaatggctagaattgagcaaggaaagcaaaaatctaaagttttaaatttgtgagacgatttcaaaatgaaagcaaagcattcttttataatgagtggaggcaaaggttggaaatatttgaatagaatggaaaatcacaacacattttattatttacattgtcattcacaaacacgatgctgagaagctggggattattcttagctgaaaaggatgaacagtgaatgcaaagtaaattccacaatttgttatttacttttaaactgttgtcggctccgcatgagcacatgttcatgcgcgagtcgatgctgatctgctggacgccctgaatgctgaccgaggccacctgccttaggctaaacccgcttcgagcggcatgttctgtcggaagggaatacagcaactgagggacgacggaagcggacgaccaaacctaagcgacaaggacaaaaaaagaaaataaaagtccgccttttgtttcttccgcccgcgctcacttttatgtcgccctcgctggaccctgcggcaaaaatgtcgccgtttggatccaaacaaatgcatcgaacggaagcactcgcattgtcaaacgcacgcagtgtcgcacgcaactgacgctgtcgcacgtcccaaatgcaaatttcgccgtgttttccgccagaaataagcgactgaaacaaaagacaatacaacagatcaattggtctcacaaaataaatcaacagcgtgttgggcccacctgagtgttgggctgataagccacacaaaacgctccgtccggatggcccacaaatgaatgcaccgcacatttggactgaggcatcaaaatgtcccaaagagtgatgtctgatgattgtgcaatagaattagtctctatcctaagtgtcactttggtcattcatgccgagaccagcagtgaccagaagagtgctggtttgtccgaggaatttgacgtccgatgcaaatttggtgtgacacttttggatctgaaaataagcaaaaaacaacaaattggtttgggtgatttctgtcccctttcgtacgaaataaggcttctttgccggaacaccaggttgtgcctgccaaatggacagcagcccatccccatcgacagccgcaaaacgggcgccgttctgagcgaatgccaatttagccacttttgcgaattggccagcaacacgggcgacgaacacaggctgttcaacgccccattcccataggaaaacagaaccatcggaagagccactggcatcttaaagaaaaagaggaaatgaattttgttacgatagcaaaacagggcagtactatacatacagtagggcagcgatgaatgggcctccaaacggcgaacgccagaaaaaagtcgtttccgcaactgaaaaggaagaccaaaattcaaataaattgacacactaaagaaataaaaagggcacaatgaatcccaaaaaaaaaataattgatgcgaaataagccattcaattaatgattgtcagtcactcggacaacacaaacgaaaacggaaacacaaaagcacggattgctgctctaccttttgaagacagagtctgcttctgtcgacaatgaaagtgtttaaagtctacaaagattcaaaaggttatacggtcagtaaattccccgccattcgtcgcgtcagaaaattaacgcttcaagcgcatttgcccgttccgtttcccacaacaacgtacatgggctgatgtttgcgtggggatgttcttgcccggctgaccatcgcttcccgggatcagcaattggtagtcatcgttgtccttgagcgggtcacgacggatttgctgcattgaaatgtccaactcggcccaattctgcgcaagaagaaaagagctggtcgacggatagtgctgcagacgggagacgacccgctcatgctcatccaacacacggtcgatgctcagttcctgcaattgttgtgaatcccgaggggagggaatgtcattgtccacctgaagctcacgcccagtggagacgaccatcacaccgggcctaatctgtaaaaagttgttcgccaaattcgacaattgctttgggaccgaattcgctgcaaatgcgacgattgggtcgtgctcgcggtggactaatttgattacattcaaaatactgttcaaatctgctccttttgtgaccgaagaagcgattttatcctaaaaacactgccaatcatacatgaaaatgtgggggggggggagggtcgaacaaaacggcaaaaatgacatcggcggaagattaaacagcattttccttttgtcagaccgaccctcccccctccagtttaacgttgctgcaaatgaaagtttaaactattcaattcaccttcgcttttgcgaaagaatagcg

SEQ ID NO: 10763 - DNA, 4786 bp, Heterodera glycines
tttgcaggctaacaaatctctccttagttttaaaatcgtttgaataaatattttagcctattaaattttgggattatttttctaggtgaaattgaagaataaaattgacaaatttttagagagatttgtccgtattaaatttttatttattttaaaaaaatttttaagcatgcggacccgaacaaaactgcgccgtgtttttacaaattcacaaattttgtaaaagattggctttcttgtgttaatgcgaaattggtcaaacaattaagttaatttttaatatttttttaattttaatgctttaatttttagttgtttgcccacaaaattatatgttaaaataacatcgaatgatttcttggaaatattcgtaaaaagtgtcggcgaaaatgttgcacagcgaatggaccctctctatggtagtgaataggcccgaaattttgaaatggccgggactggatccggcacttggaaaatggacggagggaactccgtttttccggcactaccggttccggtggtttgtccaaaaaaaggggaccggggccgggaatcccggcgggcccccggttccgtccgggcgggctctaatagtgaaattatttggcgaattctttttgaatttgaattcattaactaaacagagagaggaaaccattttgaattttatttgactttatggcaatttttcattttaaatacatcttactaataaattattaaaattcacacagcacttgacaaccatacgcttgtgaaattggaccaaaaatggcacgacacggccaaagtgtgtgcctttgacaaacagtcgaaattgagatgttttgccgacaaaaagtaattgcataagccaaatgattaatcgctaaattaattttaaactgctaatttaagctgtgccgtcaaagcaagtgaaaaggaagtggaaaaagcagtcgatgagtgctatatggagcacaatgtggtcaatgttcaacacaaacgttgtgaatgcatgggaaacaatgtgccatggtgaagatgacactgaaattatttaatataataataattaaatattaattactctgtattttcaattaagctatggttatggtattgagaattactgtgagaaactgaaatgccaaatgttgcccgaccaatgttctgtttgtgaaaatttacgaagtaaattcggtggaaattattagtcagatcagtcagagccaattgaccttcttatcaaaattgttttgcataaatctgaatgaatttaaaaaaatttggttcacgaaaatgcgtcagtggaaaatgggtttagtaaaacaatacctcgaaagtaaatatcggcagcattttgaatgttaaaaatttttcgatttttgcctcggaaatttaggcgatgtttcgagaatttcagaagtcaacggcagagttttttagtttcaaatcacatttatccgctcccggaaaggcgtcagtgacaattttaatgtcataaaaacaagttccctgggttttcgagatcactgatcaacgaatccgatatcaatttcggccaattccaaaccccggacgcgaataattagaacatttagattttcgactttttgtttgaattcgggtccaaggttcagaattcagaacgaacttcctatataaatttacttttatactccgatatgtagttttgatacagaattaattttaaaatatttatatcactgacgcatttaaaaaaaatttaacttttcaatatggtattttcacttgaaaaaataattaattcattttttgaatttttcttgcaaaaaattccggtttgatcgaaaatccacgtcccgggcttatttaaacttttgaattttaaattattagggcccggatttatatggacaaaaaaatccaaaatatggacgaaatggtgcagtgacaaaggacccacagacgaaggacccacagacaaaggacccacagacaagggacccacaaatacagaggacccacggacaaaggacccacaaagacagaggacccacggacaaaggacccacagacaagggacccacaaagacagaggacccacggacaaaggacccacaaaataataattaattaaaatatattaaaaaatggaaaaataaaatgataatcatcaagaaaatgagatattttgaaaaaggtaataaagtatattcgtttttcaatgtttaatcatcttcaatcggttcctcgttttgctgccgtactggatcaacaccacgaaatttaacgaatttagaagtggctttcaaaaaattttccgtgtccatttgatagtaacgtccaatgagggtcaaaagtcgttcgtttgcctgacggtactccgctcgactttacagtgctggttcttggccgcaatccaacttgaccgaaattgcattaactcgcacaatttcctcacgaatgccaccaataaacgcaaaaatgttggggtggggtgaaagaaatttagcctgtatctgatggtccccatgattcaaccgaattttgtcgttcttgggagaggttgaattgttatttccctattgttccacatttcgcgctgaaacattgggcgccgagtcggacgaccgatccaagttgacttaaaatagtcaatgaattcaaggtgtgcctgaccattcccagcggaatttatgaaatacaatgacaatgcgttaaagtgctgtgcaacgtcggctgtttaataagaaattaataaggttccgaaaaatgttttcaaccgattttttaaaatcgataatgatgttgtcaggctgtcgacaattcacatgacataaaatcacacgcaaagcattcagataagtgttttgttgcttatcaggcagaaggcaaaaaataaacggaagaacacggcttttgtacaagccatgaataacccacaattgaaaaaacatcgaaggagctgaacggaaagtgccgtcagctaatcaagttgtacattgatacaaacgtgtacagtcaatttgagtgccaaagatgatcatgcgatgaggatcttcacgttcgctttcgtaaatcaaaaaatttcccccacgatcggtgaaccgtaaatcctattataaaaataagtttggtcggaaatagattgtaccgctggtatctcgatatctgcgagtgttttggtatttgaaattgaccccggctgcatgacggactctactaacagctttttccattgacggaattaggggaaggcttgcaataacttcatttgacgcaccagcgaggcattcattcacaactgtgcgtggcatatttccacgtgatgacaatgctgtgttgcggacgcttctgttgatcttagcggcttcacatcgtgttggagaagggtcatgattgtgcggctttcctagttggacttcaactccagctctcatcccgatagtttttgctgtcgcggtgcagttcattgttttgttttggtcacagcgccaataaattaattcccttcgtgcttctttttttggtacatatggccttcgaaagcgagttcgtagccgcccatttgtgaaggaaaaacgtagccattatatttaatgaattttgtaaatttagttcggcttttatagcacttatttcaggctatccgggcaaatccattggcaaaatttaattctaattagttaagaatagtggtttttggtcataaagaattttctcattaataggaatagtgatttttgatcatatacacaccgagtcaaaaaacgagacatgtgtcaataaagagagagtgcagagaaactttttgtctctaacttttctctccttttggcatactatctaatatttttattattaagaaaaacaacattccttctctccatataactttttttctaaccatacaatctgcaccaaattttgcatatcgatagagaaaaaaatctgcatcgatttctatgtttattatcatcgcttaaatgttgttttaaaaagttataagataaaaaagttaaattattattctttttaaagatttaatggctaaaagaactttattacggaagcgacagaccaaaaatgcacgccatacgcatgagaacaagcgggaggagagacgaaccaaaatggcaaaggcgacgaaagcccgcctggccaaaaaaagtgagtttttcaccaattttaactcaaaaaattattttttttttttgaatttcagccgcttcacaatcgaatcccaatgccgaaatgccacagcaggacgaagcagggccgtcaacatctgctgcatccgccgaagaagcgatggaaccgccgccaccaactccaggaccagtgccgacgcccgaaatggacgaggaaattttggaattcgacgacccgccgccgtcgacacctgccacaccaattggcgatttggtgccgtttccgtcaacaccaactgcgccaatggaacggggaacagcatccggaaaatcctcgtccacgccgatcaaatggaggcccttttcgagacggaatggggcaaaaaaatttgccaaacgatggcacatttggggaaaatccaaattttcaccaaagtgattgtttcatttttttgtgtaaatattttttttaaatttaaggcccagctattgtccccaggtgatttggacggactggagaacggcagttgatcagttcaaggcatttctcgacgaacaaccaatggtgcgaacccttctttcaaaaaagacaaaggcccatttgctgcttcaccactttgttccatttgcgcgccaaaaccgatttttggggcttttggatgagcagg

SEQ ID NO: 10764 - DNA, 3224 bp, Heterodera glycines
tttcactggttttttcgatcacggtcacgattcacgggaccaattcacggtcacggtacggttccagggctttttcagtcacggcgcacctctagtattttaccattaaaattttaaatttttcagatttcggaggaggggagagtttgtattagtaaattttgattaaaagtttagaggtattatatgtttctttggacatgcattcaaaagcgctctttactgatcgagtttcgaggaatttggtttaaaaaaatcggttacggtaattaccagtttttaccgttactgtaacagtaaattaagaacttttacatgtgctagaattttcctcttccttccctgctccacacctaagcaattgcgggggccagcagagaacggcaaatagtcatatgggctacgtttggccatccgttcgggcagaaaattgtccgggtcaaattcccaatgccttggccacacctaaaaaaaattaataattaaaaaattcaaattttttcgatagcatttcgccaaaataatttttaaaattgtttttcgttgtggtgaatgatcagtggcggaatggcgacggtcgccccgcggggcaaagttttgtcaccgatgcgcaagtcggcctgaagctcacgctccaacacggggaacaccttaaaaagtcatcagcaacatcagattcattataatttatgtgccagtcgggagagaaattggaaacaaaattttacacgaaaaccatggcactaattattggcataaattaatcaccggaaacatgcgcatagtctcgcgaaggcaccggtccaagtatggcaatttgttcacatcagaggcggtcaattccagctcagtttccccctgagttgctactccaaaatggtcagcaatttcggcacgcaatttgtcttggaaatcgggatggcatgccattgaccacagaaacctggcattatagatggaaatattttgtgggcaggcatgtaaatgacgcaaataaatatatattttttaaatgaattcgaatttttaaattttaatcgaagaaatttcttttttttttaattcattaaaaattgttatatattttagattaattgctatgtataaactgaccacatcatgccatgagcgattgtgtcgtgccctgaaattgtccaaagtatcgaatttgagaacggcaatttcataagtttttcttcttaaaattgaagcccaaattcggaatttgaattttttaatgaccttgcatttaatataatttgtgatctgaattatatttattttggcattttttgaatttttcatgtaaaataaattctttaacaacaaaaaaattcaataaaaaagattttttgttgacatgatcacattttttggcgatttgcccaatattctttttcgggaaatttccaattcctcactatgatgcattattaagttctggcatttccgacccaatcttttacggcatttttgctgctaattcttctcacctccgaacatgaacgcgtccacctgctccctcacttgctccgtgttcaactttcgctcctcgcgcagtgtcagcaaaaagtccaaaaatgccataattttgcctttgtacagtgatccttcgctgtgcattagtccgtcctttcggatgccaccatttgcctcattaatgcgaattcggtcctcaacaacctaaaaaattgaaaaaattagattttcaaaattaaatatcggagtgaaatatttgaattaattgcattaaatttaaaaacaccggaaaaatttttaattaataaaatatttaaaattatcaagtaataaattcccatttcaaataacaaagttgatcaattttaatgcatttttaattttattaatttcccatttaaaataaaaagttgaataattatattcatttttaaataatatttctattttttaaattatttcatttttagctttgttaatgtaaatcattaaagctcattctaagaataaatttaaacatattttattaaaataaaattctaaaatagtaaaataaaatttaaattattaaaaatattcatcattcaaaaatctcattaaattttgaatttttttccaattaattaaatttgcctttgtgctgaatgccttcagcgctttgaccgcttttcgtgtcgcaaagccatggccaaacaaataccaagtgatcgggaacaaaatgtacagtgggccaagtgcataaatggcatggtaaatgccgaattttttgatcgcttccatgtaattgcggccaactttctgctcaaggtccatttggacgcccatcaccgactcttcaaaaggcatcacaaatttttacaaaaaattcttgtgattgatcattgcctaatcagataatcatctgaactgataactataaaatagggacagacagtcagattattatcaggttagagggataattaatcagtgattagaatgaacgatcactgattaaaaaagaaatttactgattattgtatctgattagataaattaaatactcttaatgataattatctaatcacattcgattactgcaaaatgaatctctatttattggtaacgaaatgtaatctcaaatgagtcaccgacctgtcacgttgtacaatgcacatttgatcactaaataatataattaaaaatattaaaaaacccaatttaaattttattttacacaatggtgacaggtccacaagttcgcgccgtccctgcaattcggccaaattttttgtcaacattcgtccatatttgttgaaggtgggcgtgtactgttccaacatggagaagtgaaagatgggcaacaacattcggcgctaaattcaaatgaatgtattttgatacggtaattagaagggatacgatacggtaaatttcatttaataaacaattttttatctaaatattgaaaaaaacttgtttaaaaagagatagactgataattcgaaaaagtatatgtgaaaattcatgaaatcaaaattttttcgggtgcaaaagacaaaaagcccgaaaaattggccgaaagacagtttttcaagcgtgccccccccacccaagccccgaaaatcctaaatcttagtaatcctcggctgatttatggatttatgggactcacttggcgaagccaatggtccccgtcgctgaccaaaacgccgttgcccaacaagtggtgaaagaatttataatctggtccctttttcatttct

SEQ ID NO: 10765 - DNA, 2210 bp, Heterodera glycines
tatgtgcaatcgataaccgtttcaaaattaccaaacggttttggggaaacatgtgggcctggccgaggaacggaattgtctccggaatattgtaaatgccattggaagtgcggatgaagcgcaaatgggtggaaaaaatggcaaaaatacgccaaacaacgaaaacaagcagcacaaccgcaacgagaaacagaagcatttaataatgaggataatagcaatataaataaaaattaatattataagaaatttattgaaatttaaatgtgtaaaaaattaaaatggaattaaatttatttaaatttagttaaaaaataaaatcgaatttaatttattgaaatcctcgtcgctaaatattttaacccttttacagaatgtataatttgaatttaaaagaattattttttaaataaatatttataaaataaaaaattatatcttaaaaatgcattttaaatattttaaaaataattttgccttcacattaatgagtcttaaaaaagatataatgaaaatagaattaacattattttggccttgcactgttttttcgttaacatcataaaaaattgttgtaaaaaaatgattttgcccttcccaaagcaacagaattcgaaagagcagagattacgccaattttaaaaaaaactaaaaatcataaatggaaagaaacagtgtaattggtgcttgggagaaacctcgctccattttttattgctactaaaaaaaattatgaaaaaattgttgaaaatattttaaaagacaaaaattgtagtgcttaaaagccaaaaaaatttaatcatttgatgtcaattgatagccctaagtgttctttattagccttgaaaatttcaaaaatttttatttgcttttaaaaaagttatggccagaagagcttaaaaaaggtttttcgaacattattggtcataacttttttgaaagtaaatgaatttttttgaaattttataggctaatagagaatacttagggatctcgaatggcacatcaagaattaaaaatttgattcatttaaaccaaaattataggcaaaaaattttttttaatggtttttttagtaacgcccattttgatggtttttaaaggtttttgagtaacgtcataacatccattagaagggcagagattatgccaataaaaaaaatatcaacggaagatcattttatgtaatttggctgatgtattaaactcgcatcattttttgctgcaacaattttgaaaaaattgtgtgaaatttaaaaaaaaatatttatgtcatcataatagaacaatgtgctttttgtccttaaatggtagtgctcttaaaatgtcgttgaacaatttttgaaaattttatgtgccctgcggcgacccaaaaccttcaaaagtcagcagcagcaaaaaggcgtgcaaaaaaaatgaaattattgtgcgcgaaattgggccaaaaattggccagtttggaaaaaatggttgaacaatagaaaaaacaggttttgctaattattgctgtaagttagtcgtgactcttcatcaaacaaaaattaaataatataaaataatgaaattggaaaatagaaaaggtaatatttaaataatttttttgtttccaattttaaatggaattaaattttaaattatttctgtgccatatcacattcttgaatttgaagacacgttttgtcaaatatttagttctcttgacatggctaatttttttgtgggttttaaacttgttttgggtcaaaaaatttaggaaaaacttttttcggatcgttaggacaaattgttgtaatttaggggtcacataaacttttctaaatacctacatatttttctgactgaaaattttttcccccccggtacttaattattcttatgttgtacctagcgaatgctcaattaactaattacttttttgtgtacaacaaataatgtgagtaaaaccacggcgcgccgcgcaaaaaaaaaaaaaatcccgcgctcgcggattccaattgcatcggtcgcgggaaaaacgccccgacttgcggattgcggtcgcgctccacactgttccatatcacgcttggatttaaagttctctgaaccagggtttttttttggattttcaatttggatcgggtaagaagattggggaaaaaaaattcggatcggtagcacaaattgttggtaaaaaaatttttctacattttgttctgactgaaaatttt

SEQ ID NO: 10766 - DNA, 1568 bp, Heterodera glycines
  misc_feature (1557)..(1557): n is a, c, g, or t
atagtctaaatacccaattaatttccagaaattccattcacaggccgttgatagaaaatcagcaattttttcttatttgcataatgtatcggccatcttcttcacatcgttcagctcaacaggtgtggcgtttcttgtcgcctttttcatttaaaaaaaaaatttttctttgttcccaggaagccatgcgccctcctccaaaattgcctgacaggtaagacctggaaattgtcaatgtattacttattaattaaagtgtaatgtacaaatatatgcttaagcatttacaagcttgggtctcaattaaaaaaaaaaacactactagactaaatgcatttttattctgacaatgagcctagtccattgtaacattttttggaaaaaataaataaaaatttttcggcgttttgttgcaaaatgtaatttgctttgtccaattccgattcccaacctaaattgaaaaaaaccgaaattcaaaaaatttcaagttagggataggaatggtcaaaattgatctcagattcgtgatcagcgaccaacaaaaaaaagaaaaatactcaaaattacacacatttaaattgaaaatttttcaggcccctggtcccgtacatgcgcttcagcaagaaaacgtggcccaaagtcagggcggacaagcctgacgtgccgttgtgggaactgggcaaaatcattggcaatttgtggaataacatttcgccggccgaaaaagcgatgtacaaccacgagtatgagcaggacaaagtctccatttttaattttattattcagtgatttgtacaaaaaacgtgaccggacggtccggtaaaaacctaccaggcttacatacattcggcataactcaaactaacgaaaaattccccgagttttcatttacaagaaaattttgtttatttttttaattcgggaccattttcacaaaaaaaaattcccgggttcgcctgttgaaatttttctaaaaattctttacaacgagcgaattagtctatgaattgagttagaaaaaccatttttcaaaaataaatacttaacttattaaatttttctttttaagattgaatatgagaaggctatgaagcagtacaatgcagcctattcacaatatatggccagcaaaagtcgagtgaaaagtgcacatcagcagcatcaacaggtcgaattttggtggaaagggaaaactgggcgatagcctcggatttttttttttggtataggtaagtccttttcaacatggactgaattgaagcaatttattatcattcggtagcccaagtgttctcgattaccctccctactaaattgtgaaaaaaattttttgttaagtttcataaaaagttattaccagaaaatttcaaaaaattgcttttacgaatatttgttgcaataactttttgaaacataacgaagttttttgaaattttacaggttaataaatatagaatacataaaatcagacccacccgtaacatgaattgataatttgcataaatatattttttgaaaaatgatttttcattaaaaaaaactctatttgcctctgancatatgccttc

SEQ ID NO: 10767 - DNA, 2274 bp, Heterodera glycines
aaatagtgacatgagggaatttctcaaaaaatatttcgcaaattgattttaaatttattattttttatggtaagaaggggaaccctctagatcaacatagcctgatttttggtgggggcgtacaccgttccaattttttcgtgcgctctttcgttcatacatattgggtcccaattttggcattttgtccgttcattaaatttttttaggcaattagagcgcgcattgaaggcgacaatttctgtcgatgcgaaagagcgctgggacaaaattgctacgatggtcgacgggaaggacaaaaaggagtgcatccgacggtacaaaatagtggcccaactggtgaagaaggcaaagatggacggtggaggtggtggccaacaacagcagcagaaataaatgcgcgcgggtttttgaaacattttgaaacggatttatggccaatttgcgtatgttgtttttcgactcaaatactctctctttttgttgattattgttgtcgcttttttgttttgcgttttattattgtagcttttaagagtaaacattacaacttttgttgtttaccgggcccacgcactttatgggcaaaaccggaaaacgctgcacaaataattttcattttcgtgaatcattgtcagcatttattacaaattctaagtgcaaattaaatgtgattctaaacaaataaaataattttaagggaaagaaaaagtctaatctgaaaataaatggatgatcgatcaactttatacaaatctcgagattattattattgttggatattcaatatttgattgatgtttcacgtcatccgctgatcactccggcagcgatcagttgcgcctgcagtgcgtagtaaacggccaattggtcctccaccggcagccacagagtttgttgcacaattctgttcgggtttggagatctggcaaaagtaaaatgcatcacaatagttggaattcggaatgatgaaatgaaaatggggcggagagaaaccgtaccggacgaatgaggagatgtacacattgacaaaggagcccatcaacagttgacagtcgaaacggtccatgagaccgccgtggcccggtataatgtcgccaaagtccttaacattggaaattgatgattatttccagcagtttgtgtccctccacccttttttaggaggggggggggggtcgcaagttttggaaattttcttaacaaattcattaaaagtcctaaaaaattttcccggcggcacctagcggcaccgccgaaccccaaaaatctcatttttcttaaaaaattggcttaaaatcgcaaaaattggccatttttttgaaaaggtcgtcggcggccgaccccccttcgcaaaaattttgaccgacccccccccccaccttttttatgtatggttttcttggcaaatcccattaatgtaaaaaaaacctgaaatcggcgtcaacttttttttattttcatgtccatttgtcattaatttggaagaaatgcaacattgattttacgtttttttaattttttcgttttcacagatagaaacaatcggctgatggccgaactgttttcgccctcttatttgcccgacccgcgcgcctttgtgccccaacagcgcattgaccattttcggcgtcagcgcatgtcgctggagcagcaccaagtgaagtccaacgaggagttggcccgcatggcggagctgttcagccagcgcaagcgggccatccaacgcgactcggaggcgtaccatgtgagaacaatttaaaaaaaaattctgaaatttttcagagcttttttggaaaaatgtttaaaaaacttattgttagtaattaaccataaaattttgagaaaatttcaacgattttttggaaaatttttgaaacaacaaggcaagttcatcataaaattgaaaaaatcgctgaaaatttaaaaaaaaaatttcttgaagttttcttatgaaaatctcctaagaattttttctttgaaaaatttttaagtttgaaatttcttttttacaaatcttcgcggggggggggcggaaatgaatacccattttttaaaaatctgtttacaaaatttatgggcaacacaattgagcgtttgatttatgtttcattttttttttactatttatcattttgtttcaggaaatgctgaaaaaagtgtgcgcagaacggccccgggtggaccagcagcggtgcgaagagctgaccgagcagtacaaggagcagttgttgaacgcatgggaccagttccagacaaagcaggccgcaatcc

SEQ ID NO: 10768 - DNA, 4978 bp, Heterodera glycines
  misc_feature (18)..(19): n is a, c, g, or t
  misc_feature (34)..(34): n is a, c, g, or t
gcttgcatgggcctgcannggtccgggataaaantttcgccgctcaaatttaaaaaagaaaaattcttgccagtttcggtgtggaaaataagtggcaaagcattgtacacacacagccccaagccccaccgaccgctgatcatggaccgtccgccggacagactcgtcaaaaactcgtcgcaaagccacgcctcgggccgtgcgccgagcgaaccgatggagctgaattggcccacgaaggctttgtgccgctgtctttcctccacactgaatgcttcgctgagcagccgacgcaggcgcaaatggccaaaacggcacgaggcatcaccatcggtgccactcctttggaagctgggaaaaaggcaattagttaaacgattgctaattgaaacgattagcagctaatttaatagtaaaaaaatgaaagtgaagaatcaaatttcgacatgcaaaaacaaattttgaattgtattttcttctccattcttcccaaatgaaaaccccaccgtcccggcaccgaagcgacaattcggtccttaatatggctgaagtcggcccgttcaatgcgttccacccaaaattggaccgtccgatggacttcgcccgcactcggagggtaagcggcgcggagatacgccaccaaatcgtcgcggaatctttgcaaaattggcacagaaattatataaaaaccggcattaaaaagcttttactcttatggaaaataaaaatgtttccctacaataagtgtccaatagagtcttacaaaatttttctcgagatttgtgtaatgtgaaaaccgagggtacctttgttgctgtcgtcccgccgaagatgtgctggcagtgatggattgttcctcaacagcagtttcagcagaagttaaagcagtagtggttgtgccgccgctgttaacaatggcatttgctgtcaccgcaactgtttcccctttggcttttttggcagccatggcaaatttgccccgcgcatggtaaaacgcctgcgttttcgcgccccaatcttccgacaccaaatttgccgtgccaaccaccacgtgcagtgcacgaccgtcctccgactcgaacagcgacagtttggcgtgatgggtgccgtaggcgaacggcagtggtacgcccacgcagcgcacattggccgcgagtggaggcggcacggcggagcgcaacgcgtccaagtggcgactacccacgacgaaagtgatcggacattggcgaagccgacgcggagcgtactgcctgacggaggacaaagattaaatggagttaagggagcgcggggacagacaaagtctcgaacgaaaacaataatagacaatttgctcgtaatggccatagggagggcagggagaataatttccacagcaggcccgtgaccagagggacaaaagggggagatagttcgcccgacgaaatgaaaaattatttcgttttcccccgaaaatggtgggtttatttgtttactaaattttccccggcacctaacggcaccggcggatcacaattttcccataatttttgtttggtctcaaatggccaaatttccggattttttcgacggtgccgaaaaagagtcggtttgactgaacaagttttttgtcccgcagagcaaaaaaaaaaaaagctgctctcaccggcttctgttgcttttagccaagtaaatgaaccaaatttagtgttaaaatatttttttgcgaaatcagtggcaatttaaaaaataaataaattccacctgagcacccattgggggtcgatgcagtaattgaagtgaatggaagcggacggacgaatggcacggatcaattcgaaaagagacagcgccctcggcacggtgccatcattagctctgtcattagcttcagcacccaaacatgcgaccttgaccaaatgcactctgaaaagtattggtggctaattctggaagcagttcgtcccaggccacaggaaaaattaaaaattttttaccgatttattttgattttggataaaatcgaacgctaattagtatttatcataaaaattaaatggttggtaattttgaagaaataattgaagctccgcatattaaaaacgcacccaccatccaccaaatcggaaacggtcggttcggatgaaagctgaaaggtttattatttttgcttcaaagtgaaaattttttacattttccacaacttcaatttttgacagtttctcatttgaaacaagtctctgttctccgtcaactaattgtcgcttcatcgtgaacaaaaactaattaatgttttaaaattttaatattttttaaaaatttaatacaaatatatttttgcaaattttacaaaacattcgcattaaacaatttgtcattcatttatttatcataaaaatctgtatttaaaaccaataaaagaaacaacaacaattgatacatataaaatgcaaattgtacaatttggaaatgcctatcaacgcctattcattcatctgtttcagggatggagcgcgactgcaattcgcggctttttccgtctccgcttcatccctgaacagatttttattgggacaacgatatgtaaatttttgttcgaattgacattacaaaatgttattgaattatagtaatatacataaatatttattagacaattttatgcgattgtactggggctggggcaaaagtttgtgtaaagtttcagaggcactttggtttttgtgtaaggccacacacggggataaaaatggtctctatgcacatgtggaaatgaacaaattaataaaaatattaagtaaatacatggaacaaattgaatgacacacacacgcacttaagtagttgagaaatgcatgaagcaattattaatttggccgcacttcattaattaaatagcaaaagcaatttggttaattgtagtcaattaagtagaataacataaacaatatgagacagaaaaaatggagaagggatgaccaacactcgggtggacgatgaagcattttgaattgtgctaaacctgaaatttttttgcagggggacgggtgaatacagaaaactttttgatgacctattttctggtattatgcatttcaaatggcagggtatggaaccttcacttccaattacattccgaaaattagcccgaaacaaatcccgtccaccaaattcggcctcccgttctcaaacaatcaaaataaaatgcgaatgaccggtgaaattcgaaagaatgcaaaagccgttccctcctcttttttaatttctatgagaatttgatgcattgtgtgggcttcggctcgttgagacgcttgcaaaggttttcctccaacgcgtaaaaggcgtcgttgtcgcgccgtccgtccagcaccacccacggcacaaagttgaacgcgtcgccgatggccgccgtccgattacccgccagggcgtgcaaatgccgtccctcgcggcccatcgcgcattgccaaagtctgtgagaattgttaaaacagtccaatggaaaaaacccggagccgttttctcccctccccccaatttttcaaaaatcccaaattttttttaataaaatttcaagatttttttaatttcaaaattcaataaatcgtataattgtgaattgaaaaaggcaccgatcggacgaagaatggcctgccaaacagcttttgaacgcggcgctcacactttccttgccctgcacacagccaaccaacggcacgaaactgtcggcatcgggcagcagatcaatggcacagttcatcagctgattcaacgcgcactcggtctgtccatgttggcactcgcaactgacaaatgggggcaaaaaactcaattaaattttgcaaaattttccagcacggtgcttttggcacaccgtgcgacttaaatattttattgtactgttgaaaatttgcaaataaataaatttgtagtcgaaaattctgaaatgctatttttcccattgtctttttgttcccccacccaccgataatcttcgccctcctccgcctctgtccgggcacattgggctttcccgaacggcacaatggtcacattgatgcgattggttgccccgagacgggcccaggcgggcaacaactgacggcgaacaaaccctggcaatgtgggaagttttctctcgtgtaatgtgttaattaagaaaatttttctagtgttttttacataatcaaaaaatggaaacttttcttacataaagaaagccacattatcagacagaataaaataaaacatcataaattgcaaaaaataaataaataaaattcaatattttgtttataaattttaatttttcaatttctcaccagtcgtgtcaggacaaagagcctcctgaaaatgaaattgttgaaatggagaaacaatcaaaacagaaatcaattcaccatgtagacaatcagagacaccatgttgcccttctttttcaacgtcgttttctgccccaaggccgactcatccaaaaaaggcggtttcttaaaaaagaaaacattaaaaaatatattaaaaattgaattaaatgtttatttttttaattacggtgaaaagggagtttttaaatttgcagtagaccaagtaattttttgatttaaaactcgattaaacgatgaaaggtcaattttcgtcaaaacctcgtcctccgacgaagaaaatggaagagggtctacgccctcggcagatttgaactcggcccggacatttcgaatcacaatttgtccgtgtgtaaaaaggacaaagtgacaaataaaagtgaaaataacgataaattttgacgggaaaattgaggagaaaaaagtgccgttggcgctgttcaatgacgaaacgttcatggtggaaagcggaaaaaagaacaaataaacaaacaatctttttgttgtatatttaaaatgttcaacatttgttggtaagcaaaaagaattttaatggatgaaaagcggggagaaaaggaatggagcggtgacgaccctttccataaagaaataatcat

SEQ ID NO: 10769 - DNA, 917 bp, Heterodera glycines
taaattttatccagaaaaaatttaaatttaagcatttttaacaaatgaatgaaaattttgaaaaaaaaattccgagtgcgcctaacagcaccgtcggacccccattttgcctttatttttgaaaatttaatctatattggtcattttatgaccaaaaacggctacaaatccccccttctaccctgcgacaaaaattttgaaataacattggagaaataatgcattttttcattacgattccgcgctcggaattttttttttggctacgggacttttgtaaatgtaaaacaggatgttatgtgtggcttacgaatatttaattttcttgtctattaaaacgttcaaacctgcgggagaagcggcgttcagtaaaaagaattggacattattttgttatgatatggcgggcgataaaagcagagaagctaaggcctcgaaaatgaatgacatgcataaattttaagtagcaaaaaatatttgtgtgtaacttgcgccgaacggttcctaaaaagagcaaaacttttaggaaacaaaaaaaatttaattgttaatttggcaaaatgtttaataaattcgaaataattaagtctacaagtcacaaatagttaacggctcacagctgatcatgctcataaaaatgtctctacagcagaatgatatctttgcatttgtcagcaaagaatctaaagttaatgcaacattccattatctctttatgaacgtaattatggcaaaatggaattttgtgtaatactgtagtttgccccccccctttttggaaaaaaaatttttgcactaaaaacaagtttgcaggggttttgggggtcgctgatcacgaacatccatttcggctaatttcgaatcccggacccgaattcgaacaaaaaatcgaaaattcaaattttgaatttcgaatt

SEQ ID NO: 10770 - DNA, 2902 bp, Heterodera glycines
aaaatcccctttttatctttttcaataattttctctttttttaattttagcaactccaacaggacgaccaaagatgaatgtcgatcatttgcagcgcacatcacgtcgcaaattggctgatgaaatcgcggctgtaataaaacgggacagatcacgctcagccagccgggcgtccctcgaacggatcagtcgggaagttcggcacaaatttgctcattacacgccacagaagaaacaacaactgccaagacaaaacaagtcagttgatccagaggatgctcttctgatcctcgggcttgtcggtacacagaaggcttacagacgactaaaaaacactattcgcctgatcaatgccaaatttgatgtgttcccgccactcgaaaaagtaaaaaaaagttttagcatttatatttatttaaaaattcaattgaatattgttaggtgcttgacatcaaacgccgcatctgtgggcctttctatcccattaatctaaattttaaggtgatgaggcgctccattccgtttggcgccgacttgagcaactgtggaagtgtatgccggacgcagaccaaattttgcagcaactggagcaccattttgtcaacaactggctcctcgactctggcaaaattgatgaactgaagcaggtatgtatgtttggagggggtaattgcgttaaacttgttttatttaaaaattgatatataataattcagagacaaagtgatcagcgggaagagcatgatgagttcgatcaaccggaagaagaaactgacgaactttcgcttatcaatgtcattgattgatggtgatttagcaagaagaaattggtggtcgacgggagacggacgaagaaaacaatgtagaagaacaattcgattttgaatagacacagttcgataaaaggtttttcttcgtttttacaggaataaatttttttaatttttgagcttcattaaaaactgtgttatcatttcacttatatttatttgctttaaaaacctcaaaatacagttacagcatgcatgggactcgaacctgagaccccccccccccttttggtgactaactcacagaccactaagacgaaaaatccagcatacttgtacttggagcccaaaattgggccgctgtgtttatgggtttttaggctattaaaaatgaaaaaaataataattttaaattaaaatattttttattaattaaattcaattaaaataatggtaaagaaaatataaaaaattttctgttccatcagggaattgaaccaacgagacaaataatgaaagtaaaaaggtttagccacttgaccacttatgcatatgaacacatgctataaatgaaaataaataatttaatttatttttatcaaaaatttctgatccctcaccgattcacttctcttttctcaccaagacccccatttttaccagtgcttatttagtcccgccgggactggcaaaaccgggaccgggatttctgtttttccaaaaaccgggaccggaaccgggacctgaaaaacccgggatttcccgccccgatcccggtcccggtcaactctaataaaaagttttacaaactaaagcgtaatctttgacctaagcccaaccaagtctaagcttaggcctaagcctaaagcttaggttttagatttagcttttgctcataaccacatggccatgatggtcttttacaaaaaaaaaaaatttcttccccacttttatgtaagaagttcaattttctcattttcacgtgatttttctgtccttttcgttttcccatttggtttcttcacgtcgttcgaaagatttatgtgttttgccttttaatggaacacataattcacttaattggggcataattagggatgtcaattttatgtaaatacatatttttttcctggcttctccatgctctaaatagtaggaaaaacactttcttttttatgtttgcggacaaaaagtgggatttttatttacatatttcggggttttatacatattttacatatttcgaaattttatacatatttggtacatattttggactttttcggactttttcatacatttttttttacatattttaaggcttttttagagaaattttcggaaattctcaaaaaaaaaaatccaaaatttcggcaaatttttcgtatatattttcatatttttattacatattttgagaatttttgtaaatttataaaatttgtagtgaaaaataaaacttaaccaaactaatttttaaaatactaaaatgtgattataggcctatttaggtcatttttatggcattttgtgcctatttcaccctttccgaagaatttttttttccaaaaaaataaccattttaaaaattttatttacatatttggtacatattttgggtttttcttacatatttcgggatattttacatatttatgtgcatattttggtgctaggtcatttcgcgacaagtgcaaaaataaaaatcaataaaattgggcacttcgcgacagtgcaaaaatgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaactaaatattttatattggtttttaatttaatcttttaactaattatatttgaatatgattaatcaacgtaatttgttagtaaatcaatttttaaatttattttgagtttgcaaggcttcaacatttgcattattctgtgtagaatcagttacacaaat

SEQ ID NO: 10771 - DNA, 1386 bp, Heterodera glycines
  misc_feature (1318)..(1318): n is a, c, g, or t
  misc_feature (1323)..(1324): n is a, c, g, or t
ttgtttctgaaaatattttgacattgtattattattattttttttagaaacgatctgcaaatagactgccaaattcccttgctttttagggtgaggcccaggggtttagggccgagttagttttacgcggaaatttgaagttttcaaatttttgactcaaaaattcaaaaagtctaagtcatgcggatgcggtggtgccggtaataggtgcccttgtgaaacggcgtagcattgccttggctcatttcattttcattgaacgggtcaaagttgtactgttcatcatcggtggtgtgcggttcgaccgtaacattgtacggtattgtatccaacttgtcaattgcttctttcaaccatgcaagttcattgtctattttttcaatttgttcttgaaatgtttcttgcacttcgtaataatattggacaattccgagccgaaattcactttttcggccagagccttcgaaagtgacagcggaatctacgcgatatctgttgttaaatatgtttcaaaatgttgcgacttatacggcgcacagcaaaaacgaacatttgcgctgctcagcaaaatcgacacttgcgccgcgaaatttgcaccgcggacatttgcacctcggcgcttgagccgaccagcaaaaatggacatgtgcgccgctcatcagtcaaaaatatattttaaatattatgccgattttcaacaaatttttactcaatttcgcaatcccgcattttttggaaaatgcgggacttggggattaatcccgcgggatccagtcccgcaaagaattttgagttccaatcccgcagcgggatccgcaaatttgattttttgtgcgggattatgcgggattttattgattttttgaaaattctaagacagaatgccaaatatttttaaataaattaaataattaatttaattaaagaactcatttttcatcgcaaatttcattcaaagtttgtaaaattttcccggcggcgcctatcggcaccaccggataggcttttacttaataatcctgtagaaattgagtcaaaaactgcgtcatttggtcaattttagacaaaatctgttaacaaatcgcattaaatttcataaaatttctcgcagatgtcgataggcatcaggtatgacacggaaagacttccgatttccgacatttttggggtcggaattccgacttccgaaatttttgatgaaaagtcggaaattttttaaattttttttttcaaaaaactagtatgtaagttttgtacaatttctgttaataaattgaactgaaatttttaaatttctcccccggcggcgccctatcgngcacnncgccgtaccctcctccaagttcccaaaaagtttttgaaaaaatcgcgctgttaaaaacgtgt

SEQ ID NO: 10772 - DNA, 1576 bp, Heterodera glycines
agcaatttgtgtgaaaaattcttgacgtaaggcgaacacaaattggccaatttgagtgaggctcagttcaacttgtatttcgcagtttacagacgataaatcgaagattcctccattcattgaaataaaaaagaaaataaacaggaaaattttttcacgcatttaatatgtatatcttaattagtttaattaatcatttagtttttttatgtcataggatgggttagaaaaaattaattcgaagttgaaactatttacataaataaaataatttatttttttttaatttttacgcttttatcgcgaaagaagtaatcgcttaattccctttttcaatgtaaaaataattgccaatgcatcatggggatgaacaaattgattttcttgaaaatgacttttattttttattaaatttatttaattatatgcataaatttcatttataaaatattattataatcggtttaattagaagtgcgagtttaaaaaattaaggcaatcggaatttttgcccaattgattcattaaagttttactggaaaaagttaaaacaattataattcaattcatgtttaaattaataattttggattcagattatcacttaaaaaccaatgtttctcattaaaacttgtattttgagaatgaataatttttttcatttttattttatacaaatattatttattactattattaaatattattttgttaattttacatgccaaaagcatatattttagatttttgccagattctctattttagcataattcttactcataaaattgttataatgtcgcatgacacgcaaatcgaagaatgggggtgttgtattctttttcaattttccatggcaaatgatggtgatggtgatgaccaagttccaataatgacccctcatcaacaaaaaatttgttaaaaaatgtggcagacaaattaattacgtagtcaaattgacgaagataaaatcaaattcacaaaagtaaggaatcaaaattttatgaaaaaattgatgcccaataatgtgctcaaggcattgaaatcgttaagtcgttcaacttccagaaaaggtgacgtcatccctccagttaaaacttcaacgccaaaaaacgaaattgatatagattattttgtcatatttttgctaattaatagagccaacggtaataatttcaattacagctctcttttttcgagaaatcgaaacttttttgagaatctttattttaggggtttagtgaccggagaatccgaaactgaactttttttcgatctgtcaaacgccgaatcgaacaaaaagtcgagaaatcaaattttttcgaattccgcatttgggtttaaagagtttaaataaatatttgaattaaatttgaattttacctttttagaacaaaatgccaatgaaagtgttggtgccaccagcgacaaaagcgatggccataaccgttccattatccacaaaaaagggagtcttgcacactttataaaaatgtaagagaaaatctagaaaatgtgctaattttttggagttgaaaacaaaccatcatagaaagcccctaaggcttcttctttt

SEQ ID NO: 10773 - DNA, 1660 bp, Heterodera glycines
  misc_feature (1573)..(1573): n is a, c, g, or t
tgtgctggcctggcattgtgccatatattccacctttgcatacggtagcacctaaaaatttatttttgcattttttttgatttatttcatttaaaatatttgtgtccctatattttcattttggaaaatggcgtctatccccaaaaatgattataaataatttgagttaaaacaatatacaatatattttctcgtaacttattgtgcataggtatcgtattttttggcattttcaggtttataccgaaatattcacttatgacaatcgaatggcactaaaatttataatttcgtcattttgaaggttaatacagaaatattcatttatggcaattgaatggcacgaagatttagaatttgatgtgtctgatttatgccaaaatttccaaatttagcaaaaagtaagaatggcgccctactggtacaaatttattaccggtaaatggtacattcgtaaaacaacagacaacgaagaacaacaacagatatgcgaagtccatttattcttaatttaacaaaatttatttatttattcttttacaatttttagttaaaattaaatatgtatcacaaataaatgaataagtatttgtgaaggaattgggcatttcttatgacacatttagaaaatggaaaaaagaattagcgccagtgcgctgatcacgaatatgacattgacttttaaacgtctcatcatcaataaccattttcatttttagcgctatttcagctgaagtagtggttgctaattttttaaatgaaaaaaaaacggaaaaagtgaagggcgtgtgccaaaattcatcggcattatttttcactttgtataaatttcttgaaaatttcagttttcccattgacagtgcccgcagacaccacttgttttgaaaagtataagcacatttcggaagggatcactatttaattattttaatgaaattaataaacgtaaagtattgattttttgaaacttttagagcacacacattttaattgcacaacagccaaactgcgcacaggtgccatcagagtgaaggaaagaaggcattccagacggactgttggtggttgaccagcgaaaccatccgtaggcaaaaaaatgggttcagtcggtagaatttgatgcattttgcacaaacagtgaccagctgcttgccagaacccggcaaaaaattaccccaagcactgaaatttactgatgtggcaccatcggtctcgtgcaaaagtgaatacattgttgattatggctggaaatttttcgggtgccattagtgagaattgatcaattaataaaatatttaagatttgaaacaattgaatttttataagaaacagattaaggggaaaaaaaatttacgcttttatgcaggtcaataaaaatatgcgaacaaattatatgcaagtcaataaaaatatgcgaacaaattattcatcaataccaccggatccattttttgtcagaagccgattgatgccccgctccattcggtcaaagcgccggtccacggcgtcaaaacgccggtccacggagtcagtgagcttctcaaaacgggcgtcaacgtcaactttgagagcnttcaaagcagtctcgacggaaccgactctgccgaacaacccccacaggagcgtcaacagaacacccaagaggataagcgaaatgcca

SEQ ID NO: 10774 - DNA, 1107 bp, Heterodera glycines
tatcattcgaaagccctcagcatgctgtactaaccagcataatttagaaaaatgttgtaaaggttcaaaaaacattatgtccaacaatatgccaatccccggtttctgatgtactttcggtcagaagttcgttgaaaattaacgaaattttttgaaattttgtaggctagtagaggattcttagggctattgaatgatgtcaagaaagttggatttggttggcaatgaaaaaacttttagttcaaaaactaggctggcgcgaaaacgacctggcccggtgattttgagggtattaatcggctcaaaaattttttttaaaaacctaaaaaaagtttttaatgcgttgattaaaattccctaaagaattctttcacccaataaatattcgtatttacgggtttcccgccgggtctccgtccgaaatttttatattctaataaggttcgctagcatttgatgaatgaaaatcttaaaaattaagggactcacaaaatccgtaactaccaaaatttatccgcttttattcaatcgtttttcaattcgtgcattgtcggataacgttctcgaacaccaaattggttccattttagctatttaaaataaaatcaactatgattatgtgattaataatgttatttgcaaaaaaagtcttaaatgagaagaaattagaaaaaatgaagcaatatttcaaaaccaaaggaaaaaatcctgaaattagcgacaaaagaatcgccattgaattgaaaattggagcttatacattgattggttagatggaaaaaagaatttgcttcaatttcaaaaatgtgatggaaattatggtggccgagtcgtttcgcgaaaaccgcaaatatttaacaaaagagagcgggccacatcagtacggtgtctgtatttgttaatttaagaaaaaaaacaactttaatgtctgtttcaagccactcaagcaaacaaagcaaagcaaatgaatatttttttacgtagaataaatagaaaaaaaattattttctaattcatttatttaatagtgtttttgggatgaggttctttaatttgttaactgataaatatatatttttatagacaattagcatacggtacatatgt

SEQ ID NO: 10775 - DNA, 1952 bp, Heterodera glycines
agtgccaagagtgtggcagtgccacttccgcgcccctttcttaccagcagttcctctcccaactgttgctcgtccgcttcttccaaagcttcttccgcttcgatctccgcttcttcttccagcaactcctccgtctccgcgtctgtttctcgtgccactcgcgcggctttttcctcctctgccgctttggcgtcggtcgcttcgtcccttttgttgctctcctccaagtgtttcatgagtaccgcaacgacaacattgaccaaaacaaattgggagatgagcacgaacacgacgaagaagcacggggccaaaatggggtccacgcaacaattgcgctgaaaaaggaacggcggaaaaaattgaaaggaccgccgaacgaaaagcgatgatcggtcggatggatcgcatccattcactgacctcacaattatcggaagggtcacagtcatcccgaagggcatcctcaaaacaagccgatgttttggtcggtttcagtgccgcccgttcttctcaccttcataatgccgttccaattatcccccgttgcgatgcgaaagagtgttagaaaagccattccaaaattcttaaaatgggcgtgctcccccaacccatcgcacgggtgctcttcgctgcattcttaaaaattgaaaaatgaaatgccaaaaaatggacggggagggaaaagcgccaaaggaattcaaaacgaagggggaaaagggggaaaagcatcggtaccgagacgaccgaacaattcgacgccgagggcggcgaagatgaaaaacagaaggaagaagagcgagccgagattgcccacttggggcaatgcttcaccgacagtgtccaacagagaacgaataccctttgccattttgagtaatttgagaactgaaacgaaaatcggaagtaattaaggacagaaagaaagagaaaggagagagatggggagaggaagaaggaggaggagggagaaaaagaaaagaaagagaggggaggagagagagagagagcgagagagagagaaggggagagagagagagatggggagaggagaaagaaaaagagagagagagagagaggggagagagacattgccaaatgaattaccaactgcaagtgaacaattatggaatgaatttaaaagttgcctctggcaattcgcagaactctcatcacgcgaatgattgtcggatttatcggcagttcaagtgcttcgaactcttcgaacaaaatcccggcaatggacaacaacacaataaacatgtccaattggttccaacttcccagaaatttaaaattgtttttaattacaaaaataccgtaacttaccgttccgccaaaaaccgtttcagtccgagtgcgtacagtttcatcgcggcttccatagtgaaaacggcagtgaataagtaattgagagcacgcagcaaatatttgagtccatcgggcatcatgtaaaactccattgccattgagacgacattgacgccaattacggcggcgatggccaagtcgaagtatttggaagtgatcactccgtgcgtaaaaaggcgaaacggaccgtagcgatgccaatagggcaatgaatgagtctgaaaagggcaaccgcaacttaaaacatgccaaggcacaatgccatccttttttggcactattgtcttcggttttcggtacccccccactgcccccgctattcctatgattgttgaccacaaaacgagataccgagttttcgaaactcttgctccacatattccgcgagaagctaattccacagcctttactatcggtgtatttattctgacaacgcgggcgtaattcctattactgtcgagcagaactagagatagtcaattatccacatgtttcccaaacaaacgagccgagaaacaacttccagaacaattagaatcagcgtaattattctgagaatgcgattgaaattcctattactgttg

SEQ ID NO: 10776 - DNA, 2202 bp, Heterodera glycines
agttaggacctcccgaaacaaaggcttcgatgacgacattggtaagagaaatgaccaccaaaatgccatccaacacattccatccgtccttaaagtacgcaaaggaaccgaagaagcagccgttggccaacactttcagcaacatttccatggtgaaaatgagagtgaaggcatagcctaaggcaatcaatttgttgtcaattgtttaaagcgactgtgagaagcaccggttgcggtgaggaaaaatctctcggcaccccccgggggaatggacggccgttccatggccaaagtgacgcaattgagcccactgagagggaagggagggcaatggccaaacagctaattagtggcaaacatgcagaagagaatggcgtagtcgaaccacttgcgcccagtcagtcggaggcaccgctccctgagggaattgcccgggggcaaaagaaacagcgaaaactccgcgcgggaataaaggaatgatttgcggactaaccgacgccacctgaaaaacattgccgaaatgtacgaaaaaggcacaacggagaggagaaggatgccgggggaggagggcgaggcccattcgatggtccaatcattacccggctaattttaaccgattgtaatcccattcaatggcttagccaactctaatgctgaattcgctcactcatccgtatccgttcatgtttatcttccgaaatgcattttccgatctgtcgtcacccaccaaatgttctttcgcttttccgcccttctcttctcttcctcgagtgtctgctgcaattcctcgttggccttcatcaacttttctcgcgcgtacgcttcgagcagtgcgtggtggccatggacggggcactgcgggtcaaagagggacgagtggacgcagccaaagtgagaccaactcatcagacgaggacggaccagggaacactccatggaagcagtggggagaagtgagaggggcgattggaagacggacattgatggaagagtggagggacggaaatgaccgcgaggaaagggacggacggcggcagaagaggatgagcagtacggcacccgacgattggcatggagagaggtgcaacggctgagatggaagggacgaacctatgaaaagggggaagaaggacggaagatgaagaaaggaaaggagggcgggcggaagatgaagcgatgaaaggagtgggggaagatgaagaggataaggacatgacttgaagaagtgacttacttgggaggacagaaatgcttcggctgctgaacactgcggaggagcacttcgtcgattgtttttgttcttctcatccgctgaatgtggatgaaacgatatggaagaacatggctcctttgaactttcttcacgtttcttcaaaatggttctgattcgctccgaattcttcgtgtattttattcccatgtccttcctctcctcttcctcctccgtcctctccctcttccatctctcttccgttggtttcatcctccttcccccttcttcttcttcttccatcctcttccttttctcccccttcgtcgtcttccgcttctcttcttcctcttccgtccactttccccggtccctcctctcttctggtggttccatcctcctttcatcttcctcttccgtcccctttccccagttccttctctcttccccttcatcttcctcttccgtcccctttccccagttccttctctcttccccttcatcttcctcttccgtcacctttcctctgtaccttctctcttccgatggtttcatcctcctttcatcttcatcctccgtcctttccctgtctcttctctcttccgatggtttcttccttcttcctttttcttcttcttcctccgccgttcgttttgtctgctctcccctcaccattagctgttctctgaccgcgtgcaaattgttctgtccgcagctgcactccttgcgcttgtcaagaaactctggcgaagttgtctctgcgattagcacttccaactccgtcttgcgctccctttcttcctcctccgccctccgttgcgcttcttcctccaattggcgcttttcctcctctttgctctcctgaaagccctcaacgagaatggccaccagcaaattgaacagcacgtaattgccgaaggtcattagggtgacgaagtaaagcgcagcccatggagtggtctgagctgaacattaattaattaccattcatt

SEQ ID NO: 10777 - DNA, 891 bp, Heterodera glycines
aaatgaaagcaaaggtattaaatgcatgtcaactatcatttaattgattaatcacctgaaagacggtgagaaatgcggtgagaaatgagtcaaagttggccctttcgcaatgaccatacgatggcacattttttgcttggagaagtaattccgcattcacttcattttgagtgcaccgttcgccggaaattatttttgtacaaaaagtgcagacgaaaagaatcatgcccaaaagcatgagaaaaaggggggggggggtaaagagaaaagaaaagcgaagagaaaaggaaaaaaggaaagaaagagggaaaaagataaaaagagagagggaggagagaaaggagagaaaggggagaaaagagacaagagagagaaagaggagaggagagaaaggggagcgaaaagggagaaaaggtaagagagagagaaaggagagaaaaaggaaaatgaagagttaacaggaggggggggggggggtgggtgagacaaagaaaagaaaaaatacgaaaaacacaaaacattgaaaaaaacaacacacgacaaagacacgataaaaacattcacagcaaaagaaagaaaaaatacaaaaaaagaagggggggggggggaagggcacctgaaaaacggtggtcagtgcccacaaaagcgagtcgaagtttttgcgctcgcatcgtttcacagactctccccgccaattctcctcaattttgcagaatttacagccgaacaaattcatgccgagaatactgaacagtgagagtgggtttttggttttgattagtcggaggaggggggggggggggtaaggaagagattggcattttgtaaggaaaagaatggattggcattttgaaaagagggagtgagtgattggtcagccagtgagtggga

SEQ ID NO: 10778 - DNA, 1161 bp, Heterodera glycines
  misc_feature (1150)..(1150): n is a, c, g, or t
gtttagtctgaggggacgttttagtcagggggtcgttttagtctggcaagctgtttttgtgccacataggttatattctgatttttttcgagaaatgtttaatttattatcaaaaaatatttatcaatgtgttaacaacaaaaaaataacaaaacattgaaaaattacgggcgcatttcataatttcgagaaacaccaacgagcaaatggttgatgttatcgggattaacattgacattggcatgataattatggtcattttggtgagcagggttattgttgatggcattgtagccctgcaaaagtcgaagaattctcgcatcagcggcacgatattttggcgcatttgcaggagggagttcaagcgatgcatcgtgagatgtccgcatcaattgacttttgctcacatcgaattgtgttaatgaagcggaagacagttgaatatgaacaagcaaaagcctgtagaagctttctatggaaaaaacgtgaaaaaaatagggttttactttgctagaagaatataaatttgactgaaaaaggcggcgccaaacaaagtgccatctgcgtacacatttttcataacaccagtccattccgaaatcgaagaacgagcaaatatcaaaattcttaatatggaaattagtgaaatttaatggattttttcacctttgcggtccgtcactgagttggtgaagaacataaagtgcaccctcatgttccagcttctgcttgtttcgctttgtctttatttcctgattggagttttccatttgatttgtagctaaacagacattttaaagttatgtttatgtatatgattgacaaacaaaagaaatttataaaaagtaattaatttgtgggtgaaaacagctaaccagactaaaccgaccctctgactaaaacggtcagactaaaccgacccctcccggtaaaggtggccttcgtaagacaattttactttttgttttttggttgcaattgggttagccatttctgaaaaatgtccaaatcagaatgtacatcaaattggttaactattaggatttggaataagtaaaattgtaaaaaatgagcgaatgttaattaaacctagcttatgccaagtggcgagggatccctcaggcttagtttttagaatcttaatttttanaaaagcacatt

SEQ ID NO: 10779 - DNA, 1104 bp, Heterodera glycines
aaattatttgactatgatttttcagaaaagccctgagcgccgcgcggtcccgcaaatggtgagcatgttaaattaaatattactatcattgatacttttgtaagttcggctcaccacgcaaaggttcttcagcattaacatttatttctgtcttcttttcccaattaaagaagcacaatcgaataggctctgtattcatgctgaattgcgcgattattgaacatgaattggaattgtgaggctgaacgaataaccaaataaactgaaagtgtttgaggagcgccgttcaagtgttgcctaaggggtggtggcaaattatcgaagtgacggggaaagggaagcgaagaacgaacgacaaaaccattcaaagaaaggagcagctgcatttgagttgttctgttgctgggcatattggtggctttgacaattcccccacaatattttcttacgctttgcccaatgtttggcttccctccgttactttctgccgcccttctctctttttgtgttgcctttgccgtcaattctccgtgcgctgatcaattgcagcgttgcggtgtaatcgttgaagagtttgagcgtcaattgcacgacctgaagaactcggcattcagaaactgcttcacaaacacagcgtaagaaaccaatgatgagtttctgcatgattttgtttttgaggtgtgtacatgagaaaatcgcatttgatgattgttatgccaaatcgcttagggccatacggacgtcattaggaagcaatttgccctccccaggcaagtaaaacgacaaaaagaagatgccaaaaggctcactattacgaattgggattttccaaaagttcctttggcatagaaagacaaattcagcaaatagcgactttttgactgcggcagagatgtttagtccgcggctggaacaatgcttcaccagcagtggtgcgacagtcggagatgaaattatgactttgatgagtggcgaagggagcgcaagcctatatgtcacaaccgtatgagacaatcgttcgctttccatatagccccacaaaatttcaaagagtacgcttttagactagcgccgaaatgtgtttgaatttacgaaataataaag

SEQ ID NO: 10780 - DNA, 3159 bp, Heterodera glycines
tttggcgattgccatgtacggaatggaattggcggaccgtttgtgggcgctgccctcaggcactctgagcagagagcatcagctgctgaacgcggaaggcgtctgctcggcaaaggtgtgccattagtacgaacataaaaccaacagattgtgtgaagtatcatcatctgatgaccaataggagtccccgacaaatggacgaatgttcggcggcggaatcagtcgcatttcggacccctcatctccacagccgtgcgcattttaattgaaaatttacgcaaaaagcattgttgtcaaatgcagcaacaacatgaacacttcgtgcacgttgagtgcgtccgaattgaattgttttgcgcttcggttggaccaggaccctcagtatcggctgctgatgtccagcaaggacaaggccattcgctcatgcatccaaaagtttgttaaatgccccaaaaactgagaccatttacgccgcagtgttcgccttcaacccgatggcaactgccacttccttcgtccgtcgtcccatcggtgcatttgcgaggcgcgcgacgaattggacagccgaatgcaaacagtaaaatgattagccgatggaattccgtaagcatttcattgacgagtaaggctgttctgaactgcgtccaacactcggccgttgctcaactttacgccgccctcagcagcctcagccgatggaattcgccggccgaaacggacagagcgatgcccacacgacgtaagaagcagttcaaaagggacacgaaatgagaaacgagtgcattttaacagccgactcttcgcccacccatcaacagagcgtctccaccgctggtccacttttgcccagcatttccttccaaaccggcgaagaaacactttcagtgccctcgcagtctgctgtgctcacaccgggtccggcctttcattttggaattgaatttttaaatgacgcggactaattttggacccaaattctccccccccccaatgaatgccattgctcaacccttaggcacttcaattaacggacaatgtatttgcgcatgtgcgcaacccacaagaacggcaagtgttttggccagccatgactttgtcggaaaaacgaccacagcaagcgccgcgacaattcccgcctcagatggcattgtttcggtcggactcactccgcaattataccgtcctctgccagttatgccatggtaaaactaagccaagacaagaagagtcaaaagaaagaacatcggataggtactaccaaccaatgcaaacggcactgagcgcagaagcaggaattgcgaatggatttgaacggttttttaacggacaaccgccactaaggaagaaaaggggggaggacgaagacaaataaattgaagatgttaaggcatttatttgcaatcaaattggcattgtagcaaaggttcaaatcaaacagacaatgagacgaaaagagactaacattggaccaattgaatttcccccaaaccctcgggcaaatcgccccaaagtttggttgagaaagggaacgtgccgggccgaaaatagaacttttcccgagtttgggttccccgggataattgtgattttccccaattttccaattccatatttaattgtccaaatcccttaaaataattctcctctttttataatttccatatcctctctttttacttctccattatccatttaccttgatcgatttatttattttaaaataacggaagaaaggggagagaatttgtaaaaaaggtcgggacctaagaattagaaaatgcctgtgggttacagttggtccaatcggcgcttcgccccccgttctttcgcttattcgtcagtcacttccatcttacaattaacactatttcctccgtttgtatcctccggcctctttgccctctctttatgcgattctctctcctcttcttctttgtccacctttctctgtccctcaaccattttggccaattcttctccaatggtctccgccatgtctgtgcctcctctttgctgcgtctctccatttaaatcgaagaaaattgtcaagtgccggtcccaattgatggacaacagaaaagccatgcaaagtgtgtcccgagggctcagcttccgcaattggtagtggcggtccttaaaaatgaaaacattcggctggttttcaacaagtcatatttatttttgaaaaaagttttaccaaaatgtgaaagttttttggtgcggctttcaatggctgtggcggttgtgactggagttgttggtcattccttgccctccctttgttcgaatcagtcgaactttgatgcgagcgttggagtagaaattcgccaaggtgttccattgtaatttcggatggtgcgcggacgaagtgggaacaatgcatgtgagcggggacggagccggaggaaaggagcgatttgctcggtgccaattccacctcaatctcatcgccttttcggcacatttcctcggcctaaacgagcagaaatttataattttagcaaagtggaattggtttcatgaatcaaatggttaccattgtctccaaaatgagaaggtcggcgccctcttccgacgatgcacaccgcgacctgctggtctgatcagtgagctgctgctgacaatgagtctcatccatcacagatcgaacagtggacggattagacagttcgtcggatgacaaatccgctgataaagtcgagtcggaacttagcaaatcggacgagtcgtcactgcttatgtcttaacgccttgagttattacacaagacaaaataatggaaaatatgccaaattttaaaaaacaaatcaccactagaagaatccaaatcctcagagctcgaaaaagctgaatttgcagtgggaatctgctggttgtgagcaacaacagttgaagatgagtcgacttccatcgcttcgacgggcgcgggggttaatgtgacgaccacctgatcgaccaattcgccgctggcgttttctgtccccgcgggggacgagtgtccctctcctccaccgttctctgttgaagagctcgccggcggatttgcggtgctcgcagtcgaatccacggccatttattggaggccttcgtttcttttctgggaattttaaattgtgggtaataaattaccacccatccatttgtgtataaatttaatat

SEQ ID NO: 10781 - DNA, 2122 bp, Heterodera glycines
tattagtttttgattttctactaattttgggcaaaccattggcgacattttttgaaaattcatgccatttgaattaaccttatttaacccagaaatactgcgaactcaaacattagaaataaaagaagtgcaagctccaacatgaaataagataattttgaatattctgggctaaattttaaaattaatgaaaacaatttttaaaaatggaatgagtcttttgatgagtggatatgagccaaatttattttctggtaagaaataaaattcgaatccataataaaatccatgttcgattaaaatccgacaaaaacaatgaggaaaaaagtgaaaaaacgaaatccaaaaaatggcatgtgcactaatttagtttaattaaataactaaaaattgctatcctaatattttatctattaaattaaaaaattaaacaatgcaaaagaatttggcaaatattattgtaaagtcgcaaaatcggacaaaggcccaaggcaggtcaacatttccattctcgtcattggcagcggattaaatgtggcggtgaacaacagcaaaatgcgcacatactgtaaaggatttgcacccgacataacatgggctgtggagaacattacggtaagtgctgtagttgatcagctgtgtgcagaaagaacgctgcacgggacgaaaatttttagaaataaaaaaaatttagtaaaaaaatgacacttttatataagccgcttaaaaagaataccgtattttctctaattaaggccctgtctccattaaaggccctgtctccaattatgtccccctttctgaggatgttgaaaaataatcgccccgtctctatttatccccccgggggataaatggaattattattattttttaaatcttatttttaataaaaattaattttaattaattctaaattgaaattcatttaaatgtttaataaacatgaaaaaataatacagaaaaatcacttactttactcaagtccgaatctaacccaccccggtgctatgtgttttcaattttttgaaatttaattattaatccctaggggtcttatgagacgggggtctggggttcgagtccgcttggctgcggtttatttttttaggtacttgtacagtttacaccagagttgccgcgggttacccgaaacccgacatttttctcgacccgaaacccgacccgatattttttctcgacccgcggcaagcctggtttacaccccataaaaattttctgaaagggcgctaaaaatatgcatacatttaaaaattcataacaagaaaactttttttgcttttattttgaagaaaggagctcaaaaaagcatttctgtattgaaattttcgattctgaagttactatgcgtcattaaaaattagactttgtcagcaaaatattaaaaaattttggcgttatgtcattattttagagtagagcgggaccgggaccgggccgggaattcccggtcatccgaggtccctgttcccggtcccggattttgaaaagctcaggtcccggtcccggttttgctcaaaattcccagtcccgctctactctacattattttattaactatttcgagatttttcatcactaaaagtcgcggccctagtcattaaaaatctgttgaaaaataatccccccgtctccattaaaggccctgtctccaattatgtccccctttctgaagaggttgaaaaataatccccccggggccttaattagagaaaatacggtatatttcgcaaaatttcaaccaaaaataaatttaaaaaaacgtgccctggagcgaagggccgccttgtatttgtcaccggtgcccttgtgatggtcgaacattttctgctccactcgtccggcaacttctgtcgcgtcgagagcgcctaaaaaattatcattttttcattaaaaaaatttgtttgtgccaaatttcgtgccattccaatcatacatgaacgaggggtgcgccgaggacctatttttccctccccggcgaccttttttttgctattcaatcactttttttcggcgcgttttttcctaaaaaacttttttggaaggggtgaggcggtccggcggtgccgataggcgccgcggggaaaattttttgaatttt

SEQ ID NO: 10782 - DNA, 1032 bp, Heterodera glycines
cctgtattctatatacttctccttttgctggtggatctgaatgcgccgattcggtgttgccgttagccgatgccgactcggtgttgccattagccgatgccgactcggtgttgccgttagccgatgccgattcggtgttgccgttagccgatgccgattcggtgttgccgttagccgatgccgattcggtgttgccattagccgatttgagtaacttcgtctcaagccccccaagtaatctttaaggatggttgaagcattagttacttggataatacgtctcacatattttattttcgaaaaattttcatttgaccatagagtaagccattttgaatcaaattatttgcaatccgaaattccggacaaattcatggccaaatgttgcaatttgcttccccccccccccgctcttcacctgtacatggcatccttcttgcctttcgtagggtaaagcattgcatttgccattttggttttttcctctgccattttcctcattagcttgttggtagctttgtttgctttttccgcgttccattcattagcacgtttttttgtatttttcggcttctgttctttggcaaatgtcttggccctgttatccatcctttctttgtccatcttatttttctttgcactttcattgtcatgtttgccgacgccaaaatcagaaggtggaagaagaagaaaatgtgcgtcttcaggttttttctgaaattttaataattttttctttattaagacgattcactttcatttttactatgttctcccccatccctttttttccgcacatttttctgccccaaaaaattataaaaattaaacgaaagtaattcaaaaaatcaattgtaaagaaaattaatttaataaaaatttagaggatttttttaaaattttatggcaaaattgaaagaaccgaatccatattccgcattgttattttttcatatgataaaggggggaggtcccacttcttccgcggctgctgattggtccaaatgtgccgacgacggtgtgttgccgttg

SEQ ID NO: 10783 - DNA, 520 bp, Heterodera glycines
gaagggccattatttgttgacaaattgcttttgttctttaaattatttattttttcagacctcttttcacagttatttttattcgaccatcaattttgacaattattttttattccttatcaaaaaaaatatatgtttatgcattttatgaatgaatagtttaattccagatgaaatctggattttgatttaaagccgattttatcggaatcaggaaaaaaaggtacttatttcctttaccgggtacttttaacatattttcagatgccaaaaatgtgttttataaattaatgaaaataagttttaagaggttttttggggtcgctgatcacgaataaagcatccatttttgccaatttcgaacccctgagccgaactcaaacaaaaatcaaaatagaaaatttatatggatgatatcctcattggtatcttgcccttgagggtaaccttggtacaggaagcctatcaagtctttgtccctgtacagctcatgtaatgaacggcagcgttggtctgagcc

SEQ ID NO: 10784 - DNA, 4308 bp, Heterodera glycines
tgattaataatcagaaatggaattcaaaattagggttgtcgaagataaacaccaaaaactgaaaaatatgcacataacttttccaaattgagggcaaaatttcaaaccaagactttcaaaaaatggctaaatatggtgtgatttagaataaaaaattttaaataaattaaaaccaaaaataactaggtatttttgtttaatttataacatttaccaatttttaaattatatttttattaatacatgagtaattcattccccaattttagcgaaaaaatgacctaaaaccgaaattttccacctttttttattagttatgacataattttatcaattttaagaataaattcaaataatttctggaaacttttataaaaaggatttgtttttttggaaaatttccatgacttttaggaggacaaaaaacccaattttttggatatagaagtccatcctagaagcttcaaacgaagcttataagcatgtttttcatgcatttaaggcatcccaaagaccagtaggggaaaaacattgatttccatataaatcaccgcgctaatgacaaaatttaaacattttcataaatgaatgaaagcatttttaggcttatactttttgcttaatatagggcatattatgaaattttaatgcttaataaaagaaacaattaccattatgagtgaaatcaatttttattgcatgcgctaaatgggcaaaatccatcatactttcattaagatatttgttaatcccattttgcgtgcttaagaaaattattaatggaaaatcattggttaattaatgttccaatttgtcaaattcctctcactttttgttggcacatttttgctcctttttctcgacaaaactttcaattgcctccccaattaattcaatgtttagcaattctttcagttcattcactttcattgcttttttcaataattcttcaacaaattgtgccaaaaaacaaaagctgtatttaatggcaaattttgtttggttggcactctcttctgccgttgaatttgccaaatacttcaaaataaaatggaaaatttgcgagtccgaacggaggaccaaaatttgtccatcattttcaatgttgccaagaattttggccatttttatcacttcgtaaactgtgggcgaatattcggacaatgaatgcaaaagatcaaaattttctgaaataaaaaatggaaatgtttatgaatttaaaaatattttagtggccggccccatgcattttataaaattttccaaggatatttgtcttgaaaattgagctaaagaaaattttgagtcaacattttttttgtcctaactttttttaaacccagtgaaattttttttaattttaattttaaaatattattcagaggaattcacattaacatataatgtttattgccatgctcacatataaattattaaaatgcaattgagccaaaattatttatatacgatagccctaagaattattatttttttgtctttaagattccaaaaaattctgcttcaaaaatgtttcgccaaaaaataaactgactaaagattttgaaatataacccatacagtaattcatttttatagagaatacctagagctattgttgaaactgagccaagttatgaatttaaatgttttacattttttgtttttgttttcctacgccaataatggcggaatttaagaaaaacttagcaccaatgaggatttgagaaaatttttaggataggaattaccatatggcgccgcgaaatttattttaattgcattggcaaaattcacaatattttctccaaagaatttgctcatctcatttttcatgcttaagcataaatgcatgaaatattaaataaagaaaataattataattaattaattaatgaaaatgataggagaataaattgcaccttttgtccccgcacattctctcctttttctcggcaaaattttcaattaccatcccattggattcaatgccaaaaaacactaaataatgattttcagccattgctttttttaaaaattcttcaacaaaatatgccataatgcacggcaaatgttggtcaggcacttttgggttagaattaaaatagtagggcttcttcagaaatttcataacaatttcaagtgttttaaaatccgaagcgatgcccaaaatgtgtccatcatcgtcaatattggcaaagaaattcgccattttaatcaattcatcaaatgttggcgaatattcggacaataaaaccagaaatataaaattcactgtaaaagaaaattcacatttatgtgtgatattcaggagatttaataataaaactaaaatttataaaaataaaaaacaaaaggacttaaaaaacactcataaatagggatacgatttttaggctctaaaaacagccaaaatacctaggtaggttttaggtcctaaaaaacccaaaaataggcactaaaaaaatgaaaaaaagcaatagaacagggctcggattcgtacttggatgccaagtacatacttggatttctgcttttgtgcttggaaaattttaactgtacttttttccaagattgtacttggaaatcgggatttttgagtatgactaaaaaatgtacattttatgaaaaaatctaaaatttttggcattttgtcaaaacgacattaattttttactaaattaacctagaaatagaaaattttcggtgaaaatctgtaaaaaggtcaaaaggtctaatttttctcccggcagcgccaatggctccgtccatcctcccccccaaaaaagaactcactttttttaagaaattgacccaaaatcgcaaaaattttcttattttgggtttaaaaagcaaaatcttaattctattgattttgcaaattgaaaaccagcagttgttgaggtgtttttgaaaaatgcgtaaattgctcagcggaaatataaatatttggataaaacattcaggtgaaaaatagatttgaagttaattaaccttttttaattttttttttgttcaaatttttatgtgtacttggatttaataaatttcccacgttatgtacttggaaattggtatgcctgtacttggaaagtgacttggtacgatccgagccctggtttagaaatattttaattttatgtatacacacaaaaatgtctaattcacaagctcaagctgaataaaaccgttcaaatcatgacttcgtttctctgttagttttgtctatcttctgtttgtctaatcactgggcgttctctgtcccttcgttttgcttttcgattcgccaactctctccgtgtttgagtgtcacaaatgcttcgggttcaatccctgcagcagcaacagccttcgtcagcatttcccgtggctccaaatacgtttcgtatgagcccatctcaaaagtgccccaatgaacggcaatgctcttcttcgacttgaccaatgcgtgaatttgaaccgcctcttttgggtctgatgaagggggaaagaaaaccaattaaaaagggggggggcaaaaaggaaaatgaattcacaattgaaaattgattaccgtatttactggattagaaccccccccccctctctcttgcgggccgttgaccctttaaaactcaaaagtgttcggaaatgccatcgaccaaccgatgtgttgcggcgccaaaaaccatctgcgagaaaagaaaaaatttccctggtccgacttcatccactccctcctctcgcccacctcggctcgtacgctccgattggaattgcgcttaaatcaatgggtccgtgaatgacgcccaacttccggaattcatcggcacaaaggcctgtgtcaccggcgaaaaaaaatttgtgttggggccccttggtcagccaaccactccacaatgactaaattgggaaggcgtgcgttttttgggtttctcgtcaaatctcaccgtgtttcggtcaattaagtttcgctgtgaccaatgctgtgccggcacactgaacacttcaaaggttctctcgtttaattgcagttccagacggtcacccttaaaattaaaaaaattatcgaaagtttgtctaccaatttttatttattttttattgtaagaaatgctgtgtacgagttgccaagagctcaaaaaattgctgaagtttttttcttcgaaaattcttaaaaaaattgaaaattaaaaaaaaaatttgggacgaaattttggggtgcacccgttgtccacccactcgtaacggcttctttatcttctgtgcctcttcctttcaaattcacaatgtagtttttttgggtttttttttcctcaccccccccccccc

SEQ ID NO: 10785 - DNA, 5168 bp, Heterodera glycines
cacacaagggtcaatcagaagtgtggatgttaaaacaatctcaggaaggattgttgagagacctgttagtaaaatatatcctttggaggcgagtgccaagggattaacagattcaaattgtcaaggattaaaggaaacatcaaataaaaatattgaacttaaagaaatgatacaaaatgagaaggctaaacaaattaaagaagataaacgaacccatcatccaatgcttacaagagcaaaggctaaaatattgaaagagtcaatgggtttcatgataattttattatttacttgtgtctttttgactgatggtcaaaatacaacagaaaaaataaatagatgtaaggattgtaaaatcaaatgcgattcactgggaattattctgaaaacaccaaaacgaataaagaaaacggaaatttgttgtacgggcagttgttatacccattcatacataagagaaatgaaatacaatctgccaagggagtacctgatagtggatcatgaatgtactgtaacttattggtcaagaagaaacgtgatgtatcaaaataaagttttttgccccccggtggaaaaatgtgattcaataaaaattttgagttgggacatggttttaaatccagaatgctggacgaaatggacagaattattaattggtgtaataatgttatttatgttaattattatttcttgtatttattggtgtgtaaaatcaatttatgctattttgaaatttgctgggtcatgtttatgctttccattcaagataatgagaaaattttgtttaaataaaaattttaaaactgaatcggaaatgagtctactcgcatcaaatgaggaggataacgagaccaagaccaaagagtggataaaaaaaagagaaaccggcggttaaaaaggttgagtctaagtacaaaaatgggttctacaatgttatttatgttaataattatcataatatcgattaaaaatgttaatgctggggctgaagtagcagtaattcaagcatcatctgaagattgtattaaaaactctaatggcactttgtgtcgggttaggggagcagcagaaatgacaatcctaccagcgggccaagagatatcattagcattgaaaaatgataaggctcaagtaaaaggttcaattaaagtcagactaaaatcattaacattaaaatgtgtccaagagacagttgcttggctaagggaatataaaataaaagttaaatcagcaagaagatgccctacgatggggtcgtgcaaaaaagggagatgcgcaaacatccgactaagtgaaaaactaagagaattaaaaaattattggaattatcctggtaatacttattgtatggagggagagtcaatttggggttcaaaatgtgctttaccatcactgggtataaatgaatgcttcttttataaaataattgcgataccaagtacaaatacagtatggaaacaagtacgttgtattaattgggattatgaaattcaagcggaagcagagttagtaatgggaaacatgacaaaaaagaaaaaacttaaactatatccagggataacggaagaatggcaagaaattgcatttaccccgcaaggagtgactccaccaattgcgccattgctagatgattattttattatatcggataaagatataatctatgcgggaaaagaagtgcgaactcaattaaaatgcaatgaccaaaatagtgcgcaaaatttcgagtgtattttgggtaccgatgcatgtaaagagtgttggcttaatagaacaaaaagtgaagaagagttggtacaatgtgaatgtgaagactcaacttttggtagggtcgagccaaagttaccttttacaaccgataaaatgaatttaagaaaggatagaaatacaattttgagtgaaacaatttatactcctatccagttattagtaagagttgaaaaattaaaaattgtaacagaaattgagtgtaatttgtgtaaagccaaacaagtggcaccattgaaaggttgttatgaatgtaccacgggtggacgacttaattatacatgttcaacaaattggggtgaaaatatagctgaaataaaatgcccaggaaacttgattttcttggcaaaatgcaataaaaatggcgaaacccaaattgatgtgttaccatttacaaagtcgaaaattaatatggattgtgaagttatatgcccaggaggaaaaacgagtttaaaaattaaaggcgagttaatgtatatacctgtgaatgaacggaaatatcaggtaagaaattcagaaatattagaaaatactaatgggttcggacttaattgggaagatcttttccaatttaattggaaattatttttaaatccatttcaaaattttaaattatacatattaatcataattttggcaatttttgcaatcggagtcatttatattttttggcttatgattccaattttcaatggttatagattcataatcggcattttaattttagtcatttcaattcccgctgtcagcggagggatgcatggcatcgagagcataaatgattcagggataaagggtcaaagagtgcaaataaaaattgggatatataagggaacgatggaagacaataaggcacattcaaaccaatcatattcccaaatatttaaaatttattttgtaaaaatgccttcggaaaaaatggattttttgaaatttgcctcccaaattctggcatgtgcgaagagagacatcggaaattatctacaacaacacttctaccgaaaactattaaccaaacacaccaaactggcaataaaaaatggtgccagacttctctaccgctgcgaaaaaggggtttacgatattttgaatgggccggaatttttaattttgggtgaccggcctaattttgggctgagacctcgggtcccaagtcatatatttgcactccaaattctgagactaaatggggtcattgggtctacaattggccctacactccttatgaatggtcattattacccattgggaggacttgtatttcaagggtaccaagatgagttgaattattttgaagattttttcaaattggaaatggataaatcggatatggaaataatgccacaaatgggtcttggcaatgaggaagttactgaaggtgagaaccgaattacaatacacttggacaacaattcgagtcgggaatgggtcttagaattcaaaaatatgggtgaaaatggattgaaaataattggaaagggtaaattcaaggctgttctcaactttgtgtgcttggcaatttgtaccttggcattgttaaatggggttcatggaatggacagacaaccaaacgggcaaaaggtaccaagtgaaagtgccgatgatttcgaagacttcgaaatgcaacaatggcaaagtgagctaagagatttgcaacagattgagacggccgagtccacttcgggtctaaacacggttgccacaaacaccggtacaaacaaccaagaagtgagtttagcaacggatactgtaatggttgtgccaatttctgaaccaagtcatcaagtacgggatatcattgaaaacccagttgtggatacaaatgtacaatgtgttgtagaaaaaatgggtacgacgaggcaattgtcaattccgacgaatttggatttgttgaattgggctcaaattcatcgttttttaccaccccctaatataatgttgaaggcccaacaagtgtccccaaatgtgcctcttgatcaacgaccgtccacttcggcaaacaacattggcaatccaaatgtcagtgcttcttgtgccccttcctgttcctcgatccaatgtggcaaatacgggaaagcaattcgaaattgggatggacgagttgcgcggccagtacagactgacctgtgccgtcgagaacgttcagctccttacttccgtccacggccaattctagcagcacctcaccagcaaccacgaatggtcgccaacccgccttttcctgttgagtccatccctcccattcacgtgccgtctggaattcgtcgagagttcttgcgcagaatgagccaagagacggaccactttttcggcctcgctcagttggttggagaatggaaccctacactcgcaactctgttcctggctttggaaacattctgccgtgccatccttcagctctgcgtgactgaagggggcgaccaccctgtcttctcccgccccgagtgtcgccgccgataagcgcgacgaaagatcaaaggaaagagatgatgattaatcaaaatggggacggaaaatcatatttaagaaagcaaaaagagagcacttcatcattcatttgatcattcaattgtgcaaataaatttgttgaatcattgggaaattcgggagaaataatataatttaatattaaattggttaattcctaaggcataattccttagaaggtcgaattaaacaaagagtctcgacagtcaaattacggatcaaaattacggaaaaatcccaaaaatccgtaacccgtaatccgtaatccgtaactcccaaaaccccgtaatttccgtaatccgcaatccgtaatccgtaattgcgtgcagccctggtctggatcctttaataggacatggggcaggggtctggacccttaatatgacaagggacatgggtctgagggtacttaatagaacaaggggtaggggtctgaacgaccatgtccgttgattatatgcagaaatgctttaagttacagggcaggggtccccagatcccttgcgataggttgtaggggcaggggtcccagaccgctgcccatgtgatagattacaggggcaggggtcccatgtgataggttgtaggggttcactttgttttaattcgattgaataaaatgaaaaagacaaatcgcaaatttaagcataaattgaaacaaactcatttgtcgcagaaaaagattctcttgcataactcttagattaagaaaatcgcatggattttgctttaaaattaatttttattttatgaattgactaaaatatttttaataaccttaagaaaggatattttttgtgtagaattaatgtgaaaatattatttataaaaaaatgggaaaacgaaaaaaggggattttttttatatttatttttaaaagaaaaaaataagtttttagcttccgggttaactca

SEQ ID NO: 10786 - DNA, 2666 bp, Heterodera glycines
  misc_feature (2654)..(2654): n is a, c, g, or t
gatttccatgccggcttcattttgccaaatgtatcaaagcaaaaaagccgaaacatgccgggattgatcgcctcataataagccttaacagataatgcttaaaaataaagtcaattaataaacaaattatttgcctgaattgattctccgtattcctcaattgaatagaagggtaggttgatgtcaatgttgcacccccggcacaaagcatgaacgccttcaagctgttttctctcatcccttttgtattccgaaaaacgttgttgcgcaagtatgaatttcatccgaagcatttcaaatgaccggaagagacagagattgtcgttgttcagaagctcatacgttgcaccatcggcaatacggtagtcgatgttgaagtcgttacgcccttttccagccattttcggtttggcgcacttgctctcgattgccgtgatgtcaattataaatggttcttcaaggagtgatggcctttccttcgctttgttgctttggtcgaccatttcaaaacgcgtcaggattttttctgttgccgagttgtccagctttttaaagtgtacagccacttcgtagtcaaggtgttttgacgtcagaaggaaaatgaagtggtccgcggatattttcattgatttggccccctcggaggcataagaaaggcacatggtgaataaattgcgcagaatgtcctccggaaaaacagcaccaaacgttaggctcatcaaaaattgcccaataaaacggaacgctaaacaccattttaaaaaaatacctcaatcaatcaaagcacaacaaaaaatttttttaaatataattttcatagataaattaaataataattttatatgatgtattatttacaaccacacctttaaaacgtcccgcttccgcctgtgcggcagagagacatgtaaagccatcgccgttgaacaattccgcctccaattcgcgggtaattgacggctccttctgggccttgcgctcattgttgtccgatggcacaacctgaaaatgtctcccaaaattagaaaagaattttagaaaaacatttcgtaaaaactaaccgagatcggaaggcgtttcataacctcatccaatggcggtgcttcgtccatcaattcggtgccgtcatccccaacaggggaatacggtccgtcgagggtaggggggagggaattgtcggaatattggctcattgttttctttcttaaatttaaaaaaaaaagaaaattcaaccattgagtttagttaaaaatgtcaaagaaaatggccgatcaaaaaaaaatcgggcatgacccgtcccctgagcgatgttttgggccatttttggagagccaaaaacgcgcataggtccgcccctacacgtgtttttaaccttccggcccaaagccatcacattggagggcatacccaccaactatgactatcatagcaagcgattatggaaccgctcatggaactcaaagtgtgtggcactaccataccaaagtgcggaggtatggtgtaggcatctctatgtcgggtaattactcccttcacagagcattttcgccaacgcccacagcacatatgagttccgtcaacgcggattttaatccggggtgttgagtttgagcagctgcgcgttcgacactgctcagtgactcgcggtcctccgggccagccagtcccggttattctctcgctgtaccaatgcagcccgtaggcagggcacattagggctaggaaccgccacccccgctgctaggaacaggcacaccttcaccctcaaggccagcgagtgaagggcccccatccacaccagaccgactatctggttaggcttaaacatcgctgtgacacccggcgggctatgacggaaacttggtttcggtcagtcactgccgcagccctggataccagcggaataagccccgtggacagtgaacgcccgtgcccacccctctgggaagtaacccagtaccggggcaggacttctcggtttaaggatggcccccaggatatttgaaaaggcttaacaaatatcctaaaggggtttagtaccgagtaaaccaacaaaatgaaaaaatggggagagaaaggacagtgcaaagtacttgtgatcaaagaaaaatgaaaaaaaaaacaagggaaaaatgaagaaaaagataaatttggcaataataaaattaattttaaaagaggaaaagaaaaaatttatagaaaaaatagtcaaaaatggaaataatttaaagttaaaaattttaaataggacaaacataatgccaagagtcgaaataaatttttaaatttgttaaaacagaaagccaagagtgaaaataattttaaatttgaaaaaaacagaataccaagggttaaaataatttttaaatttggaaaaacagaatgccaagagtgaaaataatttttaaatttgaaaaaacagaatgccaagggttaaaataatttttaaatttgaaaaaacagaatgccaagagtcaaaacaattttttaaatttgaaaaaaaattcaaagggttgaaataatttttaaatttgaaaaaaaacagaatgccaagggttaaaataatttttaaatttgaaaaaacagaatgccaagagtcaaaataattttttaaattcgaaaaaaaaatgcaaagggttgaaataattttttanatttgaaaaaaa

SEQ ID NO: 10787 - DNA, 1497 bp, Heterodera glycines
  misc_feature (40)..(40): n is a, c, g, or t
  misc_feature (1202)..(1202): n is a, c, g, or t
acccagtaccgggcaggactctcggtttaaggatggcccncaggatattgaaaaaggcttaacaaatatcctaaaggggtttagtaccgagtaaaccaacaaaatgaaaaaatggggagagaaaggacagtgcaaagtacttgtgatcaaagaaaaatgaaaaaaaacaagggaaaaatgaagaaaaagataaatttggcaataataaaattaattttaaaagatgaaaagaaaaaatttatagaaaaaatagtcaaaaatggaaataatttgaagttaaaaattttaaataggacaaacataatgccaagagtcgaaataaattttttaaatttgttaaaacagaaagccaagagtgaaaataatttttaaatttgaaaaaaacagaatgccaagggttaaaataatttttaaatttgaaaaaacagaatgccaagagtcaaaataatttttttaaatttgaaaaaaaatgcaaagggttgaaataatttttaaatttgaaaaaaacagaatgccaagggttaaaataatttttaaatttgaaaaaacagaatgccaagagtcaaaataattttttaaattcgaaaaaaaatgcaaagggttgaaataatttttaaattcgaaaaaaacagaacgccataatttaattttgaaaaaacagaatgccaagaattaaaataatttttaaatttgagaaaacagaatgccaagaattgaaataaaagaaaaataatttttaaatttgaaaaaacagaatgccaaggattgaatatttattaaaatttaaaaaagagaatgccaaaaactggcaagaaataattgaggagttttggcacgaaaaggtgcgacaattggcaaatgaaaatgtgaaaaaagggggcaaaacaatgccaaaaatggaaggaaataattgaagaattttggcacaaaaaggtgcaataattggcaaataaaaatgtgaaaaaaagggggcaaaacaatgccaaaaaattgaggcaaaataaatgataagggattatttgattggcttttccatccgtaaagtgaattaaattaaatgaaaatgaccaaatggacaaaaaatcaattagtaaattgtttattgtctgaaggtgtcagattacataataagcgtgcgggagtgtgggcggcactacaaagtacgcgaccaattaaaaaatttgatttgtttatttggcccnttcccaacaccccgcccccttcataattgatttgtttacatgaccccccatccccctctcgccgcacgctcttgcccccctcccccccgctggtgacgtcaatttttccctttatgagagcaaattaatgattatcatccattgcctatgtggccgagtggttagtgcgtcagtctggccgccctccctggggatctgatccgattgatagcggcgaatttttggacaaattttaaatcaatttaaattcaacgtctttgacctttaagacgttttaaaataatttaaaaattaa

SEQ ID NO: 10788 - DNA, 4127 bp, Heterodera glycines
  misc_feature (4058)..(4058): n is a, c, g, or t
tttaaaaatttttttattttttgggcaaatttttgggcccttggggattttggcctactatttgaaaattcataacaaatcgaagggttgataaattttacaggaataaagccttaaaaatagagaaaaatcaggagaattttatggactttatttggattttctatctaaaaaaggaaaaaagttattccagaatttctggaaaaattcgaattttcagaaaaaaattcataactcggttctgaaaagatattctggaaaaataaaatactacaaaaatccgcagttttttgctttattatataaattttatttggcatttttatcacttttttaagaatttttataaaaataaaagtgattttgagattcgggaccaaaggggtgagcataggatttttgagcggaaatttttttttcacaaaaatcttccaaaaatatgtctttaggggttatttgggccgctgatcacgaatacgtgatcagattttacttttgacatcgttaagacctcagaatccctgtgtgattggggattctgaggcatcattttttggggggggggcaaagttcgaatccggacggtgtaacaatatttttctgtgcatttttgggttattttgactgtttttaattaatttaaaatattttgttgagttaataaataaaaaattatatttaatttaatttttttttgatgaataaattttataagtttaaattaattatttttttaattaaatttgttaaaaaatttttcatttaaaagagtgtttgtttttttaaattaattttttaatttaaattaaattatttttttgtgaaaattttttaaaattaaatttttgtttgattaaagaatttcatatattgtttttatttgagttaaggtgctgagcacaatatgattacgtttcagaattttttgtattttttaaaaagtgcaagttcgaacccggacggtaacacattattgggggggcgaagttcggacccgggcggtgtacattatttttctttgtatttttgggttatttttaatgtttttaattaatttgaagattttataaattatttaattaattaatttaatttcattatttatttgagggtgctgatcactaatctgacatcagattttagtttatacatcgttaagacctcagaatccctgtgtgattggggattctgagtcatcttctgtggggtgggggcggtaggttcgaatccggccggtgtaaattatttttctatgactttttacgttattttcaatgtttttaactaatctgaagatttgttgtagattatttaaaaaaaattttttacagtaaagaatttaattatttattttttgaattttctaatcactgttgcacctcttctaatcacttttgtacctcgtctaatcaccattgtacctcttctaatcacttttgtacctcttttatcacttttgtaactcttctaatcactgttgtacctctttaaatcacatttgtacctcttcatcaaatttgtacctcttctaatcacttttgtacctcgtctaatcaccattgtacctcttctaatcacttttgtacctcttttatcacttttgtaactcttctaatcactgttgtacctctttaaatcacatttgtacctcttctaatctctgttgtacctcttctaatcacttttgtacctcttttatcactggtgtacctctttaaatcacatttgtacctcttcatcaaatttgtacctcttctaatcgcttttgtacttcttctaatcacttttgtacctcttttaatcacttttgtacctctttaaatcacatttgtacctcttcatcaaatttgtacctcttctaatcgcttttgtacttcttctaatcacttttgtacctcttttaatcacttttgtacctcttttaatctctttttacctcttctaatctctgtaaggccaacaaaatttgaaaaactggcgcgaggcgcccgactgaggccgcgatcggcccaacaagctaaaaaatgggcgcgaagcgcccgtttgaggtcaacaaaattgaataacgggcgcgaagcgcccgtccaaggccaacaaatttaaaaacgggcgcgaagcgcccgtcttgatcctcgatgtggactaaaaacccctaataattttttaaaaattcaaaaaaacctctccaaccaattcgatccgaagctcaagaagtaaaaaacgggcgcgaagcgcccgtctgaggccgcgaagcggccttaatagcccaacaaatttagaaacgggtgcgaagcgcccgtataagcccaacaaaatttaaaaaacgggcgcgaagcgcccgttcgaggccgcgaagcggcctaaaagtcccagataatttttaaaaaattccaaatctccacaaccagagctaaaaaaaccgtagttgtacctcttctgatcacaattgtaccttcccacccgtggttgtacctcttcccccgtaacagtctaggtagcgaagctcccaaagcgcgaagcgcttttccacagctaaatagccgacggttcacgcacccgctagtgtattttattacagggacatttgtttggtgattgcggaatcatgaaactgggcttgcattggcatgcgacctcaatgccaagtgcatcgatgggtgggccgatttgcctcccgctcctaacggatggggtggggaaggaacatttgtcgccgaattcaaaattttttcatcctctttatcaccagaaaaactgtaatgaagcctattctttccatgatttcgctcaaggcttttccttaatcaccaagtttttgaatttggaaaaaattttctgaaaaaattaaataattttcagaattccattatttttgaaattgtcccggtcccgacgtatccctggtccaaaaattgatccggatcggatgagagtgccgggaaaacaacataatttgggatcatcaatgacacttttactactttactgtggcgagctctggggggggggggaatttggaattctctcccgaaatgtaaaattaaaattttctcagtaaatttcgctaattctgaaaattttacattcaattttcaattatacttttattaaaaaatgttgcagttatccgcacggcgtcgacgcggtgtttctcagtccgccctggggcgggcccgcctatttgcacagggtcggtccgtttgacctgctcgccgacatggagccgaacagaatcgataaattacgccgaaccctgtctactttttgccgaaaaacacccgcactgatcaatcagcaggtggttgtggtgatggcttacaattaactgttaatggctgactcataaaaaagcaaagaatttgcgaattcttgcgtttgtccaaaatccttttaaatttaagtttttcggttccaggcaaaacatttaaaaaaattgccccatcgagagtattttatttcaccaggtcaagtttgccttgagctttccattcgccccgataaaatctcagtaaattttgctaacatggaaattttgcattcattttttcaattatctttttattttttaatgttgcagttatccgcgttttcgtcccatctttttacattttcgtatttcaaaagaaaaaaaataatattatatattaaatgaaaaagtcaaaatttttaaaattaatctctttctattttgcacaaattaaatgtatcactcactaaattttgatattgaatttgctttgggtggtttccttccttctaaatccctcgcttctcttttcatatctctcaatcacttttcttttcaactgatatgctaattttgtccctttcatggccggaagggattcctggttgtctctctccaaccctataccatccatccgctgctatgcctggtggaagagatgtccaccaaaaaatgaacatcctggtcaggctcttggattgggaggccgaaggaggaagccgtggcatagaatgaattcatttttggccggaagggattcctggttgtctctctccaaccctataccatccatccagagatgttcaccaanaaaatgaacatcctggtcaggctcttggattgggaggccgaaggaggaagccgtgccatagaatgaatt

SEQ ID NO: 10789 - DNA, 1070 bp, Heterodera glycines
taaataggcctagaattacattttagtattttaaaaattagtttgattaatttttatttttcacttttcaaaaattctcaaaatatgtaataaaaatacgaaaatatgtacgaaaaatttgccgaaattttggatttttttttttgagaatttccgaaaatttctgtaaaaaatccccaaaatatgaaaaaaatgtatgaaaagcccaaaaaagtccaaaatatgtacaaaatctcgaaatatgtaaataaaagtcccaacttttgctcgcaaacacaaaaaagaaagtgttttccctactaaaagcatggagaatccaggaaaaaaatatgtatttacataaaattgacagccctattgatcagtgtattgaattttaaaaattgttggcaaaattgggcaaatgccgccaattaaaaattaaatggcgtcccttatgagttaatcctagcgaaatttccaggccaattgtgctctgtttcattggcattgatggggccggtaaaacgaccattgtcaaggcattgcaaggaggtaggccaaaccaaataaatgccatggccgagcctttagcaaaaattgtcacgccccttcagaggattttggcaccgttcattccacggttggcttttcccgggcggaattgcgagtcaaaaagtaccgtatcactgtgtatgatttgggaggatcggctcgaattcgcgaaatttggcccatttatttcgccgaggtatttacttaaaagttatttcatcagcaggttaattcgcaaaatatttatttacattttgtaaaatgaaataaaaatccaattattttttgcctttccaattttaattcttggcactattttgctctttttttgtttttgtttttactttaggtgtttggcgttgtgttcgttttggatgcgagtgccgccagtcgaatcagtgagaacaaaaagatggtcgactctttggtcggactgcccgaccttctcggcaaacccattctgtttctgctcaacaaaaaggacctttccggaagtgcgctttgttttcctttcctttgccttgaaccgattgagt

SEQ ID NO: 10790 - DNA, 1206 bp, Heterodera glycines
acagaaaaaagaagacgaaggaacctttgagaagggcgagcgaatgaaacgatgacaataaatgacgtttaagcaggaaaagaagggaaagaggaaaaggagggaggggaaaagagaatggaaaacggagagaaacaagagagagaagaaggagcgagagaaagcagaggaagaggaggaacaacggaagagagcggaaaagaaaacagagaaataggaacagcggaagggagtggaagaaaaagcagaggaggaggaacagcaccggaagagagcacaagaaaaacaaaaggaggagaaagaagaggaggaagagaaagaacagcggaagagagtggaagagaagcgcaagcagttcaacaaggcacagttgaaattgaaatgagaccaactccccgagcagaaagcagccgaggcggaagcactcacggacgaaatgcgatagacgtaatgacaacggtgggaagttgaaaaacatgctaatcactcaattaacacttcaagtgatcataggttgttgctaatatccttttgctgccctcaatttgtcactgattattaaattttgaccgattttttaagaaatattcgcccttttcccaagtattttctcttgttgtttatccattcaattatcctaataaacggatatttgtgctcttcagcagctacgttttgttcccttaatgaatgaagcacaaaacggcggtcaatcgccaaggacagccgccatttgtaaagggacggctttaagtggggggggggcattgaatggcattgcccccattaataaatgactgcaaaaagaaaggcattattattatccgccggtcggtcaatggcaaatcaaaaagtgacattgaaatgaacaatagaggaaaacattgattaaattaacaaatgagcgaatccgaacttgtaaatgggggaaaaagtacatggaaatttaaaagtgttaattgacgagtgccctccgattctttccaattaaaaggcaattgaaaatgtaatttttgtagcaaattttgtgaaaactgtgatttttgtggcaaattttgtgaaggtccgtcgggcctcggaattagcatcaaaatatctctgattggccaatcgattctcttccgatcactgatcatccctctctctctctctctgatcagtcttcccatgtcagtgagtgccgttcgcccaccctcagctggcaat

SEQ ID NO: 10791 - DNA, 1769 bp, Heterodera glycines
acacggctcgctgggcagcggaggcggcggcgtttgcaaagcggaaccgcaaaggtcgccttggcacggctgaataaaagtgagttttttgcgatttgcaaggaaaatgaccggttgaccgcctctgtttccatttggaggcgatggaaggggaggaaaaacgccctgaaaattaaaaaatttaatgagggcggctttcacccttcgaacatactcctttttgtacccatccgcctcccccttgacagccgccgccagagcacccacttgcgcttccctggcacccacttccttggcacccacttgcgcttccttggcacccacttgcgcttccttggcacccacttgcgcttccctggcacccacttccttggcacccacttgcgcttccctggcacccacttccttggcatccgcttccttggcacccacttgcgcttccctggcacccacttccttggcacccacttgcgcttccttggcacccacttccttggcacccacttgcgcttccctggcacccacttccttggcacccacttgcgcttccttggcacccacttgcgcttccttggcacccacttgcgcttccctggcacccacttccttggcacccacttgcgcttccttgccatccactcgcgcttccctggcacccgcttccttgacatccactcgcgcttccctggcacccgcttccttggcatccgcttccttggcacccgcttccttggaatccgcttccctggcatccgcttccctggactccgccgcttccttgatattcgcttccatggaattcgcttccttgtaatccgcttccatggcatccgcttccctgacatccgcctccttgacacccgattccttggcacccatttccctggcatccattttggcttccttggcatccgcttccctgacatccgcttccttggcatccgcttccctggactccgcttccttgacatccgcttccttggcatccgcttccctggactccgcctccttgacacccgattccttggcacccattttcctggcatccatttttgcttccttggcatccgcttccttgtaatccccctatttcctgggttgctccttctcgttggcaccctgctccttggcattctccgccctgcttatttcctcctccctggcatcctccgcttctcaggcacccgttgcaccctccacatccttggcatatccttccttggcaccctcctcctccctggcaccctcctccagcacctcgatcctgctggcatcctcccccttggcatacgcatccttggcaatgtgtggccacctgctgctgttgacacccacttccctgctggcattctcctccttggcaccctcccgcgtccgcttgaactgctcctcccccgcccctacaactgcaggcacaaaattccgcaccgctaaagcattctctgccgcctccccctgtctccccgctctgttggcattctccgccgcattcgctccccccgcagtcataaaactgcgtctgttgttgatagccgaatgggcgtgggtaattcacaattagcggtgccgcataacttccgcctccgccgtaacttccgtagccgtaacttaatggacggagaaaaaagtgccaacgaaaggaaaagtgggaaatgccgaaaaatagggatttatatttaacagaaggtaaagcatgacggagtgtttacttcatttgacagatgggaacggccggcgcacaaccgacgagcgacgaaggaggacagcaa

SEQ ID NO: 10792 - DNA, 989 bp, Heterodera glycines
agcgatgagattaatctgaaaatgaaattgaagggcttaaagtgatgtttaatgaagaaagaatggctgtgaatagagctcgacctggacctgaacccaggcctagattttcctaaatcaaagtccaggtaatttttcagcaacttggattttgtccaggaaatcaaagtatagttcaaatatgaaataaatcaaggcccgatttcctggacaatatttatcgagtgagtgaccaagctttttaaaaaaatatgaactctagtgaaaaattctttttgaaatttgaataaacgttttactgacttttattggcattttctccgtggacattcccttgccgaccatcagcgctttcttcaccgcctcaatgccttcgtaggagaaacaactcacttcgatgtccgctcgaattttgagtgctttgggcgtaagtttcttttgaatttcttccaccaatttggcgcgcactttagcctcgatttcgcactcgtcgaaaacggacggatcgctgaaaaggaattggggaaaatggatgaaaattaagccagacattacgaggctttgtggtggtcaaaatatgagggcccattcccttccgttccccactcgtaaatcatttcccatatcgactccccccgcccaccaccacccagcccgattaattcgaaaacaaaactttaaattcttaagaattcattcaaaaaattctaatttttatcagagaagtgatacggagaattgaaggggaggaaaccaatttctaccaaaaaacaacttaattttttttaacacttactttacggcttttgtgaacacttcatatgaacctgcttttttcttcatcttacggtcgaaatgccaagcggtctaaagggacaaatgaaaaaatctattgtgaaaaacaggagacaacataaagtattttcatttgatagtattcaaagttaataatttcgacactaaaaaaggaaaccctgcagtgcgttgtt

SEQ ID NO: 10793 - DNA, 1649 bp, Heterodera glycines
ccaaaaggaggggaatggtctccttataaacacaattctttaaatcggaaagggcgtggagaacaaagtacaagaaagggcgtggagaacaaagtacaaatatgaaaatattaagaaggtcaaaacgccaatttaacatttccaacacacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcagcagggatcgagaccgggataagaccattggaaagaacagctcgagctttacaagaagatatggaaagaaaaaatagacatttcagggactttttcagaaatcatgtttaattccccaatggggccccattttgggtcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttcagggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgccaatttctaaaacgcttaacca

SEQ ID NO: 10794 - DNA, 1694 bp, Heterodera glycines
  misc_feature (93)..(93): n is a, c, g, or t
aaaatttgaagtcaaaaaattattcgaacttctccaattttgtttccataatttccgaatgttattcggtatcataatgccaaaccaaacganattcgttttaagatattcttttctggacttgacttggtttctcaatatcgaagcttttttctccgcaatttctaaaacgcttataccaaaccctagatttttggttccgatgggtttcagaaaaaatcccttgtggtgcaaacatatttcacatttcacttcataactttttgagttctgcacggatcgagaccgggatatgaccattggaaagagcagctcgagctctacaagaagctatggaaagaaaaaatcgacatttcagggacttttcagaaatcatgtttaattccccaatggggccccattttgggtcctcagctacagccccatgcttctcccaattgtggcgaaaacaatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagacagggataagaccattggaaagaacagctcgagctttacaagaagctatggaaagaaaaaatcgacatttcagggactttttcagaaatcatgtttaattccccaatggggccccattttgggtcctcagccacagccccatgcttctcccaattttaagtcttggatttgtcaaataaattaacgatttcgaattaataataaaatattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggacttttcagaaatcatgtttaattccccaatggggccccattttgggtcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctcctaattttgtttccataatttccgaatgttattcggtatcataatgccaaagcgaggaacgaattcgttttaaaatattcttttctggactt

SEQ ID NO: 10795 - DNA, 2540 bp, Heterodera glycines
attctgaaatagttaaataaatattcaaaagccaaaaatttttgcaatattgaaaacaaataactttaagtgacaatattaataaaaatgaattatggttgataattttcctatttttaggcgttttttgtaaaaaaaaaaaatgctgaagttatcgttttatttttttattgtgaatattctataaaaatatccttacaatttatttaaattgttatttgcgaagtaaattatatttaaatttaattgttattttactttttcttgccaatatttgttcagtagaatttcattttaatttgagaataaaataacagataatgtgaaatcgatgggagatgagaaggaccaccgattgaaaacagcacaattattcatccgctttgtgttgagggatatgcatacattgaatcaatcgttcatttctctctctccaatttttcgttccaattaattagtcatccattgattcttatattatttaaaaaactttaaaaacattaaaatactttatttaaacttaaatttgcctcttaaatatggccgaatttgcccaccgagccggtgctccattggagtgcctttgcatggctctgaaggtaaaaaaaattaaattaaataatgaattaaaactcaatttaaatacccaattaaaactctaattaaaatacacaacaattatatctgtaattcaaatgtttgaaaggtccaaaagcgtcaggaaggaacggacgccgaaggcaatccgcgatggaagtaatttaatattattaaaatggaaaaaaattcccccgtgtccttttaaattattttggtgggttttcgaagttgctggttacacgaatttgacatcaattttgacaaacccgaattgctaattgaactcgaaaacaaaaattaaaaataggaaataaatgaaatttttccaaccctttgaattaagttaggtattcggatttggtcgaaatgggcgtcataaaatgatcttgactccgaaaaaaacttaggtaatttccgattttatataaaaaaggttctccctttaataactctcaaagaaccgtaaaaatgattgtttttaattttattaaagaattggcataagtattggcggtggcattgaccaaaaccatcgacagtccgtctacagtgattccgtctgttatcaattttatgaaaaaaacgatgaataattttcttaattgatatgctaacaatatgatttgattgtttatatatatatataacgaacgccctttttatggtggcttttatataacgactatagcaccctaaaaaacaaattttatcaaaaataaatttaatttgtaaataatttttttgaattattattaggcaatcctaaagaatgggggtccctaatttttaacttcccattctttaggatggtcgataattacataaaatgattaaaattttcccgacttaagggaatttatgtgacaagcgtggaagcaaagtgacgtgccaattccttcttgaccatttcatatttcgattttaagttcacccgcggaagaagctggactgaaagtgcatgacaaaattctgcaagtgaacggcgtcgattacgtaaaaaacagaattaaattacaaaaaaaaccattgtttttatgcatatgtcggtaaatgaatcatctttggggtgtcttttttatttttattacattttttaaggatttttccaaaaatcccgaaagtaggcgcaaaaatggcgaaaaaggcacaaaagcgttttgttttttgcttatctgagcgtatcaaacgcacagaaattttaggctttttttaaaaatggcagccctaaaaataataatttattaagcattcatatttatcggttccacttttttttgcagacgatgatcactcacgatcgagcagtcaaatatttgaagaaggagccggtgttggatttgctggtcaccagggccacagcgaaacccagcacggaagtgcaaatgtgaactgcttgccggaggaacgaactaattgcacattaagtccgaaataaacacacattccaatcgctgatccgatccatgtaatttttgatccaatccgaataatttaaaataaatttttgttggatttaaaaatttacgactctactctgacgatgtaaagaattacttttatttactcaataccataactcggcattagaccgacaactgggagaccgaatcccggttctgtaataatatacaaaatgccgtaaatttagtgttcctgtttttcattttgacggtctttaaattcgagccatgccctgtttttgcatggtatactatttttcactcaaattttggcgagttatattgtatttattttattaactatgaaaaatcgaaatgctacttttcgattttgttcctacacctcaaaatttaaaagaatatttaaaattccataaaaacctttaattaaaaagtattaattgataaaatttggtacttttcggttttgctcttaatccaaaaatttttaaaagcccacaaaagtgcgcgcgcaaaagt

SEQ ID NO: 10796 - DNA, 2448 bp, Heterodera glycines
  misc_feature (23)..(23): n is a, c, g, or t
  misc_feature (31)..(32): n is a, c, g, or t
gtagaaattaggctgcatcaatntatttgtnnttttgaattaggataaaaaattgagtgtcatttcagttcaaaaataagacaaatagaaaaatgaactttttatgcgtaccttttgttgatttttttaaattttgaggtgtatgaataaaaccgaaaagtacaccgcattgccaaaaacggtgtaaaatgaaaacgggagatcagaaatttagctttattatcaaggaaagatcgaaaatgccataaatgatgtaaataaaaattgcggcttaaaaccaattacatttgcagcaaaagtaatgcggaaaattgtgcacccaattattttacccatttctgaaaaaaaagaattaaattcctgtgaattaaaatgaacttttatttatgtatgtattactgccattgattttgttttccggatatccttaatctttgctaatatgcccaaatatattttaaaaattttctcacaaacttttgggggaaaaatgttaaacttatgacacgaaaaatacaaatcttcgttttgcttacacatctgcaaattttaatgatcatcagtaagaattactgcaattttaacgaatttattcgaaattgatgctgaaattttagaaaaatgatatttgcttaactgtcgcaattttaacgcattggaaattctcatataaaaggcgagtaaaagaaatggatgcatcattcaataattcactaggaatttaatttttttcagaaatggggaaaataattgtgtgcacaattttctgcggtgtcttggctgcaactgtaattggtctcaagccgcgcggaccgccctatcataagggacaagaacgttttggcccaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccaccgccggaaagcagctctgacgcttcggcccgtaagaagcgcagtccgttcggcttccgtccccatggcctaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccatcgccggaaagcagctctgacgcttcggcccgtaaaaagcgcattccgttcggcttccgtccccatggcctaccaccaaatggccaacatagcccaggaaagttcggacccccaccgcccaacagctccgaccttccaccgccggaaagcagctctgacgcttcggcccgtaagaagcgcagtccgttcggcttccgtccccatggcctaccaccaaatggccaacatggccttggaaagttcggtcccgcgccctgcaacagttctgaccttccgccgctctcatcgacggacagtgaatgagcaatgaatgtttggatgatcaaatgcacattatcattggaaaaaaaatgcttgaattatggcatagtttatatgagaatacattatgaagtgttgattatttgacgcattttgtggaaaagttcccgagagtcctctttttcagatttttctaatttgcgtgttggaaatgatttttaaaagaagaattaccaattttctcagcaaatctataaaactgcttattttaaataattataattcagtgaaaagctttcccgttcattatgccaatataattacccaattaattagcattacgcatggattgactttttatataattcataattgggactcggaaaattctttaaattggcataggaaattttttaccaaataaagacaaatttttttttttttgtaaataaattcaaagaaattgaatttttcctataaaggcgaaaaactaaaaattttatgatgagataaattttttagaaaatttttaattttccaaaaaatggatgaaaatacaccttttactaccatttaatacagtatgccactgttgaaaataaaaggtaacccgctggggttcgaacctacggcccttccaaaccgtgcgggttttacgagtcataatgctagtaaactcttaaaacaaaagctgcaaatagatttagcagtagatgactggggcggcacagcatttttgtgcttgctaattaaattcaattttcattaatgtaaattaccctaattaaacccattaaaggcacaattcttttcttcagtatcattcatcatatcctttttacaagattcaatttaagat

SEQ ID NO: 10797 - DNA, 927 bp, Heterodera glycines
  misc_feature (24)..(24): n is a, c, g, or t
gcgggatcccgtccccgcaaaganatttgagttctaatcccgcagcgggatccgcaaattatattttttgtgcgggattatgcgggattttattgattttttgaaaattttccaaaaaaatcattgacctatcaaaaagccacaaaatgaggataaatcctcagatctggcaaccctgtattaaattcatcctctttttccttttcatcattatccatatttttttttgttttgtttttcttcccgcagcgtagattttcgttcaacacaatattgagcattaataatatcaggaaaatcttcaatttcatcaaggtttacaacgcaatcattagaatattttgttttgcaccgctttttttcccggagtttgaaccggttcaacagcttttatcaggagcgtacaacccgtttgaccgcttttatcgggagcttgcaacccgtcattttctcggaaagaggaagtagaacacggcgcatcggaagggaaagtttgcttagtacgtacatttggtatttattaagtaaagtatctagaaaaaaaggaaaaaatacattaaaaagaaatatttgaaaaaacgaagttatgaaaatacatttcattaatataatttaaaaatagtaaaacaatatttattattatattaacgaaaaatacattaataataataaatcataacctaaattttggtctttgtttagtaaaaaaaaagttaactattttaaaaaaataacgaacgtataattaaagaaaaaaatctataagcataaacaatttcataatcttattgtctgcatttagttttatttgtgcaacaaaacaacaatccaattattttctgttatttcattttttttaatttaaagctttcgttacaaaaaataatctattcaaaatgtgacatacagacagacagaccaaattag

SEQ ID NO: 10798 - DNA, 2363 bp, Heterodera glycines
  misc_feature (2207)..(2207): n is a, c, g, or t
  misc_feature (2351)..(2351): n is a, c, g, or t
gttgatttcgacagtaaaccttatttttaaaaaatttgttctaatggcataagtctcgttaaattttgacaattaaaatgataagaacatggctcttatacattgcagatgggtcgtgattttcgaattcttgcttaagagtagggttgctccccgacccctcggggggcaatttttttttaattttaaaaaaattgtcgggggccggggaccgcggggggcgacatgtcgggggtcggggcggggaggagctcaattgtcggggaccccgatcggggaatggccaaatttttttaacccaaaaaaaccattttttttctttttatctgctcgtaaatcttttttttactttaatcatctgatttcgttagcgccagtaagagtgagtccaagttggcctttaaacctggggtttccatttgttcttatttataagaatattctgattttttggggggtgggtagcgactaaaattattcggatttcttaaatatacttatagttttgaaattttatggcataatatcaaaacttttcaagaaattttaaggtctgccgcaaaatttttttgatcttttgatcccgaatttactgaaatttataattttgcattttcctccccaaaattatcaaattgataataggatactaaaaatataaaatttgatcgaataaattggaaaaataacggattggaaaaatgttgctaaatgttcatatttttgacactaaaatcttattttggaattggtgtttatattttgaaaatttttcgatggaagccctggtttaaaaatacgtagaaaggagtggggttaaacagaaatttttgcgaacccgtctcaacatcgaatttgaccaccattttttgcggcgctctttttcagaaaaacttttgggtaacaaaggggtgatgagggcggtggtgttaggagccgcgaggaaattttttttttttaatttgaaatttgttaacagatttttcctaaaaataccaatttttgcaattttgggacattttttgcaaaaaaaaaattgaattttggggggccggcggtgccgataggcggcgccgaaaagtttttcggaatttttaataattaatattaagaaaattgttcaaaatttcataaattttcaacctttcccctcttcgttgttgaattaactttttaaattttacaatgctcggggtccccgattccccgaattagtgtcggggagtcgggggccaggacctcggggagcgacatgtcgggggtcggggcggggaataggcccaaaaaatgtcggggatcggggtcggggaccggggagctcggggacggggagcaaccctactctcatccacataactggattggataaatttaaaatgagttacttgatatatagaaagtatttaattattaatgctaatttgacccagccattttgaactcaccttttctcgaagaatcgcttcttgagtaactgtggggagggaaaaaaggaaaatgccaaacattgatgattggattgaagttaggcacaagccaaaaaataaaggttatttggtttataagataaaaaaagactttcgaaaatatgttagtctcagctttggagcaaattctttggaatatccctgtgaaatttttgctatcgaatagtgctgttcgagaccgaaaattcccgagactcaatagcgagaccgttttgactccaaaagaaataaaaacattcggctaaatacaaatcgtaaagaaacgaaattgattttattgaataatttcctatgtttagaccatgaaatttagccttgatagcctttatttttgaccaaaaaatgtcatttcaagatttttctaaacacacataataattaatttaaattatttaacccaaagagacaccgtactgattaggcccaggtctctttcttttaaatttgcactgtcgcgaagcgcactcgctcagttgggcctcacggttgggccggcacggtttacgtcattttcttgaccaacttttttgtattttttaattttaaatcgatattatttgttaaaatttgtgataattaaaataaagttttttttttttggaaatttggaaaatttttttgacttattggggcccaaacgtgccggggcttcttcatttggtagttcccgaaactattgagacgctgccttttgtttgttctggaattttattataattnttttagtatttttctcaaaaatactaatcctttttgtgccgctttttctctattttttaatcatcattttgataatttaccaagcgtcagtttaaataacaataaatcacaagaatcaattccacttcgtcctcacaaatattntaaactcgttga

SEQ ID NO: 10799 - DNA, 1585 bp, Heterodera glycines
gaaaattattagatacaattttgttatcatttcattttgaaaaagggaatttaggaaaaaatttataagctaacataataatttttttgctaatttcaggcagagcgaccagttgttgttacgttgtgctcgacgtggcgtggccttgtttttttttaattttttttttttgccttatgagttgaaaccgacggtactttcctttttgtcacaccccctgctgaaatattttttaaaacaatttccctatggtaattttcagcgctatacacgaagataactggtccaaatgttcacgtaactcacgccgacgttttggcgccaaaactataataaaaaaaagaaaacacccaaatttaaaaattttgtaaaacaacaaaaaaaacgtatttttcgcgaaggtaatactgccgatggttggttgcccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgatttggcgccatgtagggaggaggtagaaatgatgaaatcgttataatttttctgacgaagtctatcaaagagccggattaattcttcatttactctttttcgctttggcttatgttatcttaattttgtatttaggtaatgaatcgtcaaattgatacgaaaaaacaaaagcctaaaataacgcatgaaggccagcttcggccggtgggctgatcgaatgaaagaatgtttcggagacggcacattctcattggcacctccaatgttctaccaaataaattgtttccatttcttcattttgttaattattatatttaacgaaaaatttcattttttataatttttacaatttcttcctgccttttttttcatttttggcttggcgccaaaacgtcggcgccaaaacgaccctggcgccaaaacgtcggcgccaaaacgtcggcgccaaatcgtcggcgtcaaaacgtcggcgccaaaacgacctgatcccgttttaggagcttgttttcgtgaacttgttgttttggcgctatgccagaaactttaaaaaacgcaaataatacataactctaacgcaaaaaagttttatgaaaaagtaaggcaaccaaataaagacagaaagccaaaaaggtttgatcaaaaaccaatgatctttgtcatagcatatggatatagatgtgcattatcatcatttttagcctgctgctttcactgggttgttggacttcggcgatgcttctcgctcgggggctgcccctcacctgacacggaaattgcccctcttccaatgcattcttcgtaaatatttttaactcgttgactggcctcaagcttgtttccattgcatgacaatgttaggtttttgagctgaatattttcaaaatgcttgatcgtcttcttgatcttcgttttcaatgatgagactttttccgttgcctccaccgca

SEQ ID NO: 10800 - DNA, 1249 bp, Heterodera glycines
gacgaacacaaacagccccagtgctggccaacgaacgtcgcggcagcaaccaaagacaaaggctgtactcattggccgaatattacaacaaggtttggtgttaaaagacggaatttttttgtaaaatttaaaccccaaatttccaaataaatgcctgtttttttaaattcgtaatttttaaatttggatttgcacaattccaaattgtttaagatcatgcaagtgtttcgggagcacaagcaccgccactatgtggtgaaggcgggcgaaaaagcggtgcatttggcacgtgccgaaggcggaggcggcacattgggccaggaagtgctggagcttctaatagtgcgttttaaaaaacaatttccatattattataaatactctatatggtaaatgccatcatctaaccctcatttttcattaaaaactaatttttgaaaaaaaaacctgaaattttcctgtaatttttatagtttcccccaaaataaattgacaccatttttcaacagtccgaaatttacaccacaatgttcacgcaacatttgatgtccgccaactacccacaagcggtgctcaccgtactgaccaacccgaacacacagcgccaaatggtgtgcctgcgccagttgatcacccatttgttggaccaacgccaacgccgtgtgctcgtctcgttgccctttgatcggctgtcgtccgaagtgatgagccttttggaggcacgctgcaaggcatgtcgggacggacacaaaagcattgaacgaaacagcaactcttggccgaatgccggtcccgaaagtccattataggagaaaattatccatcatcggccaaattttttgagcggcatggcgaaaaacaggaatttgtaacggttttgcgccaaaaaatgacccattttcccattttggggtcaaattttcaaaaatatggtccaatggggtccggccgggaaaattttttggaaaattatactgacaatgaagatatgataagaaaattgtctattggccttggtcgagtgacttttactgatcccgctggacatttattgatccctccaaattgcaggccgaactgatcaatggtgccccaaatggtaccaatccgatgtacgaaatcacttatgcatttctcatttcgcgctgtgaatttacaagaggtgaaatttgtttttaataaaaatatttcaaaatttattatttcctccccctaacaaatgtttatatcagctgccaaactgatgtac

SEQ ID NO: 10801 - DNA, 3992 bp, Heterodera glycines
  misc_feature (2577)..(2577): n is a, c, g, or t
tctagagtcaaataaaatattttcaaaattatttatttcctccccccattaatgtttatatcagctgccaaactgatgtacgaattggcgatgcgtttgcgccgtgaaattcagtcgcgcgccatgctgcaacggcggagtgccgcgctgtcggtcgcctaccaaacaatgcaaattgacatggacgagccgaacatctgttacgagccgacggaatacgaagtaatatttttatacacggcacaatgcattgcaataatgccaaatttcaaatgtatcgccaaaatgccatgcattttatgggccctttgttataaaaacttattttaaattattttggaattttaattacaggacgaccaactgctgttggctgcggatggtattgaacgttttgctggcgatggagccggtgaagacggagcagacagaatggcagtcacagattttgagatggtcgacatgcaagcggaggaacaacaaagtattgttgttgttaaatattggccattaaaatatttacggaggataaatgcaattttctaattgatttcgtttccaaaattcctaacatttcgactcgacttggcctttacatccggaaaatatgttgttgaacagtaccattttccattgttcagttgctgctgctgctgctgctgctgctgctgcacgaccacttcgaacccgtgtcgtgatcaccaaagaggacgtggcacagcaactgctccaagcggaggcgcgcttggcactgctggacgcggacgcgcacatggtgccaccgctggtggacgaggacattttgcgcgagtcgctcaaccacaaacgcttcgacatggcctggctgttgatcaagttggacttgagaatcacgaataattttgacaattttaaatcggtcaaaaaaacgattttttcctcgtcaggcaattcgagttgaaaccgtacgagctgttggaacgcgtcacggagcaggcaatccgcacggatttcgacgctgaagacgacgatggtggcggtgagggtggcgactcctcgtcttcgtcattcgttggtgtaatggtctctgacgaggggtgcaaagatgtcgagacggccgacacgagttttggtgccagacagaagaagaagcgggtggtggacgacgagttggaggagttggactgggtgatgtacaaccggcagtatttgggcgacggagggtctgtttttggatccttattttgcaattcatataaggaacacgatccacttaagttctatgatagttgcgcccttgcgacggattgaaaaatttgtttaaaattattaaaatttaactggaattcatttgttcaataaacacaatcacaaaatgaaacaagttttggttaggaccagtacaggaaatttcagcaaacctaaaaatttattgagcaaatgtaaaacttgttttaaaattttattgcaaaaaacccaaatttaaaggaaataaaaccaaagattgaaaaattgttgccatttttggggtttaattattgggaaattaatattttttgtttttctacccatttccattcattttcttcagcagtcattccgcccattggcgtctcgtcatttcctacttggacatggccatggaactgttcccacatgacactgccattttgcgcacggtggccaacacttttctcaagtactcgctgaagttgcccacctggttggagagtcgttacaaggtgttgctttttagtgtaaaacaacaatcatgattttttttattcaaatttagcgcgttcactttgcggatttgttgcgtctgttgatcgattatgacgacctcagtgacgcatttcgccttctccattcacacattgactcggcacggcagcgactccgggaatttgtggcgcgatggattcgcaccaaccctaaggcactttttcaaataaattttcataattattcaaaatcgctatattatctcaaggcaacattcatccccgacgaggaattggccccccttttgccgtacacacacatcaacgaactgttgcggttggcggagaagcgcactgacagacagcaattggtgggtgatttaaagtgctgctcaagagttgggtctcgaatctcgggggtcaagtcttgagtcttgtgaaattttcggtctcgagcagcactagtgatttaattaagtacttaccaatgatcgacgcataaattttggcaattcaattttcagcccatcaaagagacggtggacaagttgaggcagttcgccgacttccaaaaatcggtcacaaagaatccgatgccatttttggccaaatgatttgctctcgcacagggcacggcaacaaaaacacacattttcttggcacctttttaaatattttgttgtttgtcctacactttgtgctgtcctcctttttgatctgctgatgacacacaaatgacttgttgaaattgaaatgcgattgactgccttttttaattgtaatttttgttaacaattttttattcgcataaattagtgcaatttgtttaattagtcaatcaaaatgtttttggaaaaagtgatcccgccccccntaaaatgttttgttgtcagttgagtgagcgaataatgatcacagccggcaaacggatcaacttggaggatttgtgtgatccggtgggtagctttttcaacaattaatgaatctgctgcttcctttttctcaaatttcaattagcggtcggttttcggcacattggttcgagacttaatccggcatttcgataacaaaatcgtttcctaaaaacttgagagttgggcacgggcccggtttctgttccgcagaaattctggacgcattttttgttttgcctgattagtcaggatagataaaccgagttcaaaatgccaattctgatttcggcactccattctttgtgattcattcgtccgcttttctcagctgttgccgcccaaacaaaagttggtgcccgacgaattcttcggcgtttattgccttgtcagcaaaagtgtggagaagtgctataaggcaaattcaaaatccagacaaattatttgcctattttatttaattaaaaaacagaaccgctgttacatcggcttcacggtggacccgaacagacgcattcggcagcacaacgcgggcagacaagcgggcggcgcgaagaagacggacaaccggggaccatggtgccgtgccgggaatgggataataaaatgccaaagtagtgtgtgtaatgttcgggaccgaccctcgtgaatttgttctaatgggcttgacatttcgatatccaacggtggataaacaaataatgatgattggtgatcataacgtacattccttgagttaagcccaagaacatctgctgatcaggggagttgaagcgataggcaaaggctgttgattgggactgatcagaaaaccaccagggcaaacactgatcaacaggctttgtaacaaaaatgatgtcatgctgctcttctctgtccagggatatggtctgcatcgtgcatggctttccgaacgcaatttcggcacttcgcttcgagtgggcgtggcaaaatccaaaacgctccaggcgtttaaaggtgtgcttatgcgttttggatgccaaattatatctataatttcagatcactatcttttggatgaatttttagatcgaattgatcaatataaattttactagtcattagcgatcattagtgctcgtccctctgaattttgctggcaattttgcttccatttcagcgctttgtcgacactgaattggccaagcagcggcgcgagtctccgttcgcctacacctaccgtatcgcgtgccgtatgctgaacacggtgccctggtgcgaaatggcactcactttccgttggcttatcaaagtgggcgtgcccgttttgccattcattgttctctttcatggtgccgccgcttccttcccacttttgaggagtatgagctgccctttccgcccgagtcgcctctcc

SEQ ID NO: 10802 - DNA, 4618 bp, Heterodera glycines
ccgtgaatgttatttttattgaattctgaaccgggttgagtagattagactacaaaaaatagacgagttcacttcgacctggggcgactgagagggggcgatattaactagcagcaagcagcacatagaccatttttggcacaatttgcaccaagttgtcccaatttttaaaatttcattcttataaatgattattcgtctttaaactcgaaatttataaataacacaattttataatggtttttgcggcccaaggcaaaattggacatttagcatttgtttcattaattacgttcataaactcctttcataattttatttttttttttaattttaacgaaataaaaagtcaaacaaaaatataaattctaatttaaaaaattaatgacctttaaacagaaacatcttttccatttatcaggtttcaatgttaatgaataaacaaaaataacgaagaataataatttttacgatcataaataaattcaaatgaaaataaatttcattttttcttcaattttctttttttcttcgtaatcttccatgccctcctcaaattattgaattaattaattcaaaaatgtatataaaacttatataattttttttcatgaattccctaaaattgtaaaataactaataaattgcccagcaaaatcatttaaaaattagaaattttactcaactcaccaacaaaattaacttccgctcgccatttttggacatcatctaaatcaattcacaaaaaatccgctattagcatcagagttaaagggatacttttgcctgagtcggtcgaaatcattcatcaatttctgccattcatctgtccgtactaaacgagtaggcaattgttgaaaattaagttttattttttctagaatttactagtttttatgacaaaaagttggtggattgaaacagacgaaaagaaattaaacaaattacggtccaattatcgtatttcctctaatatagtgcgtccctgaattagaaataaagccacccttttgaggggggttgataaataaagccggccctgaattatctgccaacccttacgcatttatatattttttttaaattgtcgaattggaaatacttttcgtttgggcaccatcgcctaaaatgttattcaccagattttggacaggataatttctttggggaatcttttatactaccctaattaattttactattgggtttgttcttccttgattcacaaattgtcattattttgatattttgggttacatcctctaatatattattctccaactgttttggggtactttgggtattcttttaaactccttatatttcattgtccaacagaaatgaaagtataaaattgaaaaaactaaattatatcgaaaaaattcagcatgccaaattatatccaactgaccaaatgaaaaattaaattctttcatttatcctctcgcctcaaaaaaagagttgatttgtttaactgctttaatgcctgcctatttggccttattttcaatgcaatgtgcattgccgtgccaaagttgccgtggagacaattatacttcacacaaaccaccaagtaatttcataatttcctcaaaaattaataattgttcgtaatcattttccaataccaattaggtaacgtgtgagttttattatttttttctttaacacaccattgtgcttattgttcatttgtgaatatgatattataaattcaacgttttttaaattgtatacataaaattataacaatcattacaatatttatctactgtttcattttttgtttttattttttaatttatattcaaatttgtacacaaaaacatccgccggatggaaatgaagtttattgaaaactatgtgagaatgtttttctttcatcattatttttgctttgagaatttttgcatatcgaaattgaattgataaaagccggtcaattatgcattaaaattaatgaaaatttcaatttaatatgagaagattcattcatgtctataaggtttattttactttttcttactaccaattcattttgaatttttattatatttcattattttaataacaaatgaattcaaaaataattttaataattcacagaaatttcacgtcaatgccattattaatacattttgacaaaaagaaatgaagaattgcaaacttcccgtttcccttttgtttaacttttaagcctcacttacatattagagaataaatgaagcgctgacgttctttcgataatacattcattattttcgaaaacaaagctcaacgatggaaaaacgagcttacatctaatattttaatcaatttttatttaaaaaaagtttcaaatatactctttaaattaaatagacaaatttattgaccataaaaggttaatttaggaattagaaacttcaattttaaaatgatattaatttaatttttaataataaaaattcataatatttagaaattgttttataatttttgaagatgggcatttgtcaaagcattgaagaaaaagctatggaccttaaaacgaagcaaatagaccgagaacttattcaagagcatcttgacgcacaaaagattgtcaaactattattgcttggtaaaattttaaaccaataaatttaataattcaatttaatttcaattattactaaatttttaaatattattttttttgattagtcttaattttaggtgctggcgagtgcggtaaaagcacaatattgaagcaaatgcggttattttttaaataattgctttattgaagataaattaagtgaaaaaaaaaattaaaacatgcattcatatgctaaagtattttaattatttgtttaataaaattcatttctttgacaatcagcattctacatgatcatggcttcacggatgaagaacgggaaaaacaaaaatcagcagtgtacaacaatacaggtcagaaaaaacaaaactaaaaatttgcatgatttctttttaccgtagtttgattgtcgttattatttagttttggctatggccactttactccatggaatgcaaaggctgaacatcccatttcacaatccacgaattgaagtaagatataaatgatcatcaataattgtgatccggcattgcagcgtggccactgctaatcttttaatccattttttccataaaatttttgttttaatcagaatgaagcaatgatcataatggaggtggtaaatcatgggaaagaatcagagccattaagcgatgaattagcacatgccattaaaacattatgggcaggtaaaggaaataaaattgtaaaaaaatggatattttgtaacgatgaaatttaaaaaatggaatatttagataggaacattagagaaaaggtttatcctcgagggcaggaatttcagtaagtgttaaactaaattgtatttgatataataaaaattattagttaaaatccttaattaaacaaacattaattataaaactttttgatttgtatgcacaatttccttcatttaggcttgtggaaaacagtattttgtaagaattttatttaaaatataataatagttaaacatttattatattatatagttttttggaatcggttgatcggatcgcaaaaccggattatcgtccaactgagcaggacatactgttatcaaggatcaaaacgacgggtatcattgaggtgatggtacatatttattatttttaaataaatctaaattgccattttattaattatcggatgttacgattcagtttagcttacatttatttaccacatactagtataccgtattttctctaattatatgcccgtctcattaatatgcccgtcaccaattatctccccctttctgatgaggttgaaaaataatctctccgtcttaatcccccgtctccgattatctcactttataattaataaaaaattaattcaattttaaggttaaattcaaaatgaaaacggttgatttccgcgtatttgacgtcggtggacaacgttctgaacggaagaaatggattcattgttttgaagttggtgttttcttttagtttcataagatcaattttccaacctaaactggtgccagttttattaccaaaacaacaccaattcgaaaatttaatctcgaactaattctgaagaaattaaaaatctgttaataatttatttatatttaagtaaaaaaatctttaaatagtattaggaattctttaaaaaaaaagtttgttaaagctaatctttcttgattaaggatgtcaacgcaatcattttcatcacagccatcagcgaatttgatcaagtgctttttgaggatgaaacaacggtaattgatgaattttataaaattaaatattattttatatattcagaacagaatggtcgagagtatgaggttagcattaatgttacatttattgtgttaagaatattttttattaaattaagaaatggacaattttcgttgtattattttttaattaattgcagattgtttgagtcaatttgcaactcaagatggttcacaaacacgtcaatgatcctttttttgaacaaaatggatttgttcattgaaaaaatcaaaggaatttccataagtgtttgcttcaaggattataaggg

SEQ ID NO: 10803 - DNA, 1414 bp, Heterodera glycines
cgatggtacggtgggccgatggcgaagacgggcgggctttgatgttcagtgccgggatggggccgagtggaagaacaacagacggcacatttccaccaaagatcccgttgataagatgccaatgcctgtgggattagtcaaacgaggaagagggaaaaagtgggccaagcccgagattagtaaattttggcaacaactatgtttatacgagaatttcccctcagcccccaaaaaaagagattagctattaattctacaataaacccaaaacaaaattgtcgcagacaaaactaatacaaaacttcatttcattttggcaaaaaaacatttcgggatcggggtcgggcagcaggtcaaaaaggttggggattggagaaggcaagatcggggtcgtggagcaaccctaattaaaaatctaatttatatatttcaacatatttaggttcaattaatccttgattctgttattgatttgattatccaaacaaatttgcaaagttgcggactttattgaagaaagtttatcaatatttcttgtttcaatacccatcatattatttttttatttaacaactttttttatcatgcttagttactacttgtatatatttactaattatttgttgaaatttatcagtttttatcaatcttcatttggctttggttttttgttaatttttgctttatgaatacaattgtttatttttatttgaattgaatcatttttaattattatttttttctaaaaccattattgtccttcactgaagtttttgttgttggttaacctgttaaattgcttcaatatttagcgtgattcaacaggttttcattgtaaaataaaatatcaaaaactttaagaccgattcagtcgccaaccttcatttatttattaattgacataaaataataaaccataattgagacgggagagagtgaatcaatttcaagagtctttactcagtaccattattttgttttgcctctaattttgttatttctatttaaaaatccaattttttgtccctctattttaatttatatgtagcagaaatttttggtataatttattaccaggtctatttttcattcaagatttgacattattattttttatttattcaagttattttaacatgcgattcaatcgctaaatttttggctccatttaaaaaatatgaaattttactttttgacgcaatttaaaagtttcgcatgtgcagaaacttaaaaataaaataagtttttttgaagtttttcatattttatttttatacggtatcggagtttacctttaatttaagaatgttttcatttttcacaaatactcactccaatacattatatatattcttttcttaacatccatttgaattttcttaattgttttcttttaaattcacggtttaaacac

SEQ ID NO: 10804 - DNA, 4388 bp, Heterodera glycines
  misc_feature (54)..(54): n is a, c, g, or t
  misc_feature (64)..(64): n is a, c, g, or t
  misc_feature (68)..(68): n is a, c, g, or t
  misc_feature (71)..(72): n is a, c, g, or t
  misc_feature (4266)..(4266): n is a, c, g, or t
  misc_feature (4290)..(4290): n is a, c, g, or t
  misc_feature (4297)..(4297): n is a, c, g, or t
  misc_feature (4299)..(4299): n is a, c, g, or t
tcgagaaaaaggaatttcaactgttgtccgaattcttcccttctagtggctatnccaattccgnaagnatnnatttcatcccttgattaagtcaaacaaaattgtcattttaaaggtgatcaacccattgatttacacaatggtatgttttttaatttgatttaattaaaagttttaaaatggccaaaccgcagcaggagggaaatgggcaattttttgtgagctattagaaaaatctaaaaaattgtgaaaatcattttgtaagcattaaatactccataatatagttaatataactagggaagcaacttttaatgatttaactattttttgctcaattgttttgaagaaaggagctcaaaaaacgcgtttttacgttgaaatttccatttaaccgtcaataatcttctgtggaaatcactattggcatttttttacaatttgtacattttttgaaaattttattaacaaaatgcaataaaaagaaaaatattcccctacaaatcgacccaaaaaaatttcagaaacataaacgcctatgaaatgaaaaactttctcgaaatttcatctttaaaatttattttttttacttgccaagaatttttgattttttattctccaaaaaattagcgcacgaaaaattggaagtttaaattttgctcaatttttggcggaaaattatgtcaattattcgtcactttcggactttttttcaccatttcatctctattttggcatttttcactatttttgttaattatttcgatattttccagaactaaaagttgctaccctaatgataacaatgatgaagtgcataaaattcgatttaaattacatttaattttctaaattcttaactaatccaacaaaatgaaaccttattttaataattgtacgaaatttaaatgtattttttcgtcgggttaccatagcaccgtatttttgtcaattatttctgctttttcagtacaattcggattttcggcgctgttcccgcgatttgttgggcatgggctgcatgaaccaacaccgacgcacaatgagcgtcaaaaaactgcaccaacagtcaaacctcttttgacaacaattgaattcatcatttttataaatattttttaactgctctcggtgctttcattataattttgtcaaaattaaattttcatttaaacccaatctttttttatttccaaacccctaataaaaagagtatgaatttcatctttaatccgagactggatcgtgatcaaaaaaaaacccgagacatttctcgaaaaacctaataatgaagaccgaaaaattttgtttttttttaaattaaaatttttgaaaatttcttaccttttcttagaaaatgtataggttggtccctattccgaaacaaaatttacccgaaaaaaatccaaaattcttgactgaaattttctacatgccttccttctatgcaaaatggactgaattttacctttggatcattttaaacccatttaaataataataatatttatagaattaaaaatatttctcttatgttttatgccacaatagataggataagcataattgtcaatttttgattatttattaaattcataatttttttttgggttttgtttgtatgaaacttcgttctccttccttctttctttcttttttctcctctctttgcttcttcccccattcaatcagaacaaaatgcaaaatgcagctaaaggatggaattagataaatgaaattaattttttatggtttcttttttaccggccaaaatggcaatcaccaatgggaccaaaacggcgcctccactgccaagcgatgggtgcgtgccgagcgcaccgttgcacaaattcccggtgcaacaatcgaatttgcatctggggtcacgtctggccacttcaaaatgaggatcacctcttcctgcgcacatatccatattagcacagcccttgacatggccgctatcttgaaataaagataaatttttaaaaaacttttcattaggcgaagcgtcattttgaaggctttactgctaattttaatttcatttttcaatgcaaagatttggaacaaaaaaggctaaacttaaatacacatttgtcactaacaaataagagcccaacattctttggttaccaactgctgaagcgcagctcatctttaagcagaaattgagcattgggggacagaccatttgcccttttgcgttgaactcgtcattcttggaatcagtcataatggccaaataacattgaagcgctggtaatttaatattttaatatatttaaattcaatggttttctcaaaaaaaaagtatgtttaaagtcatcttaccgaatgcagtgggcaccaaaagagccaaagtaagcagaaaaaaagcggcggattgaacaaacatcgttttttgttttgtttgttaaaaattgacggaagcagatttattctggattattatcaaatgcataattattttatgatttgcagttttgcatataaaaaaacaaaaacaaagcagtaaatgaaatgaaatgaaatgaaatggaatgaaatgattttgcttttgcactgtacataaagtgaacggaattttagcctaacattgtgaaaattattcatccattttatgttaattgatcagggaaaaaataaatgaaaaattgtgaagctatctgacaaaataaaaatgattcatcgctttgtgaaagcagcggcgatatttaaaaacaattaatgacatttaaaaagaatttgtataaattgtttgattaaataaaaaaaggttcaagagtctaccgccaatcagtcaaccgcctgcggatcacgcgcggacttcttccgaagcaagaagtattgcaccaaacactggccgccgtacatagtcaagtgtgcgctgctttttagtacaataagcaaattataatttttattttcactatgttttcaaatttcttcgggttttgaactgattcaaaaaggtctcagatgggccgtttcgtccttattctctgatttttagccttaattcatgaagataagatccctcgaatgatcggaacgggccaactccgtctgagccaactttgagtcaatataactcttgaagttattgaccaaatcaaacaatcttgatatcattcgaaagctcttcacaggctctattagcctactaaaaattacagaaaatttcgaactataaaaaaaggtagaaataaaaaactttgaaaattctgccttttttgcggttttcaactgacaacttttttgagagctgattaatcactgagaaataccttataaatatcttctaaacatctagggctttcgaatgataccatgattgtgaagtttggccaacaaagaaaaaagttatagctttttgaacattgctgagacggagttggccagacggagttgacccctaccgtcgaatgataccaaatttgtccgggttgggcacttataaaaaggagtaccctttttctctgtttctcaaatcttgaactggttcaaatatctgtttaaatttttttttcaaagtgttagaaaaagcccagaacacaacaatcatagttttattgaaaaagggtttaattagaatagagtttaaaaatttattactttgatcagtgcagtaatattctccttaattctataacaaatccttttttttaatttgatagataaatatttaaataaattcatttaaaaaaaataatatttttaaacatcgacggtgttttccacaaaacgaatgaatcatcatttttattttgttaatagctttacaatttttaatttgcttttcccaactgattgacaattagcacaaaatggatgaaacttttcaattttatgcaaaaggccgttgattttatttactgtgaaaaggcaaaacgaaaaatacctgttaatttatttaatgagtttttgggtcttttaattaattgacaagagattaaatgaaaaaaaacaaattaattttttatttaaaaaacaaaatattccaaccattcttaaacaataatgtctgcttcatcgacattttttctgcttttttccttttggtgccaactctaaacggttaattcattaataactagtgttgctctcggggtttttttttgggtcttggtctcgaatctcgggaaaattttcgttcttagcagcagcactgtttctgcaaaaataaatgaatttgagaaagaattgttgtatattatcaatttagtttttattttgtacatttcagcgcttagatgctatgancgcactgaataagatggccgcggngtataananaagtgtactgccccccccccccctcaacaccatgtgcatgaatatgcgtgtgtgtgacaggtaaattcaagctttttttgaacacagaa

SEQ ID NO: 10805 - DNA, 1627 bp, Heterodera glycines
taattttcattttattaacaaatgccctgggtatgttttaatcacacatttaaaatattaaagtacaaaaatttactttccaatacattcgcataaaagtaaaatcacaatttgtatgccttttttcgcctggcaatgtttcttctcccattttagttcaatgcaaaatggcaattcctgtacaaaataagaatattaaagctattattatttatttatttttaaattccatccgttaccagtcaaaatgccaatcagtgcggccaaaatcatgctgtttccagtgccaaaagtgtgcacggttcgcatcacgccgttgcacaaatccccctggcaacagtaattagtgcaactgtctgtttcattactcccttgtctacagtctttatcggacatgcaggtcttgtgggtactgtagaggataccgttcttaccttggaaaatgaagcaaatctttacgaaaattttttcaattaaaaagaccattgctagagactgtgcctgtatggattaaaaacatgcatgaatcgccaatcgtatttgcctaactcggggcattattttcacaatgttctgcagcaaaattaggcataatttgcgaaattttaagaaatttacaaatatttacatttcttttttaatatctccttttttccagcctgaaagccacccatttgatggtcgtcaacttttataaacaggcagattttcgaaaatttaatgcagaaatttttttttgaattttgcgaaatgtccgtccctatggcataatatttctgtaccatatttaaatttattcatttaaactcacaaattagcacagtgtttaatgatccttctcatataaaaacgatctctgacctttgtatttgcagtcaatttttgcgcaattgttcaactgatcggggcattttccctgctctgcttcactctttatcggaatgttgctcgtttttgcggtaacattgtgaacaccgtgccaacattcaagtgctgaaaatgagcaaatgttatgaaaccggaaatttacgacccgatttaaaatttgtagctttgaattttaatagatttcatggagcaagattttgttccaattattagtaccaacaatttgcattcttagatatttatataggttaaaatctttgtatgacacattttcgcttaatttgcatttatttatttctattttttgacttttttgtcgattctttgtatcggaataaaaaaaaagattttgtcaattttaggcgccggcgaaaataattaatgaatttatttttatgtaatattttttaacttaccatttgccattgacacaataaatgccaaagaaaccatcggaaaaagggatgaaggcgccatttgaattggaaaagtgaaattgtttatttcttatttttaatctaatacaaaaagtataaaagggcctttagtaaaaatgaataattttcgtggttattcaatgtaaaatggaaaatgtttagtttcatataaaaccaatgattcatcatttgaaataataaataataaaccaaaaatttggaaataaataaataaataaaactgttataaaattaatggatgaattgactttagcaaaagcaattagattgaattttaagaa

SEQ ID NO: 10806 - DNA, 1074 bp, Heterodera glycines
taatttttaaaaaatgatatgcttttcggatttaacgatcgagcaagcaccaagcatcccggtctgtctttaaataatcagaattcatgtttttctttccgtaaaaattaagcactgaattaataaattcctatttttataaattgaacaattaaataatatttaatttttacatataattttaattcacctgaaaataaaatttgattgtatttgggcgaaaatgtttcaaccaatcggtccaatgccaagaataaattagcactcgactcggccgcaaaaagcgctaaaataacatttaaatttcataaaaaaactattttttagattatcaaaaaatattaaacgaagctaagctctccatttatttggtcataaaaatttactgacttttctatttacttttataaaaaaattattgctttttttctcaccggccccacatgaaccaataaaataattaagagacgcatttgagcagaacacaacgccaaacacgctgtacagtgaggagacaaggccatgaattggcaacatcagcacatcagtgatgccgatgaagaacagaaacttgtagcagggttgggcacggtgtttccaaattgctatcaaacatggaatgtagagaatctgtttgaaattaaattaaattaaatcttacactttttaatgaaaataaattataactatttttaatcaatttttgtgctgaattcaattcttattttggaaccccttttgagcaaaaaagaaatgctcctgatggtctcatttcaagggcgtagccagacccttggcttcggagggggctgaagttcaaaaatttggtttttaggggtgtgtttttcgttttttgaaatcccgaattatggggtatattttacaagatttttagccgtttttcgccaaagattactattttttgacattttggtaaaattggaggtcccggcggtgccgataggcgccgccgggaaaattttttgagtattttaatgcaatttgttaagaaaattgttgaaaatttcaaaaaatttactgaaaatttttacttttttgcgtttcggggggggg

SEQ ID NO: 10807 - DNA, 1822 bp, Heterodera glycines
  misc_feature (40)..(40): n is a, c, g, or t
  misc_feature (1718)..(1718): n is a, c, g, or t
ttcagcaaaaactattcatagacaaaacaaaataggcttnaacctaaaaattcataaaaaaaggaatctaaaaatatatcaaattctcaaaagctttaaatattttcaatatttacaaactacatattaattaaattttatgtaatttagccaaaaatgccggaaaattttaaattataaaactaaaaaaaatattttcgaacttgggtttagcgatgccgattgtgggggagacggagcaatttgttggggaattttcacagaataagaactgccaattaaaatgacagaatgttataatggcacaagaagacgacaacaaatagcagaaaacagtgccaattggcagcagatgttttctatttttaactgtttttttgttgacaccctcattaattaaataccccagctgtcagtcacattcatttgcctgttatgatgtgccattttctgaatttgccacttttttggcataatatttttctcccataagttttctcgtaatggtttttgaattagagcgaattatgaatagggcttatatttttagggttttgcctattttttcctgagctccctatgttctgaaaatgcacgaaaaatatgttgttatttttttggtagttgttaattgtaagctacttttcgagtcattagcacttatttcttaaatctttatttttagagtcaaatgcataaaaaaatttgaaaaacccatatttttgcctattttggcattttgcccttataacaaagatgcaataaaacgaaatatacatcactaagaagcaccttaaagtttcaaaaatacacccatatgacttaattttattactttttgaatacattttgtcatttaataccccctaaattttaggttttttactgcctattttatggatttttagagcctaaaaatataagtcctacttatgaacatataaaaataacaattttatgggttttgtaagattaataatttttcttcgttgaatttttttttaattataaattttaatcataaaaaaatttaaaacctataaaaatctaaagaatcagaatttcaaatattaaaatttcttattgaaaaaaaggtattcaaaatataatgataaaatttatgaaaaagtaaaacattcctcagttttgtcaagtcagcacaaattacatttaatgctgtaaattgaattcagctgtcataaataattctcacggttcattcaaaaaataatgcaaattaattaaagaaaaaggtgaaaattgagaaacccaaaaatattacaaaaatgaaaattaaatagacaaattaagaaactttaagacaatatgcactcttcatcttaactcttcagtttaaactgtagccaatttgtccgattcaatcttctcggcatctaccgtaggagagttgttttcggtctccaccgtagtcaaattgtccgcgttctccgtcacatcccccgccgtagtcgaattgtccgtgtcctccgtcacatcctccgccgtagccgaattgtccgcgtcctctgtcacatcctccgccgtagtcgaattgtccgtgccctctgtcacatgctccatcatagtcgaattgtctgcgttctctgtcacatcctccgccgtagtcgaattgtctgcgtcctccgtcacatcccccgccgtagtcgaattgtccgtgtcctctgtcacatcccccgccgtagtcgaattgtacgcgntctgtgtcacatcctccgccgtagtcgaattgtccgcgtcctccgtcacatcctcccgcgtagccgaattgtccgcgtcctccgtcacattccccgccgtagtc

SEQ ID NO: 10808 - DNA, 1211 bp, Heterodera glycines
tttgaaagaaatgtttttgaaacgaatttatgcaaaatcttaacaagattcagttaaatattcaaatttttatctcagcagtacacttccagcttagagttcggcctggacctggatccaggcctggatttttcctggatccagctccaggtccaggccatttttcggcgacctgatttttcctggacctggattttcgttgccccctaaaaattcttattcttttaaaaaattggcttaaaatcgtaaattttgtcattttttgaacaaaatcgttaagaaatcgcattaaaaattacaaatttccccggcggcgcctatcggcacccccggactctcttccctccccatacccaaaaaacttttcggaaaaatacgccgaaaaaaattgttaaaaactgactttttgattctgaatgcactgaaatttacaaattgataattttttccacaaattattaaaatcgattttcggaaatgtataaatttctcatttctaagcaggaattattttcttaaggaattgacccaaaaaatcatgaaaattagtcattttatgattaaatcggtaagaaactatgcccacaacaggcacgcctaccgaaacaacctgtcctcccctcctaccttccccaaaaaatgtctgagaaatttgacttaaaattcaaatttctgcttataaatttttatgtttattttttctttaataaaaatggcaatattttgtgagtatttaattaaatttacgaattactctcccgatcgcgcccgggattccgttaaaaatggacaggattttacgagattcccgttaacgctcccggaaaattattttaccggtctaaaatttatgcagaaaatttttggcattctgtcctattcaaaatgtataatggattccgaaaaaatctgatttgcggatccagctgcggttttgaaacttgaaattttgtgggacgcgacccgcagggactaatcccgcaaaattccacgcgggatccttacgcaccgggctttaatctctaattaatgtaaaaacacgagctttgcaaattccaataattttgattaaaaaagaaataaataattccatctcgcagcagaataagtatttggtttttcctattaggttcctcttctcttcctttttaatttctttcgatttagattttttgaccctaaatttattttaaaatgtcggatatatcgga

SEQ ID NO: 10809 - DNA, 1706 bp, Heterodera glycines
  misc_feature (52)..(53): n is a, c, g, or t
  misc_feature (64)..(64): n is a, c, g, or t
agttgcaatattgattttcaaaaaaattcacagatgtgggtcgtcagaagannaatggaatttntggggtgggggattactcgggtttcttagcaaatcctattaaaaatctcaattttcttgggtaacgcctctcataattgccgcttatcctcagaaatttttgataagaatgctccgaaaagcaaaaaagctttttaaattagttacttggatgaaatttcggatacatctttagttttttaattgtctttttttaaatatatgtgaatttgtcagccaattttcacggaattttgcaacaaaaaaaatggtacaaatttccttttttccttaaatttatcccggctaaatgtgaacataactaattggaaataatttttgaacgacttataattgcttaattaacttggtatttaattcagtgaactcgacacgctgatcaagcaagagaaggaaacgattgaacatcttctcaaggagttgccgacccaatttcgaccaccgtctgctgttgatgaacattcaacggcacaaatgccatcgggaaaccagcagaaacagcagcagcaattcaatggtctgtctgattgggctcatttgttggcacatttaaccagtgctgtggcaatgtgtgaagccgcattttccattcttatgaaaaatgtcagaatttttatgtttccaaaaacttgcttcaaatgtggagaaaaaatcttttggtaaaaaatctgggtaaatgtactaccgatagggcacatgtcccactggaatgaaaattataatcaattttcctaagaaaaatgagcaaattttttggatgtcttttggttagttattttgggaaaaacgctaaaaaatatttaattgttgtaattgtaagaccaatctttcggaatcccccccccctttttcgcgttttgtatgcctatatgtaatcctgtaaaaaaaaagagagcccgtcaaaaaaacattttttagcgcatttgaatgccggcgccaacaatccaccgcagctgaagcagcgtttcatcgcaccgccaccggcgccctcatttctgaacccgcagcaacagtcaaagcagcagcccccgcccaccgctgctgctgacttttctgtgccaccgccacccatcggcggcatgcagtcgcagcagcaacaaccaaatgagtcagtagtcggtcaaattccaacagtaacgcaaatgtatttgtataaatatgccaaaaaaaaatcaggggggttgagattctagaccttttttttgctgttcagccaaatataaacttgagaatattttccaaatatttaatttccgcggagaaaaaggcatttttgtatatttcgtccaaaaatgggaattttatgaaatttttataaaattttccccatgatacctgttgttattgccgagacctcaaaactccatgaaattttttaaaaatttaacaaactaacaaaatttccgtaacttttgccattgttttttgatggttttaaatatgccgctttcaactgtcagattgtcttccgcttctttgccacctccgccaccatttgtccaccattttatgcgtccgccgccgtcgctgccgccccccaaattgccattgccgcacagttcgccggcacaaatgccaccgcagtttggccacagttcgtcccttttgttcacaaagcctccaccgacttcggttgcatcaga

SEQ ID NO: 10810 - DNA, 1499 bp, Heterodera glycines
ccactatatcttatccttttttgagggattatcgtccagtttgaatcaacagcagaagaattcacatttcttggtaagctgaaaaagcatttttttattttttattttgaaattttcgttgcattttcttgttttgatgccatattataagagctttgtcaatggaatatttgcgcattaattgttcgggtgtcaatttcattttatttagttgaccaatttgtacggtgaacaccgtccaacttgctaaaaagtggtcattttatttattaaatacacaaaagtaaacaaattattttctataaaataattataattaccgttatcaacttccatcatttttttatccaaatttgtcattaaatgttctttttttcctctcaatgaattgctaaataatgggccaatggtctaaaaaataaattgagatataatattaatattttatttaaaaaattacattcactttcatgtggctgttgaatagttccgctaatactgcacaatcgctttttgaataacaaaaaattgccaattttggcatattgccaaaaaaaatattatttttttaacataaataaaaataataaaatgttagtatgatttgatataacaatattttattataacaaattctgagaaaaatttattttaagtagaaaaatttagaaattcaaaaaatgtcttctaagcatttttgcaataattgatgcattcttcgtaagttctaaaataaaacttttcaaaataataaatggatatttttcttaaattactcaaaattattcgcattgccaagtgcaccaaaataagagaacaccacacaatttccagccaaagctttgtaaaaataacgctaaatttttttgaaatcaattttaattctgaaaaatcattaattaacttgtgtatgattctgttgaaacacatatttcccactatcactttgaaccttgcagacaatgtctgaaaattgttaaataattaacataataaacgcaacaaccattgcttaggatggcatttttgtggaattaatccaccagaaaaaaaaaatcatttttctcagaaagaattttcccgttttaagtgccggattcccgcaaattctgcgggataacgggaaaacgcgagattcccgcataggattacttctcgcctttttgctggcaaaaattatcattggaaatcacttatccagggtaggtaaaaagattggagaattctggaacccggggtcaggatccaggttatggaccggcgaatcagtcaaacaaaaagaaaaaccgggaaatccagctataaacccatgaaccgggacttatctcggtaaaaaacttgactgatcccggtcccgacctctttaataaattaattaatacctttattagcaggacaacaatgttcgtttacacatttgtacccctctggacaattgtcatctgctggacatgtcaaaacacgcgattgactgtcaaaagcagctctcactccgcctt

SEQ ID NO: 10811 - DNA, 1574 bp, Heterodera glycines
  misc_feature (16)..(17): n is a, c, g, or t
  misc_feature (80)..(80): n is a, c, g, or t
tttatatttttaaatnntaatcaattaattagttactatgtgagcatctgttgtaatcatcgttagcttggcaaacattnagaagagaagtgattgtgattaataaaacgaaaaataacattgaaaattttgctataaaaacgaaaagtatttttagaatttgaataaatatttgttattattttcttcacactaacatattttatttaatttccctctatttttagttcattaaattaaatttccctattttattattttctcaatttatcaaatttttgttttgacaaaatatcatttcgccgaatttcattttgattaattttccagcctgtactcatatgacagacaattcatttggtgacttttgttgtaataaacaacttggaccggtcgaaggtttttaattgagccccatcaaataatttattactttctctcaaattaatggcttttaattaattctcaaaattacttactgtacaaattcaaagttttttttttttaattttagaataaaaaatcgaaaaaatgaaaaatttccttacatttttggcttttttcttaatagtgccatgtttcaaggctgacaatgagaaaaacaaagcggcaccacgagtgtttgctgaacatccgggtagaagaaattatcaaatattaaaattaaaaaattgatttttaaattttagggccaaaattggtggacgaaaccacgcgatggagcaaatgccaagcggaccaaaacctgaccatttatgacttcgaagtggaaacacttgacggcaaattcaccaacttggagaagtacaaaggacaaattgtactgctaattaatgtggcaacattttgcggtaaaaaactcaaaaattcaaaaaaaacataaatattttttcagcgtttacccaacaatatttggacttcaatccaatgctggagcgtaaccgtgccaacggcgtcccattgacaattttggcatttccatgcaaccaattccatttgcaagagccggccgagaaccatgaaattctcaacggggttatgcatgttcggcccggagacgggtggaaaccgcactccaacctgcacatccatggcaaattggaggtgaacggcgccaacgcacatccgttgttcgactttttgcgcgactcggtactgtttttcgacgctgctaacaaaggaaggtccccaggtgtccgtgggatttccaaatgaaatttggtgggtggatagagcacccatgggttcttaagaaaagtgtttttattttctgcgaaatgagtacgagtgccgagatatgacgtgccaaacttttttctatcccaataaatcgaataaacatttgcaccgttgtgttgttcggaggtgcggaggttgtgctcctgccttccctttttgccctcgcaggctcgaatcccacatatgttaatttattttccccgctttaattttgatttgatgcaaattaatggccattgaaatccattccatcgggccaaagatttttattcctcctccaagtcattcctaaatatgttcgaatatccccaaagtattattgtccctttcaaaaa

SEQ ID NO: 10812 - DNA, 1987 bp, Heterodera glycines
aatggttggaacgatttctgtctcccggataatgctaacttaaaagagaagcaaatcccaatccatacacctggaatatgccagcctttagatgtttttttccggtagttttgttgccaaaaataaaataaaaaatagttttagaatttggaagcaatttacgagaaaaatatcggaatttgtaatgatttatgatgtgaaaataaatttgcacgacagggataacattgttaaattacaatcgttaatccataatcaggttcaagcagaacgttttcatggatggattaattttgcctggagaaaatcgggttattacggggacgagcctctgccaaatttttgccatcccgttaaatactgctttgaagtgccaaaaaatgacatgtgtcagaaattaaattgtgaatgttttattttattacggtgtgcttattgtgaattatatttatgctttaaccatttttttaatgattaccatttgtgtgaagatgaataaaattgaatgaaaaaggagaatttttgacccgatggaattgatttcaatggccattaatttgcataaaatcaaaaataaaacggggaaaataaattaacatatgtgggattcgaacctgcgagggcaaaaagggaaggcaggagcacaacctccgcaccaccgaacaacacaaacggtgcaaatgtttattcgatttattgggatagaaaaaagtttggcacgtcatatctcggcactcgtactcatttcgcagaaaataaaaacacttttcttaagaacccatgggtgctctatccacccaccaaatttcatttggaaatcccacggacacctggggaccttccttttttatacgtacttattttaagaaaaaagtctttaaatttaaaggattctaagaaaatgttccttgtgtttgtgtctaaaagcaattattaacaatttttggcaaaatttgatttttgatgctaaatcataaatttgttgtttcattaattcaaaaaattgtcatcctaattaaaataaaaataaaaaaactaacgaatatatactcaaatttttccattcagtgccctcaaacggtccctgtgcttgggatcaaggaatcaatgttctataatccgatcacggtgactattattgctttttattcattttttcaacagaaaaaatctgaaagtatattaaaataaatttgtaataatttttgtaggtcagtgacatcacttggaattttgaaaagtttttgatcgacgctaacggagttcctcgtttccgttttcacccaacaaattgggtaaaatatattttaataatttcacttttgagttaacattttttattttagtcccatggtaaagaggtccagaaattcattgaccagctgtcagccgaacagaagaaagagcccgtgaaaaaggcatgaaaaggaagtgatttagaaatttggaaaaaaataaataaaaaccattaatatttaaattcaatatttgtgttaattttagaaaaccaaagtagaatgaagataaaataaattgtttaaaaattttaaattagctgatcaaattaagacttcaataaaaaggtaaaattgagacaaaattcattaactaaaaatggtaataaatcttctgccattaacacattaatcatatgagattaaacagaataaaattggaaaaaagaagaattcgtcaagttaaagatgatgagagtaagtcaaaagagttgatttgattaatattcttctaaattcttaattttattaccatataaaaaatttcaaacaaatttattattttttattctctcatattaaaaatatgtaaaattgtgcaaaataatattaaaaattttacattttcaaagatattaaaaaatgtcaacagaaattggaaatgatcagcagcagaagagcaaaaaacactcaacagttacaacaactgcttggaattcgatttatttgtgcacattattcacattttccac

SEQ ID NO: 10813 - DNA, 6227 bp, Heterodera glycines
aatgttagaaattttcattgccgtttcaaaaaagttctgaacaaaaaatgctgacttaccactttttgaaatgttatgacaataactttttttatacttaagtaaaaaattttggaaagttattctgaaagagaacaattaaagctattgaatgatacaataaagaagtaatttggttgaatttgagccaagatatgaatttttatgtgttacccattttttgttttcaaacccattggcggatttaagaaacgcgcatgggtggcggaatttaagaaacgcgcttaaaatttagctcaaaagaaaggcaggcgaaaaagtcggcgtaagaagcgagtggtggatattgtttttggattgctatattgcttggccataattatagcgatatgtgcttggcattgggcaaaattcaaaattaatgaatacaaaacaaaacagaaaggtaagataatcgaatcagtcaaattgggcgttggggaatgttttatttaataacagtcggaaaaaggcaaaaaactttttgtaatttcaattaaaaataattaacaaaatgaaatacaaataacacttaaactgatttaaattgactactttaatttcagaaaatagtttaacaaaaactggagacagaaatacagaaaagcttttatatacatttaacaatgaattaaaagtttcaattaatttctttaaaaattgctaaaaaaagtcacaacacataaaattcttcataaaaatttagttttgaaaatcaatgccaacctatcaaaacagagaatagatgaagaaaacaaaggtggtgatgattgcccaatttgcctatcggaatttggagtcgtagaggaggaggctacagaattgtcgtgcaaagtcagttatgctattttaatatacaataatataaaatgtgtaaaaccaaaagtaaaggcggtacttctaggttttgtcacccccctgaaattttttttctaataattttttctaggctaatttttgatgctgatcaagaatctgacctttatttttagccataacgtgttttaagtgagttatgtgaattttttcgtaaaaaagtgaaaaatttaaagataaaaaatttaattaggcgacataaaagcaacaaatttcgtaaaacctcatcaaaaaacatcatttatgacttttgatttgttttcttacattaaagccgggtttgaaccaaaaatgcgaaactataaaaaatttgattttcgactttttgttcgaatttgggttcaaagttcgaattgggctgaaatggatgtaagaatcggattctctgaccgcgaaaacccctaaaatgacttttcttcagaaaaaaattttgaaatttttttttcgaaaaggggcggcactattggcactcttacctttttaaatttttcacgtaaaatttctcacgtaaaaaatgttatgaataaaaataaaggtcagattcgagaacagcatcaaaaattagcctagaaaaaattattagaaaaaaaattcagggggggtgacaaaacctagaagtaccgtaaagacgtagtaaaagggcactcgggggatgcgccccgaggggttaaataaataaatatttaaaccggttatatgaaagttggcaatttaagcacaaatttttataacaattgcacaaatttaagttcacgatttacactttttttttgtcttttgaataattgaactaaaaaatttagcataaatttcacacggaatgcatcggacaatggtaaaagttgaaaggcattaaatttccatttctttttttgatttattttttttgtaggattaagctgcatcagacttgtccatattgtcgagcaacaatagaaaatgaatcaagcggaaaaggtccttttttggagaaggggaaaagctatttaaaattaattgggaaataataaataaatattttttatttttataaattcactgaaactcaaaacccacgtattttcttttgtaacttgaaattttgagaagtttcataatttctcttaaaaagttaggagttttaaaaaagtttgagatttttattacaattaatgctcaattctcagtgattatgtttttttaatgaatttattttggtgaattttgaacttaagccaacgcacaagggcaaccgcaacaattgccccctggcaaatgatgccacagaattcggatgatttgacgtggcggagagtgtctgatgatagaaaatgccttcttattaagcggaaaattgcagtttacccgtccataagctttagaaatcagagatagaagggacaaaattttatgttttcattttcattaatttccgaaaaaaccctacctttttggaggcaaaaatttacatattttgaccaaaaagagcgcttttaatcgaaatgggttaagtgagtctgaaaattgttaaggacgggttaactaactgtgcaattctgagttcatcagctgaagcattcacttgcattttcattttcttttctgtcgtttttttcttaaatcattttccattttcggtttctctttttctgtcattttttattttctttattttccattttaaagaataaactttaataaataaaataagtccgcaagaaacgaataaaatataataaataaaaaatagatgacagagaataaatggaaacggaagaaaagaagcaaatgacatggaccgacaacgtaccaggtgttttcgacagtgattggttttgacagtactttttaattaatttctacataaattattgtatacatgaattagtattaatatataatttgcatatacaaaatttataattgaagtaagcaataaaaaaaagatttgtataggattttttgtcaaaatttatcgttttcactttttctatataaatatctcctgattgactgtagtcaaaaatacaaaaatttacttacaaatcatgtgcgaacatctgctaactaatgtcaggtttgagtgccaaaatctaataatacttataccattagaacattaaaaaaaataaactttactgtcgaaaccaacactgtcgaaaactaacagcaccactgacaaagtttgtgtgttcggtagggctgtgcgagagtctcgattcccgactcgggaaatttctcaggtttttcgcttctcggtctcgggtttttagtctcggaaacccagaaatttttacactgttaaggatggtcattgcggggaaggggtcgccagcgaagggagaaaagaggaaaaattattgaaattttggacaagttttcttaataaagttcattaaaatcgcaaaaaaatttcccgttggcgcctatcggcgccgccaggccacaaaattcccctaagttcaaaatgtaaagttatattgactcaattttgttcagacggtgttggtccgttccggtttatcggtaccgctgactcaaaaaacttatactttttcataaaattggcctttttggtgcaaaattattactaaatcgcacaaaaaacccaattttttaccggcgccgccggtgaattttcttaaaaactggactggcttaaaaacaaaaatttggtcattttagacaaaatctgttaattttagcttttaggtgctaaaaataaaaaactagaaaatagttgtgctaactcaaaaacaagcttagtttcctggctggattttgcacatcatttcccgcactttttcagcgctgaaaagggcaagtgcgcccctaattctattttttcaaacccattcaaacctttttacatcgattcagaccgtttttaagcatttttgaatttggtgactacgatcaatatctaccaaattttttcaaatttcttaaatatttgctcaatatttcgacaatttttcgtaaatatttatttaaatattagggacttttattaaaataattcccatttcaattaatcacataaaaaattgcaaaccaaagggtcacccttttggttttaataaattcacatttttcggggggggggcaattgcagtacgagtttttacaaaaggtgcaccattaaatggaaattttctgggataaagcctattttttgaattggacaaaccgttccccacaaaataccctaaaccatgccacagaagagaaaatgggttgctgctaatttttgtttgccaaaccaacattttcgttcgatttgttattgttgtgggaggggggggggagggggaaggaataaatgttcatcggaacgaatacaaacaaattccatgtccatccctctgcgggggggggggagagtgtggcccgaaaaacaatggccaataataatgatttgttgatcaaacctaccaccactaaatatgtggccatggagcaatgaatgaatgaatggacggagtttgttgagagggatgactttggcagcagcggagggcaaacacaaacaatggcacggaaggacaaacggacgaatgaacagtttggggcaactcaaactcaatctgctgatgataagctttcattcgtagccaattttgaaaaatattgcgacaaaaattcttttattgcttcttgcgtcttaattgtgcttagatttctcaaaattttgagagtcccatccacaaaaattctttaaaaaagttaatttaaaatatgtttccaacaggaaaatttatttctgtccaaatttttgtggtaaatttcgcttattcgttaaattgatttaaaacaaatatttatccaattttttatccaataattcttaaatccggaaaatttcgcttcttttttatgtatgcttttaggtttctaatttttttcttccaaaatacttttattaaattgggcgagggggacggagtggtcgaatctgttgacatttgatgtcctttcgcctaatatataaatgttttgtatatttcttctctgggtactcgtgaaaagtgccacttcctctcgtctttcatcaaaaagaaatagtttttccattttgtcgttctgtccattttttgtggataacaatcctcccctgaggggtcgggggacaacaaagagtgccgccgacggacgacgacggcacaaaaagatttgcttccggaatggcatcccacccctccactcgccgacctcttgacggtgcgcaatcgacttgtcacaaatgcgatgcaaatgcaatgtaatgagagggggaggggggagaggagggcacatttcaccaggggccgaccgccggaagagtttatttgtacaacgaatccatccatcggcacgtcgtcggataaaacggcgacggacggtgctgctttttgagccttttcgggaagtgagattcaatgactctgtcgatcattctgtttgttattaattatgtccttctgctgctgtggcaatcatcagtcacacaagcaatcagtttcaattttgaaccatttaaaacatttgagaaaaatctttgattgtaagaaaaatttatgcttttatgaccaatatgagcagatttaaatttattaaaatgtcgaaatatttaatttttaggcactgtattttttgaatttgaaaatttttttggaattttacaaataaatattacaaatattattttgcaatgaatttatgcatattgacgtttaaattcattcaaatgatggtttactttttcgtgtatttgccaataaaataaaagctgcaggaaaatattaaaaatgtaatccgatcgatcataattaattaaattaaaaaataataataaattaatttttctcaaatgttttgaatgttcccttcctctttctgctgcttaatgcttttcccaatatctttttttccattttccgttaccgtatctcttctcttcactctttttccgattggctgctcatcgtccgtcattcagtcatcagtccgccgttgacactgtgcaaattaatccgctcgacaaatgatgcgcaaattgtgggatttttgtgacggggggggggggggggggaaatacgcccaaatgacactgttcaaacattggacggacaaaaagccaatgaatggctttgcttatgcttttccgatgtgtttactgcttgtctgggtggacggcttacaagcttaccacgggataatcatcaaatcagtggattaattgggaaattcacaatattaaatgaatcttataatttattttcattaaaaaattattaatattttttgtatctttaaatcgttaaaagctttttatccgctagaaaagtttataa

SEQ ID NO: 10814 - DNA, 5920 bp, Heterodera glycines
ttctaaagatttttgtgctttcaattcggaattaccgcttttgctctaattatagcccatgggggattatttttcaacctcctcagaaaaggggggataattagagactgggggattatgatagagggattatttttcaaaacacctcgtagactggaggataattggagactgcgggattaatagagactgggctataattagagcatatacggtaatttcggtttccgaaatttcttgatcctaagaatttacgagcattttggacctcgtaattccgatttttattattttataagcctagtattccgttttctgaaagttttggaattacgatttcaaaaatttgagcctcggaattttttaggcctcggtagtcgatttccgaaaatttatttgaatgttggattgcattgcctactttactgccttaaaaataaatctttaataaaataattattgttaattttgtacatttagaaaaataattttaaaacgtttttttttaaattggtttggagaataaacgacgaaaaatgatcgttttcccaatgatgattatcatattatagtggcagatgttttttttattagtcatcgccactttttcaatgattggtccattccaatctgttccattgattagaatctgaatcacatttatttttaattatgttaatcaacaattctttatgaattgcaaaaattgttcattttttattattataaaattaaaaatttaaccctttaacaatttaatttttaaatgaaatgcagtgccaaaattaacaaaaatatggacataataaaatcgagaaaatggaactatgcaaaattgtggatataggatattcagtactgcttgagatcgaaactttcccgagacccaaaaagcccgagacttttctcgagtcgtgacgaataaagcctagagcatcatagccaaaaaaattttgtaaattaatttccgaggcctaaaaattttggaaaccgaaattccgaggctcaaatggaaaccggaactccaaaatccccaaaaaaaaaaaaattcataaatcagaattgcgaggccccaaaaatcccaacctctattataataatgttattaaatatttttcttcattttagagcacaaatgcgctttttcatcggattaaatatttttatgttgagtttttgcataattttctatcaaattaaattaaatttagggagagaagcaattagaatctctatttaaaaattttaaatttcgggagagcggcgattagtctttaattattaattaataataatttggttaattaattattttgagttgcaattttagttcttcccacagttcgctttggatgtgttaagtgccaatcatggatcaaaagagttgccgcctttatcgattgatcagactttctcacttcaacacactgatcaagtgccaatctccatcgctttcacggcattgaccgacacaaacacaaaaagcatggcggtggagctgctaattgcccatgatgatggtgggaaattaattaattacaaaagtctattagaggccggtttttaagtaaaaatgaaaaagccaaaaaaattttttttttttttttgtaatttgtttaagccaaaacttgcgcagaaaaacaaaagaaaaagtttttcacgaattaaaaaaatgaaaaaatttcttttttgaaaatcttaagatcgatttttaaaatattttccaataaatttttttttcaaaacctgcagatgaattttttttttgtttaaatttcagactgaatgtttgtgagaaaatttgaaaaatttcaaaaattaaaatcagaaaatatgaaaaattgtttttttttttattttgagtttttcttgcaaaaaaaaattaagaaaaaatcctccttttaaaaaaacaaagaaaaaaaatatattatcaaataaaattaaggtgatagtgttcggcagttttttttactttttttttcattttcaagtgtccattataatttaaaagatttatggcgaattaaattttgttaagaagcaaaaaatattataattgattgattcattgttattaaatgccggcccaacttttcaacatcgaaaaattaaaaataaggtaaagaaaggttaagaatttcaagagaaaaaattaaatttatatacaatcaaaaaattcattaaaaattaagtcagagaaataaataaatgattaatttaattaattaattctttttttttaaatcctcctcattcgttgtttcaattcaaaaagtcaccgtttaagcactgtaaaaagcactaaatttttccaaaataagcatgaaaaaagcaccaaaaggcaaaatcagcacaaaaaattggaaaaaagcataaaaattaaggaattaaaggcacaaaaaattggaaaaaggcagcaaaatttttgcatatttgcagattttatcaaaataacaaaatattatttcttagttcaggttgatagatcaaatatatcaaatatatttcggggttcagagatgaaataagttcctttatcggactaaatacggtcatttgctccctgctgattgccgctcaaatcggtgaacatttgccaattttttagccgattaacattatattgtttcaaatatttatgactagggaacatatttttttaggcgctaaaaagtgccaaaattgttagtttttaacttctaaaaaactcccaaaaataggagctaaaaatgagaaaataggtagaaaaaatttcaaatttaaggggtgtaatatgaaattttattcaaaagcaaaaaaattaagctaaagcactgatttaaaacattttttctattttttttttattttttttctttttttaaaatttttttttaaattaaaaataaaagaaaaaaaataataaaaataaaaaactattcactgagataaaaaattaaaaaaaactaaaaaataaaacaaataataaaattaaaaacaaaacaaaaataaaaaaaaattgttttttattattttttctttttcttttttttttggtatgccttaacggtgatcttaattaaacgattttaaagttattaaaaaaatagttaaaaatttttttttatttttgaaaaaatgttttgaaagttaaaagttttttttttattttttttttttgagacacacgattttattcttgtcaagaaaataaataaataaattttggagatgcatttttaataaaaattttccatttcttaagggggtgtattttttgaaaatcgctgaaatattctcgaaatcctcaaaatgacgaaacagcacaaaaaaaagcaccaaaatggcaaagtcagcataaaatttaaaaaaatcgagaaatcagcaaaaatcagtattaaaaatataggtctagaagcttcaaaccaagttaattttgtcaatttctaaatcatttaaataaaaactaaattttcaaaaaaaaaaaaatcttttccgatttgcccgcccctctcatcgaaaattttttaatttttattaataattgttctaataaacctacagtttcgtattacttcaatttttttttatttcattaattgccgattttagcctgtcgatgaagaatgaatgtacatttcggacttccccataattttttttagttaaatgccaaaatatgtgattgatgttccgccggtatttaatacaaaattaaaaattaccgtacccaaaattaggaccatttgctcagcctaaatcttgggtttcaaattgtcggtgtgtttattattttttccatcctcgcaaccgttttgcgggattggtacctaaaattttgtgggacgggaccccgcgcgattaatccagcaaattacgcattttccaaaaaaaaaaaaatacgggattgcggacagggatcccgcaaaggtcttttagcctcccatatcctttatcccactttctcccaaataccgcttcctcctcctcctcctggcatcacacatgtataatgtctgtgatggaaacggcatttctcttttctcatctcggcaccgattttttgacttagatactcgcagattccgtagaataaccgcaaagaagcagatttttccaactcggtaccgatgtttcacgtgatccccttactgcagttatttacctaataaatttttttgaattctgttttcggtatatcaacgattagatagtgactagaagaggaacagggagggggggatgatactcgggagaaacggcggagaacgatattcgggagaataacggtacccggggaaacggcggggaacggtaccgggggaaaaagcgattatatcaaatcaaatccattctattattatatataatatataaaatataatatttcttttacataaaaatgtataaaaaaaaatcaattttcatcaattgcatcattcgcgcacatttgcctgtaaaatggatttttttgattaatccacatttatttgcccaaattgctggccaatttcattggcagagagggcaatatatttttttaaagctctgtgccgtaaggcccaaatatttggccccttcccattgacatggaaaattggtgccaattcattggcagggctaaattttggtggccgttacaatcaatcaattagcaattcttcacaaatatccatgcatatccacatgaaaatgatcttgccaaaagcatagaatggcattgccaaaaaattggccaatttctcctcctgtttctcaatgtacctaatgccaaaaaaaaattggcaaacccaattttcattgtcctgctaaaaacggccaatttctgcctccttgggagcagtaccaagccaaaatcgggcactttcttatgcgtgcgtcccattgtgttggcttctgctgttgccacggtggattttctgctttaaaagtccccgcaaaatccccacattttcactattatttgaaaaatcattttgcgcaaaaaaatttttatttttgtccgaaatgaaactcctttttaccccaatgtttttttctgtcattcttcaaacaattcttctcctgctgctggtccaacatgtaaatggaggaagagatcgagtgcaaggtaaaaagaaatgaaaaatttttacaaaaatttttaaacattttttgaaaaattaaaattgcgccatgctcattaacccttaggcaacatttatgtatgtaagttactttgagtgatctcttgcgaggttttgtcttatttgtaacactggaccaggctcgaccaattgttttttccggggccaaaaccgaagcggccgaatcaaaaaaaaacagtgggcctggccagcggagcggcggcctaactcgaagataatttttttttaatttcaacaaattggtgccatctgattcaatggccctacacattttcaagcaactaatttgcgatgctaataattagggctggcaattttatgtaaatacacatattttttcctggattctccatgctctaattagtaggaaaaacagtttctttttgtgtgtatgcgaacaaaagttgggacttttatttacatattttatacatttttagtacatattttggagtttttagcattttttctaaatttttttaagaatttataaaaatttcatgtgaagttaaaaatttttttttttgaaaatgtacccctaaaaccgttttgttttgtttttcaaaaaagagataccaacaattaatttttaaatatacaaaaatgtgcttctaaggactcttatttgttaggtcacttttaaggtattttgtgcctatttcaccctttaataagaatttttccaaaaaataaccatttaaaaaattttatttacatatttcggtatttttcttacatatttatgtaatcatattctgaaaccactttttgtacatatttttgccagccctact

SEQ ID NO: 10815 - DNA, 3632 bp, Heterodera glycines
tctagagtcaagaaggaaaaacgtgaggacaaatggggaaaaaaggtaatctttatgaaacaaggaaaaaaggagaaagaaatggaaaacggatcaaaagcagcaaaaatcagctgataaggaaaaggggaaaacatgagagaaaagagagagaagtgatcgaccaatttgatcagagttcacttttggcagtgaaaaattattctctggatgaaataaattcttttttttggtccataaaacattcattgtttttgccaaaacaacaattatgtcaatttgtcacccattcaaatgatccaatggagaagaaaatacccaaatggccgcttattttttgtaaagtttccgtcaataaaacctctccgttaagggtcattcatttttcgggaatgggcaatgaatgatggaataattgtcccatccgtccgtccgtctccccccccccccccgggcgtttctgccgattgactcattcattccctttaaaagcggtgattttgttgtttcttcagtgacattttcattcttccgccctttgatccgctgcttttgctttgattgtataaaaaaaattacttcggataaattattattattttaataatattaatgggcataatatgcaataataaattaaaaataggagacaaaagtgcaacaaattggggaatcaaagggaattgttattaaggtaggcctagcccgggtacccgatagggtcaaggccggggatacatggcttttttaagaaccgggcccggaattgaacccagttttttgaaaacccaataaccggtatccgacccgcggtgggaccgggtccaagaatgttttgatgtttcttacatattctatcaaaaaatgaacaagtgtcattttttgagtccattatttagtttataaggtggaggtcgatccagcggtgccggtaggtgccgcctggttttttttaaatcttatatgaaactttgcgaaaatgctttaactaattgaatttattgtaaatttcttcaaaaaatatttggcattcgctctttgaatttcaaaaaattcagtgcggattcccgcggaatcccacaaaaaataaatctgagggtcctgctgtcaaaatttttgcggtacaggtcccgcagggactaatcccgcaaaatggctagtcatctgaggaaaagtctgccgagaataactcatttatagcataaatcagctgaagacaaacttcatgatattgcccagatgaaatttattcagccgacggaatttctgttattgtggcgcaccttttatcgtccaatcaaaaaagcatatcaattaaaccaaaatataattggtttgtctatctggaacaaggccggagaatattccgtcgcgaattttcagtcttgagccacgtatcagaaaaacattactactccgaaattggccgatttttcatagaaaggcaagtaaaaattttactggtcactttccatttatgattcaccttcaattcccgtgctagagaattctccgagtcaaaggtgcactgttgcgcatcatgcctacttttttgcaactgaactttttatttaaaactatattgttttttattttattatcactaattttgcaaaaaattttacccagtttttacagttgtaggtaaagaggcagtattctgcggcttcgccacttatccgcagaaactcgcgcgtcacgtcgtccgggtgggtgttgacacagcagagtttgtgccatatatacaaagctcatcatttgatttcgttggcaattccggcaccaaatctccaaaacgcacacataatattcgaccgcaatttgctcataaatttcgtcatcattcacattttgatatactgaaagtatttattataccaaaaaatcagtctattatcactcgcttttaactaatatatttaattgtttaagctaaacacaccttctcgattggccggccgacgaaaactcaaacgtctcaggattacgcagattgcattcttggcaaaaccatgtgagacgaagggcgttgtgcgtcgcccaagccatgatcgaggtgtcccacattttgtgtcggaagattctgagctgagtagctcgcaggtgctgcagggcgcagggacattgcgtcccatgcacaaaatttgaaacttcgtcggtgtctggcctggagtcggccgatgcgggagatgaagatcgggacatgattgtcctgaacaaaaaataagagggccccattaaaaatagcgaatatatatatatatatatatatatatatgttatataaaatttgttcaatgcgcagcggtgcgccggtggactcggagaattatcgtgccacggaattgaaattgagtcatacatggaacgtgaccagtaaaatttttattctttctttactatgaaaacccgaccaaattcgaggtcgtttacgtgggaaaatattgatcatatggcccagaacccaaaatggtcaaaatatacaccaattgatagctctcggtctgtaatgaaaggatacgaaagaatttttttgcggaaaccaatccctgaagagttaatacccgggactgaaatggccaaatggctttgggactgaaccgtccaaacccttaaacgcatggaattgcgataaaatgcaacaaaagttataggtcccctcaaaaccggttcagtcaaaaaataacaaaaattcgtcaaatttgaaaaattgaagtgctttacgtttttttggctcacctaaattaatttttaatcaaagtcattttttgaggtttttgaggacccataacttttgtcaatttcttttttatccaaaaattataactttcaaagagcatttttttactatgctaaaaactagggttcgagccccgcccccgtccccggggacgggacaggtttttggggctcacccccgcccccgcccttttttatttctgtttttgcttcaatgagaatttttaatttctactttctacattatttgttggtacctatttggttttgctttttttcacttttgttttgccagttgttgtaaaaagcacatttttaaaattctccttttttttaattttttttttttgtgaattgatttgtctctgatacagatatgtaaaagattttgtttatgaaaagtgtgatgattattaaaaaattaaatagtttttgtttgtgtaatggtacttattatatatgtatcttcccagtgactggaattctggtggattgagtcccagtgactggaatgcttttggagtcccggcgattggaatgctggtggattgtgtcccagtgactggaatgctggtggattgtgtcccagtgattggaatgctggtggattgtgtcccagtgactggaattctggtggattgagtcccagtgactggaatgcttttggagtcccggcgattggaatgctggtggattgtgtcccagtgactggaatgctggtggattgtgtcccagtgattggaatgctggtggattgagtcccagtgattggaatgctttaggttgtgacccagcgattggaatgctggtggattgagtcccagtgattggaatgctggtggattgagtcccagcgattggaatgctggtggattgagtcccagtgattggaa

SEQ ID NO: 10816 - DNA, 791 bp, Heterodera glycines
tatcgatgagttgcttatggatgatttgggtttggatgagttgcgtatggatgcgttgggtatggatgagttgggtatgcatgagttgggtctatggatgagttgggtatgcatgagttgggtctatggatgagttgggtatggatgagttgggtttggatgagttgggtatgggatgagtttgggtatggatgagttgggtatatggatgagttgggtatggatgagttgggtatggatgagttgggtatggatgagttgggtatggatgagttgggtctatggatgagttgggtatggatgagttgggtctatggatgagttgggtatggatgagttgggtatggatgagttgggtctatggatgagttgggtatggatgagttgggtatggatgagttgggtatatggatgagttgggtatggatgagttgggtatggatgagttgggtatggatgagttgggtatggatgagttgggttatggatgagttgggtatggatgagttgggtctatggatgagttgggtatggatgagttgggtctatggatgagttgggtatggatgagttgggtatggatgagttgggtatggatgagttgggtatggatgagttgggtatggatgagttgggtatggatgagttgggtatggatgagttgggtatatggatgagttgggtatggatgagttgggtctatggatgagttgggtatggatgagttgggtctatggatgagttgggtatggatgagttgggtctatggataatttgtgtctatgtatgag

SEQ ID NO: 10817 - DNA, 4200 bp, Heterodera glycines
cgtggctgagttcgtggccaagcacaacgccgattgcgttttatatcactgcttcgggccattcggtgtcaaaaaagggctgcgccaggatggaggcgggcacagtgatggaattcagctcgggttggtaccacgcattcgtctgaccattgcattaataattaacccactaattaatcagttagtggcctcttacaaggatgatttggccattgaattccgttctgtccgtcccctttctcttcagcaaatgcgcccattgctgcgcataagaaaatttcatcgttttgtcccaaataatcaaaaaattgtctttgtcggtgaaacgcagttgttcgtagtactgctccaatttgctgttgttgaccatggtttgaggccatccgatgttggccgtgattttgtcaagtttcgcgtgggccgatgccttcgcccggggggacatccacgaaatctgttggaccatcgagcggaaactcagcaaaatactgtataggaataagcgatggatgaacccaaaaagcctccgtttttgttcgccccacctgtccaccaatctttgggccccttttctcagattgtgtcgactttcttcgtttggcatcgtttggtcaagccaaagacgacctccgaccaagtccatcatggccaagctgtacgaggcgcacagaaactccgaataatcctgtccaaagtaacagtttggcatttggtcaaagtgccaaagggtacttacgatttgggcattgattttctgcaatttcttttcctcaaatatttccattcgcctcggttttccaattgatggtctgtagaagaagtaatccctgttgctgatgggctttattatgtggccagatttggcagcccgttttggccaattttgcgtaatcggaacattcagagttgctaatcgtttttaaaagtgtgttcattttgagattattcgctttaatttgagtttcttttaccattttttcctgtgaatgcctgtgggatatatggtgaataaaacagtatcatccggaagtacaaataattaagcagctgattggccgtcaaattgtgcttattccctgggcccaagtcgtctcccaatttggccaaaagtgtcggctcggcaattgcaaaacggaaattcggctgccgcaatttctcttggacaatttgcggggcattttgggccaattcgcggaggaaaagcgaccagttgagaaaggggaagcgaagctgagcatcggaaacggtgaacaaattgaaacgcgagcccaagtcattttcacggatggcatcgctgacgaggaaattattggccaaaagtcgctcaaaagcgatcacttcctgatcaaagggaaatagaagagtgatcagttgggagagggaaagggtgccaaaagcgattgatcacttctgacaaaaaggggggggatttaccaaatcctctcattataatgaatttgaaataatttgtaaatgctttggcatttgttttggcgtggtgttcgtttttctttgttacgcattgtctcctttccacttttgccagcattcacctgaacggcggcgtttaaatcttttcttgcgtattccacgcccaaataattggccatttcggtcagaacttcgtccacaattcgtctaaaatgtttgctcttttttcattttcaatttctccaaatccccactccatctggtgactaacgatcggaaacacttccggggaataataataagggtcaaatgccaaagttggctggtcgacgaacaacgcataaggctgaatttgaaatgccacaaattgatttggggggggggggtgccatttgaccatctcttcagagtttgggtcggcccaattggtgtcgacgaaaaagctgatcaaagtgtcgaccataacggagccgcttaatgcgcccaaagccttggacaattcctctcggcttggccaatccatcgtttggccagcaaaaacggggaaatcctaaaacattgtcaacacttttagcattggttgtgagagtaaaacggaccaatctgctctttttctggaacaagaagaacttctccctgggcaagtcggcttggacgatcacttggttttgatgatgcatcagaaaagtgcacttttcaaaggccaatttggccttttggatgggctcaatctgaaagttggggaagctttgttttccattttgtggcatcatatccaaattaaaatcttttcactccaacttttacaacatcgtaatcattggcacaaagtccaaagggatttgctttctcgtgtctgttccccgttcgactttctcgtgtctgtccccgttcgactttctcgtgtctgtccccgttcgactttctcgtgtctgtcccccgttttacctgttggtgtacattgttcgctctcaattcagttgccaaagtgatcagattctgaatgctgattctgtcgaaatgagtgatctcatcgaaagcattgcacgcgtattcgtagaaattgttgcacgggtcctgcgctatgtccacggatttttcaaaatattcggaagcttcgcggaatttcggtgtcaattcactttctttttggggaatgttaagcgaaggcggcggcggaagaaagttatcgccgttcactgaacaaataagtcgtaaaacattaacataaattgaaataattttattttttaggctttctgaatactaacaaaagctcattttatattctaaaaattaattggagatgattaatttcaagaaatttttttatttcagaaactgtccgaaagtgtccgtccgttgcgcattaattgaaattagtcccctattaacaaaaagccatgcgaatgaatcacttcaattaatttccttccctcaaattccattggcttttcccattcacttgccctgcttcacttcgctgatccacacgtcacagtgttctttaggtgcgtataaactgtccttggggcagttaaatgcgttttggaaagcggggaaattttggagagagccgaggacgcggaatttgggcggggggtgcgggtcgagaagaaggcgccgggacgttttggcggggtcctcggccgattggcaccaaatttgggcgaatgccaaaaagaacagctggtcgtggtcgtactggctgagcagtgggccgggcagtgtcaactcggccccccgcagttccatcgcattttgataggctcgataagcggcacgaatcccttggatgccaaactctcacttttaattcggtgccattaagcacctccattgtctgccacattttccctttggctgagaatgccatcgacacaatttgcagttccatcctgcgcaggcaaaggacaaaatcggccgtactgtcgaatcacacattggaccatcgcgtcgaacgcggccttcgaactcggctccatccattggcgaagcttaccgaaagcatcgaattgagtgccgaccgaatctaagcggagcgatcagtgatatccgccgaactgattattaagtcgatgctttccttaccgaatgcgtgggtcaattcgtggccaacaatggcacccaaaattccgtaattaagtgccgttggattgttttggtggaaaaagggcggggagagaattgccaggggaagagtgatcgagttcagctcgggttggtaccaggcattcacctgggattttccaatttaatctgtcgactcttttcggcggttgttgcgaattaccatcattgggagtccgttgaaatttgtgcgatttgttggccctttcaaagtcaaaagttcgagggactctcgcagcaagaaattggaaactcggaactgcgtctcgatcaaattgtcctctgagttcagtggaaatcgttcgcaataagcggccaatttgtggtcatccacgagccaatcggggaaggcgatgttgcgcaccttacagtaccattatattaattacggtacatgtcatgtcattaattaccaatgccaatgccttttcatttttggcatttcccactcaccaaattgtccactttctccgctgcgtttttcttcgacttttcgttcatccattccaattggtccaacatcgaatcaaagcccaccacaacattctcgaccatttcgttcactgactttcgcaaattctgccgagcgcgctccttcaaaagcaccaaatccaaataaagacgtgaactgtgatgggg

SEQ ID NO: 10818 - DNA, 1599 bp, Heterodera glycines
  misc_feature (38)..(38): n is a, c, g, or t
  misc_feature (62)..(62): n is a, c, g, or t
tgaaagttgaaggttcggtgggcagtcaaattaaaagnccatttgcccctctcacaaaaatnggattcatttcggacgattgtgctgcttcttcggccgtgaagaattcgtcgaggtcgaaaatgggctcgtcccaacgggggccttccaattggcggacgaatgaatcgttcggaggaaacacttcggaacaattgggagccgagaggggagtcactctcgaagaacggggacagagtgaggagcagacgaaagttcagataattgaacaaatgggcggggacgaagccgaagggatttccaggctaaacaaaaagcattcggaagggcatttaatttgagcttaattttctaaatgccctcatttttggccaattccgcttctccccaatccctcatcattaattactctgaatgcgttgcttctcttctccattatctccggctccatcaccacaatcgtattccgttgttgcaacattcggtcaaaaacttcccaactggcagaagtgaaaagcatctccaaaatgtaactttgcaggtcaacccaagccaaagattcgtcatccattttcataaactgaaagggcaaaagcatagcaaaacattcattatgaactaattgctccctttttctttttctttgatactttctccaccagcagatccaagtggattcccttttcaatttaaaatcaaagtaaatatttgcttatcaatgctttctgtttcaattcctttgagctcaaatcaattctttgacatggttttgaccgttggctaatgtcactttttaaaaatttaagtgagattggcctagcaaaatcacgaaatcttaacttaaaattaattttaatgtttaaaaagttatttcgaaacataaaacatttaagcatccgccgaaagtgttcaataaatttgtttacaaattaaaatgttttagatgacctcttcttcaattcatgaaaataattaatttaatttaattttaattctcaagtaataagcaaattgaaagttttaaaattaaaaaaaaattttgattattaattattaacgaatccaaactttaaaattttttcgctttaaaaaattggattgaatttgaaaaagaattaaaaatatattattttttattttcattgaaaataaaaaaataactttttctgctgtgtcatcaaattgaaacacttttttgacatcaacaaaaaattaatttgacgtcaaaagtttaaattaaaacagatggccaaggggcgtcaattccttgacgatgttatttgaagtcatttcttcgattttttaaaattgaaacagaaaaatacggtaattgaaaaggccccgccccttctgctgatcgcttcctgctttttctgtctgctctgactgatcactttccctctgcttctttctccccccccccctcccgttttttctctctctctctctctctccctctgatcactttccctctgcttctttctcccccacgcgttttctctctctctctctctctccctgtgatcactttccctctgcttctttctcccccccccctcacggttttctctcccacttttgttttctcaccgtcactgg

SEQ ID NO: 10819 - DNA, 5113 bp, Heterodera glycines
cggtcagaagagttcaaaaaaccaaatctttccaactttcttcggccataaattcgttcaaaatcgaccaatttttttgaatttcgcagtctaatagagcacgttaagagctttcgaacgataccaacaacgttgaatttggttgacaaagaaaaaagttatgccaaaaagccgctggggccgaactgagccggtccgatctacccactatgggtcaagcccagtgttagacaaaattgctcataacgtcaaatagcgtaattggcgtaaattattgcgcgctaattcaaaatgtacactggaaaatgccttttttgtattttttattttgatctgccataactcgcttcattcccaactaaactgaacaaatttggtatctaaaaaaagtttttgaaaaggagaatctttttctaagcgaatgctaagcaatttgacatctcagaaaaaaacccgtactcaaacaaaaccgtttttcaataaattcatactttatacttcagctcaattaatgctgaaaaataacttattaatccgtggcaaatccgtccttttctcgttgccgttgagggctttttccctgtccgctcagtgcgccaacggtgagcccattcgtcgcgtcgttctgatccccggcgatggcattgggcccgaaatttcttccgcggtgcaaaagattttcgaggcggccaaaaccccgattgactgggtttgttgttgtcacatctctcaattttaaccgcccttttgaaggatcccgtcgatgtcacaccggtgcagggccgggacggcattttccgcattccgaacaaatgcattgagctgatgcacaagaacaaagtgggactgaaggggccgctggagacgccgattggaaaggggcaccgttcactgaatttggcggtccgaaagtcagtcaatttccaattaaaaaaagctgattccgttgcccccagggagtttaatttgtacgccaatgttcggccgtgccgttcgttggagggccacaaaacgctgtacgacaatgtggacgtggtgaccattcgggagaataccgaaggcgaatattcaggcattgaacacgaggttttgaaggggagagggggaaagaaagtgccatcaatttattcgtttgaataaaatgcccattcggcaagcattcgttctatttttgtaacgttcagattgtctctggtgttgtgcagagcatcaaactgatcactgaacaggcgtcccgacgcgtcgcccgttttgcgtttgaatacgcacgacaaaacggacgaaaagaggtcaccgctgtgcacaaagccaacattatgaggtatttgtcccttatttttcgcttttctcaaattgcaaattcctttcgcagaatgtcggacggactgtttctgaaaatgtgtcgcgaacaagcgcaggaattcacggacattaaggcaattttggggacaatattagatattcgtataatccgtcgccatttcaaaattttaatacgtttttttcagttcagagaggcctatttggacacggtttgtctgaatatggtgcaggacccggggcactatgacgtgttggtcagtcaaaatgccgctttttgacgcaacatccaaaaccgagtctgtctttgtctaggtgatgcccaacctttacggtgacattctgtccgatttgtgtgccggacttatcggtggacttggtgtcaccccgtccggaaatattggcgaaggggcggcagtgtttgaaagtgaggatctttttattgttggaatgggattgatgaacataatcctgtcaaaaggtgtgcacgggacggcgccggacattgcgggacaggacaaggccaaccctaccgcccttctgctgtccggcgtgatgatgctccgctacatgggcttggagtcgtacgccaacaaaatcgagaaggtcggcactgacggggaatgcctttgctgtcgcattagcatactttcctccaatcccgttggttcaggcttgtttcgacgcgatttcgcacggggaccacaaaacgcgcgacttgggcggcacgggcacatgttcatcattcacggcggacatttgcgcgagaataaagagcatgtgaacgggcgaagagggaaggaatcgctgatcgagactgatttgtcctgtcttatttgtttcccattctttgcccggtcgtaaacttaggcttttttgtttttttgcatctgtctccgttgctctctctctctctctcttttctcatttgtctgttaagaaatcgtctgcgtaataatttgtcagtgcatacgaaacggccatttctcccatttttgaaccacaaaagacagtctctagtcgaagcaaatacaaaagcaattgtttaggcatttgaatgattgaccgagtaaaccatcgtttgttatttctttacaccattgacttttaaatgttcatctcataaacaataaattgttcaccataataaagcaatttgtttgtgatttctggcatattattccgaacaagaaaatatttacaataatttaaaatattttgcaaagaaatataaaaatgaatgaggaaatgactgggagaggacaataaacaaataaccgagctgccaattccaaaaatggaagtgaaatgagtaaagagaagcaatgagtcacatgtgaagcaggaaaaggagattgattgcggggagaggtgtaagacggtgtcatttggcgaaacaattttgtaggaatttggtcagcattgtgtacaggtgccaacggacgccactcaaattgtgcgattcgtcggtgtacacctaagaaaatgagtatgtaaaaagtggttcatcgatgtgcacgaaacaaaagcaattaactcgactgaccattagcctaaattggatgttttcgtcagtgagtgcgcgaataaattccgccgagttctgatagtgcacattatcttaaatggaagacagtgtttaatataaatggaaagacatttgataaaaggggcccattttgcaattccaaatttaccgtcggccgacccgtgggccaacataaatgacacattgcggaacgggcgcacatcggtgctcaggtcggtgcgttcgtacgcctcgggccccgcctcgcccatgtaacgctccacataagtggcatctgtgggggaaagggagaaagaagtccacgagaaaacggaaaacaaaaaggcaccataaagtttaaagttggagacgggggcgacactgaaaaagaggaaaaatggtggaaggaatcgggaaaaagagcagtcaattacctcgccgcacaagagaaagtccgattgacggccaaatccctttggacggcgcgcgcagtgacaaaaccgccataggactgacaatgaagggggaattggttcagtgaaaggcttttgccgcactttagcacaccaagaatttacgagcccattgtccatttttaagtttatataaatgtgccattaccgcctttgttttgaaatgttcgatgtaattgttttgaaccttagaaatgcccttttgccttcactgacccatccccaaatgccgactctcttctcatccagcaatgggtactttcggagcagtgccctgcaaaatataatttggaaaggaaaaatttcaaattccgacctcatcgtcatgatttggtcatccacctccaccgtgccaaagttgccgtacaatggttgcttctgaagccatccctggtggcctgagccgcgtccgtcgatgaacacgacaatgaattcctagggggaaggacggattggcacaacgccaaaaacatgagaagaaatggaactcacgagtttggaaacgaagaaaatgtcgagccaattggcggacgcccactcctccgtcactttctgtgtgccgggaccggcgtatctgagagaaatggcatcaaaatgccaatgggtttcaatggcagttggcaaaatgccatgccacaactcacacgtcgacgagcaccgggtatttgtgttcaggccgcttttcattcagtgaaacgccgtaggggaccaacactttagcggaagtttctgaaaaaggcacacacggtattgactgaatacacagccaatgaagcgcaaaaaaatggggaccaaccgacgccgttgtccaattggaagcgctcaaaatggacagtgggcaatcggtgggtgtgcaacgctttctcaagcgcgtcgtttcgcccaaattccaacactgacaaagaaaaagggaatatacaaagtgatcagacaaaatgtaacagtcagataaactcaggaaccgattgattttaaaatcttttcatttccaatagagatcaatcaaatgtttcgacctccgctctgtttgtacaaattgacaattcacttaatgagtccgcccctccccacccaaaggacgaaaaacagtgaaaaaaggtcgtcgcccgagggggagggggtacccccgcccaagctgaaaccctgggatcgtcaacccagggaagtctatgtcccacccgtctccaatcggtcgtccgctgtgttcagtcgtgccaccagcacaaacggcgtgcccggccctttgcagctcaaatacacaaaacgtccgtccgatgcgctgccgtcgctttggtcggccagcgaactgtcgtggaaagagcaattggaggaaatgttgcaggacaaacagatgggctccaccagtccattgtcaaatgtctgaagaaaaagggggtggtgccaaagtcacataaattgggaaaggaaaaaacgtacggaaacggagggactgacgaagagatgcctttgggagggcgaaggggcggcggcggtgtaaaaactgcagagaaaagggcacaaaatgagcgaaacacagagaagaaaatggtggaaatggcaataatggaagttacatttttcggcgttttctgtccattccgttgatcttcagcacatcgaagtcgcccatggcgaggaacgctttgaaaatgaatggtgaaattgacaaaacataatttttaaaaatttaacggtgacgcctatcagaagcaccaaaggactttttaaaattttcaaattaataatttaccgaaaaaattattaacaaataaaaagttattacccaattaaa

SEQ ID NO: 10820 - DNA, 1125 bp, Heterodera glycines
agcgcaaaaagaacctccgcaaaatgcgtcgcccgccccattgtgtccacaatttatccacagagatgacggggaattcctttattgtcccattttgtgccacaattagcggcttttcccctcgtgtaatcagcacaattcggccccccgttttcctccgttggcctaaaacaaaaaagaaaaacaattgcttatccaaataattattaattatttattccttttaatttctgtcaaaaacaatgcaatttgatgcaaatgatcagttgggttgagttcatttgcctttgcataagcaaatgcttccatttcattagctaaattgggggaaactattaaatttaaacataaaacaaaaaagtttatcagttaattttgagtttttgataaatgaaaacttgccaaaaagaatgtccacaaatggcataatttcgttcaattcctttttgaattttccaggaatataatcggcactcaaattgaataaaaaaggcctctccaattcatttgcttttgtggccaaatgtttaattgcctcggggcaaaccgtaaaaaaatgggccttaataattttaattatattagttttattttattttttgaatcacagatgaataaaaaaattttgctgtatcgattaatttcgcattttcgggcaaatgcaaaaaatccaaagagaaaaaagaagcagcgccaaggcaagcgcaaagcgaactaaaattgggaaaaatacaattaaaattaataaaattaattaattgaccgatttgtggcattaatcagtgagacgcatttcccggtccgaaccccctcaatccgttggaatttcgcttcgacacccgtctcaacggtcttctcgagtagcatttccgcttcggaatcatcgccaaccgaaccgaaaaatattgcacgatcagccttatgaaactatgagctaattaagtgattaatcgcatcattaaacttttttttgcccattgattccgttcaaaacccattggaacaccgctaatttgtgttaagtgctgaaccgccggggtaaaaaatggccgaagtccaaattgagaatttccccctcccttaaatgcccttttatggaaaaaaagagtttaattggattttgct

SEQ ID NO: 10821 - DNA, 3324 bp, Heterodera glycines
tgccaaagccgaaaaaacagccgacgaaccaactgaagaggtggagagagccgaaagcggtgcttatttttggcagaatgacctgaagaagcagacaattacaaaagggtcaaaattgggatggaatgccgtggcaattgccaatgcgccgccaatggcagtcgcccccaacgcatttgggttgaatccgttgctgaaccaatagcgcccgtccacgtccctgctgtacaaatcgggcacccaaaccttctgtttgctcgccttcatttgtggcattttacaatgcccgcggggtaaataaactcttacgatgaaatagccagacaccaaaatgccatgcaaaggcccaattaaagcgccgagaatcccgagagcaaaatgaatggctgcgggattgttataccttaaggggcagaaagattttaaaaatcatttagacaattaccaattccacggggttaataaaactgaagcgatcgctgtgatcattccgccgcctctccatgagatataattaggagccaaatttgaaaaatcaaaagcaggagaaataaaattggccacaatgttaatgccaactgtggcgatctgaatgcgtaggaatttgtgtttttataacagaaaatatttttaattaatttttcatttttgccattttgttgaacattgacagaccacaaaagtcgcccctccgacagagacaacggtcagtccgacccaatcagaggatgatctgttcccaatttgctcaacaacttcgatcggatcagtgatcaatcggccgaagacgggaaaagtggcagaagtgatcagaacggtgagcagagagaagaaaaggaaatttatgggcaaacctaagggaagcgggttaatcaccaataattgactcaataaatttatttttcacccaatttttacctaaaaaatttcccaattttacagctttccaagatttggcataacgcgaaaaatcgccaaaattaagcattgggcccgaaaaataagaaacaaccaacgcaacggcagaaaacattgacgggagagagtcgacaaagggcaaagggtcgccttcggtttaaaattatgttcggtttttgaagtgccaatgccacaccaaccgaccgctgaggttcaaactcaaattgtgaacgccggcgttagcaaccaaataaacggcgagcagaagcatcgccacgtacaccgccgggccggcccagtcgatgaactttctgatggcctccattcccatccaaaaaagaacggcttgggcaagtgacatgaagccgaagcagcaccagccgagcggagagagaccgacaaagccatgggactgaaaatgacggggagaaatggacggggaggagcaaaaagaagacattgtgcaagaagaccagtgatgggaagaacttgagcaaaacaacgataagggcacgggaagccaagaaagtttgtacaccgtaccaagcgatggcaatggaaccacggagcaaagcgggcacgttggcaccgcgaatgccgaaaatggcacgattgatgaccgggtaaggcacgccagtgacctgttgaagaaaagtggaagtgaaaaagacggagaaaggcaacttggctgggcttggccacccaattgcagcaaaaatggacaattagtattccgaggatgagggcaattagcacataaaaaggaaaaaagtaattaaaaggaaaatgaaaaataaataatttgaaaatgactacagcactcactattctgaattctgattgtgagcttaaataataatcatttacttgccatccggacaaacggagggcgaaaagacttccggctgtcagataaccggccacactgtgaacatctgacaaaattaatgttcattctcttttttcattttaatttttgttaattaccggtcatccaaacagcgaaaatgttataagtattccaatgttgactttgcaatggtttcaaatcatcattacaaagggacggatctaacgaagggacgcaatttgcaccctccggcggagaattcgttttacattttgccatttcaatgggtcggattttatcggtgccatttttggaagaagccatcgaaaaaagaatgaaagaatattattttattttcatatatgatttattttaaagtacaagcaaatcattttaagttttgtaagcagagaaataatttaaaaagacacggaaaatggcgaaaagcaaactttgaaagagcaaacaaaaaatgtgaaaggacagaaaaaagaaagaagaaatacattaaaaattcacttttaatgatcaaaaaagtaaagaaagaatttgttattcgattaaaacatctgttgttaaaaaacgatcaaatgaattggaaaacaaaaatttcttttgacatttcgacgtaatttgataactaattacctaaatggaatgttttgttaaatcgattgtctttttttaaaattttctatgaattgggcaaatccaaaactttgggcccgatgatcgattaccgtcgtgtgggaaaactgaacacaaattgcataacacaaatgagaattagtaattcgaactatcatttttataagattattttcatatatttttttttattaataattcgctatttttttaatttaaaatcaaattataattcaaaataaaattaaaaaaggcataaaaaattagctttgaaaaagaaattttattggcaaaaataaaaatgtctgtttttgttcacaggaatggactcaaaaagaatgaaaggcgaggcgaatgaaagcgcataaaataaaaaatgaaatgcgaatgaattcgattaatctctccgattaattcaaatccctccgtcggttttcgttgtttttggttcgttcggttcggtcttcatttatttgctgcttttcttcctttgcttcttcacattagcattgccaaacgtcgttctgccggcgtcggcggttgtggccgcggcctttcgcgaagcgcctccaaccaaaggccttttgtggccgcgtcgggacagctgaacacgtagtcgcgggcctggctggacactttgaacgcgttcctaagggaagcgccggtgatcggctctaaaggggggggggggggggaattagccgaacagaattcaaatttgagggtcattagcagtctctgcttctgccgaccttttccgtcgtgcagctcctgcacagtgactccgttcagtgccattctctccttaaacaccaattggtgcctcctcagcacgtcccttcggcacagcacaatcgtctggtcgaacagataagcgtgcacacttttcgcccattgcatttgcgcgc

SEQ ID NO: 10822 - DNA, 1387 bp, Heterodera glycines
cgtcaaatgccgaggaagtggaagatgaagcggacgagtccaatcgctctgttgtccgttttgcttccgcttttttcgttccgccttcgtccgtgcagcagtcctcgtcgatgaagtcgttcagttccgttcggttgtgctgcggttggcctttgctttgtcctcctattgccaattcgcggctccgtgcgcccggctgagagcgcgaacgacgcttatgcgaagcggagaaggcggacggagcggagcagcagtcgccgctgtgttggttcagctgcggacgcgagtcgtccgcgtcgacctgccaaacggaaataaataaaagacggacatcagcagaaaaaatggaaatgatcaaaggaattgagaaacaattgaagtaaattcacttatttataagtcaatcagagaatgattaatggcttatttatttactaatttaatattcgatttttgtttctattaattttttgttttatgctaatccaatcgattgacagtcacaacaattcgataatcgacgggaatttttcgttggacggaagagttttcgataatggatgtggatgttgagctgctgatcaacagagaaaggcgggagagaccgctgctgtgccgattggatgcccgcccattaatcgtccacctgatggaccgggaatttcccggggcggagatgggccggcggcggagggagtcgcgacggccgaggcatgtccaacagaagcagaaggtcggacggaggtgcggaggaggagggagaagaagcagggcactcccggaagggctgccgaaagtgaagcccaggggaaagacgacggggcgaacaatgggaagggtcgtcgacgaaaaaatagttggaatcctaggggaggggagggaaggaattggaaaaacgaagaaaaatggggaaaatgttaaaaatttggggaaaactggccggaaaaaagggacacaaaagaagcccatcattaattaaatgtttaattaataaattataaatgagctccatatgttcacatttcgctctctttgatttttttgtgatcgaaacgaaaatcgaaaatcccatcgaaaacggacaaaacgaaggaacgaaaacggagaagcgaatgaggcgaagatcggcgcgggagagacaatggcacgacggaatgaataaatgatcaagtgggaggagggcgacgaacacttttatagtgaaaacgccgaaggcgaagagaaagaaatttggaggggggagaaaagaatttattgcttgagacattctttttttattaaccgttttatgaccaaaattatttgtataaacggaaagtcaattcgaatggaaggacatttgatcaatggaaaaagcaattttaaataaaaatgaaaaatttaacaa

SEQ ID NO: 10823 - DNA, 2878 bp, Heterodera glycines
ctgcctcccatgcccgtaaacctgaaaaaatttgatgggaaatcagcgaacttttttgagctttaccatagaaaaaacgaatcaggcggtgacggtaaatgctgccgagaaaaatttaaataaattttgtcaaggggttttttggtgattgttttggatttttgttctatgttcatgattttaagaaccatcgaatgtatcgttacgctaaattggctcacactgatttcattgacattacaacatttgaaggtttgtttttccgcgttcgtctatgttttaaaaaataaaatctcaacttaaggccatcaatgggtgttttgtgatgcgttagatggcgaattaaactcacttaatccgggaggggttaagaaattcattgcttccattcaccaaaattcgcatcgacggcgccttagagtcagcgcaatttcttcggtggaaggtaaagtttcgaaaatattttatacaaacatcttaacaattgaatggttcctatcatttttataggattgactttgaaacgcgtaattttacgacttttggcatcaaaaatttttgaccattggaattccaccgattgttgcgattgccggtcaattggactttttcttgaaactcttcgcctcccggtctgcattcaggtatttgtcacattggattcaaatgattgtgatttaagaaattttgttcctcattttttgatttaggttcaattggccaattttctcatctcttgtattctctaccaattcaaatttgactccaaccgttctaacattggtcaaaaacatttatttgatggacttgtaaattttattcgatcgaaaactcaaatttattatgagaattaaacgtatgcttgagattggccaactgtaatttcgcaattgtaattaactaaagtgtccattattagtcccttttattcaatgtttgtatcattttacttgtgtaaaaagttttagcttcccttccaaaaattaaattaagtgccttaaaactaattggttaaatacctactaaattaaagcctttaatccactttcttttttcttttactgctctttttatgttgaatccgtctgtcaacaaaattcacttctccaaaggtaaattcagttgtttttcgttttcattgagttcgttcggtttattttcttttccccagtgaaaatttcagaaaataaaatacctaatttcttgtgaagttctcaaagacccattttgctttatgggatgctcattgtcatctgctataatcttttaattcgttttttggcagatgaattggacaagattttgagggatgctgacgagcagagggattttcccgcgttgctccgttcgcttggccaattggcttttcgtcccaccgatggcttttccttcccttcgtccgctctctcccaaatggcttcccatttcgcttcgcttagccctttctccgcttttcactgggccaatggactcttcgctttgctcccatcagcagaaaaccatgccaattccgagtcggttttccttttctccattaataggccctatcatcctgaaagatttcggggaagcaccagcggacaaaacgagcttttttgtcaagattcctccctccggaattttctccgttcttcagagtgctcattgtttcgcttcttcgctcgttggttgacaatgtgccccttctgaatgccaataaattgcgtgcctttgtcaaaactgaaatttcgcggcaatgcgtctcattttggcaaattgggaaagcgcatttggcatccgcactcactttatgtgtgctacgaatcttgctgatggaattgtcctatttggaggcaattcaaaacggagtctgtcgtgccgatttaatcgccgaagcgcagaacatttggtcgcaaatgctttctgctgatgaacttttggtcgtttgtcacttttccggtgcgattaactgacggaaaacttttcagaaggtcgacccgggtgccttccttcgactttcttcgtcgcttttccattcggcacttggcttggattatccactgacaaattcattagaagcaaatatcgttgtttgccttaagaaatgctcaaatgaaatgggaagtcaaaatggctgcgattcgctttactgtgcatcggtcggtgttcttttgcggatgtccggacaatccgtcataaaacttaattttaggaattcgccaagaattgtaccaaatatccttggaatggcattcctagtaatttggcggattgtccgggcgccgaaaatgcgatggctcaaacattccgccttaaacctcgtcgttcagctctttgatctcctttcggcacatttggcgaccttttgccaaattcttcctggcgatgtctgtcgtgcgatgtttgaatttttaatcgcccattctgaaaggcatttttgaagagacttcatttgttagcaataattaatttttgcagagataatttggagattttgctgaagcaattgactaaaaattcagccattcgttgcggcgaatgttgcgagaaagtcttccgatcactttatgatttgccgatgccttcgccttcttttaatttggaggaaatttggagcattgaaacgaaaatcagcggaaagaaagaaactcaggcgcaaaagattggttggcatttgggttggtcattgcttttatcttttggcacagatgagtcgcagctgagttgggcttcgctgctttccctttccgacgaatgtttggccaattcgctcgtcggcgtttcgaatgccaaagttagcaactcaaatgcactgattgtctctttttctcgctcagattgaaagcattgtcctttctgccgattttgctgttttccaaccagagattgtctccgtctc

SEQ ID NO: 10824 - DNA, 1736 bp, Heterodera glycines
  misc_feature (353)..(353): n is a, c, g, or t
ttatcattccttcccataaatttgtttgttttcccatttcagtcgaatttctaccgacggactctgagggaatggcccgagtcgcgttttgccgatcgtttggagcattcgctggcattgctttgcagagaaatagtgcgaaggaagaaatgtttcaataaggtgagaggcccatgcttatgatctttgtacgttccttcccatccttttgttatggccctgttttgtgtccattggtacgccctcgtggtccaaccccccccccccccctcttattgtcgtccaattctcccatcctgggtaatccccccccttatcgtggtccaattcccccatcctggctaatccccccncccccttatcgtcgtccaattcccccatcctgggtaatccccccccttatcgtggtccaattcccccatcctggctaatcccccccccttatcgtcgtccaattcccccatcctgggtaatcccccccttatcgtggtccaattcccccatcctgggtaatcccccccttatcgtggtccaattcccccatcctggctaattctcccccccccctccgtttgtttggctatgccccctaaatcgcccctttcgactaaaagccttcgtgtttcagcttctccccttcgtcatttcgagttctttaaccggcgatcgtgagctttgttttccgatgtatttacttttttctgcacttgacgagaatgacttggcattgctcagcagcaatttgagtgccgctgaaaaactcaaattcagccgactaaaagtgcaattctatgcgagcaacaaaatcatcggctgacaccacttcgccttgtccactcatttcttcgcttgttattttaccgtttatttgttacttcggatttgcatatttccaaatattttatgacaagcaacaaacattttctgctctttgatcatactgttgaagggcaacgaccagtaactgaacagtcacactttattttatcccttttttgtgcccatttcgccttcgttactcacacgtccggtggcaaaggttcgtctttgaaaagtgtgcgtttcgtctttctgtacactgtctccaccttttgctgtgtttggaccaattttcgcacatctctaaaaattaattttgaattgttgcagcggtgggaaattcacctgtcgaagacgtaaatggtggcgaagacgccgagggagcggagatttatgccgtcctaagcaagtaattattccgttcggtcttttgtttccgttcggcttttcctacctctgtctgaattaggcttttgaacgtttctttggtcagcccttggctcttgagcatttcctccgcgttcggcaggcaaaagaccaattccatgttttcgtatgtccctgggctcagttcctgcccgcaactgatcgactttccgtccaccagcagttgtgccttcagtcctctgttctcttccaatgtttggcatgcgtcgcaatacaaactgaaaattccgtcttgaagaatcatcgaaattggctggtgaccacgagccgaagccgccgcatccgtcgtctttgcgattgtggcacggttctggcacctgctttttgttggccgagctgcgcagttccaagtaaatgctgaactcgcccttgaattcggagaacaccgtaaccttggaaaggaattggtttcgcggcaaagagttacggtaccttccctccgatactgtagcactgaaaaggggtgggga

SEQ ID NO: 10825 - DNA, 1032 bp, Heterodera glycines
  misc_feature (5)..(5): n is a, c, g, or t
aacantttgccaaaaacattgccaaacaggcgcataccaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcagatattaccaatgtttgcgcctgtttcttattactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcagatattaccaatgtttgcgcttgtttcttattactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttcggaatgttctgcccatgtttttgtttcatattttctggatgatttagcaaatattgccaatgtttgcgcctgtttcttataactcgaaaactaactcgaaaatattgacagagagagattcccaacatttgccaaaaacattgccaaaacaggcgcataccaaaaacaggcggaatgttttgggcatctctatcctggtttttagcgttttagccgatgttcggcaatgtttgtgtctgtttctggtagtgtatttgtcaatgtttgggaatgttctgtccatgtttttgtttcatattttctggatgatttagcaaattattgcccaatgtttgctccctgtttcttataac

SEQ ID NO: 10826 - DNA, 3292 bp, Heterodera glycines
aaacattgacagagagagattcccaacatttgccaaaaaacattgccaaaccagccgcataccaaaacaggcggaatgttttgggctaatgtttgggcatctctatcccgttttttagcgttttagccgatgttcggcaatgtttgtgtctgtttctggtagtgtatttgtcaatgtttgggaatgttctgtccatgttttcgtttcatattttctggatgatttagcaaatattgccaatgtttgcgcctgtttcttataactcgaaaactaactcgaaaatattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgccaatgtttgcgcctgtttcttataactcgaaaacattgacagagagagattcccaacatttgccaaaaacattgccaaaacaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcagatattaccaatgtttgcgcctgtttcttattactcgaaaacattgacagagagagattcccaacatttgccaaaaacattgccacaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcagatattgccaatgtttgcgcttgtttcttattactcgaaaacattgacagagagagattcccaacatttgccaaaaacattgccaggcgcataccaaaaacaggcggaatgttttgggctaatgtttgggcatctctatcccggtttttagcgttttagccgatgttcggcaatgtttgtgtctgtttctggtagtgtatttgtcaatgtttgggaatgttctgtccatgtttttgtttcatattttctggatgatttagcaaatattgccaatgtttgcgcctgtttaaaacaggctcaatatgttttgggctaatgatcgagtatcgctgccatgttttgcgagttttagccgataaaaaaattaagttcattaaccacttgatattttgtgctattgactacagcttgactttgattttaatatttttgtttgttatatttttgtgatcattgatcttctatagtttgtatgattgaggataacattgatctactaaaacctagttattttaaattaattaaccacatgttaaaaaagagatttactaggagtaattcactacaaatcccttgtgttttatgataggtggctgcccgagaaattggaggtatgggcgatgtttgtaatttaattatttaatttccaaataatttaattaaatattgataaaataaaaaaaaagaaaaaaagtaaaagcctttagttaaatacaatataattttgaagaaaaagctttttgtttaaacgcttatcgcttcattatttagtcagtggcccattcctagttagccattagatacaaaacacataattatggcagaatttggaattggaattcgattattcaccaacgtcggattcggtcctcttgttgtgcgtgataagatgaggcaaaattgttagccatgtcaagcctattaagtttggattcactttttaaaatttaaataattgatttatgttgattaaacaaaatattaaaaaaatgaccagcgcatgagcggaatgtccacggaacggtcattgacgcccgtctcagagccgagcagagagttcccatttttattgaccaatcgaatgtttccatcctcccattttatgcctgaaatgcaatgtttttccttttaaaactcattaatttttggacccctctcgttccatttccctcccccgacaaatcccaaaaagggattgtccggcgccattttctctctgactacaaatcggtcgaaattgttcggtccccccgtgtcaatttgggctcgtccttcctcaaccgctttcttttccacctgttaaaatctcggtgttaaaaattcaaattcactcaaaaattattaactccaaaaaattggctcaacggctccaaaattggatttgcgcgagtgtccacttgttttggctgttgttcttggcgcaaaaaagacagccacggcattggggcactatttaaataataattaataattccgagtaattagtttatatgtatatatttcacagcttttgatacaatttcatattgttacatattttaagctttttgaaattgtttataaattttttatgaaaattttttgtgttattttgcatattcacgcttttttacattaagaatttattgtcaaaaaattacttttacaaaatttatttgcaaattttgtgcttatttaggacttttttttacagatttcatatacattttggcacttttgtatttttcgggttttcttacataaaatgacatcccttttctaatgtgcaactaaattcaattaattaaaattcgcccgattattttccaatttcattgaatttattcctttctaaaatttaaaaaggatcttagacatattctaattatatgtattaataattagggctgggatttttatgttttaacatatttttttgtggcttagttatggcgagagaagcccaaaaatagcattttctccgaacaatttttgatttagagcgacttataaaaacataaaaacacatattttggcgttttggcacataaaaacatatcgcacatatttggactattttggatttttagcacatattttggcatttttgagaaaaatcataagaaaaatacaagaaaatctgaaaatgcaccctaaaaattgactcctttacgtttcttaagcatttagaaaatttctttatatatttaaatgcctaaagcagccaaatcggaaggcgtgttaaatcgtcgtcactggatttcaaagttcccg

SEQ ID NO: 10827 - DNA, 1824 bp, Heterodera glycines
tcccgaagaccaccatcgcttttttcccatttggggccggaaactcatttcgtccccagaccatctcggacaaatcatcttcggttcccggaaatacatcttcactcatcccgacggaagaagtaggacgaaaaaaatctctaatttaatctctaatcactagatttcgggatagctcactttaaatctcgaacaaatcgtttttcttcatctcctctcgtaaatcgtacacttaggggcccaaccgttcgcagtgattacgccatcttcttttcactaacgttcagccaaattcgatcgtatagcgatttgaattatttaaataattaattaattacaggtactcacttcgaatatttcggtttaccatttacatcctactcggcaatcgaaattcgaattaaaggacaatttcgaaaaaaacaggctaatttattgaaaataaaattatttattatttttttgttgtaaaataaattttcaaaaattagtttaataaatcgaaaatttttattatttgaaacttaatgaaaaagcttaaaatttttaaatgttagaaaattaattaatatttatttatcacaattagacttaactattatttttgtgtataattaatttagtgtcggcataattctacgaaatgcttacaaattggcaatacaaaacattggtgctgatgatgtgttcaagaacaacgaaaaacccattgatgaacaagtggacacattaatggtaactaaaaatctcgaaatagctcaataagtgcaagggcttctcagccaaagggccattcgatggacgattaagatagggtgctgtctcgggaccattttttcatacgaccgtcccaattttggtgcgctttttccaaaaaaattgggaaatggggaagggatccaaaggtgcagaccggcaacgccgggaagaatttaattttgcgagaaatttgttaatagattttgtacaaaaatgacggcaaaactaaacatttattgtaatttgacggcaattatttattaaatataaaaattgagaaactgcattcgggtgcatgatggaccaggtgatggaatttgaagtcgaacagtggcggcgaaagtgctccagcatgtggacacggaattggtcagcagtggcgcggaaatcagcaatttgatcagcagaaagcaaatcggccacggcaaatgattggagttttgccagaagtttaagcgtcattagaatgttgtcgcggcgaggtgactgtggcaaaaattccgtgacatgcattggcccgccatcgcgtaaaatattcctaaaaatctcgatatctaacaaaaatgcaatttccaaactgaccgtacgtgatacccgctgtattcctggcaccatgcatttttgtaagcccccaaagcttgcaaccgcatctccagctgtttggcgtgtgcaaaggtgtcgcaattctgtgaaaatcccgaaaaaaactccttggcatgcgacgatgtgcagcgacggtggaattgtcattgaaggctcaatgttgaaaaaagggctgaaaaacattcaaaattttgtaaaaatcaaaataaaggcgaactcaaattgcattcctgcacattgtttgctcatttgtgtcacatttgtcccattttgaacgccttcttgaaattgagcagcttgtttcctcatccatacaagtgtccgttggcgccccaggtcagatggcaaattctttgcttcacagcaaaaacaaggattagcactggctgctccacggtgtccaaagattttggagatgaacatcaggtcgccggtgagggaaattggacagggagaccatca

SEQ ID NO: 10828 - DNA, 4240 bp, Heterodera glycines
  misc_feature (229)..(229): n is a, c, g, or t
  misc_feature (235)..(235): n is a, c, g, or t
  misc_feature (4151)..(4151): n is a, c, g, or t
  misc_feature (4195)..(4195): n is a, c, g, or t
  misc_feature (4210)..(4211): n is a, c, g, or t
  misc_feature (4219)..(4219): n is a, c, g, or t
agtgtcggcataattctacgaaatgcttacaaatggcaaatacaaaccattggtgctgatgatgtgtttaagaacaacgaaaaacccattgatgaacaagtggacacattaatggtaactaaaaatctcgaaatagctcaataagtgcaagggcttctcagccaaagggccattcgatgaacgattaagacagggtgctgtctcgggaccatttttcatacgaccgtcncaattntggtgcgctttttccaaaaaaattgtgaaatggggaagggatccaaaggtgcagaccggcaacgccgggaagaatttaattttgcgagaaatttgttaatagattttgtacaaaaatgaccagattttgagaaaaatttcagaaattttcctcttttacaccacctccacctcttttacaccgacccccttaagacgaaccatggacgataaaaacgaaaaaattgccaaaatataattggcgtaaaaaacaaaacgccaacacactcaaattaaaaacaaagtatatttgatttgatcaaatgttttaaaatcgtcaaaactcattagaaatcatagttattgagggcaaaactaaacatttattgtaatttgacggcaattatttattaaatataaaaattgagaaactgcattcgggtgcatgatggaccaggtgatggaatttgaagtcgaacagtggcggcgaaagtgatccagcatgtggacacggaattggtcagcagtggcgcggaaatcagcaatttgatcagcagaaagcaaatcggccacggcaaatgattggagttttgccaggagtttaagcgtcattagaatgttgtcgcggcgaggtgactgtggcaaaaattgcgtgacatgcattggcccgccatcgcgtaaaatattctaaaaatctcgatatctaacaaaaatgcaatttccaaactgaccgtacgtgatacccgctgtattcctggcaccatgcatttttgtaagcccccaaagcttgcaaccgcatctccagctgttcttcgtactctgtcccatggcgtgtgcaaaggtgtcgcaattctggtaaaatcccgaaaaaaactccttggcatgcgacgatgtgcagcgacggtggaattgtcattgaaggctcaatgttgaaaaaagggctgaaaaacattcaaaattttgtaaaaatcaaaataaaggcgaactcaaattgcattcctgcacattgtttgctcatttgtgtcacatttgtcccattttgaacgccttcttgaaattgagcagcttgttgcctcatccatacaagtgtccgttggcgccccaggtcagatggcaaattctttgcttcacagcaaaaacaaggattagcactggctgctccacggtgtccaaagattttggagatgaacatcaggtcgccggtgaggaaaatttggacagggagaccatcaatttctctgatgtttgccagttgccgtgccacgtccgaaaaagcaacccatatgccaacacttgtttcggcacctaaaaattgtacttgtaacctttagaagattcaactgttcaaaatatacccctgtagcatccgagcaaagtgaaatttgaagctgccgcatggatggtccaaccggtttgggttgaggcttccattgtcggcgtcgcgcattaaactcccacttctgctgttgcgtcccatgccggcggaagttggtcatcaatggtcaaattctgcgacatttggacataattgtccaactgaaagtcgaagtccactaaaaattgaatatttgatatttttttataaataaaatgattgaaactcacttgcatggtcgtaagtctcttccacctgctccgcttggcccatttcttgctgctccatctcggcttctccttcctcgtcgtcaatttgttggtattggactgctgaaattagtttgaaatattttaggacctaaaaatccgttgaaaaacatacttttcttagccagataggcttgtctcgccttctccgtctgagcttttctttcctctcgcctttttttcagttgttcagcacctcttctgccttgaagcttaagcaataatttttttagccataataaaaaatttaaaaaatttcagataaatgcgaattaaataactttctaggccaaaatttttactcaaaacactgaaagtttgcacattttccttttctctatcgatatgtaaaatttggtgtggatttaacaagcagaaaaaaagttaaacaagatgaagtacctaaatgttgttcattacattattaaaaacgaagagatagtacataaaattgagagaaataaagataaaaagtaaatatgacagaaggccaatttttttctataattattcataaaaaatattttttgccaatttttttttcttttttaccatccatggaacgaggcaggggcgttttttgttgcttttcacttacttttatgcgacgcatttttcaagaaaaaaatttgaggaacagggggtccgcggtttttgaaaattctggtccgtttttttttttttttgcccctatttccttcccagttgacttttgttcattttctagcgaatcggatttgcacttttaaaaaatgttcagggctcggcgaaagaatttgttacgccaaccatatttttccacacagtgcagcagaaaggtgggcaaatggacaagcctttaaatgcttcagcaattgtaatccgttggaatggagcccagaatatttatttttcacgaaaacgaaacatgaaacgaaaattaaaaaactcgaaaacgaaacgaatttttttcttggacgaaaacgaaacacgaaaacgaaactcaaaaagtgatcaaaaaagggacgacatgaaaacgacacggaatttcgcacacccctgctccggatgatgaaaatttaaaaatatttcgacattttggttgtggttaccttattttgggctttcttctcatgtgtttttttaatccacaactttcaattgaattttccattttaattattattttttgctttccccaggaatgagtgttgtcactttggccaacgaaattgctcgacgcgttcgcattttctgttggattttgaccggcaaacagaaccaccaaaagcgggccattcacgtgaaggcgacttgggcaaaacggtgcaataaatttgtgttcatgtcatcggaggacgatccaacattgcccgctgtgaatttgaacatttccgagggcaggtggcgtatttaaaaaaatatttcaaaaaatttgtttatgcgtaccagaattgtttcgggtcactcgaaacccaatatttttctcgtcccgaatcccaacccgatgattttgggcgggattcgggacaaaaaagaatttatattaaattttttgaaacgattgtgttcaatttccgagggcaagtggcgtatttttaaacaaaatattacaaaaaactcatttaggcgtcaattaatcctttcaatgtcaaagtgtggaaactggaattgaaggtctttgtaatgaaaaattttaattgcctttttcatgcctttttcgggattttcgttacttttcatggcttttttcaattatttggtgcttattatagtgccttttcgcgcctttttttgcggtctctagttatgacctaacggagggcaaattatagtctatatgaaagggctcctgatgtcccttttacagattgagagaagaacttttctctaactctattcaaatgaacacaaatacaatttaccttaaatttacacgatttaattgaattgaaaactccgagctgacttgaatgtaaatcaacaagtgcaaacaatgaatgtgggccaggtttttatattttataatcgataaggggatgagcaaataacgtggaaaagataagcacaaacgaaacaaaaaattgatgactcagagaaaatggatgaaaaaagaatagtgattatgagatgaacgagagaaacattatcgacaaaaataaatacaaattagattttaagaaatttgagtcgctttccgcaacatcacttctgttgtcttcctccatatgattcttttcactatctgctggttcattggatgtcgccgaaccgcaagttgaggacggttctccaggtgtcaatccgctcattgngctcggtgacatcagaagaatgaaagtcatccctcctccggtgntctcaagacagctcnntgactcgntgtctgatgctaattaacttg

SEQ ID NO: 10829 - DNA, 813 bp, Heterodera glycines
gttcaatgcctatattggccataatttgacgccgctcctcactgttcgaattgttgctaaaatttcgaccaaattggactgattttgtccttggcctcccttttcacctgtcctccccagccgttgtcccattgttgccaatcgtcgtaatttacaatttccccaaaatcatgagttgccggttggccagcaccataaatgtccattcgagcacggcgaccggatttcctccctcgacgtcgctttcgtcctattttttgctgttaaaaatctgacagttgttcaatttgaaataaatttaaaagcactttttaaaattaaaaatgacaattagtaggttttcatagtcgctaatcagaatcaagcatccttttcgcaccccggatcaaaatccgaacaaaaggtgaattttttttattctcgaaggcgaaaaaacctctaaggaatgaaagatcactgtcatatccttatgaacgaatcccataaattttctattttctacttattcattactcgttttttatttagaaatatgaaaaaatggaggtctaaaggtaaatatgtattttatgaagtaccatttcgaatgagtcttcgtagcaaacgacatcaccatctaaaaagtcttggaataagacatcgtggtactagtgcagttggtacgccacaaatttttttttgtttaaagccatataaaaaatgttcctagggttttcgagggcgctgattatgaatccgacctccatttcgaccaattctgagtcccggactcaaactcgaacatttggtcgataagtcaaaaattctcaaaaa

SEQ ID NO: 10830 - DNA, 4521 bp, Heterodera glycines
agttgccctatattgttgattatatttatttgataaaaaacatttttttgggaattttagacttttcgacaaaattttagaatttgagtacggggctcagaattggtcgaaatggaggcacggattcataatcatgcaacctggaaaaccctagaaacatgttttatacgactttaaaaaaaaattattgtggcgtaccatctgcactagtgttcccccctcgtttaactgaaaagatctgacaaaaaagttatatataaaaatgaatgattatctttcaaaattaatttggaattacctcgttctggtagaaaatgacccgagccaagcggaacaaaatttgcattcgaattgtcagagaaactgagttgtgcgtgctgactgattgtgtgcgggaaagggcgaccagagccaagtgggacaaaattagaattggatgaagaagcggcgggttgctgatttggatagtcaaaataagcattgtatccaccaccgttggggcttaaagtcgggtccgcatcatacgaataaaagttgccaatttgctgttgcgggtggtcactgctaacccatccactgctgcttatgttgctgtacattgtgaaaagactctaaattaccattaattcagttttatgtgaacattaaaaaataaaataaaaagatttaatgcaaccgaaaagaatggtcggaacggagctaacctaactttaaattatccgaacttttggcgttttgtaggcatcgtttttttttgaacaaacaccaaaatacctgcgcacgtacttacacactagcttcgaaattagctatttacataacttcttttaagaatacttcatatttgattataactctttttttgtctcttcttcaatgtcaaaatcagttgcatcaaaaactggcagcacaacaaaggtaattggactcgaatagtttactcgtttttaatatagaaaattaagcggaaaagaaaggccgacggaggagggaccaatgaattggcatctgacgaaatcaaaatggggaggaaaaatgtgaaaaccgccaaaaaggagccgactacttcaagcgcagacgacaacgtattacttaaaacggaggagacagaattggaccggaatgaccgggccgaatcttcgccctcaaccgcaacacaaccggcaatgatgccaaaagaaatgtacaacttttgtaaggtctggcagaaacaaattcaaaataaacaaaagcagatcatgaaatatgttttgtttctgtttcagtcgattttggaaatcgaagagaaaggcaatgtcaacttaactcgtctaaagggcaacaccaaatttagccaacttttgcgggacaatccgatgtttgacgacagcgttgacattaggtaatttgaactaaattcgacaaacaaatgcctgaaatggaatttattatttacaatcggatccaagcaattttaagcatttgggttcacaatcatcagtagatgtttttttcttgtttgttaacagattaaccttcattttagtgcgtttcaaaattcatttacgcacttttatcgctgggctaccattttgtcagacgtttcgttgtcgaaagcactgcacacggtgatggaatatgcccaaagtgaacacatggtgttcaggtggttctcgctggataaaaattcattgaaaaacttctatcaggcacccaaactacccaaagcgaccgcaaaatgcattcactcgttttgcgcaactgaccggctccaaccccttcaagtcgaacgggcaaacgagtgctgattataagaacgaccaagtgattggggtggaatggagcagagggaacttcaattgaatgataatgaagttaccaaaacaagcaattttaaggatccgcgggtggtgaaagcgaagcaggaatatgcaaaggatcgcgaacgctatctgtttgattttcttccatttgcaagaattgttttttattattatttcatattttagagccaaacttcgagaatttctcaatagccacacggatgagcttttcgaggggcaaattcaatatttgcacaaggaaatcaaaaacacgcaaaagtccatagaacagaaggtgaaatcgcattaaaaaatatttttgttaattgttaaggcatctttttttaggcagaaaaaatcgcaaaataggattatataggcacaaaaataggtaaaaaaaaaatttaatttattaacactagtagcagaactcgtaataaaatatttaattttggggccaaatttttgagagaaaaaaaattcaattcttacattagtggtatactttcttaggggtgtatttttcgtttttattgcatttttgttaaggattttttcgaaatcctgaaaataggcacagtgcaaaattttaggcatctgcctaaaaaggaagctcggaaaatattcataaaacaaatcagagtcattcttttaaggaaccaccgagaaggcgaaaaagcaatggcattaaacagccgcagaaacaattgccaaccgcgttcgatttgtacaagcgatcgaaagggcaaaagtgagattatttattacaaattcattttgagatctttgttgggtgtgtttacatgaaaacacttctttagttccttcccctaatgttgttttataatccacaaaaccttttagcaggtacgaacatttatcctcggaagaacgagaggccaaattgcgtcgtcacttcgaaaaacttagtgctgaacagcgtgaaatttacgaatctatcgcggcttcattacaatgatcgattattttgagttgaaatttggtggtcatttttaagttcccaaaaataaatgatttttttttaccaataataccaaaatttgcttccgttttccttcattttgcctgccaatttgctgatcatgaaacttacctcttttgttattttctcgtttaattgtagcaaaaacataaaaaaatcattgtatcatcggcgtcactaacaaagtatcattaattaataataaaccctccttaaccttcccaatagaatccattggattttcctgatctgatttatttaattataggtaaatttaggcgtttctttgcgcagttattctctcaatcgatgacctaaaaattcttcaggcgaaggggggtggggcgatggcgaactttgagaacgaatccatccgtcagcccaacgacggacggaccatcgctttgccccttcccattccaaatgtttctttctttctttcatttgcgattggttcggtatagcagagggacaccaaatgatttgtggtcaatctttgcttttatttttgcctttattcgtttttctccaacacttcgattcatcggcgggaggagaacaacggagttggaaggacgaggacggagtggaagtggaaatcatcaaaaagatcccgggttggtgaatgaaatgggaaggggggatggagggagggaagggccgaaaatgacaacgaaacgaacagattcaaagtgcaaagtgaagagcgaggcgggcgacgagttggagcagtacttcaagctgacggacaaagagggcaaactgatcggatccaatttcggacagaaaccgtaagacaggaaaaaagggaggagggggggggggggggttacgaggacaattggtggtaattgacccatttagctataaatttgtgcttggccatgggcaggccatccgtccgatggacaacgcaatgcgcggaatgtgcgtgggcgaacagcgccgggtgaccattccggcggaagcgttggcggaaaacgaacggccccagggggtgggcgaggaacaagcgatgcattactttgtggagctgaagtccatctttcgcgcagtgcccggcgagaaatggatggaggacgacggacttagcattgaggcaggaaatattggaagaaatgggggggggggacaattcgacacaattttaagtcccaaggaccaaccaatgctttttctttgttaggtcactcacaaaatagaggaagacaaatgtcgacgagcggagcccggcgacttcataaagcagcactacaccgtccacctgcaggacggctcctacgtggactcgagccacgaccgcggggcgaccttcgatttcaccctggggatggggcaggtgataaaaggcacgaaaagcaatcaatcacattttgaaatcaccatctttttttgttccgtcccccacttcgatcgctcttttttattgcagcaaaaggaaaagaaaatgggatcgaattcgccatggacaaataagagactcatttaggcatggaccgggcaatgaccggaatgtgtgagggcgaacgccgaaaactgatcattccgcccacgctcggtatttcccattttttggcatgacacagaattggaaatcattttcagcctatggcgaaaatggacggcccccggccattccgcccaactctcaattgcacttccaaatcgaactgcaaaagctggtcaagaaggacgaagagaaggaactgtaatagg

SEQ ID NO: 10831 - DNA, 2309 bp, Heterodera glycines
atatttattgaaaatgtgaatttttttggtacaaattctgtaaacaaattagttaaaatcacaaaatttggtcatttttttgaataaatctgttaacaatacagaaataaattttcaaaatttttcccggcggcgcctatcggcatcaccggaccaccccactgttcccgaaaagttttttggaaaaagcgcaccgcaaaaaagtggtttaaataataaaaaaaattggtcaattaataaagcgtttatttgtaaaacattatatttttcatgctttttaaaagtaaaagtatttattttcatgaaaatttttttgaaaaaatggattttttatgaatttttcaatacccggttttaccgggtacccggacccagacccggtttaaaaacttggacccggacccggcttttctggacccggaaatacccggacccggtttttgaccaaatacccggacccgtctaaccctagtaaaaacgttccgtttgccgcattccataaaaatgtaatagtcccgacaaaggaaattgctattgccccaccgactcctcggcttcggctcatcaagtctctcgaacaaaaccaaatttatgaagcttcggtttaagaaatccccctaaagtcagaagtgccttttatcacgccgtatatatagacaaataataaatactgacaatgggaatagaatttaaaagatacaacaacagacaaataattaacaaaaacaattcgaaagcttcggcaaaagggcagtgtttgtcatttgtcaaccgacggcgtccttttctgtctcgtcgagtcgcccctccccgccggaggcgaattttgccgtttcctccgcaaggagtggcgttggttctgtcctcgtgtgccagacaaaaacttttgtgcaattgttggctttcgcttcaaattcgtctatcgttacattcagcgaaatcagaaaatgtgactcctgaaaagcgaatgacaacgaattattctgagtttaaaaaaataaaatcaaaaaacccaccaaataacccctcggggtttggtaactgaagccaccgcctgcgttagtcagaattcgtgaaatgttcacggcgaagctggccatgtcaattggaaatggccgttggcgtttccattttgaattgaagccgaaaacttttgctacaaaaaatattattaatttaattggcctctgaggaatgccaattacagtacaattactgccaattagagggtattcggtgatcatttggtccacaattcccaccggccaaatgccaatttggctgatcgatcgcatctcagcgaaaaggcgccaatcgtacgcactgaaacaaataagatttaataagaattggttttaaaatgagcttcacttgtcgtcgtctccgaagtaaacgacgccccttttctctgctgctttattctcccttaatttgtcaattcttttcgctttttctcggcttttgctcttccttttcaccttagccaattgagtgccgcgtttcgttgtgcgactcccttcggaaatttgtttttccattcgctgggcgttgtcgccgccaaatgaatgccgacaatgccaagtcggcccatcatttggccaatgaatggcgacggatgctcagaatcctaatgacgcgttgccaagaaaaatcaaatcgccaaatttgaatgacctcgacaatgatccaaaacagattcgcaacgggcaccaaagtttggccaagacgggtcaaatccgccttttgcgcgactcggcgagaggtcggagtgatgaagaaaatgggagggagggacaaaggcgacggaatgggaggggaggacagcgtaaaatgcattctgaaaaggcatttaattttaaatgagtggaggggagggggacaaagcgattagcatcagcagaatggtcaattaaaataattaattatggattgggccaatacatgttgcactccatctcccacccctaattacccatttacctacttaattttgctaattatggtcattagctgccccctcccctcctccaccttcttctgccgctttgccctctctccgcacttttgctgctgaccaaattgtcaatttcgccctgcagcgcttcccttttccgcctcatggaaaatatttccgcctccaattggcgacttgtggcagacaattccattattttggtggtataaaaacagaattggaacagtgtcagaatgcaaagtgtgataaccatggaacacttttcgattgtcatttctaaaaggtcgaaatgaatttccattacgaaaaggaaaaaatcgttcgaacattgaca

SEQ ID NO: 10832 - DNA, 1487 bp, Heterodera glycines
  misc_feature (1404)..(1404): n is a, c, g, or t
tggggagtcgacggaaattttgcagaagtccggccatctaatcgccaacattttctaattctttaacaccccttctcgctgggaaagggtcttccattttggaaactttatgcgaaggtgaacccaatgtcatgtcaaaaataattggctttttcagtgtgatttgccctaaacaatcattcaaatgctacaaaaaactcacttcttccatctccctcatatacaccgcctttgcgctcaccacggccgcaagatgatttgcttcagcggtggcctaaaaaacaaaagcaattggcagtcataaggagggaaagcattaattagccttttcactaatcactcgggtcaataacaatacagaaatgaatgttcttttccacttacattgagaatggtttttggctcgggcagttcagccttgctgaacacctcgaaataagcctaaaaatttgaacttaaatatttcaattcgacgcgaaaaagggtacatttatgtagatggcaagctctcggcaagtgatgggctgaccgccaatttgtttgacgaccaaattgttggggtcgaacagatgcggcaccagcgaacggagctgtgccttgaacttggagtcaatttctaaagcagaatgaaaattgaatacaatgaacaaacaaaaagagcaaacaaacaataaaaaaaacacactgtcaagttcgcctcggaaatgctgatttgtggacacttcgaggccggggtgaggtagcaaaaagcagcgaatgttgtcgaaggacgagcgaatgtgacggcgcaactgctgaagttccgggtgttgacggggcgtaacctggcaaaaacaaatacatttaacaaatcaatggataagccgagaataaatgggggcacaggaattgattttacgaagaatcctagctaatggaaaatattttaaattttgagatggaatggaagaatataagaaaatcttcaatttatgcatgagattcatgatacattcatctgattgagtaccttcaatcgtttgtcaagaatgcgttgaccaccgattgggccgtactccgcgtcataagggaaactccagtcacggacaaggaacaaaagcgactgaaattgatgagagaaatggtcaaccaataaaaaaaagaattacctggaacggtttgctgttgttgtactcgtccagcgccagtcgggcgtactctgtgaacagttgcaagtgctgcagatggtcctcctggatggtcttgttgatgttgaaaatctgggaagcaaatgaatggaaaaatggatgcaattccttaaattttattcaaaaattctttcagtttaaaacctgaacagaggaaaccatcgtggacaacgcgaaaacggtggcgcaatttttaaaagtgctgacactgtcgaanatgccttgtgtgtccatgaggaggacaacaacctgaaaaatcatcctaataaagacagaccaatgaatttctagggaattaaa

SEQ ID NO: 10833 - DNA, 2710 bp, Heterodera glycines
cccccccccccccccaagagggggggactgtgttgtcgtcgtcgtcgccgaggagtctcgagccacagtgtgtcccttggctccttcattcaatacctcttcaacaaaatgccagatttaataagtcgaaatgaaagagtgaaaattatgaaattggcatagcaaagttgaaagttgaaaatttaaattgaactaatgaatgacaaatagtcagagacccgaaaatgaaaaaaaaacttttgaacgagtcgagcaacggcataaagccagtagagcccggaattttgaaaaaagcgggatttgagattggcatcaggccggcataagattactgaggattaccgggataaaataaagaccccccccccccgatttttgaaatgggaaatttaaaaaaatatatggtttctaaataaatttcgttagaattctcaaattgtactcggcggaagaatgtatcggcatcgcctggctctaactagtcaaaaattgaatatgtcagcaatttgggagttgttgtcaggaattgagacttaagagcgggccgagactgaagcgaagccaaagccccaaagtccatatttaaatgaggcgcggaatgaatgagcccaaattatgccaatgattggtgtcaaatgtccggtgggacggcggacgaatcgccataaatccgctgctaaattttcataatgagtaatccgtcccactcatttcactctcttcccagttcacagttttaattttaagcggatagacaaaaaacaaaattgtgtgagaaagtgtgtgtgtgtgtgtgtaaaatttctctctgtcgcccattcagcgccgtgtttttttcccgtgacggcattatgccaatgaagaaagttggcttaacataggtatgtatttgatatttatttgtgcctgacccagacacagttaggcgcgtcatttggcaacggatcagacagacagaaaaagaaaaaaaagtgagcagatggggtgggatggaaggagctacctaattgaaaggaattaaagttattagaaaatttattttgtttttctgcattttcagaggttgagccatgaaatatgggctagaacggtaccattcggtaattagcggttttttggtacccgttttttcaaaattagaattaccggtttttctagtaccgggcggtaccgttagtaaaccgtaaaaatttacactgctgatagaaacgggaatccgagttgaaattattttgaaaatttgggaaaactgaaatgaatctgcattttcaaaacgaatgaaacatttcgtcattattttgctatcaatttttgaaataaccaatggatcaaaattgctcagacagaattcggagtttgtcgaaatggataatgtcagaatcagttttacgaccctaaaaacaagtttatctcaaacaaaatttggttttagtttttttgaaaatctacggtcagataatagaaaaatatcaaaaattcgacagtaaaatttcattgaacatacaacgaaaacaaacaacatgattatgtatgtatgacaatgggactaattttcctatggaaaacgatgggagaaggggaagggtacggcatatttacagggggaatgattatccagcaaacacaattcacccataataaaatatcatctgatcactgatcatcgttctggccaaacatctgatgatcgttctggcgttgctgctgatcatcgttcaggccgaagaatgcgcggatcacaaaacggagatgagcgcgctcacgttcaatccacagccacagattgttcaaagtgtatggcgacgcttcgaagttgcacagacgccctctgcgaaaacgactgttcaaaatgttgagctcaatgattgaagaacaaaacaggacgatgttgagcagctaaatttggcaaagaaatgatcagaaatgctgaatgatgaaagttgtaaaaactcaccaaagtgaacaacggcgcattcgatggttcaaaatgcaggttgatacagagcccatgaagcacagccgtacagctccacaccgaatacgagacgagcgccgaaatgaaaatgatggcagatgcagtacgacgacggaaaatggctttgacctgaaaaaaagttgacaataattaatgctaaacataagcccagcaaagcgttaacaaaattgcaacagacaaaacaaaacagtttttattctctgagattcaactgaaaacacaaaaaatttggattcataagacattagcaagttgcaattttgtgctacacgtccaaaactcacagaattcggcacagacgcccgccttgtgaaccacaatccaacggcttcatttgacaacaaaatcatcaccaaaacgaattgtgcgaagagagagtggccgaccatttgaagaagatttccatttgtgttcagcggtgtctcgaaaaacggcatctgaattcaaattgtcaaattagtttttgtttgtgggactcttttctgctggtctaccttcatttgaaggcaaatgcgctcagccggatccgccacgtgtaaatgctggccattgctccatttgtcttcgctaaccacatgttcacaaaacgccggaacaccaaccttaaaattggaaattttgtgttaaaattttaaagtgattgaatttaatttgattgaaacgacaaaatccgcgggggagttgcgagcaatttgccacatgggtgaccatgaa

SEQ ID NO: 10834 - DNA, 1193 bp, Heterodera glycines
  misc_feature (7)..(7): n is a, c, g, or t
ccaaaancggaggcacaacccaacgaattgactatcgaaagagcgaaggaagaggagagaatcagcacaagcaaagtgatcatttggaaaggcagaagaaggaactgaaggggggggggattaaaagagaaaaaattggacacaaaaaccaaaaatgctttaaaacctttaaaaaataatccatcaatcagcgtaaatacctaacggaccaaccgaaagagacaaattcggcagaatcagtgccgcattatttcgcgccaggccaaatattgcggaaatgaccgaaagtgaccagctgaggttgacaaatagcgaaacgaacacaacaagcctaagaaaacgcaaaaataaatgaagaaaaccaatagtcagtccaattttatagaataaaatgatcggttaagcgattgtttttgatggcactgatcggaagaaccgaccgatcactccaaaacattgcctggatgtttcgtagtgaaaggccgacggatggagggcgaggaggagggaagagttgtggaagacttggctgagagaaagggacaattggaggatgagaagggcaaggcacagtttgtgaatggccaacgaatttggggcattggacggaggcaaaaaggaggcaaaacgaacggaacgatcattgcaaagtttggccattttgggaaaacaaatgaatgagtcgggggggggggaattcatttatagggggagaataaacatttgagcagaaaagggtgacggattgacttacacttccacggggaaacaaaagcaggagaaaggcaccccagggaatttcattcaattaaaaaatattgaaaatggcctatggaaataaaaatgatttactgccaccttttagaaatagctcactttcagcagcagtcgaagcgattattaacgcaacaattaatggaatattttgaatttgactgtcaaaaaaggcgatagcagcgaatttgaaggtaaaaggccttaacaatttgaaaatcattaaatgcttttaaagaaaagaccagcatggaaattgcttggaaggtaatcgccgaggtgaaaatgatcagccaatccaagtcgagtgactgatcagcactgatccaccagtcggagagccaattggccacggagagagtgtgaaagacgcagacgacgcccgaggcgcaaataatgggcaaaagaaaaatcggacg

SEQ ID NO: 10835 - DNA, 1888 bp, Heterodera glycines
ctcgtactccctcgtcttcccccccccctttcccccctcttcgtcctcctccctctgctgtctgtcccccatcatttccaacattttttcggttggccaaatgattcgtccgcccctttctttgccccccccccccgcttcagctccgttttttgtttgtcttcgtcggtcattcggtgtccctttggtcatctccgccttttcttacgttttatttttgtcctccgccgttttttgctttttcgcccattcatcacaaagcacacgcacaccaaagacaaaaaggaccatttgattcagttttggtactcatcataagcagcagtagacgaggtcatttcgtccgcttttttgctttcgtattaaaaattaattaattgtcaattaagtcaattaattaccatggccaaatgaaaaaggaattattaaatgtttggccattcattatccaccaataagcttttgtgagatgtttcttccgctaattcagcttacttactctttttttcttattactccgatcacctttgtcgaatgcattttatcgatgcgccccctccgagttacgaccaaatcgcagcccaaacgaccaatgccgtcgcgagggactcagtcggctacgacctatcggaaaaaattgcagaacaatcgacggtaataagagtccaggaattggagattggggagctgaggcgagacttgggacggatgaaagagcaaatggaacgcatggaacagagggaggacgagggacagccggggggcacaggcggaaaaacaacgccaattccgcccaaattggagcaaacgctggtccaagtggtcaccgaggaagaggaggaacggcggatgaaaagaagtgggagacgaaatggggagggggatttataggggagagggagacaaaatggcaaaatgggagagagaaaccgtggcaagccttggggccctctcctttcaattgccatttaagggggcagaaagtgcgacatcattggcggattggtctgtttcgtggcactgatggccgtcctcggattgggcatttacattgtgctgaacaaacctgcaaatactttggccaacaatctgatcacaaatgatcagccgaagatggaaaaggaaatgaattcttccatagtcgcagcacccaaaacgacaccaacagaagaagaagaggggacaatcgtacggcactttcgcattatcggaaaaggttggaggaaatgctttttatgtaaaaagcatcaaatgggaaattttgacaaaaattattgtcgtgcggcttaatagaaaatgccaatgattttgccccattaagcgaatggtgacaatttgtgttgggcccgtgccgtgctttcttcttcttcctcctcttcctcttcttcttcctcctcttcctctgatcaaattcgtcccaatcattgctttgtattccgccgctctttggatgatcggcgccttttctgctcattttccctcggccatttcgtttcgccttctttcgctgctttttctcaaaatgggcaatttgcgctgccggcgatgcgccgaggaaaggccatgattttgttgaaaagtaatcgaaaattaaaataataattagagagggaaaattaattaaaaagtcccattgtcattcatttatccatcaaatcaattaattaatggattaattaataatctgattaatgatgatcacttaattacgaaattctttagattttttagatcggcaaagactgcgcaccttcagaaaagacatcgacacttttcacacgcacacattaagcattgaagaagcgacccaagccagggccatttgcacagaacagttttcgctgttccgcaggttggaggaaaacgacgcgaattcgcaggggacgga

SEQ ID NO: 10836 - DNA, 1075 bp, Heterodera glycines
  misc_feature (980)..(980): n is a, c, g, or t
acctgctgaatcagtcactacaaatggactgatcagtcatgcaatgggtgacgaacagttgggtactgactgatctgttgagccttactgtccttctgatcactttggcccctccgcgtgtcaattttctactgcgttttctttttttaaaacaattgatttttctcatcagtcgatgataagaaaacattgaatgttttcttatggttttcttttgtaaagtgatgcaattcaaaagaaagaaaataaaataaaaaaggaggagaagaggaagcggaaagaagaagaggaagaagaatgaatggccaaagaaagaggaatcaccgacgaaagcccaaccaaagcaaatttggcatggaaggagctaagggaaaacaatagccgactttttgaaccaattcgactttaatccaattcaatctgacatttattttttaaattttaattatcttcttttctgctctttggcttatcgttcgtccccacatgcgtcgctctctctctctctcgctctctctcttttctctctctctttccccatatgataatcaacaaaaaggaatgcgtcgtcggactgatcactgctctgctgataaggtcatccatgcccactgatcatcaccatccttcattcaccccctgcacttcccccccccccgccctccatcggttgcttaaccctccgccgtttgtcccactcatttttcagtttcgtttctttttcatttctcccactcattgataaaaatgataaattataaatacccattagcttcaccaacgcttaattgattctcaggatatattaattcatctgttttttaaaaatcccaccgattggcactttcattccttggactttctctgcacttagaattatttaaatggataaattggttttaaaaatccgtgagctcctcgatgagaacgaagtaaattttggggaagtgcagcgaattttggaagagtataaaagtganccgaaggattggctacaagacacacattttgacgaacacaagtgaacggaccccgtttgagagtgaaagcaaagtgttttcagatacacgcgaaa

SEQ ID NO: 10837 - DNA, 4181 bp, Heterodera glycines
ccgccggccattccccgtgcttttgtcggcgcttccattttggactactgacactgtgcacgagcacagcgatcatccgccgttcccctcgggggatgatttgtcactgttttatttttggtgtccctttgtcccctcccccccccccaacctgacaatgagcagcagtaaatgcttcttcggttgctgatcattcgtcgtcacacattccatcgttatcattctgtgctttattttattgtccccagaaaataaaaatgatttacacataaaattataaattaattaatccattttatttttggcatttccaaatcgaattctttggcattttcattcaaattctctgggatttataatgctttggcatttccaaccgtggtatttcattcatcagaggttcatggcatttccaattaaattccttggaggacttttcaaatcaaatatttggcattttcattcaataggtgaaatttccaatcggttcgttggcatgttcaacaaaattctctggcatttctaaatgctttggcatttccaatcaaattccttggaggacttttcaaatcaaatatttggcattttcattcaataggtgaaatttccaatcggttcgttggcatgttcaacaaaattctctggcatttctaaatgctttggcatttccaatcaaattccttggaggacttttcaaatcaaatatttggcattttcattcaataggtgaaatttccaatcggttcgttggcatgttcaacaaaattctctggcatttctaaatgctttggcatttccaatcaaattccttggaggacttttcaaatcaaatatttggcattttctgctctgctgattgaaccctccttctctctttccttaaataaacctttcattttattgccatttgccccaattttcgccatttgcttttggtagcccaatttctcgcgcataatttatgtgttaaatttgctattcctcccaaacatttcctcccgcatttttgccgctccgataatttcgtcgatcgtggcgaaatacattaaataatcgccaccaccgcgagttccaaaacaaattaattaattgtgaaaacttatttgctaattcccttttggccaaattgaaattatgggactgatttggcacatttggccataatggcataaacattcaaattccatgttttgtgtatgtggtttttctttatgcaaattagagtccggcgggatcgggactcccgcgggattttacaggagtcccgttcgggactcccgtcccggaaattttgaactcccgctcccgctcccggaaatttttttttaccggactctaatgcaaatcaatggcattttttatcgaaacgatttcctattttagctccatttctgtcctctcaaaaatccttttaatttcccccgctttttgttctgctgcccaaatgcccgccgctcgggtcgccgaccgttcgccaatggcacatttgccgttgcgagaaagtgcccgaggggcccaacaacaacagcagcaaggaaaggaacaacaacaacagcagcagcagcagaaccaacaacagcagaaccaccacaaggagtgcgatggcgaggaggccgagcaggagcagaaccaacttcggaagaacaacaacaacggcaaattgatcgtcgtcggtgagttggccaaaattggcaaaaaaaagggggaaatgagtgcaaattgaagcggacaaatcggcagagcagtgccaaagggagagggaaatgtgcgcaaaattaatgcaaaggagggaccagctggaagagcagctgatcgcacgagtggacgagctgaaggacatttgtatcgcggaaggggtacgattgggcagaaggggggggggggggattgggcgatgcctgatcagtggtgatcagagtaggaatgatagtattggtctgactagggcctcctcattaggtgagatcaggctgggcctgatagtgctgatctgactgggcctcattagaggagatcagattgggcctgatcaaccaagaagagagaggaaagagaaagagtcttactgatcagcaccagctgatacttttgatcaggttgaaaaacttaccaggtctgatcaaaataaaaacagtttgaagaatttttcgaatcaattccgtaatgggagcttagaaaccatagaatgaatgagtgcattatgatcagcagaagttttaaattgaattaagaaattgttaaaattcgaggcaccattaaggattgattagacaaaatatgttccgatcaaaaaatgtgattgaaactgatcatttcaggacttggtcggacaattgcccaccgaaatttataagtgccttttgccgggggagattgagccgacggtgaagcgccgggttggcaccacgttcaaattccctcaagaagtgctgagaattcgacgacggaacagcaaagacagcgccagcggcggcggtgaaccaaatgtaattaattaattaggggttaattaaatataattagaataataattgaaatacaggaggaacgccaaatgacccaattggaggccgaaatcgagctgaaccggcgcattgtggcagcagcggaacggttggccaaggacaaaagcgtgaacaaaagtgtgcggaagaagcgccgcaaggatttgcatttggccgcgcaacggttacgaggcctcgagaagggtgaggggatttgaaaaatgaattccttggcattttggcctcgagaagggtgaggaaaagcggattttttttgatattttagcatcaagaaaagggtagaaaattggaaaagcggatttttaaaagattttggcctcgaaaaggttgaggaaaagcagattttggtgaaatttttacttcgagagggtagggcgatttgaaaaacggatttaatgaatcttttcaacaaacatttttaatttacgccccttttaggcctccatcggctacgcttgtccagctcgaagccggacgtcagcacaatggcggacggatgcggcggcgctgtgcccgccgcttccattggccatcagtcgggcagcggcttctccctgaacagtctcagtcagttgggcggcacacgctatttgagtaccactaatctgggccgaacgaaaatcatgaattgattagtaattatcaaaatgataaataccaaactgaacagcgactgatcggtccttcatgagatttaagcgacacttttgccaattttgcacttttaaatggcatctctgcattttcccattctccaaacaaaatccccacccctgtttagaagcttggcccaacttctaccacacttttcgcatgtcctccaacaccaagtcgtgccctgccaccccccgtggctctgtgcctgatttgacaatgccattggctgattctgccgcgacggctgttcccggggcgaacaatgccaacggcgcggaggcgggcaaaaatcggaggacgacgccgagcacggcaaaaaagttgcacaaaatgttgagtcggtaaggcagcaaattaattagcattaaaataatactttctgatcaatgtgatcagattaattccttcccccccccaatcactgatcactttctttggctctatccgatcactttcacatttcgcccaatcactgataaccttttttggctttatccgatcaccttcccctttcccccaatcagtgatcaccttttgtcgtcctcaaactcggcccatccgtcttccgtccctcccgcgtcttcccccgtcggccacccttcggaattgcctccctccccctcttcctcctcgtctctcagtggccatctccccgcttcttcctcctccccctcctccagtggcatttcttctgcgacgccttccctttcatcttcgtccaatttgatcagcttggcatctgcggcaccgccaggtcttttttttaattttccaaatttttctgaaattttctacccgaaaaaaaaattctaataaaacttcagtgccaagtcgtcgcgcgtcgtcggggggcggtgcatccgccggcggtagcgtccaatcaacgaattcagccacaacagcagctgatgatggagcggcaacaacagcggacagtaggacagcagaaatgccaagacaagactcaagcagccacttgtacgttttagggcatttacg

SEQ ID NO: 10838 - DNA, 1055 bp, Heterodera glycines
gaaaacgatctgctgatcagtctccgagcaagttctctccgaattttctgatctgatcatgctttagcgtcagaatagcctctgatgagtcgcctgatatgggctgatcggctggcattaatccccatcggctcactgctaaatctgaccaatctttgcctgattgtgaggtcaccttttaaatgtcgcttttaaaaaggtacgcaaacattggctaccagtcgtcgtctccgtacaaaagtgcttatcgacagtgccatttcccaactctgctccagcaaacgtcgccgcctctctccgcttatcaccagccaatgacgtcatcgaccagcttttccgttttggttcgctaatttttggctagctaaggaaatctcctcctccactctctttttctctcctctatgttcctccctgtctctatcctctctctctctctctttttctctctctttctctctctctctcgttattgcttaatttctctgatcatttgcccccccaccgcagaaggatttgtcgtcgagcagcagctgctccagcggtcgtccctcctgttgtgcttcctcctgctgctcctcctcgtcctccgtttcattggccgccgtcgcctccacccaattgggccaaattgtgcgtcggttggatgccgcgcgtccgttgcgccatccgctcgtcgtgcggcgaagcggcggcgacggtggcaccgcaccactgctcagcggaagtgtacacggacaagcgcactccaccggcagtttggacaggcgcctgagacgggtgccgacagcggaggagacggcatcaaagccattgaaaaagatggtatcgacgacggcaacgggcgcaatttggtgggcttttttttgtggggggagcggcaattagtgtgttgtacatttaattggaattcattcattgctttttcagtgctcccgcttttgtccaattgtccccgccgccgcggctgccccggacgagcgcagttgaacagcttgccaaccagcagctgatcaccactttcccggcatcggtcgccagtgccaatcggcgcg

SEQ ID NO: 10839 - DNA, 5968 bp, Heterodera glycines
  misc_feature (5961)..(5961): n is a, c, g, or t
ttctaaataaattggtgacgcgtcgtggtagtcggttattacggcaacaaaattttaaaattcgaattagtacgaaaaggagaaaattaatttgtaaatattgcaataaaattatcaatcaaatggcaaaaggaagtcggttttgaattctttgctaatgaatatttttatgaaaagatatttttagtatgtttgggcattgaagcgactcattaatttcctgaggattttccatcataaatacatgctctttgggaaccgtacaatattcttttcttagaaatcctttgcctataacagtcaaatattcgaagtaggcatttaatcgaacggcttagagttaaaacccaatcaattatatcgcattgattttatcatcagattctaaaataaattggtgacgcgtcgtggtagtcggttattacggcaacaaaattttaaaattcgaattagtacgaaaaggagaaaattaatttgtaaatattgcaataaaattatcaatcaaatggcaaaaggaagtcggttttgaattctttgctaatgaatatttttatgaaaagatatatttaggatgtttggacattgaagcgactcattaattttctgaggattttccgtcataaatacatgctcgttgggaaccgtacaatattcttttcttagaaatcctttgcctataacagtcaaatattcgaagtaggcatttaatcgaacggcttagagttaaaacccaatcatttgtatcgcattaattttataatcagattctaaaataaattggtaacgcgtcgttgtagtcggttattacggcaacaaaattttaaaattcgaattagtactaaaaggagaaaattaatttgtaaatattgcaataaaattatcaatcaaatggcaaaaggaagtcggttttgaattctttgctaatgaatatttttatgaaaagatatttttagtatgtttgggcattgaagcgactcattaattttgtggcaaagaaaactcggccggcgctgacggctagggggtctgtgcgcgggagtttctctcccgtccctcgggcccaattcactcaatttcctgaaactgctactgctgccgttgggtccgtgcccaagggagtgaactggggagggggtggggaggacaaacaagatggggttggctgttgttgctgtaacggcaccaccgactttttgaagagctgccggcgctcccggttgaggttcgggagaagagttggacttccggccgcgaactgcgtcaaccgccgggaactggctcccgtccttgtttgctgctgctctgcgggggattgtcccccgcttcgattctcggggctttggctccccttggtcacttcgttcccgatttttcccccctttttttgccctctgaccctttcaacacttttccgacaaaatgtttattggtgatgatgatgataaaaatggtcaaaaataggtggatgattatatgcgagatgttgatggattatatggtgaaaattggaggaagggaagggcgataaggattattgagggggtcaaaaattgggaaagattcagcaaaaagaaaaagatggtgaggagtgaaaacgagtgaagagcaagaggtgaatgtgtgtgtgtgtaaaaaaatggaaaggaatgaaatggaatgaccccaaatagacgataaacaatacttaagtaccaaaaacaatttccccctgggggggggggcaaagattaagatgcaaaagagcgacgccgaagggtacaaaaatcggcggggagaaaaaatgccaaacaaagggaaaaaatgagatgaatgcaaaacggcccaatggaaatggcgatcggagaaagtgtgaacaaagggacaaagatcggaggcagatgtgaatggcagaaaaattggtgaagaaaaggcaaatggtgaagttgacgaaaaacattatgtaaatgagcaaaaatgaagggaaatgaaaagtttaaataaagagagaaataaagaggggtgaaaatgtcgtcgaatttaaaaaaatggatcgcttaacatggcaatggcccttatccgggaatgtcccctccggatttcctggtcagcgtcgtcctcctcggcgcttcttccctcctttgtttgggtcccgcggttgggcgggggggtggctgaagatccccccggcccactcattttcctcctcctctgacagttccctcgccgtgccgtcggcgttgaacaccaatattccgcttcgtcctcctctggccctctcgtcggcaacgaaattgccgacaagttggattaattcgcataatttcttttacctcatgttctttcagaaattttttaactttcacagttcgctgatccatcagttctgtaatttcattgctaatttcctccattcttgccgggctaacaaatgatcccgttccgacctgttaaataatgaaaggatttatttgttgaaaagagttacataaattacccaaattggtcccaatcgcgagaatccccacttagtgacataattttctgccaacttaaattgatttagagagtttcctatttttccatttgttttactttattcgccctctggaggtcattgctgcaaccggttgttactcgttccttattttcaagaaacaattcttctccaatataccccgctaatagatagtcaatttcattcaagacatcaattttcgacaccctcgtttcggcgccgctcgtttcggcgccagcccagtttttggactataacttttttctttgtcaaccaaatctaacattattggtatcattcgaaagccctaagtgttctctattagcctgctaagtttcaaaaaatttcgttaatgctcaaaaacattatgactagaagaattcaaaaaaccaggccacatgtgtacttttggccataactttgttcaaaattgatcaaattttttggaattatgcaaaataatagagcatcagaagggttctcgaatgatatcaacaatattagatttggtggaaaaagaaaaaagttatagtccaaaaactgggctggcgccgaaacgagcggcgccgaaacgaagtggaccccaaccgctcgtataattttaaaaggatgtcatttgtatgcatacaaaaaaataattattcaaatggaccaaattggcaaaatgtttatgttattaaaattttattttcctcaaatctcaactcaatcctctcaatttctcacccagacccccattcttaccagtgcttattttagtcccgccgggaccgggactagcaaaaccgggaccgggatttcaatttttccaaaaaccgggaccgtgacctgaaaaaaccgggatttccggcaccggtcccggtcccgctcagccctaattttaatgcataaattatattaaaaataattcacctctcttatgcttttcttaatttaaaatttaccacaaaaattggccgtttttagcgcaatctgttaagaagagcatttttggaattgataaaaaaattgcattatttttttttttcgtttccaataatatacaaatttaagctcttatattgcatttttttttaaatgtgcttattttgaatcaaaaatatttttttgatcagtgatttgcttattttttggaaactttttcgatggcacttctagtgaaaagagtggcaaaaaactgaggaatgtttttttctgtaatttttatatttttcccacaaaatcattaaatcgtctaataaattttattcaataaaataataatagaaaaatttaaaattattaaatttctcataaatttttgcactgtctctgctttgcttgctcaatgccaacctctgctacaattttcacaaattgcttcattttttcaaaaaaatcatgcacaaaattgtataggatggcccattccatttctaccgtagtgttgttgccaatctcttttaccgtatcctcagtttttcgtgacgaaatttggcgctcaatggcgccaaacagacggaaatacacgcgcaaattcaacaaaattttattctcattttcataacattgttttcgcgattcgaatgatcttgcgatgagatactgaaattcggaacccgtcagttgggccctcacgattgggccctgtttttagctataacttttttctttatcatccaaatccaacaatcttgtgtattactcgaaagcttaacatgtttagaagctatttctaagctatcgcttcgtgattagacaattgataagaaagttatagcatgaaaattgcggaaaggtcgaaattttgaaatttttcttaataacttttgcaaaagccataaaatctttttgttttttgtaaggctaatcgcgatcacgtgaaggagctttcgagtgataccaagattgttgccttttgatgacaaagaaaacaaagttatagtcaaaaacatgcaggggcccaaacgtgtagggcacaactgaccagtgcacccccaaaacggcgtcggcgccgaaacgttcgacgaaaaactttttgaaccataactttgttcattgtcaatcaaattaagcattggttggtgttgttcggtagctctgggtgtttattattaatttgcaaaatttcaaaaattttcgttaagtttcaaaaaaaaaaaaagttatggccagaaggaactcgaaaacctagtatttcgaacttttttttgcccttatttttttgtgcatgaataaaaatttttgaaaatttgcactttaatagcgtttttcaaatactttcgaataataccaagaatgtttaatttggttgagaaagaaaaaagttatggtccaaaaatccatccaacgacgtttcggccgacgacgttttgttctgctccgccaactgacgtagaccgccgaaataggcaattaaatagtcacaaaaataggcaaataaccaagaaaaaaaaagtatatacatattttagggttaaatgtttgggaaatttttttcaattcttagtgggtgtattttctgaaatttttgcggtgtctttttattgcattttctctccatttttatgatttttttttttgtaaattattgatggtttttttagcatttttagcaccgttacccaccttcatgcttctcatcaagccggatgtggtcacatcgtcaaacattttgtcctttagcaactctttttgggtccacatgacgtactccttcaaattgttgatcatccgatcagaactgatcagtgcgcacaacgctttgtctatgtcgaccaattcgaacaaatgccgatacaaaaggtcatcattagggttgtaaattatatggattaacatattttttctgcgcatatgctatgaagaaaggggctcaaaaatagcatttctgcattaaaattttacgatttggtgaaggtttttagtccatataaatccatattttaggggttttcgggaataaatccatatttcgccatttttgtgtttttagtccatattttggccatttttggcaaattttcacaagaaaaatgagaaaaaagcgaaaaatacacccctaaagtttgactttttggaaatttttaaaattagacccccaaaaatatgaaaaattttggtttttcatcgaccttttgacatttttaattaatattttcactattttttttgcgaacttttcctttttatttaatgcgaatttttttgaattggcaaacttggaggtgatggtacgataataaaaaaaatttccatttttaaattttaagtctatttttgtttgtttattgtattttttaagtttatttaagcaaatattgaatataaacaccaaattcgtaattttttatggtttaaagcatatattttggcagtttttagtccatattttgatccatatttagccaagttgagctttttagtccatatttcgggcttttttcctctcataggttatgtccagtatttagccttttttagtccantataatt

SEQ ID NO: 10840 - DNA, 1128 bp, Heterodera glycines
ttgcataatgcacaatgcgtaagtcctgatcaggccaatgtttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttaagtcctgatcaggccaattgttccttgtattaccaaacgaagacgttctgtggtgtagtaacattatttggtgctctcattttttggcgccggatcttataaagtatctttgcataatgcacaatgcttatgtcctgatcaggccaattgttccttgtattaccaaacgaagacgttctgtggtgtagtaacattatttggtgctctcattttttggcgccggatcttataaagtatctttgcataatgcacaatgcttatgtcctgatcaggccaattgttccttgtattaccaaaacaagacgttctgtggtgtagtaacattatttggtgctctcattttttggcgccggatcttataaagtatctttgcataatgcacaatgcttatgtcctgatcaggccaattgttccttgtattaccaaacgaagacgttctgtggtgtagtaacattatttggtgctctcattttttggcgccggatcttataaagtatctttgcataatgcacaatgcttatgtcctgatcaggccaattgttccttgtattaccaaacgaagacgttctgtggtgtagtaacattat

SEQ ID NO: 10841 - DNA, 3979 bp, Heterodera glycines
agtcgcgttttataaaaccgccagtcgcgttttataaatccgccaaaatggaaagtcgcgttttataaaaaccgccacctagtcgcgttttataaatccgccaaaatggaaagtcgcgttttataaaaccgccagtcgcgttttataaatccgccaaaatggaaagtcgcgttttataaaaccgccagtcgcgttttataaatccgccacaatggaaagtcgcgttttataaaaccgccaatgtaaacaaaatattgtacatatgcgtgattatcaatttttatataatttaaatatagtaaaaataaataatcgagtaaaatgcaaacttttattgctctttaaaactttctccaaaaatatgaactgacaagcataacaaatcctaaacataataaatattaaaaaaatataaaacactggcaaacttttgtaatctttctttatgatcattaggtactattacctaaaactttacagtgactggcagcttttatttgagaatgtgaaataaaaagcattacacctaattctttatctctaaatcgcaaccaccttaaagtttttatttaataaatttacccaactaatgcttacatgtcttcttcggaaattttctttttaagaagcaattttattgaaccccgtttatttagttgaagcctttctgggacattaaagggatcagaacaatcccctaggtgatttcttcttctacggtagtaagagcttcttacagattgccaattagggtagttaaatgaaattccagaaatatcttcaatttcaatatcctcagcaacatcgtgttctctagcccgataagaccccttaacaaaaaaaattctggttttaataaagagaaatacttctcgccacaaagatttagggtttatagaacattgcacaagatctcgtctttggctcctatctatttgttcagcagctagttgctcaagcggtactcctttacattgtttatcatgaattatttgataagttctgtctaataagccatcgcgtaatattgcactagctattaaacttaaatacacataactatataaaaattataattaaaattaaaactaacctgtcagaattgggttttttcaattttttgcaacacatacagtacaaataaattacgccttctctctcgtttgtttattgaattttcgatattcggattcatgcccaatgataaaaagaaatttgttatcaaattttgaaaaacattgcgatacttcggcattttccatatctactttgtttccttctgttgattttctattttttatttttgaaatatatctttccaagcttctcaagcttaggtcgactccgatttcagccagtttttccaataattctcctttagtctttatttcctttcgaagatattgatcaattaagggtttggcgtgattgtttgatgttaattcctcaaaactaattccatgaaaaagttttgagcagcagcatactagtaatatataagctaataaataaaatttagctttcatttataaaataaaaaataaaatgaaatgggtattaatttaaaatttaatgcttttatagaatataattgcaatactaacaaatatttttgtttttattcagctgtaatattggcaaatattattgcagtctgactggcacatattgtcacataaaaatatttttatcgatctatttagtattaaaaaaaaataaatttagtatttttgttggttatttgcatattgacaaatttataaaacgcgcaaacccattttggcggatttataaaacgcgactggcggatttataaaacgcgcctttccattttggcggatttataaaacgcgactggcggttttataaaacgcgaattgttaggtggcggatttataaaacgcgactggcggatttataaaacgcgactaggtggcggtttttataaaacgcgcaagcaccttgcgtaaataaagttagcaatagctgctcctacacgtttgaatatggcatgataaactaaattttgtataaacaaaacaatgtattaattatttttcaataaagttataaaaaactaaataaaaatttttacaattaaataaataaaagttaaaaacacgcctcatattgaaattatttcatagctttaatatattaaagcaggaacaaattttaaaataatttaaaagtattaaatgcaaaaacaagataaaaccgcgtccagtcatttgcggacggacgacatttgcggacggacatttgcagacggtttttgaatttaaaaaaaaattattttttagaaaaaaatttggaagagtgggcctcgtcagtacgttctctccggttaaaaagcaactaattacgtgtgtttcagccggcccaaccgtagacacactaacttaaaaagcgcacaccaacaaacaaaaaaagcaaagaaattaaattttctgattaattaatatttgaaatttattaatcgataaaatataaaatcattattcatggattaaattgtcaaatccattggatgctaagcgatattgaagggctcttaagtgattcacaatttggtatggttcggggtttgcaagtgcataaatctagtgagaagagtgtgtatggccacatcattattatagtatgtccttcgcctaggttgcaaattcaaagcgcttgtggggtctaactcataagtcctaactttgtcttgaggaattctttcttcctctttcgtaactaaaattatactggtcggttttttattcgaaattttttttcatcagagaaaatagtattcatttacatataattttttttattactttggctaatgtttttttgatatatttaaaaaactgcttatataaattttgaatatagaaactagattttgtatttgttcttagcatgagcttcataataaataaattaatttatgatattaataaaaaattttcctttatcgctttaatttctatattattattattattacttttcttgtcagtttatgtttttacacacgtttttacacacagaaatcagtgttcgattacactttacacgaacttgttaaaatgatggcctagagatgcttcggaatgaagtccaggttaaatttcaaatttatgccattatttatttaaatttttaaatattttattttcaatgtttatttttaatttactattaattttaaagctgaaattgcgagccgctttaacttatgtgaaaaatgattacttttgcgtaccaagaataaaagacaaaacactttgttaaaggagaaaaattagtaatgcttcaaagagtaattaaatattgtacactcacaatcaagatagaaataaagtaaactaatatcaaatttaaatactatattttaaactagccgtatcgaaccttaaccaagaaaaaagtaatcaaacaaagaaatgtgtagtaataaatctatcacgaaaaaatgctaaaaaagtaaattaaacccaaaataaatattcaatttttataacaaaattgatgattatcgaattttaaaaagttataaatcctttttcaatgacttatgtatatttttaatcgttatttttgttgaaatgacacatgaatgcatttgtgtgaattattattcaattacccagttttttcatgtcaaatttaaaaaattgtccaaaacaaatataatttaaattctttagttaattcaatagcattttatccttaaacaaatatttgggtttttaaaagattattcctattaatccgaaaacgtaattaatttgttgattgatttaatagattaagcacatataaatattggaatttcttaaaaatttataagacgaaaataatgaaattattaaaaatatcaaatactaaaaaaatatttttttccgtgtattcaattttattttgtgttgcaaaaaagctttaactctcataaaatatgtgtttcgacaatgattgatctcgacag

SEQ ID NO: 10842 - DNA, 1828 bp, Heterodera glycines
ccgctgacccacgaattgtccaagtctcgaaattgagttttttattatttttttattattcggatgggcctaaggttagacaaggcgtaatatacaggttatattcgtattcagcgacctcgaaacccctaaaaagcccaaattagactcattttgtttttataaattttgaaaaattttggacaattcgtggggttttactcttttggacaattcgtagcttggacactttgtggggatgccacaaaaacacataagaaattcatagccataacagcagaaaggtcgttttatcagcaacacaaccaaatttaaaaattatgaataaataattaagcgaaaaatttggaaaatttggcaagaaaaattttgaattatcgtaaaaaaattgttttttttttgttgttttttgtttgcacagttgttgctgttattgatttgttgttgttaatgtgttgtaagtgctgttgtgccccgtgccgtgccgagcacagcgcctctgccgccgccggaggctttagggctcccattcactgcattttaaaataaaatttaatatgcaataaaaagggtataaacattttcaaaatagtacacttttaaacacaccgagtcaattttgagcccctagttcaaaaagtaaatgcatatgtggctcagtggtttttgtaagatagtaaagggacaaaggggggaggttcgagtccgttgtgcaacatgaatatttttatttatttttgtccaaaatattaaaaaatcacgatatttggtaattatttttgaaggtttttgccaaccaaattggacaatcttggtatctttcgaaagttcttgatgagtagaagcttttcctaagcaaatgataagcatttttataagtttgaaaaaagatataagcgtttgaaattttattttttgaataattttagatcggagcgtaaaaaattaaaactcgagcgttaaaaatattcataatatttttctctatcgatatgtaaaatttggtgtggatttaacgtgcaggaaaaaagttaaacgtcacgaagtaaattcggtttttctctattaacagagataaagaaatagaacgccaaagcgagagatgtttttttctctgcactctctctttattgacacatgtctcgttttttgactcggtgtgtaaagtagcgcaaagcttgagcctaatcctaggcataagcaatagaacgttgcttagtacgacttttcaagacactccaggcccatacaattgtttattaaaaaattaccgaacctcttatgaagaattgacagtgacttcccctgtaaggttccggacaaaggcatcgccaacaatttttgggattttgatatccattattttggcacttgttcggtagttgtttgcaggtgtctgtgatgtacaaaagtaaacaatgtgctaattttctaattattctgtatattcagctaaccggggcagtatattttattgaggagtaaagtgtccttgaaagacagtctcggttgccccgctgttctttcataaaaccgattaaatgggatgatcctgttctcgctgaaacgaaaaagagcaattttagtttttaattctattaaacaggacagatttttggttaaacttatttccatttaaacaagggttcgggtcgaaaattttacaagaaaagaaacattaaggccaaaaataagatcttagtgtaaaaataaaaaactaccaacccgtccatttgtgttgtataatgcatgattgaagcgaagtcgtacggtaattgaaaattttcggtttttttcattggttcgtaattgtttttccaatccttaa

SEQ ID NO: 10843 - DNA, 3711 bp, Heterodera glycines
  misc_feature (1954)..(1954): n is a, c, g, or t
  misc_feature (1988)..(1988): n is a, c, g, or t
  misc_feature (2027)..(2027): n is a, c, g, or t
ttagaatcaccaaattatggaagaaaaacggcattttccgattgatttactcaattatcaccctttttcaaaaattcaaagaatatccgaaaagtaatttcatatgattattacaaacaaaaataccaacttctgtgatattcagcgacattttttgccaaccgcctcttctgcccacaaatgaccacgtaccgccatcatcaattatcacaattccctccttgcttttgttgtcaaacttgaaagtgatgcaactttctgcgcttaaatgtttcagtttgttagtgtgaaagtatacccaaaaattcgggttgttggacccaaaggcgtaggcagtgggagctgaggggttaaacccccccccccccccgaaatccaaaaaagtaaaaaattcagtaaatttttttaattttaagcgattttcttaacaaaattgcattaaaactctcaaaaatttcccggcggcgcctatcggcaccgccggacccccattttaccatattttagaaaaatggaggccaagatgccaaaaattgttattttttggctaaaaacggcgaaaaattttgtaaatacacccccttaattcgggattgcaaaaaaagcaaaaatacatccctaaaaatcgactaaaaaacagaaaatacacccccaaaaatcgaacaccttatcaaattgattccgctgataatcgcctctttgtattggtcgatatttttcacttaaatttaattataagaacatacatcatgaaaaacgccaacattttttactgaatttgatcgaaatgggaaattttgtccatttccgtgctccttgaatacttgggctggcctgccgtttttgccgaatcgtcccaaagcacttttcacatgcttaaaatatttcctcagaatttagtttaattcacaactatccacgcattaccttctttgcgttggtcatacatttcttgggcatccatttttgagaacaaagtgtcgcctgcctttaatggatcaccagaggggatctgcacatgctcctataaaaagttgatatacatataagacgaatataatataaatgaattttaaattggatttatgtctttataattttttcgcggattagttattgcaaaagaaacccaaaaatattttttatccgaacttttgacttagagcgacttataaaaacataaaagcatatattttagcaaaaaaattttgaacttaacttttttcattgtaaaccaaaacttggtatcatttggtagccctatatgttcttcttttaacctgaaaaattgcgaaaaatttgtttaaggttcaaaaaatcccataacttctttgaacctcaaccaaatttttcgcaattttgcaggttaatagataacatatagggctatcgaatgataccaagaaagtggatttggttcccattttgagcatatattttcgcacattttttggttttagcacaaattgcatcatttttggcacatattctgttaaatatttcaggatttgtatcatataaagattcggtctctattttccgggactaaaaatgttataatttagtaaataaagttatttttacaagttcggatgggtgccggcatacgcatggagaacagcagcgaaccaaggcctccgcctttcgcaacaaatctctgaccggctcacaatcattgcccaaaatgtcacatcgtgatggggaggtctaaaaagaacccaaattatgaatttgcaatctcatgactaatgagttgaatttagcgaagtgtacacaagaaattgaggcattactttttctgcgtcttaaattttgaaaccgaaattttgtggtaaaaatttttcagttaaaaagtcaaaatttgactcttaaagtgccaaaggatggaaaattttggtactagttgcagttggtacgcccacaaaaaattgttttaaactcgtataaaaatatnttatagggtttttttacgtcaattgattagctanaaaatttaaagaacagctattccactgaaatggaccatnttaataatttcactgcttcaactttcatgaaaatttttttgattttcgaccaaatgttcgaatttgagtcaggaactctgaattagtagaaattgagatcggattcataatcaacgcccccggaaactctagaaacattttttatatgattttaaaaccattttttggcgtaccaactgtactagtgccaaatttttaattgtctgtcctattaagttttcagtaaagtttttacaatgtttggattgtttctgtatggctccagatcctcttcgcgcgtaattaattttgaataatgtagctcggaaacttggaaaaaaatttcgatgtatccattttcaggtgggataaaatgaagcgattttgccaatgtgccattccatgattcttccataattgaattcaaaacggaagaaagtgaatttttctaaatatatttattattattatcttttttgttgtttttacttttttggccaaattgatcgtgagctcttttcccgctcctcgaattgtgctcgcgcgatcagatgaaaaatcgatgaaaaaaattgggacaaaaagatgcgcttgcaaaaggtcttccattttgaatgaaaactttcggcaaactttgtacctggaatttatggaaacccattattcaattatatattcattctcaaaacgacttgagaaaggtaaatgaaaaatccaaaatggattgtatgatgatcaattgggccctggcatcccgacgcacgcaatggcgaattcgaaatccagccgaatttggctcattgctgaagtgtcttttgcagatttgtgaaatcgctttgttgagtaccaatgggggtcgtttgcttttgaaacaggcaaccaattcatacgaactgatgtgaaaaaatgcaattaaaacacattaacattaatgggaaaaattttttatgaaaatttaaaatatgttcaaccaaaattggaattttttttataatacatgaaataggtaggctcggggcgtaaaatgacaaattttttaaaaaattgtaacaacattaggccaaaccagtatcaaaagttcttcaacgaaaataaataaatttgagacaatttattggaaaaaaaatgctaccctaatataaactcataaaacaggcattaggcagctgagaagagctcagaaaaataggtaaaacctaaattgtatccccaagcaaaaactaataaaatcgcaaaataattttaaagccaaaatatttttaatgttttaattaaaattttttacttccgacatgtctccgatgttggcaccttttggcatgcatcgaactcatttctcttttgcgaataatttgttggcaaattgaaaaagtcaatttgcgtttccatttcgccacaaccgatttggtaaagtgatgcggagacattgagcgaaaatttggaagtgcaagtcggaatgttaatctccatccaattgatgccgaagtgttcgctggtggtggcatgtggggaaaaacgtgacggctgaaaatgaaaaaaaacattaattattttaacaaaaataattggataatgatgatgatacaattagtcgttgccgaggattgtggcacggttgtaagcctggagggccaatggaaagaaataagacgaaaaatttgacaatttgtctcattttccgctgaaagaatttttgatttattat

SEQ ID NO: 10844 - DNA, 2256 bp, Heterodera glycines
tattcctctcacctcctcaacccattcctgcactttctcatgcgtctccgggtcctgcagtgtttgcttggcgccgttgaacttttcgcgaaccgttggtcccgctttgtcgcgcagccaatcggcagcctgaaattagaataaatatatatcaactttatgaatattttattattggtaaattaatttttattaataaatatttttttttataattattttatcaattaatattttcactgcattgtgatatatatttataaattttatgttttaaatagagttgcacggtaatcggtaattgtaaaaaaaccggtaccggtactgaccggtaatgcaaaaaccggtaccggtaaaaaccggtaattttccaacgtaaaaatttttggacaaaatttttcaaatacaaaatttttattcagttttcgcgcgagtgcttttttagcattagaattgttcagaagtatatgtatattgagggtgaccaagtttttttttcaaattcaggataaagaacactaaaatccagatgtagacctcaaaattcagattattgcaaaacaagggatcagcggccaattttccaattttgcgaaggggtctccggccatgtaaagtaatgtaaatcaatgaccttttttgctctcacaccgcttttttctcggcacgtttttcttcaccaatttcctattcttttctcgaccagacccccattcttaccagtgcaaatttttaccggcggtaccggtactagacaaaccggtaccggtactttgatttttgaaaaaaccggtaccggtggcaaaaaaaccggtaattaccggccagtaccggtaccgtgcaactctagttttaaattggataattaaccatttgtttgatctttacttacaccaacaatcttttcatgcgcaccgttcacaaaattgtcccaccaatcacattcgctgtttgtgctcagcaaaagaagaaaaaagaggggaaacaaacggagacgggcaaaggatggcattggcattgtgccaaaggaaaaacgaaagaaaattgggggtttaaaaggctgctgaaatacaaaattgtgacaaacgaaaccgaagcctgcggttagtcaatgggaaggttaaaaattgtccgcttctgaacgagttccccacaaaatccccacaatcaatgcacatcgcccgccaaactccatccttttatccttttgctcccccggggcattcagtggaaatgaacgatttgcatcgaacgaattgccggatttgaagcaaaaagcacagaaaatccaaagcatagcatatttttatgtatctttgttcctttttcctacgagaaatgacgcattattagcagaacaacggcggacgagcaaaagggaaacggaggaaaagcatcactaattggctaattaagcagtttgtggggagaaaagcgaacggcagaaatttttgttattctgattaagagaacgaagatcagacaaatttataatttgggaacctttttcattaaaaaaataataataaaaattgaggagaccaaaggaatttttgatttagcggcgatggaaaatgatgatgagaacgaagtaaatgctgatgagagatgaccaaacaagcagccccctcccttcatcaacagcagaagaaatgagtcacccaaatggaaaagccaaaagtgactgagagataaggaaaagtggcgagacgagagagaggaagtggaaattggaaatataaaggggaatatgatcgatgagaatgggaaagaaagcgaaaaatggggggagaggggggggggggggcatcgacgccgctttatcggcaacagaagggtcgcaataggagacaatcaaacggggttggccctgaaggcatttgacgggaaattgcggaattcgccttaggctaaaatatttgcaaattttcactaatttcttaacattttttataaagtaaaatttgggaaacaatttcaatttatttaaacaaaggctttttaatgatcagcttttgctgtgttacaactgaataaaaatgagaaatattaccattcaagagttttcaatattctttcaaataaacgaatgaaatatttaaaacagatgaatttgaggcataaaatacaaataaaaaaagggacggaggaagaggcaaatgacacaaaattaattggttttgcgtcgtcgtcaattgatggccctttctctctctctctcttctctctttctctctctctctcttcactctcttc

SEQ ID NO: 10845 - DNA, 3416 bp, Heterodera glycines
cttcgctcagacaaatggccaaatcggtgccaaacgtcgactgcacccgctgcacatagacaaaggccaacgggacaagcagaacacttgcgatggtggcgcaagtgctgaaaggtgtctatcatcagatcagcggaaaggctacccaaaaggtgggtttgtcccaccaacccaagtgccacactgacaaatgacgtcactctgagcgtttcggcgtattcgaggcgtattttgtgcgactgccgcaattttttgcttttcaattcgccgctgtccattcgggagaagaaaatcggctgattggtgttggaagagaatggacaaaagtacgtttgatggatatgggaagaggaagaggacaggccgagcaaaacaaaaccagattattgggaaagaggaagagaagaaatggcggagaagggaagaaccaaaacaataatgggacgaggggggggggggggaaggcattcgaaggtggggaaatgggtcggcggaaggaagcaattgtggtgggatgacagaaaagcgatccatgggatcaattgaatgattgaagacaaaaacacttatcatgcacagtaatttatagttacggtatgattcaagaaaagggaactggtcatttatacagaatatagggaacaaaacgcgtagaaagaaaattctccagaacgtgccttagatcccggttcgtgccaacggcgagttggccgcggcgagttgggcggttccccttttatttttatatttttacatattctcggattttctatatatcaatatgtatatttttctcatattttgagcttcttcttcttttgattttttgtacatatttcgcaatttttgaggatttaaagtaaatttttcttaaatgcccaaataaaacccgcaatttttacctattccgtctcggtcacttttccaaaatcttcgggattgatcgggatcccaactctgacccctccgaccccagtttgtccagtctctacttttcaaggaggcaacgttccatctcgtgctccgttttctgggcgtgatgcaaatccatgtcaagacgttcaccaccgggaggaccatacccgcgatgacacacaccatcatggacatgaaagtcaaggtcatgcaaaagacctgtttcccaattgaccaacaaaatttgtacgatgcacccaatggaggtacaactactgtacttggtatgccgagattgtgttttacaaatattttacggagtcgtcttttggactggcgaactttggctgacagcggcgtggttgctggcacgcacctttatttgattaacgacacgcagccgtttacgaacaggtgacgggcggcccgccgcttcgttagaagaatgagttgatctcttttttggataaacaaattgatctgatcttttttaatgctcatttttttatgtttcgtttctctcaatcgcctcaaatacacgcagtcgtacaacgaggcgcgcataatatgcaaacggttgatcaaggtggacggcaaagtgcgcagtgagatacgctttccatgtggcataatgggtttgtggcatggagtcagtagaatggaattttaaattgtggagggtcaaattcctaaaaaaaacaataccgatagtattgcataagcctgactagctttttttcaaaccaagtggcaaactgagcctttgttaagtacagtatgcccagctgactgataaatggtatacagtatgtccacagaggagttattgtatgtcccattacgtgggtactttttcattacagtttgtgttccgatacggttgttattccctgctgcacagcgctacagtaaccaaaccaactaatctttgtgcaaaaaatattgataaaaccattaataatgaggtttatttggaaacctgctggcatcttccgccgggttgtccgatgggcctttgtcattgcactataccaactagggatggcattccgaggtctcaaaaattttcggaaatcggaattccgaccccaaaaacgtcgacaatcgggggccgtagtcaaagaaggtggttatgtaaaataaccactgccatcatggtttacccgtagcaaatgagcaaccacgggttcatggtcatctaacgccccggaagtaggaaatgggaaatttttgaaaaataaagattaatttacctaattttcaaaatattttaataggctaaattttaaattcttaaccaagtaaaaggtgatttcaaaaaagtttttggtatttttctatatttgcttgaaaaaattactcaatgattttcatcaaaatcttttacatatgtcattttctattgttttagaacatttttgggaaagggactccatatcttttttgcggtgcgcttttttcaaagaaaatttggtactgggggggggggtgtcctgaggtgccgataggcgccgccggcgggaaagttttgaaaattccagtgcaattttttaacagaattgtagaaaattatcaattttttggaaaaaaatttactaaaaaatttccgactttctatcaaaaaattcggaattccgacatccataattttttcggaaaccggaattccgtgccatccctggtacatacatactgtagggttaacaaaaaattgaaaattttggcgttatgtcttcaagtttttcttgacactatgggtcaagcccagtgttagacaaaagggaccaggtcgttttggcgccgacgttttggcgccgacgatttggcgccgacgttttggcgccgacgttttggcgccaagccaaaaatgaaaaaaaaggcaggaagaaattgtaaaaattataaaaaaaatgaaatttttcgttaaatataataaatttaacaaaatgaagaaatggaaacaaaaaatgaaatttttcgttaaatataataaacttaacaaaaaaaaaaaaaatggaaacaatttatgggttcatatgataattgcgcgaaattccacggagaaattctaaaataatgaggcgctcatcagccgcttggtatttcttagctttccgcggtggctcaagtccagcaagaaatgacgcatacttcccatcggtgcccttctgctcacggcggagaacgtcaatgaagtgccagatcgatggatgacggcagttgaaggcgccttgaagacggtgatgttctgcctctgcgtggttgttcgtcctttcttccccattcagtgtgcgagtgtagacgttccactgctctggtgggaagagtggttgagaccaagttccatttggccggggttgtccaatgtaattgttgagcaacctaaaaattgcacagaaattgaatgcatctgaataatataaccaaccagtcaatgagcggacggagtgcagccacgttcccgaactccgtgtctaatgcgatgactgcttataacgatt

SEQ ID NO: 10846 - DNA, 5135 bp, Heterodera glycines
gtaaggaatcgatgaaagtagtggtatttctctggcgcctggcggctcccacttatgctacacctctcatgattcttcacaaagtcagcctagagtcaagctcaacagggtcttctttccccgctaacttttccaagcccgttcccttggctgtggtttcgctagatagtagatagggacagtgggaatatcgttgctccattcgtgcgcgtcggtggttacccgccgaggcatttggctcccttaagagagtcatagttactgccgccgcttacccgcgcttaatcaagtttccttggcttaacaatcagagccttgggcagtgctcagtcacggtcagattaacacacacgagtgcatatattgtttcttctgggtttttaaggtcgttaatcacgcatctgtcatgtattttgaataatttctaatccctaacccgaactggaataaaaatcgaaattttgaatttttcataattatgattttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaattttcaaaaagggtaactttcaatatagcgccaaaaattgctatttataaacaaattataaagccataatttcgaaaaggagcttgtaaatttgagaaattagggcagggtcccgacaaaattcagggcttgaattaagttaaaacctatcagtcatttcgtccggaattctggcaagcaccttgcacagtgaaacagctctgaattaaaatgaacaataaaggctttatatttttacaaaaacctcattgacaaatattgaaattctgcaatgtgtgcaaattgtggcagttccagctcttctgtggccgcgtttgcatgcattcgaaggtacgattcctgcacattagttcctgcaacgcccgactcgatcagcaaaagttttgagaaatcataaagaaaggagggagaagcacggtcaatttgacgaaagacttcttgtaaatgcttaagtggtagaatataaagaaatcagttaaagatcctattcaaccaagaattaactcacatttaaagcatgtatggcttcacgattctattattggtaaatttttattatgaacaacatttgtatgtactttttaacctcagataaagcagttttcaaccgatctatcgaagttttgatgagacaggaatatgtccatggtgccaaataattaacgccttcctcatttccaaaaatgatgtcgttgttgctcattgacacattaaacagaatttagactttaaaataaaggcagttaggtaatgaatattatacactgtgtaacattagaataaggacaccctattttttgggagtttggtcacttcccatgaaccaatcgagttgaaattttaaaaagcagaaactcaggttgtactggatttgttttaatttgtttgccactaatttttagactcaaaagaatgccaaccactcaatgtttgaaatgttctaatggagatggtagcttttttcaactggaaaatacaaaagttgcaggatattgtctacaatgtttttcgaaaatgattagacagaaatttgctttttgtcttggcaaaaatcgcgtgtttaaagaccaacaaagggtaagtcgaattttgggcattagcaaatcgtttttgaattttattagaaaccaaaggaggatggtcgggttagggattaggaattagtcaaaatgggtgtcagatgcgtaatcacgacccggaaaacccacgggagcaaagtttcacgacttattatgtatcacaaaaaaaatttgcaaactaaaaggattaccccgttggtttttaatactattcaataaattggtttttaatactattcaataaatcatcgattacaatattagtgccgtgtttttactccttattcaaattttagcgtgatgttttaattgtttgttattcaaatgatattaaatcgcttcaattgcttcggttggtacgtgaggcaacaactgaccaaaatgtacacaaaagactacggttgaaagcacaggtaaaagcccttttaaaattcaaaataggtagttaacttaagattttgtacctttcaaatgccatttcattgtttaatttgactcaagacgccgaaaattgtcgattgtatatcacaaactttaccaaataattggatttggcattttgcacatgaatcagatattctcaatgaagacttcagaaacaaagaccaggtttttattaaatctgtatgcttctaaaaatgttagaatgataaaacaactaaacaaattgttcacggaaatcctaagaaattcactgctgcgatacaatgagttatttgcgttgtgtctatcaaattctgatcggaatgagttcaaacgactgcttcgtacgaaactgatatattggtaataaaaatcggacacaaataattaaaacatttattgcagtctttccgaaatggagttccattgttctacagttttgttgccagacactgccgatgagttagctaatgacgtacttaatgccctctgttttggtagaggtgcctatttttcttattactaatagcacaaggacatcattttaacacatttccagttgcttccttgtcacatatggcttcaatgttggatgatcgcttcaaacctatccaaatcgttcgtccctttcgcgacatttcctctcgcgagttagaagcaatgcataacattgagcgggatgaatgcagtgaacccgtcttggcgtcttgcagaaaagagagtggtgatgtgtagttaaatgcatccggtaacaattaatatatgacaatgtttagttgatgagtctaattgtaagaataaatgtgacggcagtcttcaagcgcttactgaggattttatatcggaacttcgcaccggtggattcccagcgacggtattagtataactatatcagtaagacacttccattttctttttaaatattgcaggtatcgactattttaagcgtctcgataaaaattgacaatagaacagtgggtcggaattgtggactttgttacgaacaattcgaaattggtctctcactttaacagtcccaattaaaatttattgcttttagatgaatattctgatgacgattggaaaacaactcatacatggaacgaaaaaatttgccaaatttgctctcaattgattgcgggctctggtccaaaattcaaggaaagcattcaatgcatcatttcagctttgttgtaatttttttttgtttcctcacattgttggaatacaataaagcaaaacttatgaagctaggcaactgtacagacactttcgcctaattgtaagccaaaaatctatccaaattttgtttgattttcaaaaataacacaatagattaaattaaagacttgtgcaaaaataaagcaaattgatttaatgttttattttcaatatgatacaaaatcgattaaacggttacaattgaaaattagaccaaatgatgaaaattattggaacaaaataagaccggatagaaaaagctcattgtagatcaaaaatttgcatagtcactgatctcactatgataggttggttcagtgcactgctccatttatgccagtcacgttccccgggttgttgcgagccaagttaaaccttaaacagtgacatgcacaacaatggtattgaaggaaagaattgctgctgttacattgagtaggctgactccatagttatctcacgctcaatttcgagaaaatcgggcaaacgcggctcaggatcaccaatagggcgcgtggtatatgtctggaaagttaatcgagctataaaaacatttttaacaatgttttttgtctataaaatatggcaaatatttaattgcctcgaggatcatcagctggttttcattgtacatcaacgctggaggaagaggtgcaatgtaaatgtccaggttaaaatactgggaaaggaaaagcatattcttttagcaatctagtgacttttgaaggtatccgatttaccacatttccgaagacaaaacacacacgtttcttgtgaattgattgacggcttctgtcaagaagtttcaagtagctctgatactcgcgcctgtccaactgcttccgtgtttcaaccggttggggaagtctatatttgcaaaagagaattttttttaaaggcgaagattacttcttgccatcagcgtcttcaaaggttcgggtcgtaagtgtgtacgtgtactttccattttggctacgcgagcgaagtcgaacctgcaaagataaacttgtagcccaggtgtagcacaaagggatggggacctacagtttccatgttttctggtaaaaatgcgcgaaaaatttaaacgataatgagaaacgcaaaacgattccagaaatgaaaattgtcaaagaaaatggtgacataaatttcacgctgtaataagtaaaatttacctgacttgaaccctccgtactgagataatcatcctcgattaaaaattcctccttcttcatttgcaagaaggcatgtcaacgattttgctgaccaaccatttgcggttccttggaattttagatttatggaaaccaaatttattataaaattcacttgctatttgaagccaaacgatccaaaatcggaatgtcaagacgctcacaaacatcagcaataagtttggagatcttttcttcaaacgaacaacagtttgaattatcgattattgatagacattgatgcccaatccatgccttaatttcggcattggatgctaataaaataataaaaatacttctctggtgtttttgtcaagctcaattgcttcctccattgcttcggttcgggcttggttattcgcaagttgataaaatgattgtgcaccatccgcagcggtgacgagatgataaatcttattgttagaaatggatattatttgtaaataatgagcgaaaatgtctcacttggtggtatctttcacgcaattgatcgttgttcacgccacattccaccaatacatttgaccaagattcctcgtcggtataagcacgtccatccatcgca

SEQ ID NO: 10847 - DNA, 1263 bp, Heterodera glycines
tgagcccatggtttgggtccttccaaatcccaaattcacgtgttgtttatccgtgtccaattggtttgacatcccaaatcccaaatccacgtgttgctgatccattccgattaggccagcggatgccgagcccatggattgggtccttccaaatcccaaattcacgtgttgtttatccatgccaatttgtccggcggatgctgagcccatggtttgggtccttccaaatcccaaatccatgagttgtttatccgtgtcgaattggtttgaccttccaaatcccaaatccacgtgttgctgatccattccgattaggccagcggatgccgagcccatggatttgatcctttcaaatgctaaattcatgtgccgttgatccgttccgaattggtttgaccttccaaatcccaaatccacgtgttgctgatccattccgattaggccagcggatgccgagcccatggatttggtcctttcaaatgctaaattcatgtgccgttgatccgttccaaattggtttgaccttccaaatcccaaatccacgtgttgctgatccattccgattaggccagcggatgccgagcccatggattgggtcctttcaaatgctaaattcatgtgccgttgatcatctgctaaaattttgctccaaaaatcagtcggccattcgcttgtcgaccctttgtccccatcaattgtcattattttttcatattcatcgacgcccccgcaaagttgggcaaattgaaaaagcattttgaataacacaaaaaatggcatcattgccgaaactgacgaaggcattcaaaaattggagaaaaaatattggaaaataatgaaaatttatggaaaacattccttttttatatcacccgagacataaaaaacataatatttttatgaaaaaaaccacgtttattccttcgtcatgtgtggaaacgtcgaaataaaaaataaataattaaatatgaaatgggctgactgaaatttatgttttgcaaaaaatgcgcaaaaagaaatttaaaaaaaaaattcgattttaaaataattgtttaaaaaatgtaaattattaaccgaaaaatagcggaaagcaaaatacaatcaactttctggtcttattttgacaaatgataagaaaattatgaacagaaatgaacaaaaaatcaggaaaagcagaaaaaaataattttcaaaaaaacccatgccgaggcattcattttcctatttttttaaaccatttttaacaatttttttgtttttttt

SEQ ID NO: 10848 - DNA, 1796 bp, Heterodera glycines
attagttttttaattaattctttttgaatatttttttctgcttttaccttttttctctgtatgttttaccgcgtcatcaaatgcgtattcaaaatgcttattgacagcggaacagtgccaaatgctgcgccaaaaatgattttaatcgctggcggctcaactggtcttaattttattttaaaaaattaatttttttatcattttaattttatatatatatcacaagtgtctaaacaaattattggattggtaaatttttaaaaattgtcaattaaaatttaagaattttcaaaaatatttccgaattaattgccgccatttgccaatctttgaaaaatttttcggcattttcattatttttatattttttgaattatggaaaaaccccaaacgagcactctcttcaaatccatgaccaaactgggcccacccttttttaattggctttcggttgccttaaaatgccaccgaattggcactttttgccttttgaaccattgaatttgattttttcgaattattttttacgatgcgttttttctattattttttgctaaattctcttcaaagagtcacaggaacgtggtgctctgaacacatgcgaactgttctcaattcccgacctttgtcctcagcccaattccccgccaatgaattcggcacgacgcgcgccggcacttttccaatttaaaaaagtaattagcaccattttcggcaactgaaatgatcaattaaatattcattcccccattgatttgtttgttcagaatgtttttgcggtcggtggttgttctggcccgggacaacatttggccaacgccgaatctgtccaatttgacggtcattaaattttaggcaaattaaattgccaaattcaggtaaaagcctgacagaatggaaaacatacgaatttgaagtgccaaatgctttttcctgcgcctcgttttgccaatttttggtcattagctaatgaatacactaattaatgctcaattaagccattcgtttttgcttctgttaaaggatggcaccgcctttgcgttcggtggctttgatggtgtccaatgctcgcgtcagtcgctgtgcatccgccccctcctacagtctctccctccaccgtaccctacagtattccaaccagagaatccgctaccgtatgctctgaaaaacggtgtcgccatcgcagtggcagaagaaggccaatggcatgaggaggaaagacaacgacgcatttggctggtgggcggttgggacggacatcggacattgaaaacggtgaaaatcaaatcaaataaaaaggcaataattatacataattaagtgttaattagtagttattgattacataattaattaaatggttttccttaagctgttcgaatattctttgcccgggggcgactgttcgctgattggtcttttgccctgtaaaataaatcccctcaggtgatttcctcattttaaaatgctttttcagacccaatcgaaggccattccgtagcaaagtcttcgctggtggccccccaaaaggcattcatttcgggcggattcgatggcattagggttggaaaatgaaaatcaaaaaagatttgtatttttgcatattttaaatttacaaaataaaattttattcgaaatcttttatttgccattgtcacttttgttttcttatttttagctccgttccgattttctcacgatcgatttgcagtccggcactgttcagcatttggccggggttgggctgagaacggcaagagagaatcactgctcagtgattttcggcgaggccaagg

SEQ ID NO: 10849 - DNA, 1448 bp, Heterodera glycines
  misc_feature (90)..(90): n is a, c, g, or t
  misc_feature (112)..(112): n is a, c, g, or t
cccccccccccccccccgattttcgggctctaaattttctctggaataaatttgaaaaatataaaccttatgggagaaaaatgtactttntcgccataagattggtttgtanaattttaaggtcataaagagccaaataaagcccgcgacgaagaaagtgcgtctcaccgttccgcagatgaccacagccttgggaagctgttcggtggtgagcggtggttcaacagtcatcacgcctgaggaagtccgacggcgacttatggtggtcagttgtgggatgccaaatggaacaaacaatcaaatcattgcaacttaattgatttgtaggaaaaaaggaacgttcggagggaaaaactgcgggtcaaagggcaacagaacgcggtgcgcagggggcgccaacagaaccaggaactgatcagagagtacgcgggatgggaccaatattgacgacggactcactcatttccatttgttgattattttgtttttttcttaattgctgaatgtcttggaattttatctttttgtcgtggacaaaagtaaacagtgaaatgatggctaatttttgaacgaccattcaaagggaatggaagagaattgtctgctgctaattttatcggaagcattccaaaatttttgcaaatattttgcttcacttttttgccgtaaaaaatgaaatttcgaatgcaaaatattttagattttatttgttctaattaactatattaattgttgctattaaccgtttattctaatggagaatggcaatggaattgaaaagcgaggattggtcgttgaggacggtgacggagtggggcactttcatttcccttttctgtattttgagatgctttgtccttcctttagcaccccctttcgctttttgccgtgccgaattgttattgtgcggacttggattcggtgctcattccaaacggaatgattcacgacagaattcgacgaatggccgacgaaattcaaagcgcaattggcgacagagtttcttttaaaccaaatttgaattttgcgcctttttggcgttttgttcagcctctgactttggtctgtttgctaaagggcgcctaccgatttttcaccgctttggccgactgtttggcccaacttcggctctgttgcgcatctccgatgcaggaaaaggaccttctcatccccccatcccaaaatccccgctgatttgatcatttatttagaattttcccgaattttcgaatgtccctcgtcgtttttccgaatttttcctttttttcatttcacttctctcctcccctcaaatgactctcttctcccaaaaataatcggcccaatgcgtttcccttttttagatcgaattcattcgggcgcaaagctatttggaccaatcgtccacaggccaattgcgcagcgaaggtcgttcgtccattgacggaccgttgcggggggcggaagtg

SEQ ID NO: 10850 - DNA, 2540 bp, Heterodera glycines
aggaaacgcatgagtttggtttgttgggagtgtattgaatgaatgggcattgttcgaggagggggggggggggggggctaatgattgaacaaacaaatcatcgaattaatatgcaattagtcaaatgcaataaaaagaaaaaataattacattgtaaataaacatggaaattaatgggagggaaattgccataaatgacaatatttcactaattattttaattttaaaaataaaataagtaaaaaagagacaaaacttcgtcaatcactgttctgttccaaaaggggcgggcggaaaatgcgcaaagacagcgacggggcgagaagaaactgcccccggcggggggggggggaggggggaggcgtcgccggagggtttggcgccacgccctccggggattccctgccgcccattgcttttccgccgctgacagacgacccctcccccaaactgccaaactgttccgtctcggtgttcagtttaactcattttgtaaattcatttccggcacaccttttgtcctcccttccatttttcattttagtgagtgtccattccgtcttccgtccgtccgtcctcttcctcctccgttggcctttcttccttcccatgtttctcttccttctcccttttcccttctctctcctcgtgtcccctcttttccgcttcttcgtctccgtttggcccttcctccgacgcatttctccgcctttgtttttccttttgctcaatggcattgtgcccgttttgtcctccccttcctccgccgccatttcaaaattgacttcctccgcattttcatccgtgctcgacaacggtgtcattggtgtgggaaaagaaacacgagcattatttatttctttccaaaacaaaaaattcatcgctttatttgatgacattaaataccaaaaaaagaggcaaaatgagacgattaatttgggaatttaaaggtgacccgcaggtggactgtttggaagaccgcgtccgattgaccttccgaacgcagcgaccgttcacaggacgtaaaagcgatgagaaaagggagagaattggcagaatttattaaaaatgattaaggaatatttgtgaagggaatggtggagaacgacaaatgcgtgaacaattaccaacagaagggccaaacgaaggtgaaaaggcaaaagcaatactcaattaatgggggtggtaattggctaattcactcctaattaatctaattaatgagttcctaattaattaccccccccctctttttgcttgcttccattccccgcttttccttctcctcaggtggacttcgaattgaccaatggccagtgcaatatgcgccgctccagaaaggttgtttgattacgccgtgactagagaatgtttggcacttatcttttctgaaaaagatggcttaattctattaagccattcattaattgctttttcttttttttcttttccaattttggcattttctgaaactttcggatgttttttggaaagcatttgaacttttttttactacaataatatttacaaattgtttctcctccttaaaaataatcaggtcaccgccccaaccaaaaatagagagaattttgaatcggacgggcaacccaaagaaagaaatgaccacccaaaactcaccaaacatttatttctcttctcactttcaagtgccgaattctctctcgccttttgagaagaataaagcgaacagaaaaaaagaccttatgggaaaataaaaaaaaaagtttgaaaattcgggggggggggatttgggatttggtaagtccaatttgccattaattattgctttgaaccgtcacattttctgctgcttgacaaggtcacacaacaacagctgcaaattcatggcaaactgctgattatatatgtttttgtcttttttgtaatgagttgttttgagaaaggaaaggcgccccggggggagggaatggcgccggggggcttttgccaattctaatggatcggttcatcaaacccagcagaagtgccacttcgtatttcggcccttcaatttccgattgtccttttcagctcggccctgaacagcggggcgtggaacagtccgtcaccataatcatttcctttcacgacattttcatcacaaaggtcgatcgggcgtaccgttgcacctgcttttacatggtttagccaaacgaacattcaaatggcaaaggcttttcttttctcgcaggaagccgacaaagtggtgacgaaccgtttcgatgtgaggtaaaacgagtaaaagatcaatgcacataaaaagtgaattgaatgccgtcctttacgcagtatgatgccaacaacggaattggtggacaccgcgcgaatgccaatgtgcacttacaccgtacgcattcccactctctttggagttgctgttttaaatggggacggtcttcagaaacggaatttcccatgccaatttttggatttgtcctcatgccatttatgattagcttcggctttatcctccatgcttttctgctgtcttttgttttgaactgtgcatttgaccccaa

SEQ ID NO: 10851 - DNA, 1748 bp, Heterodera glycines
  misc_feature (525)..(525): n is a, c, g, or t
cagtcagtccaacttggcctactcgaaagtggatgtgtcaaatttgcggacaaagtgaccacttattttcaggtgcgcaaatattccttaattgtttttaattgcgtttttcttttgacttagtgcgccgtctcaacttgtatgatttccgagggaatgtgttccggaaaaacagtgcctttttcgctttgtaaatgccaattttgcgttttttttaagccgccccgttgcggttcgggcgcgcgaagacggcgcaccattgacaaaaggaatgaaaatggcggggccaatggcacggcatttcctttcgctgccgacgaccctttcacaatggtgccaatgaaaaagcactcgcatttctttataagcagcagtgaaactcatttttattggaaaggatttggcagctgagaaaattgttgttttggatttggaagattcgacgcaaaaggaggaaaatcagcgcagtgaaagggccaaaggacggagtgagtgaatttggggggggggggggggggagtttgngacggagacaattccaaaacgatgggaaaaacgaaaaaaggcgaaggaaagtgataatctggggggtcaccattgacagttcatttccatgccatttgtcgtgccctttaagctgcgcttgccgctgcttctcgccttggccttcctcaatcgcctcagttcggttggttttccaacatttggacaaataaactttctgttttggataacatttttcccctttgacattggcatttttcatttcttccatagctttgctctatgacaattcggtcgtttgtctgagtcagccattcgttggtgttttgctctccaccgtggcattggctgtgattggcatggccattgcgtcggcacttttattacgccaccaacggaggaaatcaaaattggaaagcgatttttgaaaattcaatcaaataatttatttgtaaattatgcatttaaaattttaaacgtggaagaaaggcaccgttcgagaaaaagacatgaaaaaggcaaaaacgttaaaaaaaggcaccaaaattacaaaaaggcaaaagtttttactattaagcttcgaaataagtttgcaactcatttttcatgcgtattaggccatagaagttagcaaaatgccttaatccgcgctctacatactaaaaagtcaattttttaaatttaaatattttattttttgacgtaatgtttttgtaattttttgtttgtttgtttagctcctgtcctgcattttttaggcaaacaaccgggatccgggtcgcattttgatcatttcttaacaaattttcaatcaaaattattcagttttatgtaaaatacaattcttatcagtgtgtttttaccagggatggcagatctgaggctttagcctcattttgtggttttttgacaggtcaatgaggctaaattttcaaaatgaggctttgaggctttttgtggttttttgagaaaaaccgcaaaataaagaatttttaatgaaaatatggtcaaaattcttaatttttcccccggcggcgcctatcggcaccaccggaccgtaaaaatccttaatttacaagcaaaaatttgctcaaaatcgcaaaatttggtcatttttcggacaaaatctgttaacaaatcgcattgaaaattacaaagtgttttcccggggggcgcctattcgggaccggcggcccccccttggttccccaaaagtttttttggaaaaagcggccgcaaaaaaa

SEQ ID NO: 10852 - DNA, 4414 bp, Heterodera glycines
  misc_feature (4320)..(4320): n is a, c, g, or t
  misc_feature (4336)..(4336): n is a, c, g, or t
  misc_feature (4346)..(4346): n is a, c, g, or t
tccctaaatttgaaactttttgacacctattttctcatttttagcaattattttgggggttttttagaacctaaaaattaactattttggcaattttagcacctaaaaatataagcccaattgatggttttgaaactcaggctgagtttatagtcaaaaattaatttgaaagtcaggatggttatttttgggttttattgtatttttaaaagatggaaaccaaatatatgtcaattaaataaaaattaaaaaatcataatccgcataacattctgtcaattattagccaatataatttgtaaaattttttttttattaccctaaagtgcactttataaaaatggatttatataaaaatcaatcaaatgcacttttcaaatattcaatcattcgttcaaaatcacattgtatctatatttttttatttaaaaaaatcgcacattattaaaaacgtaaatcataaatttttgtattattttttaaataaaataattaaattttccaacatttttaataaatttaaaattaagaaagaaaaaaaatgttcattttctgttttactctctgctgtttggtcagtttggcatttggcacactgctaaatgtgggcattgaaaatgtgccggaccaaattgtgatcaacgccaatcaattaacgccattaacataccatttgcttaaaattttggaaaatttgatgggcattgtgccaaaacgccatagttctatcaatttccgaattattccagcagttgacataccccttgtcgaaatggtgtacagcggtcgactgaatgtgcaaaaaattttgggagaaattgcggaaaattttgaaaaaaatgctgatttggcacaaattttcgagcattttttgatgtttgctgatggatattaccaacccgtacaaacaggtgatgtgaaccatcataaacaggaggagaatgcatcgcgaccaagggagttggaattccattacattttgttagaagcctagtttcaaccctataaagtcccttcaacactttatttattactttttggctcatttaaaatatttcctggaatagagccacccctcctgaaataaagcccccgttttgatcgggagggggggggggtctattttaggaaaaatgttacattaattttttttttaataaaataataaaagtaatcaataaatgttttttgaaacggtgaaaattgtcgtttttaaatacgcggtacgcaaatgctcgattcgtggcagtggaatttctgtccacgctccacccttaacataaaataaatttaattttttaatttttttaggaaatgctgaaaaaaagaaagcagaatttttattatattgtatttattcatttgtgaataaaattacacaaaaatgtttgcaattttttgacaatgatcctttggaggcaacaaagctttgggctgacattagtaaaaggcaaaaactttaataaaaaattaattaattaattaagtttaagctttatttctcaagtaacgcccgttccccactcaaaacttcgtgcagttttttcccaattttgcattggccaatcagatggatttaagccagttttgggtgaatggacaactaattgggctacaaataatttcaatcaaaatttggatcaaaaaattcatatcaaattttcgacaggtaatttattttatttattaattattacgttggtaaatattttttaagaagtgatgactctcaattatatcaaatctgacgaaaacaaggcggtgaaaataattttgatcactcgtcatcgcgtaaaattaaattttaaaaatttccaaattaaattttcttaaaatttagagaggctttacgtttcggaagaaaaagaaatttttcaatttagtcattgatgggacgggtaaccaccacatttgatacacaaaaataaattgtgtgctgctttcttcattttcatatttttaagaaattgtcaacacagatggtgggatatttttgacaaaaattgataaactttggcctcaaagaacattcaaaaagtaaatttttaattatttttttttgaaaaaataaattttaatttagaaaacgaattttttgtggcgctttaaatgttagtgccgcgaaaattcaagaaattttggaccaacttgcagcatcaacagaatatgcatataattcaattaaatcgccggatggaaacaatgcttttactaaaatgttgatgcataagttagcgtctgttgccggtgatcatcagttgaacataagccaaattcaatggttttctgggaaaaagttggtaccgaattttgccagatgcaaaatttaaatgtatttattgtaacgattacttttatgtaccgtatttcataaaatagaacccaatccttgctaaattaaaacaaagccccccttccgcgagcggggttgaaaattgagcctcaacccttaaattagacccccctgaaattaaaccgccgctccccttccgaggggggttgaaaataaagcccccaggggttctataaaagaaatcccccagtggtctattttttaaatactgtatgtaatttgtttaagtgatcaattttttgcttcttcttttatttctcatgttttttccgggttatttgaaatccaatactcgcagtcgattttctcgattagatacacgaaaacccgctgttttaaagacctgagatattcctttcacaagaatgtatttatgtttaattgtttttcttactttttttccattcaaaccttaattgggtaacaacaaaacttataataggaatttcttactaaaaaacagtattaaagaaagaaaaaaatattttttttactcgaatatagaataaaaatacgtattatcagactttaaggaatgctgaaagtttataagtttatatgaatttttggcttatatactttatccgttgtatgttttccattatattatcctaaagtatatatttggttatttgtatatattttgtcgttgcaattttatactttttttattttatattgttttagtcgtaaaaagctttagccgtaagtaaattcctttttttcaactgagaaaagaacaacttatgtttggcgtgggtgtgtagcacttagcaaaagcacataaattaaaatgtgctcattaagtcgcattgaaaagaatacatttttttgtgagtgggcataaaaattgtcctaacgttcaattgaaagccggtctctggatgctttaaaaatgaacaatttagattgttaaaaaaaaaataaataaaattattttctcaaaaatttaatttattcttttgggtaattaggcatggcccggggataaaagccgaaaagttatgtgcataatcaacagttttttacttttttaatctggaatggcacggcaaatggaaaagtaccctcaaaaagaggttacgtcaatgctttttcccccgcacaactatgtatttaccaaactacatcacaattagttgaataaatagaaaaacgattaaaaaatgtgactttttgtccaatttatttgtttacattttggccgtataaagtgtaaagatgaaaaacttttttttttcattggtcgagacatttttaaacagacttttgcttaacagaatgaagcaataaaaaaaatgtttcctgtcccgacaaattgaagatttgtataagaggaaaatttaattactaaatttttaagatttttgaaatattataatagaacgcaattagctaatctgtctctattatctttcaaataaatccaaaagaacaaattcaaaagaatgaatttttgtgtttaactaattgcaacatttgtaaaaattgtctaaattgcttaattttttgattgtcatgcatttttaaggattatttaatttctttagttaaaaaattacacaataaagtccaaatttcttaattatagaatttatgaaaaaataattatatggtaattatcctttcacaaaaatttatgtatttaatgcgaaaatttttacagaagggatccattttaatagctaaaaaaaatttatgcgtggaaaaaatttaaattatgtaaaaggataaattatttttcaattttttaatgccatttttgtatagccatagcaatttttttgataagattttttggcacaatttttttcaagctttcaactaacccaaattctcagattattattaatagttttttattacctaaagttaaaaggataaaatatttttctatgcctttttttctataacagtagccgtttttagtcagctttttggtacaaaaataatttttaaaaactttnaactaatcccaaattntcaaattaanatattcatcgttttttttaattttcaataaaaaagatatttatatttgggcagtgcacaaaaaaattt

SEQ ID NO: 10853 - DNA, 4254 bp, Heterodera glycines
  misc_feature (4065)..(4065): n is a, c, g, or t
  misc_feature (4171)..(4172): n is a, c, g, or t
  misc_feature (4188)..(4188): n is a, c, g, or t
  misc_feature (4204)..(4204): n is a, c, g, or t
  misc_feature (4222)..(4222): n is a, c, g, or t
aaatctcaaggctcttaaaaaggattttgctgtcctcggacggtcgtcgggcaatggaaatggcaaagatttgtcatccatctgtacagatagtttcggttctggtcctttgtccttgctaatttcgatagttctccaaatagtcaattcgctttttccatcgaaatgtttgtccaccaacgcattgaaacgtggcgaaagaagtgccattttgaggccaagttgaggacggtcaaaagaggggaaaatgtccatccaaacatcgttgcaaatccaactgaaattatggaaaaacagtttagttaaataaatgacgaatttgtgtgacttttaaaattcattaccgtcggttcatttttgaggcaattagcacaatttggccaaattctgaatgatgtcaaacaaaagaacagaataataattcgttggaaactttatttttttaatgagtcaaagcggaaaacaaaagatttttatagtcatgaaaagggaattggtgaatattttttgtatatgaatagagagagctctgatttttttagatttttcctattttttacggattgtacttgatgaaagaaacacgaaaatcacattttattaaaacaatttttgaagttttttgccttaaatggggttggacaatgtttaaatgggaaacgaaaaatcattgacaaaaacggaagtgaaggaaacattttggcataaaatgaccgattggaagaggaagaaaaagggaacgcaacataagaggacccatcaaacaggagaatattttgcaaaattatgaccatttgccgggcgttttaccctaccctccaccaacaaatcaatcaaataaatcaatttgacggataatttttcatttgtaaaggttaaatccgcccttttcaaattttgaaaattggcaaacgttatgattagggatggtaattatatggaaatccatatttttttcctggaatgtgggaggcctgaaacgcacgaaaaacatgtttttagcttggtttgaagctaagatggatttctatatccatattttccatattttgcgatttatgtccatattttggcattttcccaaaaaaaacctctattagaacggcccccagcagctaaattagcctttttgagcccaaaacccgaaaaatttttcaaaaaatcattttttcgccaaaatttctcgagaatattgaataaatttaaattttcctaaaaattggttaatttatgtgaaagataagcaaaaaatggaaaatttcggttttttggtcgggtttttttgaaaatttacccctcaatttagaaaaatttatgtccatatttttgccattttatgtccatattttgagatttttaccattttatgtccatatttcgcgatttttagtccatattttatggccatatttcgcgattttatatccatatttttaccatccctagttatgaaaaagtcaaactatctaaacgattaaaatggaaaatcatacataattcgtgctatgccaactcgtaaggctccctgatgtttcgtcactgaaataaaaaaaataaaaataaacactatgccatatacttaataaaatttttgaacaaaaaagcattaaatttgtgttaagtggtgtgatatttcacatacataacacaccatcccgaaaatgagctcttgtaagagtttttggaaattggcaacaatttgaaaattttggtatcattcgaaagcaattgatgagaagaagctttttctcattaaatgctaaccgattggatgagttagaaaaaagatatgggcgttcgaaaattagttttttgaataaattttcaatgggtcttgtcccgcaggtttttgaatccggcaaagagttgttacaaattgttgtgttgcagataaatggactttcttaaggccttttcacataatcccgttgaccgttacattatagtaatcggatacaatgtgctgccagcgaccaaatctttaaacattcgcttaacaaatgcttaacactgggggtacttccttgttttgctacgcctccctccccaaaatattttaaaaaatcacagatattttgtccagtctatgaccaggtatgtaggtatcagcagatgtcaaaacaaacgccatattgatgatgatcagtgaccttgaaaagcccaaaaatattaatttttaaaatttttcgaggggggggggggggtagcaaaacaaggagtaccacactgggttaggttcaaggatatattttgtcatccctaaaatttcttgttaccacagtttaacacacttccagaactcaacattagccaagtgtcagaaataacccacaaataaccaccaaaacacgggggaggttaaaggttattctcatgatcgaaccaatttctaaaacaaattaatcggcctacgaatcagaaagttaaatatgtattagactagtgtttttcaaatagattatgtatctatgtatataatttttaatattttttccctttaaaattctttattttatttcagtgacgaaacgttcggccaccaactcgtaaagctcttttttcaaaaaatcaacaaatttggatgacaaatttgtgccatttccattgccggaccgtccgttgcccagcaaaatccgttttaattaccttcggattgagtacttaaaaaacagttttatggcaataaaagcattccttccatttttaggtacgttgatcattccgtcatcgcttttcttcgttccaatcaccaaattttcgacaaaagaggcacctatttatacttgcggattcaatcatcacacaccatggaagagcagccaatttgggatgtttttgttcgtgaaattaaagatggccaacccaagcgattgcgttgcgataattactacgaacaaacggacttagattggatcaacaatttcaaggaggtgtggccataatctcgaaaaatcactgatttttgtttcaaattgtttagcattttcttcgtgccaatgccatttcttccatcagttacgaaattcatttttatgtgcaagtgtcgtcaatgctaatgatgccatttgaatgtgtggtgaacgaatcgacaaaggaaaagctgacattgaccaaagcaaatgaaaataaattggacaaccgatggataatgaaacgatgcaaaattgggaataagaccgcggcggttcagcagcacaaagagggcgattgtaacaatgtgtttttttggctttttgctgacattaattacatttggtgagcaataaaaaaaaggcatttaattttgtttaaataattaaaattttgcttaatttaggccattgtctccgccacccggcccataactttttttctgaaactcggatcaaaaaattcccgctgtgagggcactccgcagaagtgtcctctataatccagtattttttattttttgatcagaccaaatcccggacctgtacagacacggagactcagttaattttttttcccacttcagtaccaggtgaataccacgtcagggtttggtctgagggagggggtgccagcgaacttattgtagagtttaatgagctcgatttttcaaaattttaaaatttcgaaaattttcaaaatttttcgagttaggcctaaaagtaggttttggggtttttgaattttaggattttttaacgaattttcctgggaaaacggagaccactttcaagcaacactttttcgagctctatcgactggtatttttttcggaaaaatttcgattttttcccggaaatagaaaaaaaatttggcctgagcgggacatttgagtcccgggtccataactcgttaggggttgattttatcgaaaaaacgccttagggcaaaattgtagagcttttaaaatgctatcgaatagtgtattatatggccggaaattttcaaaaattttcgagctaggccccctagaaattttcggaaattttttttgggttgaaaatgagggtgaaaaatttttttctgggtatttttaaggtgctgagtacgaatatgatgtctattttaagtttcagaatttttggaattttttanaaattcgaaaatatttggcaattttttggccctcgggattttggcctaatatttgaaattcatacaaatcgaaagggtgatcaattttacagaaataaagccttannaatagataaaaatcangagaattttatggacntttattagaatttctatnctaaaaaaggaaaaaagttattccagaatttc

SEQ ID NO: 10854 - DNA, 1026 bp, Heterodera glycines
agggctttttgtcggggcattgccgctgttcccttcggatggcattttaatcctcctatgcagttaatttccccctgtgatccattcgattccctacgagtaagtgtctctttcgtgggtaaggtacagttcaagcgctactttcaatatcagcagaaccttcaatgaggacttctacgtacgtcaaccgccgctcccatcgtccatcacccgcccgtctgaggcctcgaagctgccttaatagcccaacaaatttagaaacgggcgcgaagcacccgtataagcccaacaaaatttaaaaaacgggcgcaaagcgcccgttcgaggccgcgaagcggcctaaaagtcccagataattttttaaaaattccaaatctccacaaccagagctaatctaggtagcgaagctcccaaagcgcgaagcgctttttcccagctaaatagccgacggtttacgcacccgctagtttatctattatatacggtggctggtcattttgatcatcaaaacacgacggtcggcacaatgttcagcagacgtgccattctttccttctttcttccttccattgttcaggaggaacttagcagcagtgagacaatcattccgtagagaccgagcacctgaacagagcaaaaagaaaattcaaataaatttacccaacagtttcgaaacgaattgggacgactgagcaccgaccgactgaggccacgccagccagccggtttttgggtataaccccattcatacctgttcgaattgaatgaatttgaaatcattcgatagccctaagagttctcaatttccttgtaaatttttgaaaaatttagtttaattccaaaaaagttattgccaaaagacttaggatttgtttttccaaacattttttgaacacaacttttttaaaaacggaaattttttcaatttaaactttagcaaggtttataaagatttttaggcctatcggatgatatcaaatacattcaattcggacaattatgaaaggagttatagtcgaaaaacag

SEQ ID NO: 10855 - DNA, 5404 bp, Heterodera glycines
tcccccccccctttccccgtatatcaaggccttgctataaaattgcctcctcatgcgcttctaaatcattcactttcgcaaatgcctccaagcgaaaatttttcaaatatctcgctagatattaatgatttggaagctcgaccgctgcctgagccccaacaacccgaacaacaacaagctgaattattgattcagattgttgatgttgaggaggctttgcttttcaacgttcatgagggagaagaaagaagagaagaagaagaagaagatgaagaagatgaagaagaagaagaagaagaggattttgtgcaatttgaagaattgatgcgtttacatgccgagtatgtagcgcaaattttcaatgaaattgatgatgatgaaataaacaatgaatgatttttttgaataatcgaagatgaccgaaaaaatggattctgttataagctccgccccttttgctgtaaatttatttgttattccgcttcttcgttcgaatgaggtcattaacatttaaaatattttagcttatgggcggagcctaatttatttatctaagtccaccactaaattttctgtataaaagcacaccgctttgctcactttgttcattcgaacagaagaagaagccgaagaagcaacaacaacaaaaaataaattcggagccatcgactagcgcatccctttgaccaataaaaaaaaatatatttgttgtgtttttttgagtgtttaataaattttttattgttaccattattcaatcttttctcccattaagaattaaatggctaaccgaaatccattttctatcgagtctgtgcatgagatgcgcaataggccaaggaacactcggggagaagtggcccaagtgcgttttgtcccgcttgaacaagtccaacgaccggaccgcgtgttggaaatgcttgttgaacaattgtttgcgcgagtgcttggagatcggccaccgccctccttgattggcttacaattgcacccgcccacgtttgagaatccattcacaattgctcttcggcctcctgaacaaaacaatccggccgcaattgctgactatattcaacgtttgaacgatcaatcagcggcaggaatagacttaacagccgggacaacgcttaccaaagttttggctgtttggccaatgcatgatgatcgaacggaaaatggacgtgaaggtaaaagagaccacaatggatgttcattggatcatttctataggggcgtgttcatgggatcatgaacactccgttgttcacaccgtcaactcactagtccggattcggaatccgaacgacagattgtgcctagcaagagccgttttaattgggttgaaagaccatcgttcgcgccagtaccaaaacacccgagctggacaacaaatgtttaagaattatgttggccaacaacgatttcatgggcctgaagctcgccatctgttacggagagcgggaattaagacgaataaaaatatgtacacgctggatgacgtcagacagcttcagcaatgggttgatgaacgttacgaagaggcacagattcgtctaactgtttttgagaaagagcgacagtatcgaattgtttacaaaggggcgtctggccgtgctgctcgcttcaacctgtgcctattgttggagaacgcccattttcactatgttgggcgtattgaacaactgttccgttgcacgtcctattgcgttgattgtgaaaggcgggtgactcgttggtatcatccgcaagaatgcaaagttgtttgccgcctttgtctacgctacggtgcagactacccttgccaacaacaacaatttgccaacggaaggaacagcaaacatttctgtacacagtgccaattcgttttcccaaatttggactgctacaactatcatttgtccaatcgcgcaccggccaacttggatgggcgaagcgggcgcgcgttccgttcaatctgcgaatggaggcgtgtttgtcgaacatgtggggggatcgtctatatcaatttccaacatgtttgtccaccctcggtccgacaacaacaacaacagcagcagcaacagcaatttgcatcattgtgccaccagtgtgggggacctcatgcggaagatggtccatgttttattcagccaatggatggacgtcgtgtttttgggcaaacacgacgtcaacaaaaacaacaacaacaacagcaacaatcttcagttgaaaactgtttgaatggcaacgatgatgctgccgataaagaagatgataccgatgatgacaatgatgcagaaggcgagtcccagcatggggctggtggtggtggccaccgtcgccaagcttctcaaaaaacaattagatattgtttcttcgatgctgaaacatctcaggacaggccattacaacttcgaacacaaattgcacaaaaacatgttccgcttttgattattgctgaagtgatttgcgagcgctgcattgccgatggaattaccatttacggcggtattggaaagaaggcgaatggttgtgtttgtggcatgccatcagggccacggggccgtctttggtgtagcccgccctttcgtaacgcaccaaatgacgacactgagatgccaacaaacatcacatataatcctagacgtcttttcttccactgctttgaagacgcaaccaaaaacccagtggaccagtttcttgacttcctcatctcaacaggccctcgaaaatcgcacactatttgtttgtctcacaatggtggaaaatacgacatgcatctggttttggaggcactacatcatcgaaatttacccccaaaacgaatctgcacaacggggctaaaaatttactcaatgtcgcttaaaggaaatcttcagcgccaaataacctttaaagacacactcaattttttcttctgtgaacttgacgccctgccaagaacgttcaatttgccaaatgaaattgcaactgccaagccgtttttttccatatttatttattcgccaccaaaatttgaatgttcgcctccaagggctgccaaatgctgtattctatcaaccagaccacatgaaaacggccaaacgcgaacaatttttgagttggtatgcttatgaaggagcagtcgccaaatttcagctcagagaacaacttataatttattgtgcgaatgatgtagctatcctgcgtgaaagtgtgctgaaatttcgccaattgatcatggagaataccatgggcttggatctatttgttattgcatctacgggtgcagcacttgcgttggcaacctttcgacgttgttttctgtctcgcaataaactgatcaacacacctgagggcggttatttacgaggaagacgcgcatcggcagaatccgcacgatacattcgcatgtatgaactgatgaacccgggtgagcacgttcaatcggcgcaatggactgtgggggaagcgcatgttgaggattctggttatcgattggatggattacatgttcgtctacctcctctgcgaaatatagcgattgaatacatgggctgtttttatcatggtagtattaattgcgttaaatgcgtatgaaaaagaataataattctcagggtgtcccaaatgttttccaaacgatcgtcaacaaactttggctggcggtagatctgctgaagagttgtatgaacgtacacaacgccgcctttgggagctagaacacacgcacgggttcgagcttcacgttgtttggggatgtgagttgaagaaaagtttgcgggccaatccagtgcttcggcaaatgtacaatgacgccttcgttcctcgcccgttggatccacgtgaggatgccctgcgtggagggcgcacagagccatttactctccaacacatttgcactaacgatgaggaaattgttctcatcgatattgtttgtcaaacacaacagtgaagcaaacataatagcattttaattcaaggtgagtctctacccttacgtgatgaaggcatttgattttcctgttggaaatcctcgtgtgcttacacgtgaagtgcttttacaacctccggcatctccattaccatggcgaaacgcaaactgcaatacatttcgagggctgctgtttgtttctgttttgccgccagatccggttctaagccctcttcgtatcccgctgctaccatatcggacaaatgatgggcgcctgacttttcctctctgtgctcgttgtgctgataatcgccaacagcgcgcatgtgcacatacagatcatttacgttcttggaacgctgcgtatgaccccccccccccgctcatcgattggtttatacacttaggtacacacatgttgaactaaacaaagcacttgaactcggatataccgtaaccgatctgtttgaggtaactcgataaatttgaaaaaaagttgtaaaaaaaaatataggtttggcattatgatgaatgggatgctgaaatgtttcgtggttatatgaacacatttgtgggcatgaaagttcaagcaagtggatggcctactggttgtgaaagcgaagaacgtcgcgatgactatattgacgagtttgagcgtgccgaaggaatacgactcgaccgtggaaaaattgcaaataatcctggtcttcgaatggttgcggtaacatgccttgagcaatgatcctctatgctaattctactttagaaattgctggcaaattccctttggggcaagtttgcccaacgcgtgggaagaaccgaagttcgttacgcttcatcgccatctgagttccactgtttgctcgacgacccttcgatagaagtactcgactttcatcatgtttcacctcatcttgaccgtgttgttgtgaagacaaaagctgatttttcaaaagcaccagcgaccaactgtttgccgattgcaatttatgttacttcatacgcaagacttcacctttattcctacattgagaaagttgtacaacttggtcataaacttctctattgtggtcagctttttagcttgtttttttacattctagtgattagataccgattctatttattatgttgcaaaaaatggggagcgattggtgcctgaaggagaggctcttggtcaaatgaagcgagagcttcctgaacgtcgaatatatgaatttataagcggtggtccaaaaaattacggttttcgacattgtgatcgccatacccgagcggaagaaaaagcagagctaaaagtcagaagttttcgcctctcatattccactagccagctgctaaattttgaatcaatgaaagacattgttcttgagcactacgatcatgatggacaaatgtgagtgtgttaattagaccttcttacaatattaatctgctgctgattatttttagtgacgacgcactatattagaaggattatgatgacactttcgttttttctggctcatcgcg

SEQ ID NO: 10856 - DNA, 3168 bp, Heterodera glycines
ttgaaaaatttttcatttcttagggatgtatttttgaaaattttcgggtcgcttcttaggggtgtatttttcgtttttattgcatttttgttaataattttgggcaaaacgccaaaataggcaaaaataggttctttcaaaaatttttaggctttttaggcgctaaaaataaaaacctagaaaataggcagtaataactcgaaaagtagcttaacaacagcccaaaaaaacgtttttcgtgcgtttcaggccacggggagctcaggaagaaataggcttttgcctaaaaatgtgagctctactgattactgtccagtttatcaattttcagaaatggctaagtaattaaacttctcagctacatcgaacaagtgctgtctggcgccagtcctcgttttgatatggttgaattttctcaggacggctcttggtctttttgtcaatcacccgacacaatgttagacacggattcggaagacgaagaagctgatacaactgcgtcaccatccactgatgaaggattacaaaagcaaatgccgattgagaagataataattaaatgagggtgactatgcccgtggcaatgaagaagaatatgaggtctttatcgatatttcgaaacccctagttaattaagaagtaaaatccatgaaagaaaattgggatctcaaaaatagtcattttgtggataaaaagcttgaaaaatttcacgggcgaggcaattctgtcctcaaatattttggaaataaagcgaaacattttaagttcaaaatgagtaaaataaaccaagtgttcactttttattggttctggtagtcctatggtgactttatgcactttagaaattctatgaaatttaaaaaaaattctcacctccagctcccgatattttcaataatatttatgcttgttaattggaggatgacggatattattttttcagtttcatcttataatttatacatttattatgagtttgttcgtatgaagctttgttaatttcatctcggcgtgataagaagattgtatcattttatattatttttaactaaataaactttatttagtcggagataaataaaaacaatcaaaaattcgtatttctgattagggatctttgaaataattttttaacttatgtattatcaatattgggtcaacatggtaagaatctttaaaaattattctattttatatttttcttatttatttttgtgtgtttattgacaataaagacgataatcaaaataaataaataaataaataacgaagatgatagggacaaaataacaaaatagtgaagggtgatatctcccaaaaagtgaaaatggcgaaaacggtgaaaggtgtaatttttgttcagcaaatttatttcagagtttttatcgaaagtttcataaataagcacatctctggtaagattttggattcaaaagtaagcataatttgtaaagcgtagttcttattaatgattgctgaccggtcgcgccggagaaggatttggaaatattcactcaatttgtcagcagattttatccaaaaaataacacaaaatactcttccataatacataataatttttgtttagaatcaaaatccttcccaatcatcctctgttccatttgtctccgtttgtattgccaatttaacaaggccaacatttctgaaacaaaatagaaatttataattaaatatctttttttgttcaatgccaatccagagtataacgaattttatttttcattttactttcaaaattttttagcatttttatttttcaaagttttggatatcaaaatttttcgtttttacataattattatttttttccgtttcgaatattaaattttgtttttcttcccttcattaaattccaatttggggggtgtttttgagtttcaccagctctgatcacacaggatggaatggaaggctgttccaccccgaaattgtgaaaaatattcccggcccatttttacccgagttttattctttccttcgcagctgtaaagggtgtcattatcgttggttttgtagtacataaatccatcaccatattgtgggtctcccggcgggacattttgcacatctgctggagcaacataggaacaattctgttccgttacagcaacagtttttctacgagtcattttgcttggctgagggggcgtatttaagcaaagcaaaataaaaaacagaaaaaaatttttatggcaactcgtacaaaaagtcaacttatattagacaaaataaagcctaagcctagacccgagcaagcctaagcctggcctagcttaaagcttaggcctaagcctaagcctaaatcctaggcctaacctaagcaattttgtacgaatttgtacagcagtgtacgatttgtcatgacaccaaaattgttaaaaataaattatcataaattcaaaaattatagcaacagtatgggccccttctatggcctagaacctcactaaatttggtcattagaattcaaggaaaaattttcatttattcaaatctgatttttgaattaaaaactaattattgttcggattacaactaggttaggccaggcctgggtatttaggcaaaaatcaggcccgggtattaccgggtacagaaaaccgggctcggttccgggtagaaatttctaaaccgtgccttgatcaaaaagcctggcaccgggtcagggcctgctcggaaccgggctcggcctaccctaattataaccaatatggcttgtatgaagcatacctagcaccttaactttccggatttttctgtgttttttgtttcttaattcgattaaaaaattatggaggaaattaaaaaattgttttttatttgatgccaccttgaaatagttttttgatgttttgttggtattgttttgcaccttattttgatgcggaggttgagcagcaacttgttccacggcaccttgtatatctggaaactgtcgtgagctacctgcagccgagtggtacggtagctgccaaagccaacgtaagacattttccgagcgaagaagccaacccggatgatttatggctttttgcttttttctctgtggttcttgctataagaattttaattggtactctttcagtttaggtcccccttttgggtcgggattttttctaaatttttttttccttttttattatcaga

SEQ ID NO: 10857 - DNA, 2106 bp, Heterodera glycines
  misc_feature (8)..(9): n is a, c, g, or t
  misc_feature (17)..(18): n is a, c, g, or t
  misc_feature (53)..(53): n is a, c, g, or t
cttgcatnngcctgcannggtctggaatattatattaaaaataaatatttaancatatgatcattagttggatagaaaaaatttaagtaatattgtaacctatgtatataattatttaatattcaaccgagaatattattccgtttttgaggtaattcccttttttggcattttcaaccgtagcgattgattaaaacaatttttactggcttaatatgcaatcataaaaaattgattttttaattttattcagagatatattttatagtactcccggacacattctttaggggtcacaaaaatttcatttgtcaattttttaataaaattatttaggggcctgatgtgcagaagtcttttggaaaatgcgcccggaataggtactctattttttaaattcctcaaattgattttcgaacaattatatttttcaaccgaaacaaaaatcttttttatattaaattaccatttgatgtattcgattttttcaaaaaagagatattaataattaaattaaaatgcctaagttttaatttagctatttacgcctttgtgcttattcacgcttttctatatgaatttttgtcctaaagtttttcataattggtgatttttgtgcacatttttatatattttggggtttttttcatattttcttatttatttttataattttcgttttttcttacatataattcccaaccctagtaattattgtggtaagcacaaataaaaaattgtttcacttatttaatgctctgtgtgtattagcataaagcttttgcaaatccaacaaaattacgctcgtttcttttccattattatacatatatcttttccttcttattttctttttttttcaagcattaatagtattgatacatttaaaaatcattgaaaatattattaaggcaatcaaataaataatcatttttgttttatataatataattttaattattttgaaaaaataaatttatatgaatttaacaaaaagttttttggttattttatcgtgtttattttatgcaaaagttgttgcatcaagagaaaggtatgcgaaacaatcaatcaattattgtataatgatttaattgctcaaaaaatatttttagatagcggaaatttcaaatttgcggattccgctgtggtttagaactcgaaatttttttgcaggacgggatcccgaaggattaagcccgtaaatccctgaatttaaattttcgtgatcccgcgcgagatagaactcaaattgtgggatgctctcacgggattaatcaagcgaaatccctaaatttcgtaaaaatgcgtcgcaaaaacctgcgtgggattctgtcccgcgccgtcctctaatattttattatcttttttttaatattataaattaatgaaatcaaatttaatttttattctttttatatttttttatcttttctacagaaaaacggttgaagaagtatcttcttctagtcaatcggatgataaaaatgatgttttttctgatgaagattgtaaattgatgagacaactggagaaattgagcctaaatcaaagttatgtattaaattaattttaaattaatcgatttttttttaaacttccaacaccaccttcgttgcccaaacatccttcgcgcaccaaacttcttaacacggatgatgaagaaccactgtgggtggacccacgacgaggctcacgtttatatggtaaaaattttgttaaaattttttagcataatggtatgcaccgcattttttctaatagagcctataccaaattctctaacgggttttgggtgcgaacagtgcccgtttgcgaaataaaaaaaaatccgaaatgcgaaattgaaaaaaacgcaaaattttttctacaatttttttaatagtcaaaatcataaggcaaaaatcagcatgaaaaagttggacctagaagtctaaaactagggctgccacctgaaaattttcaaaatcagcatttggccgacaaaaaatcagcatttggggacaaaattcatcattttgtaaaattctattccaaatttaaaaaatcaataaaaggcttttttgcggcgcgctttttccaaaaaagtttttgggaagagggggc

SEQ ID NO: 10858 - DNA, 2059 bp, Heterodera glycines
ttaatatagtcatagcatcaaggctaaatgccttgtcacattaatgctttagcataaatcaaaaataaaaaaagctacaatataaataaatagttgacactttattaaatgccctaaatatatatgccgaattttcctgctacaacattttttctcatcaactggcgagattgtgaagattattcacgggatcatatttcgtttaaatagtttaactattaaactttattaacaaagcaaaaaatttttatattactcaattaaaataaaatttttgaacttaatactgcataaaactaaaactaaatgaaaacatcacatttctgcaaaatatttatgctgaattaagaagaaaagatctagatttgtatttctaaaattatatatcaacaatattttagctgcttatatttttgagcgtcgggaatatttgtcaagagtcaatctgaccaaatgatataaatcataaatgaaaaaaaaattattattttattttaattatgcattactggataatttgtgtaaagctaattgtaatcatattaatcatggtgaaaaataaaagaatttttagattcaataaaaaattttaaaaataatgattttatataaatatcgcttaatgttatattaagcaataaataaagagctatattatttttcttcaaaaacttacgaagaatgaacaaaattcaatataaaaaaaaataaattattattatcgcaatagaataattattcattattaccatatatttcatttaacaaaatgcaaaattatcataaatcatcatgaagagaagaaaagattgggagcccttatcgagaaaacatatataatgcaaattaaataaacaaatttttctgaaaatgcaatttttaagcttaaaattaaaaaaacaaaagctttgtgaatttaaaaaaaaagaagtaaaataatttgctagcaatctaaaaattgtacaaattgacaaaattttaatcatctttaaaacaaaaataataagcttaattgacccataaaatcaaaatttctctacccataaaaagaaattataaaataaatgaaattattatttattgtataaggtttagttttaatctaaatttatattaaactagaacttactatatttatcgcattttcggacttaacccatctaaatgtacaaaaacttgaaatttgtttttaaaaatataataaaaatatatggtaattaccagtaatttcattcttaattctaacattcaagattaccatttgttaactcaaaaaggagttggcggataattccatgaaaaacattattcaaatgaatatttttaaaaaataaaatgtaaaatataaaaaatataatttaaaaataataagtttgttagaacagaataaataatcaagattaactattaacctcgggaaaatgaagctagctgagagcttgcatcacttgtattatcattaatataaacatcaaattatagttaaattcttaatatcactaattaaatcctctgtccgataagcgattggtttttgatttaattatattataaatttaaaaatttcttgtataaaatttggaaggtacccctttgcgaattttcctatttcttttgtaatttggaccaaatctccgatttcaaatttattatttttcgaatttcgaaattaataattgctagaattgtttatagaacatagccaggaattttaaatataccaggcctgggcttagataattaattgatcaggcacggtagtccggtaaaaaacctttttaactcggccacccggaccaatatttttcaatgattgttgaaaacttagatgatacaaatttaataatagttttatattcgctcccggcccttgggaatggatttttaattttttaaacggtataaaataaaattttaattaattttttttctaaaattgtgtatgccctcaaatgtcgggtcttcaaaagtcgggaatatccgcaaatgtcgggtcttcaaaagtcgggaatatccgcaaatgtcgggtcctcaaaagtcaggacctcaaatgtcgggt

SEQ ID NO: 10859 - DNA, 1245 bp, Heterodera glycines
ctgattgagggggtcccttcgggcggccgcagtcaaccgcctgtggcgctcgtcagactgcttcctccgccctccgtctcgccccactacttgctccgtcttccatgctcccttttgcgaagttcgaaagctgcaagtggtcttaagcgttttttggctcacttaaattggttttttttatcagtaatttttagagtttttgatgacccataacttttttcaatttcatttttatccgaaatttctttcggattcatgggttacataccgagaggaatggattggtatgtattttgttgcaattccatgcgcttaaggctttggacggttcagtcccaaagccatttggccatttcagtcccgggtttgtaactcttaagggattagtttccgcaaaaaaaattctttcatcatacattacagaccgatagctatcgcttggtgtatacttcgaccattttcggctctgtgacatatgataaatatttaccaaaaattaaattaatactttacataatcttcctcactttgccatttatttaagggatcactttcgtggcgtaattcaatgtcaaattgtgtaataccgcaacatttattggaaatttgaccaattataataaaaaaaaaacatcagtttttaaaagaaaaacaatattaaaaataaaaaattaaatgttccgttttattttataaagtaagaagtcagataatatttaattcaattaataatgcttctgatctctttaaattctttgaaattaaaagccaaaaataatatggcatctagttttaatgaactctttattggtattattgaataaagcatgcgttaaacataaagttaccataacaaaaaataattttaccatagttaagtattgttggaaacataacataatttgtctttaaaatttaacttaaaaaataacctataatttaaattttgtaaaatcttgacttaattaaactcttaggggaaaaatagaaaaaataaaaggaactgcaagaaaagattaatttttatttgaattaacttatattgttataataccatcaatatttttaacaaaattttttaatttcagacgctaaaataaaaaaagaccaagaataaaactaaataggaatttatatgcaaaacaaaaataattttaaaaaattaaaataaaaaatttcatgccagcctctagaacaatcgcactataacaaatcaaataaattaaattaaaatacactttaaaa

SEQ ID NO: 10860 - DNA, 4989 bp, Heterodera glycines
atgctttcacggcttatcgcgaattatccgcgaccccccttagatattttgattgcaaaaatttgcaccgaaactgaacgtttcacggcacaattttgcagtcacgaattgatcaacttcccgtcactgcaaccgaaatagcagaaatgactcaaaaagatgaaattctacaaaaagtggcaaaattctccaaggaagaatggtcacaaaagtgtaatgaccccgacctcgcaccattctttccaaaacggaacgaaattttgcaaatcgagaattgtctgctttatcaaaaccgagtcatcattccaacagtgttacgagacagaacgttgaaagcgcttcatatggcacacccaggaatagtgcgcatgaaagctctcgcacgccaacacgtatactggcctggaatggactcagctatcgagaaattggtaaaaagctgcgaagaatgccaaatcgcccacaaagcagcaccaaaaacattgctttctccttggaatgccactaaacggccattccaacgtgtgcacattgattttgccggcccatgccaagatggccatgcttatctactttactggattctttttcaaaatggcccgaagtttatcagatgaatacaatgacatcaaaagcaacgatcagtgttctccgattaatcatccatcgacttggcatcccagaagaaattgtctcggacaatggacgacaatttcgttcgtcagagttttccgaattttgtaaagaatttgggattcgacatacgttcacaccgccatttcatccacagtcaaatggccaagtcgaacggtttgtcgacacttttaaaagggcaatgcagaaatgttcgaaaaaggacaaaaattgggctgagaaaatgctcctgtcctatagaacaacaccgaattctgcaattaatggacattcaccggaccaattattctttggtagaaaactccgcactcaattgtttcttacacatccgacaggaaaagtcaatgagacgattgacaagaccatttttcatcagaaacaggaaaaataccgcacgaaaattgcacaaaattttaatgaaaagcatggagtcaagtcaaatgaatttttaccgactgatccagtgcttgttttgaattaccagcatggtaaggcatattggctccaaggtacagtcatcgaacgactcaacaattcgccaacttatcgggtaaatgtgccaagactcggacgaaacattcatcgaccggcacgccaaaatacgacaccgaaatgccaaaagcggaagcagcccgacgaaatccacccaactactgccaattcaccacccatggcattgagacgctctagtcgcaacaccaaaccgccgatccgcttctagccaggctgacgccgttcaagaattgaggagggagatgttgggtagtgaataatttgaatttatggcgatctgacttattgactttatttgttatttctatgtccatccgccccctccctcgtccataaaagtggatacctcctcccattatttgttctttcctttcatcattcatttatattttatttcccattttgccctacgaccgaatcaataaaattatttatttatttctttttctttgtgtgttctaagtggaagaacacaacactgatcaaagatagaatatggcatagtttcaaatttgagggaaaatcaacctaaattattcaatttctaaaagaagaaaaattaaatatctaaataaaattgtattcaaaataataaaataattgataaaaaacacctaattaaattagaaaatatttaaatataaatttaaaaattatatttttgtcattattttgttggccaataatttataaataaataacagaaaaaaatttttggggcaatttttgactgaaaattatttcactatatcttagttaactatttcagattttccgtcactaaatgtagcgaccctaaatattttgtacttaagacttgatcaatcttacccgaagtgttgcggtaacaaaaaatacccacaagtgaattaaaggaataaaaaattgtacgttaaaaaataaaatctaatttatttttttaatttcttatttacaacaataactaaacactggttattaatttttataattttaaaaattaaatgcaattcaaagacattcaatttaaattaaatcgtgccttgaattttttcaattttcaaaaactttaaaatcttgtgctccaaacggtaaataattttttaataaaaatcatgttgaaaatttaagaaacatttattccagaggaaatccgacagttttcggagacgagttctacaagtaaaaataggtattatagataaaatataattgaatcgttccaaaaaaagatcacttcaataacataaagctaatgaataaaaaatatttaaacttttcaaactataattttatgtgataataattttccgaaaagtttacaaaaaatcgctgaaaaatcgttgaaaagttaataaaattgtaaattaccacctgaactaaatgcgaattacaatagtacactaatatttcaaattattgggtttaaaaaattactgaaaaataggttaatttataataaatatcatttaactttaaactaagcaaattttttagggcatttaataggaaaaaatattttagatttttaatatatttagttgtaatacaaattatttatagagaattctattcttactatgtatatctatgttgtaaataatgcataaagaattaacaataaaatttgaaaaactgaaatattgggttgatgaaaaagttctgaccctttaagcacttcaacattaaacaattttttatttcacaaaaaacaaatgttcaatcaatgatgtactcaccattttgatcaatgatcctcctccatcgttcgggcaacatttcaatcccctttttataaaactgatcatttttcgatccaaaaagtcatccaatgcattttcgacctcgttttgatcagcaaattctttccctctcaagaagtgctccatagatcgaaacagatagtagtcacacgggctgatgtctgggctgtatggtggatgaggaagaaccgcccatcgaagttgctcaattttttgttgcgttgataacgcaacatgtgggcgtgcgttgtcatgtaggagtacgccgccgcggaattttgcagaaaatggaggacgacgaatttggtcatgaacccgctgcagttgttgctggtagatgtcggcgttgatggtttgcccagccggaacaagttcatagcggaccaaccctgatgaacaccaccagacgcacagcaataccttcggtgcatgttgaagacgcctgggggtcggctcgctcaattcgtttggcttcagccattgtttttgtgccgttttgttgttgagataaacccacctcatcacacgtgatcagctggcaaagctgcattccagcactcaaacgggcgagaagttcagtgcaggtgaccactcgctgatgcttttgttgttgggtcagtgtatggggaacttcggcaccctttttgttgatgaagccgagctgatggaggtaattgagcactgttgtctgatggaccccgaactctgctgcaagttggcgcgaactagaacacggatgctgctgaacgtgctgctccaagtcgtccgaatcgagagaaggtggtcgtccggagcggggttcatcttcgagctgctcattgccttcacgaaattttgtgaaccatcgcttaactgtagaaagagagagtgcatcattgccctcacttttacaaatatttcgaagagcttgggttggtgtagaattttttcggaattcgtaaagtaacagttgtcttaggcgaattttgtccattttttgaaaatcgttcgattttgcaaaagtaatggctatacaacaaatgcaaatggccagaagatggccaaccgtccgctgattcatcccaattgcctgcctccctttttcaatctctttagaattaaatatcattttttgcataatttgttttttcagagtgtcagaactttttcatcaacccaatagttaattaaagagggcaaggaaatgaaagtttttgcaaaattcaacgccttttatatgacttaaatttccaaaagaaattcattccaaaaaaagaatataaaagcaacaaatctcctccaatccctcactaatattcattttcgtctttctgccttttgctggccaacgacacacacatttccctcaacgaccttcgaccgactacggcacgacgcgtacgatgaacgaggaatactgcttctctacttcgactgttgttgcacagagctgggcccaaacaaactttcgaccagtggacgagcaaccgaacagccttgtggacacgctcatcgccaaactttcgtgcacgactttcgagcagttcacttccgaagtgagtgatgcgttcattttatccgtctttcatttcaactcttcaggtcagtgctcaggacattcacaagctttgcgatgtcaccgtcggtgttctccagcaacagtcaatgctcatccgtctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgagtttgctgaggaggattgcgcgagaatcgttttaattgtccactttttaaggtgaaatatccggacagtgtcatccttctgcgcgggaaccacgagtgcagcaacatgaaccgagcgtgagtttggaattggacgaggcctgaggggaactaattttctgcttcctttagctatggcttcttcgaagaggttgaacgtcgctatgggcagatggatgcttacgctctttggaaccacttcaaccaaaca

SEQ ID NO: 10861 - DNA, 1481 bp, Heterodera glycines
agttaaatttttaaatttacaaaagattaaaaattgaacccccccagaggtaattttttcaacactcattaaattaaatttcttaatttacaaaaaaatttttaatttacaaaaattaaaaatttgggatagaaaaaatagataattttttcaactaccctcattaaattaaatttttaaatttacaaaagattaaaaatttttaatttacaaaaattaaaaatttgggatagaaaaaatagataattttttcaactaccctcattaagttaaatttttaaatttacaaaagattaaaaattgaataaaaaaataggtaattttttcaacactcattaaattaaatttttaaatttacaaaaaattaaaaatttttaatttacaaaaattaaaaatttgggatagaaaaaatagataattttttcaactaccctcattaagttaaatttttaaatttacaaaagattaaaaattgaataaaaaaataggtaattttttcaacactcattaaattaaatttttaaatttacaaaaaaatttttaatttacaaaaattaaaaatttgggatagaaaaaatagataattttttcaactaccctcattaaattaaaattttaaatttacaaaaaattaaaaattttaaatttacaaaaattaaaaattttggataaaaaatatattttttttcaatactcattcaattttaaatgtacagtaaattaaaaattttggataaaaaatagttaaatttttcagtggtgaattgattattacggtgaatattgttcatgaaaaacactatgaaaggttaaaaaaggttattgctcatggaggcgaattcattgaacgaatcgtttaccacacaaacaaggatttgacaaaaatgaacaacaacaacaacaacgtttttgagcaactttttgtagcgataatgaacgtaataatttattaataataattaggtatcggcattttgaaaaaagtaaatccaggtccaggaaaaatcaagattgccgaaaaatggcctggacctggacccaggaaaaacccaggcctggatccaggtccaggccgatttttaataaaaatagccagagctgagatattatgtaaaagagcgacgaaagcctcgaactttgcgttcgagaaaatcacgaaacattttttgggtttttgtgatgtcgcggtcaggaatatttgtaggccaattagtggactttttgagtctcgaaaatttagatttttcgagagttttggcctttgttgtgaaaaactcttgctactcttgctagttctcggttttttttagtgcgtctaggtcgggaatcttggggatgcattctcgatgtcgttttatgtatatcggcaaaatttcgtatttcattttttaacaaaaaataaaaaataaataattcaaaatgggagatttttttttaaaaagcaatttatcctaaatatttcataaaatgtaaaaatccat

SEQ ID NO: 10862 - DNA, 3925 bp, Heterodera glycines
ttttattatatatttttacatatttcattattttattcatatttggtacatattttggacttttttcttacattttttcattttttacatattttgaggatttttttatgaaaaatttttggaaaccctcaaaaaaagccaaaatttcggtaactttttcgttcatatttttatttttttaaatgtaccgctaaaaatcagtaaaaaaagaaatatcgaaaatttatttttaaaaactaaaatgtgattctaagcctatttaggtcaattttatgcaaatttatgcctatttcatcctttacgaggaattttttttccaaaaaataaccatttttaaacttttatttacatattttagtacatatttctgggtttttgcacatgtttatgtacatattttggccagtttttgtacatatttttgacacccattattaattaattttaatttctaattaccaccatatacaataatatcccttttaagctgaaattcagcgtctatgcatttgaaaattctatgatggcaatgggtgggaatatggccaactatggcatgatgccaacacaatatccgaacaatggcccaacattcggccacacaatggccaattatggcatggtgcttggcgccacgctagggaatatagcggaaaatgtgttcgagcgtggcaaggaattggtcgccaaaatgaacaacaatggcaaccaacacccatttagcggaatgccaggtaggaagaatcagtctaaagtcatttcataatttaccgcaactttgttggcatttcgtaaaagcgcgccaacattttaaaatttgaattttgactgctacttcttaaaaatagttcttatattaaaagagagacttgaaatttttcacaaaagtactttagcataaggactaactatctgtataaaaaatttcaaaaaaatcattttttaacttggaaagtaaaattgcattatttcctataaaacctaaaaaataagtgaggcatatgccatggaatttatttgaaatgatcaggaaagattattttcacttttgaatattataaaaattttaaattgatttgaatttgacttagttcataattttattaaaatttccaaaaattacatactctaaaatattccgaaatacttaatctcgaccggtccatgctctggatttagatgaaggcagtaggtcattcaaatgggggccggaatctttatttaaaaaatcttcaaaatgaaaatttttggtgaaaaattatttataaatttgctatcttttgatagcccttggtgttttctattagtcttttaaaaattttgttaagtttcaaaaaacggacacctaattattgaaatagagcacaaggtgctgctgccctattttcaactcattgtaggggacggggctctaattgataagtggggcatactgtaatgtctctcagtaaatatggtaattattaaaaaaataaaaaattgcaatttttcatttgctaattacacaggcataatggtggagaacaacaccaacaacaacagcaattatggcaacatgccatcattggtggtcggcgttgactccacagtagagtactctgtgaatgtgagaagtcgcatggtcgaagacattggcatcgaagtccaaggcgtggcacaatggccaaaaaaattgttggcaaaactgtttgaggaggaattgtttgagggcttactgtacaaaaagggcactggtgccaaccgtggcattgggccgagcatggccagaattccgcactgggaagccatgctgggcttgtcaccacaaacaaaagtaaatttaattgggtggttggcatttaaaaaaaaaattattacggaaattaaattagccactaaatgccaagcaaattcgtggaaaatttatgatgtacttaattcccgaaatgtggcaaaaatttttacgaatttctggggttcttatttcatcatcttaggaatgaaaagtcacaaaaatccaaaaaaggcatgaaaaaaggcatttaaattttttttattaaagcttttaaggagcaaaacacgtaaaacttaatcaaaaaacttaattttggtcatttaaatgattactaaattttgtataatgtttttcaaataagtaaattttaaacctaaaattttttatcaggaaaaaaaaatgaaattttggcgataaattattgagaaaaattttcaattattaggggtatattttctcgattttattgcattgtagaaaaaaaaaatgccaaaaagacaccaaaacggcaaaatgccaaaaaaggcattaaaagcaggaaactgccgaaaaaggcaaaaaaaaaaaaaggcataataaaagtcatagaagcctcaaaccaagtgggaaactgcgcttttctgcttaaatgcactaggaaattttcagacactcaaaaaacattgaaaaataatatattaaaaaattcttcgcaactgaaaatttttattttatttttttaaatccctaaaaaccgaaaaaattttgaaactgtgaattcctaaataaattttaaaaagttttgcaatcacatcccacccaccctgcaggcaattcttcaattttgtaaaaattcgacaactcttggacctggcctcaaatttcgctcacgcatcaaaacaaagccgggaaacgcttggcaacactttaaggaaacaatttcccagttggttgggtcgcaggagatatgcttttaaagaaaattgttgttgaggaggagaagcggtggaaaaaattcgattttcaaaaaaaatctttgttggaatttttgaaaaattttgtaaaattttgcggtaaacttttttttttttgcaatggtaacaattagtggtcggtgaatgacaagaattgtatgtggtaatggcattcgaaactggtgccatatttgcgtacatttggcaagtcgtacaaaaatttaaaaaaaaaattattgaaaattcattataacttttaatgtatgtttttttacatgtatttattatacttgttttcatgacccttttagaccatggttgtttaaatcagaaaaaatttttgtaagcaaatacagtttcttttatgaaattatagatttcctttctctctctcgctccactttttcccccactcccactccccccactctcttcttttctctttttctcactttttcctctcatctctctcaattcctcttttactcgtttctctctttccttttctattttctctcttccccctctctctctctctctctctagttgactttcccttctatttctcactttttacttattcctctgactcttttttctctgcctttttaccgttttctctctctctctctccctttatttctttctctcaatttctctccagttctctatattcctctcttgttctctcgctctctcctcttcttactcccgttctttaccttcataattttctcctttccttctctcttcttttcactgtttttctctctttcgctctcttctttctttctatataccaccctttctcacgttcatttctctcccacccccactcgcatttctctctctctctctttctctctactcccttttttcctcttccctcactctttctttctctttctctcgctttctttctcttcgtcgctattacttctgcctctccttccctctttcttttcctctttcctatatctcatttttgtatttatctcttctctttgcctttgtttttctctcactcactctctcatttctctatcttgctctctttcgttccctttctttctctccctttttttctctctctctccttctctctctcctttcttttacctatctctgatctctcatgctcatatagaaagaatatttaaaagataaaaccaatttaaatagaccgcaggcagcaagc

SEQ ID NO: 10863 - DNA, 1581 bp, Heterodera glycines
tttgattaaaatttgttgacagattttcaccaaaaaatcatcaaattttgggatttttgtatcatttttctaatgagaaataagagttttggcgcgccgctgagaacagtttttcatcaaattaccaaattttgtgattttgggccattttctaagaaaaaataggagttttgagggcgcggcggtgccgataggcgccgcccggggaaaaaaaattggaaattttgatcatttataaacagtttttcactgaaaattagccaatttataggtaaaattttgaaaaattttatgggaatttaatccaattcttaggggtgtaaaagtcgctttacgcgccaaaaagcgaaatgcgaaaagcgaaatgcgaaacgccaaaaaatgcgaataatgcgaaaggcgaaatgcgaaaagcgaaacctcggcccatccctgatagatacagtgagttacggccgcacatttttttgatcctctgaaattattcatttgatgtgccgttattataatgccgcaacgctaaggcgctccgaaatatataaaaaaaatttatctttcttttcggcgccataagaatttggctaataatttttatacaaaattgatattcattggtagtacaaaatattatatacaatgtaattttcaacatagatttacttttttctttcttaattattatttattattattgaacctaggcgaattgcctgcctacaaaaataagctatgaattctcaatatcatatcagcttacaaattagtccacccccaaagtgatgctcatttcccgggaatttccggttaaaactcaaattttcattgcaaacaatttgtaaaagaaaaattaaatatattaaaaataatttactttaatttttaattgcattaagcacggatgttgtcataatattgcaaattgaaaaacggcatctcaaagacctacaaaatatgatacggaatggacgtgaatttgcatccagaattatttattcaccatcatatgagttggaggaagaattttacgaatggttaattacggtaaaaattgaagaaaaaaacattttcatataatttaggtggggttagtcgttacttaaaaaaaccatcaaaataaacaacaatagcatataaatttgctgaaaaagcaaccaaaagttagtatgaaatttttttgaaattttgtaggctaattaggctaatagaaaacataaaggtaatcgaatgatatcatgattaagtttccaaaaagttatgacaataatgctggacaaaatcttgtttatatgaattcttctggccatgacttttttgaaagtcaacaaaagtttttttgaaattttacaagctaatagagaacacttagggctatcgaatgatctgaagaattagaatttttttacaccatacataattttttgcttcaaaatttttaaatttgatgatttttgagtaattaatgacccagcaccgtattttaacaaaacaaaaaataattttaaaattttaaaactaattataaatatttgaaaatagctaattgaaaatctgcattataaaatcaaataaatttcagtctgc

SEQ ID NO: 10864 - DNA, 2345 bp, Heterodera glycines
  misc_feature (672)..(672): n is a, c, g, or t
  misc_feature (726)..(726): n is a, c, g, or t
cgcgatttgacggccgtggcctttctgatgtgatgctcgtatctgtgagggggcaaatgcacgccagccaaccgagcgccctctgaccggtcccccagccgggttacgagcgtctgttggattcgtaaatttgccgctggagggaattggggaataaccatttaaattagccagaattccatccacgcgcttaattttggtactttccatcatacgcaaatattcctaattgaaaattggcaccaattccttggctttctctacaaagcggccccaaactttacaccccattagtgtgttaaagtccgcaattaagcacatgccttctcttacacgtgaaagcgcgactgtagctctgtggctgtcttgaaagaatcctggcattatttccacttctcttgcttcccagcaaagctgttcgaatttcttaccccttgacatgtctaacattttcatgactaatgagatgtttggctatagcctttcaagaaatagctcacgtaattgtgcttccttttgtgagtcatccttcacatcggatacctttgctttgcggcgaatctaaatcagttcgcaaattagccaaagctaggtcaattgtggcctttcgattcggatccattttctccaaaattctttttggaacaccatccaaataaatgaccaacctgncaagcttgtccttttcatcgagttttcgaccaaatgcatccatgtattctctanaacgtttttgcccacctgtcaaatgtgaccacacagtcatccttgtagcctttcaagtgccatgggatacgcatcaatgatcatgttgacactttggaaggataatgcattgcgttgctgatcatcctcatcatcgctgctggagctttgttggttttgattaggtctctggcctgtttggtgtcccaattgctgtacaggaggatgagcatgatgagggacaagtggttgagtgacagccgtagcttgttgaatgtttttgtttgctgaattgaggttttcgagggactttaccttaccagcaacttttgaaatctcagcggtgaaggtctgaaagcctacgttgacttcattggcaagggtgccaagatgattttgcacattgttagccttgcggttaacttgtcggatggtgcggctgactccctcttcgagtcgtatgagttcaccgaaaactttttcaacatcctcaaaacggactgtactgtttggctgtttgccttgaaacagtgtcttatttacgattttaagagtcgactcatcatcagaaatgataggttgggctgtcgcccccgaagacaatactgaccctgaggtcgatgaaggcattgatgggttgggaggtttgaaggagtagtgaattgagtctagaattatctataaactaaggtgttagtctcaataagtacacactagtgattgatgcaaacgagttagcattgagtgagggacttagtatgggttagtaccagttagtgctttgatggggaactgtgatgagtgaacactgatggctgaagagcgaaggcttgtgatggataatgactgattagtgaatacataaggcttaagtattgctcatacatggtgtgaattcaagatcagaagagataggatgggcactgacattgtaatggtatgaaaacggaaggcctaatgtatgtgaaagctgattggcaaacaccgaatgccatgggacaggctgattgatgagagtcggcgatacagtttaatgatatggcttatggccattttcacgattgaataatgatgtaatgaatgagaaaaaattacaatttagagaaatatcggaaatatgctatggtacactgtaatgtgagaaagaagaaaaattacagtaagaatgagcattgagaatgaatgtttaactgtgatgggaaaaaggcataaagtccgaatgactgtacatttgtaagaagatgatattaaattacagtacgcttttggcagcccctttaccattgcaataggtttcggttccacaccctttgggtttttgttagaaataggccttagcccgaatactatacgacgaatggcatttgatgagtgccattgtttgaatttacgggaggagcactacatttgtgccacctcgtcctttggtatgccaaaaacctttgaatgaaaaacatttgactcaaatcagatttgtcaaagtatatcactgccggatgaatggaatatttaacgacgtatgggataattgcaaaaaaacaacaaaaaggattgcaatttggttgggctgggccgtggcccttattgagcgccaaatgagacagtgaaatagacataattaatacagtaccatgactgag

SEQ ID NO: 10865 - DNA, 2746 bp, Heterodera glycines
  misc_feature (25)..(25): n is a, c, g, or t
  misc_feature (30)..(31): n is a, c, g, or t
  misc_feature (835)..(835): n is a, c, g, or t
tgacaattaatattaaaattaaatnagatnnaattatctaatcccacccgccccggctttgaaagatatagaaattatttttatatatccccaaaattaaagaaaactaaactaactaaatgaggagaagtcttggtcattaagatttgaatagaaacttaaattagtcttgaatgatacagaatgtaacattatagccgcaccccgtttttcatgagctttaatttactttatatatataaatatgaaattagtaaatcatttaagataacttacgattaataacttaattttttatggcatatgaacaaattcattttaataaataaatttaatacttatattagcttctttcaaaatagggtattttttaatgtttattcaacggttcttggtttgcaccctcagagaccttcagaacgagttgaagaacttgcgtagttcatccatgactgatttgagcgcccataaagagaaggagagaagggttaaaggaatgagggagacggagcaaaagcggcgcatctcgacatccggaacaaatgaccagtggaagtgaggatatggcttgaaatggtggccaatttataggcgccatagggatggccagcttagagcaagaagcgagagcgtcagttgttcattttgcgttaaatttaaatttgaatttcccgccaaatgcataaaggacaagtgtcacaagcgagaaagagagagagtagtgaatggagcggcttcgtgtaaagcattattttttctatttttttgtttagaaataaaatgaatatgttaaaaattgaattattttaaaaaaaaagctgatgcttattattanataagtgcatcgctctggtgttcgagatttcgagcggcatatgagcggtattatcttagtttttaatccggccggatttgttatgttgggctgtcgcccctgcgcagaatactccataaccaacaggcgccgcaatacaaaatgaaaatgtgcacatataatttatataataatgaaattgtacaatggggaaaaaaatggggtaaaatgaaaaaaaataaaaaataaatggtcgaccgtctcccgaatccatcccgaggtcagtggataggttgtcattcgacaaccatccggtgctaccagttaagctgtgccgggtttcgggattcggcctgcttagttccgacccctgagatcgatctcctccgtccaccgacggattgttggactgggccgtagcccccgcggaaaggctccgtcccatcggtcggcttagggggagggccagtagtgggagtgatgactggggaattgactgactgacctcgatggctgggagagccatcgcttaaaaggggaatcccggtgggcgttccaatggggaggagcctctcccctccaatcccaatcggtagccgagacccgagtcccggcttacaatataattaatcataaacattaaaaaacaagactagcttaataacgaaattgagaagattagatctaatgttaatgttatgagtagtggactattatgttaacaatttgataaacttatattaatgtgaaaaaataaaagaaacataaatttttaattattgtaataaagacagaatatagaaaaacgaaatattctaatatttaattatttaaattgtactagaattcaatacaaataaaaataggagttataaataaagtatatagacattaaatcaatgaaattgttttttacaaatttgcattgtttgatgttattttataaatattaaaacatatttatcaaggtaatttttgatgaaaattagacaaaattaaatttttatcatttcataaattaagttaatttgaaattaaaagtttacatttgaaatacttattatttagttcattaatactaaaggaaatttgggctcgcataaaaataattaggaaaagcatgttatggttatatataatttaaagaataaataaaaaaaattaaatagtgtttaaaatggagaaacttaaatgatcaacaaataaagaaaattaatttatatatttaatttatatactcaatttaataagctataaatcgtcgtttttatgtattattaacatatacctcagggatgggacgaagtttcgtttttcgcatttcgctttttggcataatgcgaaagttccacccctaagaacgaatattttaaaaatataaacttttaaaacgaatgcttcagtttattattattttggactgcaggattaaaaattccttttttttggtttccaaaaatttgaaaagttccatagtttgtttgtacgttgtttttggtggtctatataccaatgcaaattttattgattttaaatttttaattagaaaattaaaatttcaccattaaattttgagccggaaaattttatgaaaaatcctatttcctttttgattcaaataccacacccgccaccacgagaaccaacttttagattttctttatgccaaaatacagttgtaattttctctatccccatgactaaaaaggaatttcctcattttcgtaagtccatgactccgtgattagtaataaatctgtatttttgtttgtaaaagttagggtatttcttcaattttgttcatcataagaccaaaaattaattaaaccaccgccttaaaaccttttaaaaaattaacatccccttttactgtttggaaaaaaaaaaaattgttttatttttttataaaatttttctccctcccgaaaaaag

SEQ ID NO: 10866 - DNA, 1396 bp, Heterodera glycines
  misc_feature (62)..(62): n is a, c, g, or t
ttatgtttatatatagtttaaaaaataattattagaaattaaatagttgtttaaaatgaganaaactatagatgaataatttgaataaaaaaaattaatgtatatatttaattgatatagtggagttaataagctataaatggtattttttatgtgttattgagatatacctcagggatgggacgaaggttcaattttcacatttcgcttgttggcatagtggcattgtaccgcccctaattaacgaatattttaatactataatcttttaatccgaatgcctcaaattattattattctgaactgcatgatgaatgataccttttttttgaattccaaagatttcaagagttccatatcttgattgtacgctgttcttgtcgttccatatacctctgcagacttttattgattatagatttttgaatcaaagaattaaaatttcgcaatgtagatttctcagccggaaaatcttatgaacaatcctatttcctttttgatcagaataccacaaccgccaccacgagaacaacttttagattttcgttatgcaaaaatacagttgtaattttctctagcccatggactaagaggaatttcctcattttcgttagtccatgactccgtgattagtaataaatctgtatttttgtttaaaaattgtttatttttttataaaaattttctaccaaccggaaaaagcaaaaactctttttgtaaaaatttatatgattttttgtgatttgacatgaaaatttaaaaatgtttacgaaatgtgtcaatgtcactgcgcaggatgacctgattcgcgtagataatccaatcttccgcgtcctcttttcttttctttgcgcactgctcaattaatttccggcgttcggccaattgctccttggtcatgctttgcctgatccgcgcgccatgtagagcattcaaagccagagccttgcctttcattttgagcacatgccgagccgcatgccttgtgggaaattccatttttagcggtctcgctctgttgggcgttcgcatgccgacatggaacaccactggggtttggtcgagttccactgtgtcctaaatcaaattgatcagtgctctgtccgcctccccacgctccgacgctttcccggattggaactccggcacattggtgatgacaacggtccgttgtctgcggtcctcctcaatcgcgtcattcgccgtcacttgagattgaaccagagacgacgcggtggccaacagcgagtgcaactgcttaataagcagttttgcgtagtcgggaatggcgctgtcgttgtcaatttcggggggaatttgaagctggtcaagggaagtcaagaatttttttggggcggtgtttaaaaatgaatttttccaaagaatttaacttcct

SEQ ID NO: 10867 - DNA, 3313 bp, Heterodera glycines
  misc_feature (3253)..(3253): n is a, c, g, or t
ccccattcattcatttatccaccaaatccatcctcggccttctaaagcacacaaaattgggggattggcgggtcggaggttagggattgactctttacgcgttgtgttgtgttttgttgttgtttctgttctgtttttgtgtcccaaagccagtttccgtctgatcaatgccttttccttcttcttgttttcgtgtctctttctttgtttttccatttcaaatcggctcttttgactgatcacttcatctgatcagcatttatctgtggtggtccatatcctctaatttgggtaatgaaactgaattttttggaattcagcaaaatttcaaaacagagattaaactaaaaactaagccttactgaagactaaattggaaattgccaaacttaggcgccaaatgaaccgttcaaatcaatccctttgattgccgccgcctttcactttggtaatgcactctcgagagtctcgagtcttgtgacccatcaaagtttttgaataaaagtttgaatatctgtcccctttactcacgaaaaaaataaacttggggcttaatggcttaattttgaggggttttcgcccaaaatgggtcattcccacccctcccccccccccctctcgcgccttaagtgcccaccaattcaaagcccccaaaatctcacggtgacctcaccaaatccctcccccattttttggccctctcgaaatgtgtggatggagaggataagtgatcccattcgatgacgagagtatatcgcattcaaacagtgtttgttgaagtgtgctcccccggggggaaattcagtctgatgagagtaaactttcaaatttttcatttttcttagctcacaagcaaccgcttcaccccaatctaaatttcatttatcccatctcctttcttttccctattaagtaatagcacatttttaatgagggtaattaatgatttaattatgggcaatttaaaattattttttaaaattttttcttctaatttgaatagaaatattttaatgcgaaaccatttttttatgagaattatttattcattcactttttcccctattaagaagcagcacattttttaattgacaacgcaaagaatacctaatttataagaataccaaatttagttttttaatttgtgacataaaaaaagaaagtgaataaattacaaattcaatttcctttgcccataaaaagacgaaaagtcattcgaagaaaagcccaaagattttgagaatggtcagaaagtatattttttggaatttatgtaaattttgcttaaatatatttaatattattttaaatttaaaatggaaaagcaaaataagaaggaaaaagcggaagaaaggaaaaaaggagttgaaaagtaaggaagaaaaagggagagaaggagaaattcaacagaaagtgggaaaaaaagaaaataggaagagaaaaacggggaaaagtttaataaattagtgaaaaagacaatggaaggaggaaaagtttgataaatggagcagagacgaaggatgagaagatgaatggatgagttgcgcagaagagagagagacggaagaatgaaagatggacagaagacagagaagggcactttcttcccccattttcttcgtcacatttcggcaccaccgttccttccactgaatgtcggggcaaatttattgccaattcgctctccgcccccgtgccattgcactcggtcactgtgtgccatgctccccccccccccggggggtgctttttccggaggattctccgccccccccccgtcggcatcgcttctccgtccccttttaagcccgctcaaattccatcatccgttcatttttacggcttcttcatctgctggctgtttactgtctgtgccgttttattattttccttttcaaaaagcggtgaaaaaggtccgcccttttgatgctcatttgagtgcactaaaaataaaaaaaggaaacaccggccgaacgaatgaatgaatggaacattgaaaatgccaccggtgaaggcacttccatgtttgtgccatttttgcactaatttggcatttgttgtgttggttacggtcaacactttcccagtcttggcattttttgggatttggtcctagaaaaataaggcaaagccccatttcggcattaattaagtgggggtaataagcggactgcataatttaatggccaaatagctgaaaatgactctgccttttatcaagccttgtttttcggtgctttgccaaaaagccaatccaatggagaaaacgccattaaaccatcggcatcgttggcggatgtaatacaatatccaaccatccctacctttttgccaatgccattgtttgagtgtgcccgattttgttgctaaatggcgtgatggacaaagagaaaagagcgcacaaaattcagacacacacagcacaaaaatgcataaagcacaaccaacggcaacagaaagggccaaatttttatgatcccttcgaaaatggacgacgaaacaatgccaaaaagagaggggggcaaacataatgccaatgggaccaattcaaacaaaagaaaccccaccaaaatcacacagagtaaaagccctttgtttcaccactcattcttttgatgatgtcacaccattcttgacaaagcaaaagtcgctaaagtgatcgagagtagtgagtggagtgagtgaattgatgctgcgctttgaacttttgttttgtgtgcgtttatttgcccatttccccgccgccgcccctgggggtcatttggcattttattttctctttttcattgttttgtttctgcttcccccgcggggagggcttacaacaccaaagccatcgcggccggacgggtggagaagaagcggtcaccacaccgcgcgagagtggtctcgagaaaagaaagcggtggggcgggggcgggggcggcttaggcccttttaactcatccgtcttcgccccgccccgtccccccgggggtcagttttatatttatttgccttccccttccatcgatggatgaccaaaacatattccccatccatcacaccagcgaaagtcgcgggaattgaaaagaaaaagggcaaagttggagttggagttgttcctcctcctcctccttctgtccgttccattcattgtccattttcggagatgacaatgtttcttttgtggccaaaaatttaaatattttcgttgactttggagggaaataatgccaaaaatggattcattgggaggcggcaaattttaaanaatttcgctgatggggcttgaagaaaattgggcaaatagaaaaacccaggattaattgag

SEQ ID NO: 10868 - DNA, 1225 bp, Heterodera glycines
  misc_feature (1167)..(1167): n is a, c, g, or t
aaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctagtcaacactgtgatttgacactgcgattgggagcggactgaagattgctcaaatcagagcggtgctattgagactgaattgtccaaatctgtcagagcgaaagcattggactgaaatgacaaaatctgatctggccgagattcgtgccgcgcccaaatgggttggagactgaattggtcaaagctgtgatttacactgtgaaatgggaaggactgaaaattaattgatcaaatcagatcggagccatttcccgagcgcaaatttttgatggttcgccattttagtttttgtgtggggtggtgattagagcagaaaaatggacgggagaaggttaaatgcactgctgaatctgctgctcatttgggagcaactgaattcagtgaactgtgcgctgatcggacaatttgctgcgaaaaatttgtgtgggagtaagcgcagttttgggtggtgatcagtagagtgatcagaggacgatagtaaaaaagagagaaaggaattctaatggactttttgtaccgttgattagcgtgatcaaggaagaggaagaggacggaagaatggagctaaaaatgaattgatggtacaacactgatcaaaaagatgatcagacatttttagaccgtcgattagcgtgatgaaggaagagggaaggaagaaatgatttaaaaattaattgatggaaacagcactgttcnaagtgagtgattgatcagacatttttcatagtgcttatgccctctccctctctctctg

SEQ ID NO: 10869 - DNA, 3833 bp, Heterodera glycines
atgttgggtgatgatgcttgttttgttctttggcgccttttttttttgcattattttttaaaaggctttaacttttgagtggtcgtttcagccgtcactttgaggggaccgagttttgacatcaaagtcctggtcacagttgacaacatcgttttttggtgtcataccaagccatttaacacttatgtgcgctgagtcataaatcagcgcgtatttatgatgaattgaatcggacggatttggtcgttgctgatagtgcactgtcttggagtggaccacgccggacatcgctacgggccggtgcacttggaaatggcgcgtaaactcgcccccccccccccccagggcaccgccgtgtccgatcggcggcggctgatctccgatcagtcatcgttaaattccatgctcttttttgcgcagaaattaatgaatgaatgaatttgtgaaacgccgcgcggcggtgccgtcgcgccgcgctgtgtacacatacccttttggggagcgagcagtttttctggggcaaatggtcatcaagcacaaccttcagcagtagttggagcagcagcagtgcaaaaaaaaagggcagggcaaattgaagggcgtaaaatttgtgaaatttgttcgactgtttaaaaaaaaaatttttttttttaatttacaaaaaatgtattttaaatttcaaaaaatgaattttcaattcccaatgctttagctttcctaaattgaaaaaaaaaactttggtctttaccattgcaaaaaaaagttgtttaattctaaaaacttgagacctgatttatgaaaaaaatgcattaagtatttggtgcctaaaacccggtcgggaatttagaaaaattagaaaaaaaatttcttactcagatgtgacaagagctatggcgcaaaaattgttcggggcccagttgtcgggaatatttatttgactgatcaaaagtgaggaaagatgtttaaagtattaattttactgcaattttgcccttaatggactattaaatttttgctttggtttttatttgcaggaggcacttcgccaaagtggcgcgctgtttaaagtcgaagagaggaaatgggcggaggaaggtcaatgatcagagaagaaaagttgtgccttgcttaaaggtcgagatcgaaaatagcccaaattcaaagtttgtcctttagactcgagatcgacaacaataatctcgagtgaataaatttgaaagcatgaagaatgaaaaattggcaaaaatgttggactcgggtgggagaatcgaacccactcctccccacccagtgatccgtgagcagttttaccactgatctacccgtggatcagggatgtgacggagttttatccaattcttgctgctgggtcaacaatttaactgtaattcactaattgccaaggaaaacctgaaaaaaaagagctgaaaatttcttttcgaatattaataaacaaaatgccgatttcccatttcggcacggccctcaaatgggataattggcaaaaaatcggaagtccgccggtgttcaatcacaatttaatttgtttagccaaaaagcgctgaaaatctatgaaatttagagcattttgcagattttttccttgggaattgattgagttacaatcaaattgccgattcattaccaagaattggaaaaaatttcccgtcacatccctaacgtagacataaccgccgaggaacttatgccgagatatgggatcagtcactaataccgagatatgggatcagtcactaataccgagatatcggatcagccattctaaggctctcgaaaccaaagtaggcaaattttttagtaattttttagtttttgaaaaagacgaaaaagggcaaattcgattttagtccaaagcccgattaaaaatacagaaatcccaattaattattttgtaaattatattaaatttaaggaagttatttaatttttggaggacgcaatgtgcttcaaatcacttatatgagacaatggagaccgaaaactgatcagcccatcaccgaaaatattgttttaatttgtttaactaaaaagataaaataaaaagaaacaatcaaaagatgataaaagtgcaataaaaaaagaggagagaaattgaaataaaatttaaaaaataataattataaaaaatattcttccaatcgcaggtcaagattttttctcaatgattaaataacccaaaaacataggatttttaaaagccgagacgaaggttagcaattatattcggtaatagcttgatgaagagagattttatcggcattctcaatttcgggagaattttcaaacgtaaaattagcggtttttggttgtcaattgaaatcgtgccaaaatttgcttaattaatgcttgtgaattattctcgatggaatatgtcagaacattttcaatatcctacgtgataaccaaaatcccatttgctaattgatttactgtcctggaaaacaacaaacaaggaccaggaatacatagtattcaagaatttcaaggacggagttcggaccccgtccgaccatgagaaattccggtatttttgaatgatgctttttgagtgccaaagacaatgccgaaaacgaattttggccgaaatagtgaaccgcggtggcctctcattgagtcattttacttaactttttattattgtgacattggggcgtgtattttttttttaattttgcctgattaactaacacctctaaaaattttaattaaaaaatttgccatttttaagtccaaaagtttattttgttgttcaaaaatgaaaaaagaaagcacttttaatctctgctgctatgcatatatacttaaaagctcatgtgctgtgtggttgacgattgaaagtctatttttttcactggaaaaagtggcaaaagagaaaagtggcttaattgggtgtttaagaaagggacgaattattagcgaaaaaagggggaggacgattaaaattttgaaaattgcgaaatgaacaagtcggcaaaatatatattttttttgaaagttaaagataatatagaaaaaaattatttttaaaaacattgaaaaatagattgaaataataattgttttaggagacaaaaagaaaaaaaatcgtttcaaaatttgtaaaaaatacaaaatcatttaaaaatttataaaatggaatttgatgaataaatatatttttttaatgaaaatcattgcccctttattattgggaaaagaaatataaaattagtaattccgatttagcgagtcgatggacgttttggtgtgactagtaagtcgcgaccccaaattctcgggaacgaaggtaaaacgcttaaattttttttattattatttttgcattgaagaaaaactagcaggcctagagagagccctaactaactaagtctctaaacttgtcctattggctaccgtctaaagagaactatttcaaatattttgtatattctttggcatttcgcacacatttgtttaccaaaagaatttgtcctccgagggcccataatatatgaaagccccataaactatcatgcaattttcacttttctcctacaaaaaaatttaaaaaaaatttaatggtacacttaacgcgtgccggaaatgggaaatgaattctccccccccccccccccccgggggggggggaggggaggaagggatgatcaatgatcagaacagagtagcacacagttttctcgactcatccggaagttttggagacggacggatggacgggatgaagatcggagatgggatggaaattgcgatgccctcctccccccggcggggcggggagggacggcgacggaggtcgtccgcccttacccccc

SEQ ID NO: 10870 - DNA, 1139 bp, Heterodera glycines
ccccccccccccccccccgccggtcggacggggcactctttgttttgtctatgcccccgtccccctccgcttttccttttagcgcaaatgccgcgccggtggggcgagaggggcaaaaagcgcaggaagtaccaatcaacacaggaaaagcatgccggaggggatggaaaatttttttttcatttattttattgatttttgccccgtccgttgcaagagcagcagcaacagcagcagaacacacataattaattttaaatagtattaaaaatttgttgcttggtaaaaaaaaagtggcacgattaattaatgttcaattagcctatgggaatgcgatctcaaagtccaaaataggggctccaaggtttaaaaatatcatcaaaaaatggggcatttttctctgtggtggtgtcaaaaggtatcaccggaaaatttctcgaaattatagttcaatttcttaatagagagagatttaatccaaaaatttccaatttttttcttaatttttaagtcaaatttttggaaattttttaagcaaaatgagtattggattaattttaaattttaatgagatatatatatatatatatatatgcatatataacagttatttaaaaaattgtgaagtagcggataagaatccaaaaaaatttattcattcgggagacgagactcagttatccatcaggcattcaacaatggaactcaattggctcgaaaaatgattgttgggagatctttgaaaaaaagaggccgtttatgtcgtcccatttcagtgagggtcttcattaattaaggattattacgagacaaaacattcgttttataaagtgtcagggctatcccatccatcatcgattattggaaatgccataaatttcagaaaaaacatattagttatgatatacatatttggctttaacggtattatacggtaaaaattgtgcccaattcaaaaataaaaaatgagttccttatggagtcgagacatcgatcaatgtcaataattagcataaattgagaacaaacaattgagcattatgaaacaaacactttgctaaaagccaaaaattgaggaaaattcattcaaaaggatgggggcatagccaatgcatatgatatttgtgaataataataat

SEQ ID NO: 10871 - DNA, 1591 bp, Heterodera glycines
atgattccgggttgaagccctgctgctggggataatcctccgaggaatggacagattatgaaaagattttagaggacattatgccttaaataaaaggaaaaaagcaagtgtcaataataaaaacaattttttgaaaataagaataaataaaatgggaaatattttaaattcaattaaaaaaaaattaattaaaaagaaatatttgaaattacaaaaataaaaaataaaaagaaatatttttaaattcaaaattcttggcactaaaaattcggggatgaagttttaaaaaaaaaattaatactcgggaatggaaatttgtccaaaaacacggtgattaaaatttgtatcaagacatgacgaattttgtaccaagaaactcgggaatagaattttgtaacaggggctcgagatcgttgcaccaagaaccggagaatatgacaaatataagcaagactcgagattggaatttgattaccgaaaattgggagctcgagattgtgtaaatacgagaaatgataaaataaaaaagcaagaaaagtgctaaaagattaagaaaagatgacctattccagtgacgaaatcgcatgtactaatcacgcaattaagtgaagcaacagaatcttctcattaaagcagctaatgacagtaaaaagcaaatggcggcatgaaaatccgaacaacatccccaagggggggcggggggggggacgcaggcagcatcaattaattaattggcgaacgcgagaaaaaaaaacatctccctgggggaggggaacgcagcatcaattaaataactaattgatggatgggaaaaacatctcccgcttcccccgcccctaatcacaatcatcatcattaatggaagtgtcaagtggtcgtccgtcagcttatgcgggaaaagttgtcaacggtttgtgtgaaaagcaattaaaaaacggtgggggggggtaactggaatgacaaataaacaaaaataacacacattaccatcaccatcacaccacacgttaattagtgcgcgagaaagtgttcggaatcgagagcaaaattcctcgagaatcccccgctccattttttaattggtgggtcacaatttggtgttgcgagttcttgagggaagcgtgataagaaaaaatatatatgttgctcaaattctcgaatttccgaggtaatcatcccaattctcgaaaacattggtttgctgatctttgaaacaaataaaacttgtcctcgagtaggggggggggggggagggagggccagatagttttttttgcctaattaaagggatcgaaaaattttttcgtaattttggtctattaaaatttcggaaatccgaaattccagaaggccgaaaaaagccgtcggatttccgaaatcagaattttaataaaattctgtacaattttggtcaagtttaagtggtcaattctcttaattacttacagtagcttaattgtcgatatgaaaaaagaataatcggagaatttgattctcgaaggaattgtcgattaagcaaatttatttttcaggattaacttctcattattgctcacacgagaaatatgtgtattaaaaatttcgtaattgt

SEQ ID NO: 10872 - DNA, 1773 bp, Heterodera glycines
  misc_feature (45)..(45): n is a, c, g, or t
taaaaaaaatgatgcaccattattgtttatagaacagaagtgaanaccaattattcaccacttttttgtttttggttttgctgttgttttgtttgtgcggttggaattggcccataaactgcctaattaggtaattagtgagcgggttaattgattcgtcacgcttcctcccactgtcccccattcaccacaactcaaatgatgaagagatgataatgatattgatactctctgtatcagattgttaatgagatgatttgcggaacattaattacccccagccccctgaccagcccgcccattagtttaacgagtgagtccaaacaatcagcaccaatcacatttcattaaataggtaattagatggtgcggggggattcaatttccacaggaattgattcaatcccagtggacacagtcgacgagagttttggtctcgagacctggaccgtacaaaaaaattggattgtttaatttgaagtaaacaaaaacacgcgaaatcggcggagggggcacaaggtataaatatgtataaacatttcacgaaaaaaaataagtagaaaatttcgtaagattcgtaaaaaaaaatttttggaggaggcaaattgaaaaaacttactctatgccaaaatgaaaatttttgtggcatttcagtcgcgaattgggacattttagtgcggacaattttgggtttcttggaaacaaaaaattaaacatagtcttagaatgatgatttgatggcatttttaagtgttctgaaccagcctgtaaaatttataaaaaagttttaaaaagtttcttatggcacagaaaatgtaaaggaaatttaatttttttaaatttctggtaataatttcttaaaacataatgaaatttttcgaaaatctgaagggctaatggaaaacaattaatgatgtcaaataatacacattattatggtatttaattcgatttttctaaacaaaaatctaacaatgtttccaaattactaagcccagaaattaattgagagtaatggtcaaaattggattgaaaccattgaattcgggaccataaaagggcagaaaaaaagtatgcaaaaattaaataaagaataaaaatataaaaaaataaatagcagccaaattttgagattttggcgcattttttcatcaaaatcagtcgaaattcccccccccccccaaaaaaaaaactggcccgaaccaagttaaaaaagctaactctgatgttgatccggaatttttaaaaatttcgggctttaaaaccttaacgaggggtcaacaatttactcattcgtgtaaaggtactcgctccaacaaagctcgagactcttgaagttggcaggaaaagccaaatcaaattccaagcaaaaaaaggacaaatgggggccatgcaaaaaaaaatagaggttgattgaaagtgccggatttaaattcaccgcaaaaagttttcccgatttttattgaaaatttttttacttcgagcgagagaaaatcctgactaattaccgaaatgccgaatccgggttcaacataaaaaaaaaccgatgaaaaataactgatattggctgataaaaatgaatgtttttcccattagacggacctccaccaccaccaaatgacaaaatgggaatgaaaaataatcgattaattattggacacgaaagaattgggggtgggggggggagacaaaagagattatgttgccgcactattgacgcatgttaacaccggcggcggaatatgtacaaaaaatatgatgatataaataaat

SEQ ID NO: 10873 - DNA, 1242 bp, Heterodera glycines
gggggggaaaagaaggcggcgagatcaaaggggcgggaaggcacaaagagacggacaaaaagtggttggatgggtgaatgaattattgttgttttggttatgttattgggtgttttgatggcggctaatggcatatatatatatacatacacacaagtgtgagtttgtatttcggtatattgatgaaataaatgtgtgtgtgtcgcgacgatcgctccccggcggcggcggggggggggggggggagtaattagggccactaatcgcgggcccatagggtcagagtccgctgtcacccgccgctcgcccgcccggctgccgatcgatttgttggcggcaacattttttgatgatgagacgggaaaaatgggagacagagagagagaaagagaaagagagagtgtgagagagagaaagagagggtgtttgagtgtgagctgttagataggggtgatatgatcaacagagaggggcagtgaaattgctagtggttgtgccaaaagaaccatgaaagaatcgagacccgagtttggcgagaatcgacactctcgcggggcagtcccagtggccgggagtggccagtgtcggcaaaagatggcgatcgagagtgcgacagttcttgagggaaatagttctgtcgagagtgatcaatctcagcagaggtggtgatcgtgagcgagatagagttctcttacgaagtatgttctgatcgtgaagagggagaaaatggttagctgtcgagaatgttcagtctcggtagaggagatgatcgagagtaagacaacgggggaagaagaaaatagttctgtccatgagtgatcagtgtttgcagaggaggcgacagagagctagattttacggtgtgttctgatcagtcagtgaggtttgggagacagtctcaaaagtcgagagtgatcagtctatcttggcatggaggtgatcaaatcggaatttacaacatcagccctattttatttagtgtctgatcagtgagcatcaaattttaaaaatggcatttttgaaagtttgctacgtgattaaatcattatgtcattcattttccattctgtaaaaatcagttcacaaaagtgtcaacaaaaatttgtgacgtgaaattttttttttcagaattttcaaaaaagggcggaaaaaattgggcggggagaaaatggagagatggatggggcgcgaggggttaatttaaatgtgaaactggaaataatgcaaagaacaaaaattgaa

SEQ ID NO: 10874 - DNA, 1518 bp, Heterodera glycines
accgactcggtcaccgcagtcccatcattctcctgatgcttgttttgtccgttccgttgttgttcatctactctggccttggttcctcgcgggttgagcacgttattggcatgtctttgctcggagtgaccatctcgggcccatacaatctcatcgttggcacaattgccattgatttgggttctcagcaagccttggccaacaatgctgaggccctgtctaccgtaactgggctcattgatggcattggctcggctggctccgcattgggccaactttttgtgccgttgattcaaaatgaacttggatggatttgggtcttccatttttttattttaatggtaacaaatcatgggaagagtcaatgcgagcttcttttgcccttcagaactttctttcatccatgtgccttatccgtcgtttcttccacgacgctcggctcatttccctttcgtttgctccgaggcaaaatggtcgtcggcaagagaacgagccgctgatttcgaataactgaactgaaattgctattgtatttaattcatataatgccaaatatactcttaagtcgccaaatgatgtaaattttgtttttgttgacttgttattttgcaacacattccataaaattgccacacattaaaaatttgaatagctttttgaccaatattattttttgatgtacatgaattttaaatgaaaaaatagcatttctgtacggtcgggttactgttgttggtcgggggaggggcggagaattagcatgctccaattcgtcccctccctaccgtattttttcttgcactttcctcattatttggctgccccgccccaatgattgactgcgcattttttgaccatttcaataatttcatctcgccgaatcgagtcggagtgaaactcgaactaagcgattcgaatgatttcttccgccgtttttctcacattttcgtttggcaaatgccccactttcagtgtttctcctcctgctcatttctcagctaatggcctttccttctccgcttttgcctctgtcattttcggctgtcccttctttttttgattgccaaatgcctttttttccttttccttccgtccatttcactgccaacgatggaagaagcattttcgaacttcagccccaaagtgacttttggcatttcgattgggcttttcctcaaatgaattcgccaattgaatcgtcgttttctttcgtcgacgctttcggtggcttcgatctgtcgcctttcgcttcgttttttggtgccattcttttcattagctgaccacggacaatgccttaatttgtgcagattttttcgactggactttgctcgaagggttgggagaagacgaaacggaaagccaagcgaagccaatgccatctgacagaagttacgtaataataagccgggactgatgatggcattcttttctcccattttagggaaacttttgggggattcattccttcccccggggccgcttcgtccatcttcactgcttcttcccccggggccg

SEQ ID NO: 10875 - DNA, 3150 bp, Heterodera glycines
  misc_feature (71)..(71): n is a, c, g, or t
  misc_feature (89)..(89): n is a, c, g, or t
  misc_feature (100)..(100): n is a, c, g, or t
  misc_feature (105)..(105): n is a, c, g, or t
  misc_feature (114)..(114): n is a, c, g, or t
  misc_feature (155)..(155): n is a, c, g, or t
  misc_feature (171)..(171): n is a, c, g, or t
  misc_feature (204)..(204): n is a, c, g, or t
  misc_feature (257)..(257): n is a, c, g, or t
  misc_feature (278)..(278): n is a, c, g, or t
  misc_feature (292)..(292): n is a, c, g, or t
  misc_feature (311)..(311): n is a, c, g, or t
  misc_feature (334)..(336): n is a, c, g, or t
  misc_feature (339)..(339): n is a, c, g, or t
  misc_feature (353)..(353): n is a, c, g, or t
  misc_feature (380)..(380): n is a, c, g, or t
  misc_feature (430)..(430): n is a, c, g, or t
  misc_feature (436)..(436): n is a, c, g, or t
  misc_feature (441)..(441): n is a, c, g, or t
  misc_feature (443)..(443): n is a, c, g, or t
  misc_feature (448)..(448): n is a, c, g, or t
  misc_feature (462)..(463): n is a, c, g, or t
ggcttcgatctgtcgcctttcgcttcgttttttgctgtatctgggacagcagctgaccacggacaacgccngaatttttgcagagcacngcgacaggacnccgcncgaagggangggagaagacgaaacggaaagccaagcgaagccaaggccancggacagaagagacgnaagaagaagccgggacggaagacggcaaacagngcgcccagacaaggcaaacaagagggggaaccacgccggcccccggggccgcnacgaccaacaacacagcaacngcccccggggccgncgcagggcccagggcgccncaaacgaccaccgaacgcccaannncgngacgcggcggaagnccgacgccaccgccaccgcagacccgngagagcgagccggcgacgacgaccgcacgaaacgcgaacaagaggacccnacggcncccancngagancagggccaaagggnngggaccgccgagggcaacggacccgaaattatgccggagggctgcacgtcgaagtcggcacgaactcagccacaaaaggacccatcgctgcaccgttggaggtgaacgaaggagcggtgggaattctttaattgggtggacgaagtaaacatattataatgatcactgatcactgctgatcaggaatttgagtcggtggtaatttttactgcctttgtgtttttggcattgcgttcatcattaccgtccgggttcgattttggacattttcccgtctctatcttttacatattccctttaccattttcgcccgtctcaccaagaattcattttggtactttcatataactttttatttatttattattcttcctttgtccattgtttggtttacgcaacttaatcaccaaatatttttcatgaatttttaaatatttgtttttgggggattaattcggggaggagagacgaacaaatggttggtcacccattcgttcattcattttttgtttacttttgcaaaggattaaaatggtgggagatgcgattgtatggcttaaacgcttatagtactaataaatgctgataaatgaaaattgaattggtcaaatattttaaggctgtgacaaagtgtacaccaaaagttcgcatttgaaggcccaccaacgactgcacaccggtgagacttgtgcttttggcacttttgtcggtgtcaaatcggtgcttttctgtccattccttcgattggcctttaaagtcaacaattgtcggtttatgtttggcggcgctcaaaggccattcattcgcgctgactttgttctttctctgttcccctcattaagtgccttcttcaccagcgaaggacggcctattggggtcactcatcagttcaaccaataacctcaaacagttccgtcccatcggtttttttttgtttttgtttgcgcacattctttgaaggaaatcggaaatgcgatcccaccgcaaaatcaaaactattgtaattaggaccaattacaagcgaaacgaaggctaatgagagcactgaagaaagggggagagaatgggaagaggagagggagggaagagagagagaggaagagagggaaggatggagggaggagtgaggaatgaggggattagacagactggatcagtatctgagttaataatgacaaggggaggaagagtgagagagtaaaagataggggagggaaggggcgttgattagcaatgcgatcaaaggttgatcagcagtcagtcagccaattattcaggcgaaaagccatacccatgcccattcccgaaatgccattggaagttttcacgcagtgatgagctcacccggcacattcgcaagcacatgggcgccaaaccattcaaatgtgcccaatgcatgcgcagtttttcccgctctgaccatttacaggttcagaggaagagggaatcccgaaatatcgcaacagttaaagacaacaaacactttcagttgcacatgaaaaggcacggaggaaagcgctgttgaaagaaagaatactcgttgaagatcattgccgttcattttttgacgagtttttatttagatatgcctttttcacctttttcttacgtttaaagtctgttctctaattatttttgttatttggatgtagatttgtttcatttaaaaaatgcctgaaattttaaataaattttttaaaattaaaaaataaataaataaaaaatcttacgaataaaatgtgtttgtctaatgcttcacatgccaattcttttgtgtgaatgcgtgcagttcgctttattcccttttctctgttgctttttactgtcgcattcattttgctgcttttggacaggaaattaagcacagtaatgccatggaattcgattcaattcagtgtgcacttttttaggaatttagggattttcttggtgaaaattggcaatatgaagacggcacgaccgaccgattggccaaatccgcacaaaatcggattcaaagcacagcttgcaaagttcagctaaggaatttcctccatgacatagcatttaaaaggcattggccggtcaaagaaatcgcgaagaattgcgacgatttgttcggtgcgtttccttttgcttttgcgttcgcaatgcattttttccattttcacaaatattttctttgcagaagttccctctgctgccaatgctttgaaattccgtccgttttcccccggcacttcccatgtcaaaattcttttcctcctccaattgaatgggagggattctcgccaactccgccgtctcttccgttcccttttcctcccccgtcacttttattttgtccacgtcgacagtcgccgcgaatttatgctgaaaggtgaaacattcagcagaatggttctgaataaaatatttttgaagaaatgttgaaggtcgaagagtctttgagggcggagggattcgcaaattttcgcgtggcaaagcgtcggatggccaccatttggggagggtcgaatttgctcgaccttttcctttggacggtggcggaaacactcggcgaaacgaattcgaattgggcgcaatgggattatattgtgaatctgagcgagacggacatgccaattctatcagtggaagagttggaacagaacttggccgagtaattcaaaatgaaacaatctcaaagtgttcatttcctccccaag

SEQ ID NO: 10876 - DNA, 1719 bp, Heterodera glycines
gcatacatgtacaaggggtgcgccatcaaaccccccatacgtcggacgtttggcgcaggggggggggggtgcgccaggaccaatttttcttacgtcggcccctattttgccccgttgaagaccttcttttttttgctatttaaccatgttttttggaaaataaattccgcgtcaggactaaataatgcttttgttcgtcattttatcatgatttttatgtgagttaggtgtatgtcgatatgtgtcaaaagcctagcttcattccccccgtttccctttcaggcgcaatttgcccgtcaacctccgtttggacggtggctccgattgggtggtggtccaccgcgacttggctctgttcgccatttccgactctctcctgccctctcaattgcgtcttctcttttcttccgtccttttgccccttgaaactttcttccacactgtttgctctccctcttctcttccgatgcttttccgttccttcgtttagcttgccctgaacagtgccaatttctgtcgtcggattgtccgtcgcaatttgcgctttaccaattggcgtcgtcgccagggctgtcgctgtgccccgttaaagtccgtcgtcgattggtgcggctgttctccgctcgcagtgagtgccaacgaattgggcaaattgtcgttgaatcagtgagcaccaatggcataattgcctttttatggcattttccttcctccccctttagttcccagtccaaatttcacttttttggtcgcaaattcgattctgccgttgatattgctcccattgcttttgtcgaacggcaaagccttcgcttccgtgtcgatcttttgccctcccaaagtgccgtcttttccgcccattggctcaatttgttctccgccctttcgccttccgacgttccgttcggttggcattgactttttccttttttaatgcaattttaggattaaatgccgagcttttgacgctgttcacttcatccattgcccgttttatgttgccgaacaatttcatttttcaacgtttgcacgactttcacatttacagagaattttctgcgtcccctctccaaacaatcgcaacattttccgttgcttttggtcacactaattacttaattgaggtaatttgctttttgagtttcgaatcctttcactttttccttctcaggcactgattggccagaaaagggactctttcgcaacttcttctcccaccgattttgaggtcatcgacgaggacatccgttttctgttcaatgccgaggaaggcatcgaaattgggctcgacttcgaccacaaagaagagattttccgaacttttccaccgcttctctctccggtgatttctccttttcaaacccattaaatatttgtttttagagttccaagttcactttgaaatggcgttgggttcgccttggcatcgctgccgatggccgtgccaaaaggacgagtccccccgctgagctgctcttccgtgggcccaatggcaccgttttccacaggatggccctgccttcttacaattctttctccggcactcaattcgcacagttcgaatttggccgtttttctggcgtttcccccggtatttcattttccggtcgctttccctttgcgcttaattaattattcggtggtttctcaggtgtttggtccgttgctttgcatgccaacaattcccttccgattgccctcctgtctttccccgtcttt

SEQ ID NO: 10877 - DNA, 936 bp, Heterodera glycines
  misc_feature (11)..(11): n is a, c, g, or t
ttatttaaacncattttgaagtaaaaatgtaaagtttgaccttcttaaatttttgacctattattcgaatctgggtcaggggttcgaatttggtcgaaattgatgtcagaatcggatctccgaccctgaaaacccctaaacaactttgtttctagaaaaaaaaattaaaatttttcaaaaaaagggtgcggggtaccatcgacagtattacgaaatgttcgaatccgggttcggggttcgagactgagacaaaataaggccggattcgtgctcggcgcctaagattacccctaaaaataattttctcaaattttattaaaaaaaaattttcgggaccaataatctataccattgcccgccaaaccattgatttttaagatttttttttgaaaaatttaatgtttataattgaataccgtattttctctttttatccctccggggggattatttttcaacctcctcagaaagggggggataattagacacggggggataaatggagaaggggggattatttttcgacagatttattttgtgtaaaatttcggactgggacactatagtctggcccttatagtctgagccaagtttagagcatcataacttttttctttactgaccaaatccaacaaagttgatatcattcgaaagctcttaacaagctctatcagcttcccaaaaatcgcaaagatataccgacatgtaaaaaagttataaattaaaatatgcaaaacttctgactttttggtagtattcatcttgcaacttttttatagggttttcaatcgcttagaaatagcttatcaacagcttctaaacatatagggctttagaatgatgccaaatttataaaatttggccagctgagaaaaaagttatgataatttaaacttggctcagactataacggccagactatagtgtcccccaccc

SEQ ID NO: 10878 - DNA, 2425 bp, Heterodera glycines
  misc_feature (2333)..(2333): n is a, c, g, or t
cgaagatggtaatagttacagtattaatttagttgaggaacaacgaaatgaccctgagattatggcatacattgaatttttaaccaatggacattttccgtccgatttttcagaaaccgagaaagaccaattctgctctttagcttctaaattacaagttattttcggcattctgtacttcaaaataagcagtaacattccacgcatttttgtaccagtttcgttacgatctcttatttttgagtctttccatacgtctcctttaggaggcggacacatgaatattaagaaaactttaaaaaaatgtaaaaagtattgtaaggattattcgacgcatttccctcatttaattattccttattggccattatcaattcaatcacatttatccattttcacacgtttttcctttacttattgtaatgtttctccgccccattctcttcgtatctctctttccccagtgatcagttagtcagtggtgatgggacagacttcaattattattccgatttctcgcttcgtttaaatccaacatcgaatgaataaatacatcttaacagtcaatgagtcgtttgggggttcggggcttggtcaaaggcgccttggcttttccccattccctcccaaactccatccgggataaacggtgcatagttggtctgggggcacagtgcgcatccctcactggtagcaccggatggttcccattttgggaaacgacgacccatcattgacgacgaagctgagaattgggtaagccggcagaagtttgtgggagatctccctggcctgagggcctgaaacaaagacgtgtacacgcaagtaaagaagtctgacattttaaatttctgtccgggctagtcgaagactaaagggactttaaaaagagaagaggtgagaaaatctgtccgggctagtcgaaaactaaagggacattgaagacgaagagaaaagaggtgagaacatttgtccgggctagcgaaaagctaaagagattttacaaaaaaaaagaagaacaaaatttgcccgggctagtctaaatgctaaaggggctgactgcatcgaaaattgacaaatttgacaattatttgtaggagagagagagaataaggaaagagagtgaaggaagccaaaaataaccaaaaaaaaagtcctggtaacaaacgaataaggactaatttataaaaatatttgaacgaatgtgaagcaaaaaaaaaagagagagagagagaagaagtgagacaaaaaaaaatatagaacaattttttgaggagagcaaaaaggcccgggctgataaccaatcaaaggggcactattttagctaattaaaaagagggaccaataaaaaatgaaaattaggccctatcaagttacagtttttacaagttccaaagttcattttatctctttgttttctcccgtttttcacgccataagaatattcacgtaatcacgtgccgccgcatttttcattgggcgagatcattcactttaaacatttttgcggcgcctgagaattgttaattgttcttgttaggcgaagtttaaacggagatggagcagataagcccattcctggaaggcgttcgcatccatttgattacccgctatcattcattaattttttttttctctctcaattaatgcataatgggattaccaaataattttttttagcaaaataaaacaaaatcttattacgaactgaacgacttcgaatgtctacatcagggggctcgtcaaatgagttcccatttggtacatcccaagccttcgggcaggaaacaaagatgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaattttgagactctgaaagtccaattcgagaccctaaccgaaagagttgatatgttggaacaagacagtgatgggacggattcaggtgggactgttagtattactaatctgaatagagcgtcgcgtgcaccgtttgtgacgccaatgggcaatgcacagcccaaccaagttgtaccgaaccaagtgccaattcatcaattatcaagcgaagacgaagatgacgggccgactctttttgacctgaacatgctctcgagcggacccacagtggggtcaggtttggaaatgttttgtgaggagtctgtttttgcatttgacgattgngctgaacgtttcaaggattacctgtccgtgtcaggcaaggcttacactgaacaagaaaaagtcacaagactcaaattggctctgagggacac

SEQ ID NO: 10879 - DNA, 2194 bp, Heterodera glycines
caacaatggtacgtgggtttagacctttttctggatccatgcgacgagacaacaacaaagaggaagaggaggacgaggccgctctcgcaattggggaggaggccgccaggagcaatttagccaaagaaactggtcaagcaaccctcgatgccattattgtgaccgtgctggacattttgcgtacaattgccatcaacgccgtgccaatttcagaggaaattccaaccaatcgttccgtcaaggaagatggtcaaatcagcaacctcgccaatctcagggacaatggcaaaatcggcagaatcctgttaacatgatgaatgtgccaaactcttccaacacttcaccaggatttttcgagaacttggcccagtcgttacttgacctcaaaattcaggacaatcgcaattacaaaaatgaggaaccaagatctggggcaatgaatacgctcacacacatcaaacccaaaacaacagcaatggattgtcaggtcgaaaatgaattagcaaaagaatcctctagtgaatccccagcctgtgggccggaaacaaagacaaacattcccaaaacgtcaaattgggaacggccaagcgtacgatcgaaagtcgcttctttaatgttcattacatttatgcttgttggaatgattttaccctttactactgctaatatgccccatctgccaatgcatccccttgtctgtcaaacccaaaacggaggaaaaatttggcaattgccggcagttactggctgttcaaagctgtcaattgatcattcaaaagcacctgttgttcgaactttcgatgtcttttcgccaaatttatttgagcactcggcagatgcttgggcttgccgaaaagtgagaaaatccgtgcgtaagtacacttcaatcactaatgttacgatccaagagactcttgaaccacttatgttgcaaatgactccgagtgaatgtaagcaaatggccgaaaatggaaagtgcagcttaggcttgctaattaatgactcgggactctcgcatactgacaagaaattggatttgtcaccccgaatgtggttaattggttcatttagttggtcgactgtctcaactgaaaattgttatctttttaagactaaaatcatgtcacaacatggtagcacaattatgctaagtccccttgggtcagtgaacaattgccaattcaaggcaggccaatgtgaaatggaagacaagacattgctcatgtgggatacccacactacccgtgcctgtgaattttcaaaaattggcacatggaaaggactacaacttgacaatatttggatttcggatgaagtcagttttcgtttgacatttttgaacaacacaaagaaagtcaactcatgtggtctgaatctgataaaatcggaggaaggatttgctgtacaagacttgccttccgacgatagcaacgaatcctcaaagagaagcagaaagacgagatcacttgaaagttgggtcaccgaatcggaaatgaactccaaattgggctatttggatgaacaagtaagagaaatgctgactatttccttttctcagacaattaaatcgatttgtgattatatgttggagacgagaagatgggcagcgacggcacttctctcagatccaacaacttttgccagaaaattattccaatctggtaaactggtggcaaaagtggccgggcctgaattgattaaagtgtggccatgcatcgaattgcaaggacatgactacgaatttgccaaaattggaaactcagcggattccgaattcgaatgctttgacaaaattccaattaaattccgagtgaaggacaacaaaagaatggcatttattgacccaaggacaatgattttgagctccgatgcgagactggcaccatgctcagaataccgcaaacagctcatttttgtgcgtggttctctttatgaagttgatcaaatcgatgctcaggtcaaacaggtgaatgccaatcgcattgacggtttcagccttaatctgtcattggcaccgacttatgctcgccattcctttcttcacattgccctagtgaatgtgtctgactttattggccaattttacgacgccaatttggcaagagaaaacgaactcacattccaaatcaaaagtgaggacgctatagtcacaaagaaaagtcgaacaatgggagcaggtgagtgagtccattcg

SEQ ID NO: 10880 - DNA, 915 bp, Heterodera glycines
caaaaggcacaaaaaggcgcttaacaaagcattgccgcaatttcgtagcgaaatccagcacattgcttttcactcagccaaatttcggcggattttaagtagtttttaggtgggcgcaaaatggtggcctgtgccgactcaaaatatgcaaactttgactggttttccatgcgtttcgactgatcaaatcggagaaaatctgccaaaaattaaaaaataatatttaaatttttggagagcatttttcaaagctattgtgccaaaaatgccccaccaaaaagcctttaaatgatggccaacacttaccgttttcctttacacatgtgtccatgcattgtttgagcccctcgaaaatgttgcgcgtctttccgacacatccgtcgtaccttaaagcaaaaagccgaaaatctttagcaacagaatgcatcaaaagaccaaaagtgccggcagaagccacccatggcgtcgaagtaccatttgcgtgtccaacttttgccgttgttacacgcgcggcggtaaatgtcgtcgaagggctgcgcacaaattgccaacgatgccattagcggtggtgtttcgaaaatttgcaattttaattggtattttttttttaaattccattggcaccttcgaccgccgctcggatttcctgtgccgttcccagccccgccgtcctttgccgttccccccagtgcttctcgaccccgttcagttcgcatttcctgcggcatgtctccgcctcccggaagttgttccgcgtttggcccgtacatccgtcgttccaaaagggacggcactttccgctccgcgcatcgtaaaaaaagcgcgtcctccaccgcatccgccccacacttttggtcaaattccaatcgaattggtcccaacatgcttctggaagtggagaaaatatgatcactg

SEQ ID NO: 10881 - DNA, 3173 bp, Heterodera glycines
agtacataatatggtaattatattattattgacagaaataagtgaggtcattaaagggttgccgcgggacgagaaaaatgtttaggcttcgtcatgctcaagctgtacctggtgaagtgccgcctcgtctctgctgccctcctccctctccctttcgcacgcccttcgacagttttgcacatgcacaaaaatgttgcgcgttcggatgccgcccgcgcgcggcgtcggacaacttatatccatccaaaagacgcggcaatagccaacggcagcgtcaaaataatagcggcgtttccaaatgccctcggcacagtgctggcgaagtgactcatcgaacgggtcgaaacaggggtcttaagtgggagaagaggggtcattacagtcgaccaatcaatcggtgagataatccgtgccaaggcaaattatgtatgcaaatgctggaaagtcccaccggtccgtaaccttagcaaaactccaaaattcgaaaattatttcgaagaaaatggattattatggacaccatcgatagattaataccgtgcatttttttctgttgttgcaccatattttgaggagcattatgcgcaatttcattgaaatattcggcacgcgagtagccaccacaaatggactcacaactcttaaaagtgctaataaaaatgctaatttaaaataataattaaatttcggaatattttcctcacttttttgtcctggaaaaagttgtgactggcgccaaattggcacccgccgtaccaaaagtgccggcattgggccgacgccaaatcgaagtgaaagcgcggcacccacagttgcccgggttggcattggcgttcgtagcgaacatcgaacggttgggcacaaattccttaaaaagcgaagtttgaaaactacttttaattagcagggaataattaattataattaaattatttatttacttcgattttttgtgcaattgaatccgctgcccgcgaaacccttgcggcattcacagcgaaatgagccgggcaaattcatgcatttggcattccgttcgcaactgatccaatcgcattcattcgaatctatggcaataaaaatgaaaaaaactttaaaaaaaattaatttaataaaataaattatattgaaaaagatagtcagtaattgcgctgattagtctcttttaccgatgcatttgccttctctcttttcatatccgcttttgcattggcaaattccgttcacacaaacgccgcccgcccttctgcaattttccacgcaattgttcctttgtcggtcattttctgcttctttaaatttaatatattttatataatttaattaatttttcaatttttgcccactctttcgctccgattggaaaacagcagacaatcgaaagtcgggatggcactttctcttgcaatgacttctggtacgaaagcgatttgaattgccattgcagccgctgaaagcgaaaaaatggaaaatgaattggaattgcggaaaatggcatttgtgccgaaatgacaacaaaaaatcaaagataaattaatcttttggtacgctctaagtgattagttaatggcttttcaatggtcgagattcccgatgtgaacttttggcatctcaaaatggcacatacgtgtaaaagaatctgaagcaccgctgtttggacgagttgtagtaaaaacgcgttaatttttccgtgcaattgccaagattgagcggcatctgaacaattaattaaaaaatttttattgtgcccccgtccgacattgtgccgtttgttcactcacctcacaaattctgtcccgttttgcgttccattcgattgcattttgttgctccgcatttgcattgaaatgagcgatgtgtgcggcagtggaaaagcacacgacgaggaaaagcggcagcggaagggacaaaacggtgccgaaatgcatggggaaggagagaagcggaagaagctaacacatattagcagacaatgagcaattaattgggaaatgccaatgcaaaggtgtgggcaggaagaaaatgccggattaaaaggctgcaacaatttaattctgaaaactatcgaattaaaaagtgtgggaaaattggtggaaaagcagaggaagaagaacgggtaattaattattgtaatggacgaacggtcgtccgattacggtacgataaataatttgcatttcagttccatttaaatcaaaaaggtatttaagttatttttaatttaatccttatttattttttgttcctccgttttagtgtttctcaaaataaactttccttttccttcttcctcctccatcttcgcttctgttgttgctgatcacaatcacttcacatttgtccaatcatttctatttttatttgtcccctttttccgctgccttttcccacacatttttattttttttatttattatttttatttatgccatttgtatggaaatccttcattcccacccccctcattcattgtttcttaccaaacagcagcagaagtgatcaaaatgggaaggaattgaagaaagacggactcttctgactttggaagggaagtcccatttggccattcattcatttattatctttgttggccatctttcttttgtgttttcgtttatatccattcaaatgcaaatcgctttcacaagacaagcgccatttaaatggtgccattttcgaatttccgaaataaaaaagtaattagttgaacttagaaaaatttaaaagaaaataaattgacaaaggaatgaatgaatattcaaatgcttttaaaatttttcttgcttaatcctccgctttaataatcgttgttttgtcccccgaaccctttcaattcgctgcttcaaattgccttttcccggcgattgcatttttttgtcctctttttgtgccattttggacaccatcactatcattcttgaaacgtacaaatgtcgagtgttttgttcgagcaattccatttacgatttgcaaaaagagtagtcattcagactgggccgaaaagtgatgagaattgggatgagattgagtaggccaaacaagtgaaaagcaacccaattttcattatttcggcacttttcggattaggtatttatttatggcattggcatgggatgaggtgctgctggacaaagcttagcttaacaagttggagaaagtgagtgcgcttttta

SEQ ID NO: 10882 - DNA, 282 bp, Heterodera glycines
cgccgggggggggggattcaaaaaagagcaaaaagggacaagcaaacaaaacaaagagagatgttgtcataaccttgtcaaaaaatcacaatttgaattgatcattgatcggaaaaggtggcaattgaaagaaagaaggacagaataataattagggaaataattaaagaaattgaaaaaaatatatatgtttaaaatcaaattcgacttttccctcgacttcggtccccgactttttaatgagattcattttcaaaattaaattgccactgaaaatgacca

SEQ ID NO: 10883 - DNA, 2681 bp, Heterodera glycines
cagcaacaggtggttatcggagtcgatcggcgtcgatgaacgtgttgaccacgcccgacaatggaaagtcagcagcaattgatgttcaacacgtcaatgggttccagcactaataataacaacaacaacatctttgggcacagcatgcaaagactggtgattaacttatgcccaagggttttaatacgttttttcctgagttcccagatacatgaaaagcgtgaaaatttgttttagcgactgatgttaagctattactttttattattttaacattataaagaattctttaaaaataatttttaaaaatattacatataaggagaaagataaaataaaattttattctaaaccccaacccattgatcagcagacttcgccggatgagagtccgttggatcatgtaaatgtgcatcaacagtatgcagtttcaacatatgcaaataatgagcaacaacagcaacaattgcttttatctccgtcaccaccaaaacgcagcgcatccttcacagatatgtgcgcttcctatcagcagatgaacattcagggtgggataaatttaaaaatatatttttttatgtaatatatagcatttattgggttctgattccagaatttttggataattttttgatgtttttaaaaagatttttaccaaaaagataaaaaatcaatttatcataataatttatttatgttaaagtaattaaaaagaaatctcgcttttatggatattaaaaatttaaaagggttcattatttaaatataatctaattattttaattcaattaagaaaatatgcaaacaaatgtgcaagtgactgaaatgcaacagcaatatcagcagcaacaacaatttcaaattcaacagcagcagcaacaacaccttgaagggttttttgcgcctccttttgcatatggtaatttttttaaaatttattttagattttattaaatcaatttatataaataattggttaattttatgcattgaacttgatccggatggaccacagccaaaaatatctttggcaaatcagcagcagtcggcagcacattttgccgcatttaaaggcataaattaatttagaattttttaattttttaaaattttaaggaaatgaacttactccaataaatgaagacacgccacgcttatatttggaacattagttggcctggcatattgaaaaaaggacattttgtcaaattaattttaatgagaaaatgttgcaaacagtacaattaacattaatttaaatattaataaatataattaattttaattacaaataatattgtatctctctcttctgtctacaattaatgatgattatgatcattcttcgttggcattttgctcatctattttttgttaaggtcattataacaaataaaaaagcgcattatcctttttatggcttttgttgttggtcaaaatgatttctaattattaaaatgaataaatattctgaaatgctttgtcagtcgttttagaaattttagcaaaaattggaaattaaaatataattttttttctttcgaattgtgaatttggaaaattcgttcaaaaagacaccaaaactccctaattttttgctattattgtacattaacaaaattaacgaatttctcttttgcttttttttactatttattgaattctaaacaccttaacaaaaacaaagggtttgagaaaaacgtttttaaattgtaacacaatgggacataaatgaggggaaagagaaaaagagattttttgagtaatttaatattttaaaaatttctttaagtttttaatctcttcaggttcaagagtttcttcctgttccattttttccatcaaatttttacatgaaaaaatgaaaacaaacaaaaagaacagtaaaatttatttgttaacaaatacgcatgataaataatataaaaaactgaaaataaatgtgaaaaaataaagtgaaaaatgaatggataatgaattaattaaatgaatgattaatcgccctttccgttgtttcttcggctttcttcaaagagtggccaaattgaatttgaaacttggcccaaagttcgcctcaattttgtcgccagtccacagaaaacactatttcattctgattgattgtcgttgaagaattttccatttaattcactgatttgtgaggataacacttggtcgcttaaatcaaaaatggacaattgatagggcggtgagttttaagaaaactcgacgagcagcagggagattaatatttttcattgcatatgaaaacatttttacgcgtccttgggtttcacgaatttttcccgttgtgtccttgaaaatcagtatacctatcgttcattggaaagcgaatttttccaatggcagttcgaactaaattaaattcttgaattactcgaaagaaagctgaatttcgtcttttctcaatgccagagtatttatttttttttatatttataaaattgatgcccgaatgttgtctgccttttttttttgggggggggccgctttttcggcgccagccaaaagttttcgagataataaatttttttttgttgataacccattcgaaaagctttttcatgctttcgctctctctagccattctacgcgattagacaattaattacccaacagttataacatgtaaatgcaaaaaatcgtttataacttttttg

SEQ ID NO: 10884 - DNA, 752 bp, Heterodera glycines
gtaaaataaaggtcatattcgtgaccagcgccacaaattaccctagaagaattatttaaaatgtcttttgagtgctttttatagtgcagttacttgagtgccagttgagtttggcactccaattctggcactttttcagcctgaaaaagggcaagcgcgcccctaattctatttttacataccatttcaaacctttttgcatcgattctaaccgtttttaagcatttttgagtttggggactatgatcatattttccccgtctaatagagatttttgtaaaaaggtcaaaatatggacaaaatagagaaaatattatgtgttttttacatttttgaaaataatttttaacattttttttcaaattccgatcattcaacatcaattaattcattagtcatcagtaattaggagtgcattttccggcggaatagaaggagctttgccatttgcatttgcatctcattttgggattgtcataaggactcattgctgagccttggcacgtctttttcgtgaattgtttgcatgtcgacacacaagccaaataatctcaaataaattaatttaaaaaattaaattataaataaaatgaataaagctaaatgctagcgaattcaatcaattaacaggggggagggggtaacaggctaaagagagaaaaagagagacggcgtaagagtgtaggaaaataggagaacagacagatagttagagaagcgatgagagtgatcgtttaacgcccgctccccct

SEQ ID NO: 10885 - DNA, 1580 bp, Heterodera glycines
  misc_feature (14)..(14): n is a, c, g, or t
  misc_feature (98)..(98): n is a, c, g, or t
  misc_feature (105)..(105): n is a, c, g, or t
  misc_feature (1564)..(1564): n is a, c, g, or t
aaaaataagttttnccatttcaagatggatacccgaatgcgaatgaaaacgaaaaaatttgagattagaaaataatgtctaaaaatttattaaatgtnttatttntaaatttattattattattattatgaaaattgacttttttgattggtttttatatgggaaagagtgccgcattttagttttatatgaaagtttaggaaaataatttatttgtttagcttttttacattaaaattttttccctttttcgcctccgtcgatcgttgtcctctgtttaaatatttacaaagtttttgcatttcgtttttctatttggcatttaaatggttacctatcatttcgtcactgagactaataatttaaaaattatttctcagtgacgaaacgatcagtgaaaaaatgatcggccattagaggtttttgtactgtttttttaatacaataaatgatccaaaattcaaatgtacctttttaaatctttttgttaatataaaaactttttcatattcaaattttgaatataagcaaaattgaatgttgacctaagaagaagaagttcactctttctgtgaactaatttaaacatgaaatcggtaaaatttttgagagaaaaaattgttaggggttggaaaaaattttgaagtaagacagaaaaaaaagagcacaaaataggctacaagatagatagtagggttgaggcgcgacccatcatttacaatttttttttttgccgtaacagcggcaaaatgtgaccgaaatcctcgggttttgattactattttttgattaatctgaaggagcttttttcagcgcagcaaaatagtgaacaagcacaacaacagcaaaaggcataatgccaaaagaattttcaaaaatgagaaaattccgttcttccgcaatttcctcaatcagtgagcaggaatgcatttgttttcagcagcagagggagaccattagcatgagcatctgattttgggattgtgactagcacacaactttgccgtttcggcataatgcctgaaaaatatttgaaaattgtcgccatgggctaaattcgaatccaaaagctgtgcaagccaatttaactccaattaaatcaaagagaaaatttttaacacatcaaattttaccatatgcaatgaaaaagggagtttttcaaaatgaattatattttaaataaataaaatttttaaaccatttaaatcaattaaattgtctaattttaaaggattttgatgaaaatattttattgcgatttattaaataagaattcggctcaaattttgaaataacaaatataaatgcgaatactgaaaaaaagactatttttaaaataaataaataaaaagggaccaaagcaggaaggcagccctgataaaatagatgggatggaggaatgaggagttcggggatggcaccattcggggacgaggcattcatcccagaaaaagtgccaaactgtcagtgcggggagcaaacctcacaacgcattttaaattttgctaatataaaaatatcaaaaagattggcacatttatcgaggccttttgggtctcgatgngggttaattcttagtg

SEQ ID NO: 10886 - DNA, 1212 bp, Heterodera glycines
  misc_feature (5)..(5): n is a, c, g, or t
ctaantcatccaccggtggcaataagccgtatttggcgctgagattgagcgcacgtttggatagaacttaaaaataaaatattaaattcttaacattagtatagaatttttatttgaattgaacatatcaatacagtaagttatccatcaacaaggttcatgttgggacgttttctaaatccgctctatgagatgattaaaatgaaaattttaatatattggttttattgttaaacaaatttatcattcttggtaccattcaatatctctgggaattctcaatcagaatatataaatccaaaaaattttgaaaattaaaaaaggaattatgtgtataatttgttaaattcaaaaaatcgaacttcagagttttctggtcataatctttttttttaatttttcaaaatttttaaaattaaacattcagattgagaatccttagaacaatatataccagggctaccctttgtacttatttgtaagtattgtacttatttgagctcaagtcacttatttttgggactcaaagcaaaattccgatttttatagcaatatttgcggtcggggtcattttcgcgtggccattttcgcgtggttgcacataagcgaattttttacttttttatagtttggaaaattttttgactcccgttttacttctggtgcttaattcaatatatatttaagtaaattttataaactaaattagggaccaggtcgttttggagccgacgatttgtcgccaacgttattaagaaaacaaataaatttaaatcaattactctgggaatttttcccgcgattagattctgttttttaaataaatttaaataaaaaatcattaaaaaattttgtttataatcacggatcacggatcacggaaatcacggggattttggggtgtcgtgatcacggtttacggttcacggaaaagttcaaaacaaaattatgtgcaatatatgcttattttattagaagttttcaatttttataaaatgaattgacgaaatattttgaattgattgttcatgattccttaacataatcaatgtaaaatattatagatattattacctattttttacataatttcctcaggcacacaaatattatatgtatcggtaatattacgcatgtttctttatgtactttgatcgcttaatcctaataaatgaaaatattatacgaatttaccttatattataaaatttt

SEQ ID NO: 10887 - DNA, 4762 bp, Heterodera glycines
  misc_feature (324)..(324): n is a, c, g, or t
  misc_feature (326)..(326): n is a, c, g, or t
  misc_feature (342)..(342): n is a, c, g, or t
ttgcaagcataaaaatgaggacgcttttgagtaaataaaagcaaaaaatttgtttgaaatcggggtttgggactcaaaataggtcgaaatgtatgttcgccacacatccgaccaatttcagtcctaataggcactcacgcgaaaacgtcctggccccgaaattttgcgttttaacgcccttattcgaccttagaaatccttattttgggtgttcgcccttaaaatccatattttacatgttcgcccttaataagtttttgcccttattttggcgttttgtacaaaatttattaacaaaaatgcaataacaacgaaaaatacacncnctaagaatcgaccaanaaaattttcagaaaaatatacccctaagaatcgatactaaatttttcaaaaatagaccccataagaaatgaaaaatttttctaaaatatatcttatttttttggactttttcgcccttaaaaatcctcgccctatacataacacaaaatcgttgatcactaccccaacaaaaagaaaaattttataaaagtcaagggctcaaattcattttccaaatccgcaattcaaattgatcgatcacttctcagcaaatcattcattcacttctgctatggcaaaatatgcatttattctagagtagagcgggaccgggccgggaattcccggtcatccgaggtcccggtcccggattttgaaatgtttgccaatggaatcgtggaaaaaatgattttgttttgaatcaccgccaccgccctttgtgcccattccgtcgtaaatttttgtgccttccccccaaggaatttgattttggtaatttagccatcattattaggtatataaatcatcaatttgacaaaaagtgactatggacgaaacgcgaaaaatgcctgctaatttaaaaattgactgttttttgtttattcatttgtcaaagttctacaagaaattctacaaataaaatttaataaaattgtcaataactgaacataaagacaaaattgtcaaaggatgaccatcattaatcagtcagtcagtatgtttgggacaattaagcaaaatcatttggtgtgatgctttaacacaggtgtgcgatctgaagttttcaaaaccaagataaattggatgacaaatcagcaggagtttttcattttgtcggatttggatcctccaaattataggacaaatcgggacagatcgcacgcctgctttaacacgggttggcactaggacaatcaatgtatatgtggcaaaagtcgccatgccgacccgcagattgtcggataaaggatttcgagaaacggcataccgccgacaagaaacgggaatgtcgaaaatgatattctcttgctctctctcccccatccctgctgcatttgtcttcttctaattaggcaattaattaacaagtggtggaaatatcacaatgcaaacgatgggaattggtggtggtgctgatattactatcatgtttagtggcgttgttctttctgccaccacttcgattttgatcatcatcatcatcattagccctaatgatgatgatggcggtgcctttgttgttgcctccttctcctcctcctccgttgctgattgcggtggccgaaatgttagcggcggatgaagcggcggccagcgcggcgttgtggtgcccgccaccgccgatcagtgtccgcgtcagctcgcgcttctgcgcctcaaagcacgcgtcgcacaaaaagttgttgaacggctgaacaacgcgttgacagtgcgcgttcaggcaggtcaacagcacggaggcggtgttaaacgaacggctcagccgattgtctggcaacgggggcaacgcggagtggggcatctgtggcaggaaaacagcaataaacatatttgtagggtggtccgatttttttaagaatggaaaatatggaaccgaaacacatgggaataagtattttttacattttaagaaatatttgaaaatgaaaaattggaaaactcgaaaaaagtttcttgtaaactacaatccgtcaataaaaaaatttttcttttgggggaaaccaaaagatttcataaaataattgttgaatataaaaaattgaaaggatttttaatgtatttcttttaatatttaattctataattattttaaaaaatttcaagaaaatcttaatctcgaaaagtgccaaatcaaaacgggtatatgatggtctgtgaatcggtacacgccaaaactccgccgccgaaattccgccgagacataactccgccgggaaacttagaaatttttcaagaaaaaaatctagaaaatttttttagaaaaattttttcttaaaaaattccaagacatatatttcaaagaaattttccaggatcctttttagaatttttttttgaaaaaaacttagtttttcatcattaagttagaaaaacatcgctggaaactttttataatttttttcttcgagttttctaagaaaaaatttttctatgatttttttcttgagaaatttctaggttagaaaaatttttgaaattttttttttggcggagtttcggcggcggagttttgtcctgctccgtctgtgaatacatataaattttaaaaatttcttgtatttttttaaatttcgaaaactcaccattttggcgcgttcaaagcgtttttaactttggttgtctcgcatcaaaaatttggccattatgctgcgaagggacccatcttgttggttgatttgctgtccggcagcatagacgaaggcggacgtgctgttcgtgccgttgcggaagtagtcgcgccagattgacactttacccaacacggcctgctgctgctcccatgtcctgttttcagttggccatccattctcatccttttcctgctgctgcttttcctcttccttctcctcactctcttccttgccttcctctaccattttccacgccacaccgcccttctcaacacacacaatctttctggcggcatccaacgcccttttcctccggttgtccactgcagaatccggctccacaaattcgtgctccaccatttcagctgcttcccattccactgactaaacacacttttcgattttattttcaggaattgccgaagtcgcctcataaccctgtgctattctttgcacttgttctggcgtgctgagttgctccaggaggaggtcggcaagctgacccttcggcactctgacctttacctgataacaagcaaataattgaagtgtgtttaaaggtcatttgctgtacagaccttccagcgggattcttgaaggtagccgagcccgggctttcgctcacggctggtctccagccaatagtcggtcgtaaggccaccggctcaggattgccgtggccatatttgcctaaggcgatggtggtcaccgtctttcccccgggttggagaaaggtcggagtggtgccgatgtcagcctcaaaattccgtttgcccttgggcgtcaaaatatgccagtattggccgctggtgcccttcatgctctaaaaacgcaacttttctggcacacaaacattttcctggcaattatacctcgacaaaagcaaaaatgctcttccttacatccaaaacatcagaatgtttcggatgattgcagaacacaccgcaaaagccagggctgtgcacacgtttgatgtctgccggcaggttgcaaatgttgaattggtattctacttttcgattttgcgtgcgcttgctgcggagttcttgctgctcctgaatgccattttgtcccattggtctcaaaaattttaagacctcgggagttctgtccagggggagcagaccccccatttcgagggggcactgttcggcacgttcgaagcgcattgcggtgcgcttaagcaaatcaaagcttattaaaaaatacatcaggctcatcttttactctgcatcatttgggacaagcttgtgttttacttgtcccgcaattttttttatgacagaattccaaaaacatgtttataggtgaattttggggcgccgagtacgaacccggcctccttttttggccagccaattccgaatcactaaaccgaattcgtgcatttttcgaaaaacctttgttttcaaaactcgtgaaaaatattttaagggttttagggaattactatcacgaatccggcatcaattttgaccaattacgatccgaccgacccgaattcgaacaaaaagtcaaaaaaactcaaattttcctattccatttttagtttaaaagatctttttactagcgcactatattacagcttggaccaaaatgtgaaaatcgaaatttcaaataacctatccggttcgtcccgtcataagctcgctccgtcatgtgaaaaccgtatggctggttgaagcggtagatcttgaattctttcgacatgccggtaacaaaattaaatctcagaaattgagaaaagaaaaattgaattcacgtaatttatgatttgttatgccaaaaaaatggccgaaggcagacggctacttataaaatgaaagttgtacacaactatctcgcaactcaaatagaattaaaaaagccatttattcaatgtatgtattgtgtacatgtatggagacgacacaaatgtattggtcatggtgtttgatggtatatttggcgcactcaaagcacctttcgccttggcaatatacagcgtgagcatggaatcaatgtactggtgggcgtagcaacagcacggtcaacaccacgtggttgtccacagacagttcagcagcagcgaacggagtcgtcgagtggga

SEQ ID NO: 10888 - DNA, 1424 bp, Heterodera glycines
tagcaatcgattgggctgactagactccatatttgcaggaatagcaatggcaggtctatcttaaaggcctgacgagttatgtttcgacaaacatcctgtacaccataatcgattagcaaatttagtcgaactatataaatttttcaaaaaatgattcatcttttttatggttagcgcatatgtctctagctttatagaaacggtccccgaatctgcgaggaactacttttttgagaatttctatagattattattttgcatgaatccttcgcttaaattcccatttatcttataaagtcagattaaattaattaccccgatttgttttagaattggtccaaacacgcttgctaatagcttttcttttcgaaaagagaggcgaggaaaaataaaggttgcatccaaatgtaaatttttttacattgaagcatttggatggcttgctgtttacagttggctacgtcttatttgcaagaagcagcacaacttttgtttgggccaatgaccccaaaccattcgaatagcaatcgattgggctgactagactccatatttgcaggaatagcaatggcaggtctatcttaaaggcctgacgagttatgtttcgacaaacatcctgtacaccataaatcgattagcaaatttagtcgaactatataccccctccccccatccgtctccctgccccggtccaacccacttcgtcccgcatcatcatccgttgttgttggttgtgttgctgttgcgtttcctcctccatcgctgtgggcagagagcatcgcggctggtggtactgctgctgttgctgctgcgtgtaccgtcgtgaggaaagcagcgacaatttgcggtccaaccatcgaaagtgttgccgaatctccttcagtatactgctcgacgtggacgaaccgctgctgcagcagcccgcacgtgcagtcgctgaccccgtgcagtacgacgccaacaacgacggcacaccgccggcggccaatgtgagcaattatatggagggggaaaggggagaaaataaatttaataaaaattgttagtctagagatttccatagattttcaaaatttacaggaatggagaagttagtaaaaaaaaataactgaaacctgagggacttgttcttctctaattcagattctcaaaaaaaggaattttaaataaattcaataaattttgaccaaatctgttacccccaccccctctgcgtcaaccacaaaaagggcacccaccgatggcactgctcgggcgggcactccaacggcaaataaatgccgccgaacggaatcgttgccaattcttcggccttcgcattgcgcagaatggtgtccaccaacacacaatgatgggccgatacaaaatgtgcgcgagcgcaaaacacatgcacacactccaacgactcgtacacctgcaggggg

SEQ ID NO: 10889 - DNA, 2055 bp, Heterodera glycines
tcgggtggggaaaatgcaaatccttcccttttctcacatttaattaaaaacagcaaataatttaaattaatttttttacttcttaaaaatgtgacttttaaaggctttcggtcgacaaaatttcaattttcgcttctcaatgatcacaacacttttgcttctttgttaaaagcagtgaaaatttgggcgaaaagtcagtctaataaaacactgttttataattatattcaaaattaaaatttttttatttttcgatcgtctgatttatgccggaatatttggctatttcaatggcgccgcattggctttaatggcgacaaaaatttcgcttctttacccaaatgcaccattgatttatttattatatcaattcttccgaatttactcacaattgtatgccattgataaacaaaacttaaaaatttatttaacttcaatttctgcttattcatttcatcaaaaaatgataaataaataaatgcaattttcccgttttttggcattatttaattgtttaattcagtgattggcaccgttctcagctgatgattgacaaaatgtctcgcaattcgttgaataattttgcatccctttggcctccgactgtcgcggggtgtccaatggcaataataacaccaaaattccctgaacaaaatgcgtcttacaatgtcaacactttcacattccaaacaattgttaatgaattaaaaactggtaaaacgaaaacaaaaaaataaaataaattattttaaaataattaagcaaatcaaaaattgtcagaaaatcccaacaatcggcaaatggttttcgaagaaattgaatatttgcacaaatttgaacattacgcggtcattttgtgtttgtccacgacaattgaattttaccggacaaattgtggctatcagaagagcaaaattcgacagaaacttttcaattgggcaaaatcagaagaaaattcggaaaaattggacaattatcagctgataacgcaatcggagaggaaaacgaagtgcaaaatgacaaagtaaaataaaaacaaaagcattaaaaagaaattaaacaataaataggagagaaaaacccaaatgttgggtaattaatcaatcattaaggcaattaagcaatcattaaggaacggatttatatgcaaatgcttttatttttttttgatatttttgaatcggctggctaataagcaccaaatgctcattttcctctttgtttgacacatcaggatattattttgagcgttttctgtgtatatttctcattgaattttggaaaaatgctaaaaggactaaataaacactaagaaactccaagatttttttggccaaattcaaattttctcttttttatacgttatacataacttcggaagtttgaatctgataaaccaaaatgtgtaaaaccctgattcaaaattatcttataatattttgcctattttcgtgtcatttcctaatttgtgcttgtaaatccgcgctttgtctggtaatcagttgaacaatgatggattaattgaagaaattttgctcattacactaatcggacattgataattttgtgccagtgagttcactttttgtaccgtttggcttgttggactgactttgagcagtgcttttcggcaaaatgttaacgcattgggcccaatttatcggcaacgaccaaatcacgactcattgtcagcttcgtcctcattttggcttttgtctctttacaccgataaaaataatctcatcccaacgtttgttttataatttttatttgcttcattttcttttttattttactctaattacacaattaagcatcaatcaattgatttcgcagtgaacgagcaaaaagactaatcgaagacaaagaaaaacaattaattaccttcgaattaatgtgccaactcagtgtgaagcttgattatagtataagttacttaatttttagacatatatttttattggctttctattaattttgcgaccccattttggtttttgcgtctttggcgaatgaatgaaataattttgtaaaaataatatctatacttctaaa

SEQ ID NO: 10890 - DNA, 2490 bp, Heterodera glycines
  misc_feature (63)..(63): n is a, c, g, or t
  misc_feature (2352)..(2352): n is a, c, g, or t
agtccctgaagtttttagagaatggacatagattttttaaaaaaccgctctgacatgaatccnaaagatgattttaaatatttattgatttcacaaaattgtttggtttttggaattgtaaaattgtacaaaattttgaaaagcgattatcagaaaagaaaaacaaattctcgttttgttttttttcaaaatttcaatgtttttcattgcgctgatgccgggaagtgaaaagggattaagctgagcttttcctccggaattggctcgtcattttcgatctgtagcacaatcgaactcagaagatttcgggcgcccattttcggttcgttgtcgccaattcttttaaatctttgataagcgcggacccatccgttgacgaaaacgcactccttttcgttgataaattcggaaatgggctgaatttgggccttctttggcccaccgatgccaaaaaggcatgagtaaaattgacaaaatttaaatttttccgctaaaaatagcgcattgtaagcggaaaagcattgactaatcgactcagtgaatgttagcattgacccatcggcgcttgctttgaagtgcggcttaactgccaaatggtcaagcatgccggtttcttctgtttaacagttaaaacgattaattacaataaacgttgaatgaaataatattacaatatgtttttctattattctctattggtttttcatttgtattttgtatgcaaatttaaacatttggctgaaaagtccactataattagagaccggattttgaggcttatgcctttttctacggcccaataacgcgaaaactgaatttttacttaatttgaggcttctagctttaactttttggtgccttttttgtcttttttaagattggcacctttttcctgcctttttcagtattttttgaaaattttcttcataaaatacaataaaaagtagagaaaatacctctaagaacgtcctggaactttttttaaaaataaccccaagtaaatggcaaattttcactaaaactcactttcttataatttatgttttcttaataaattttactaataaatatatctatgctaattcaacttgggacccaccaatttgcttggccattttgtttgccaattgtgccatggcccccctttcccttctcagtgccttttcaatctttgtgcccattttatggcgtccaaattctctgtaataggccaaatacaccgtaagacttgtccaccgctttttccattcgttgcaaatcgccgcgtgggttttcttcacctttttacattcccaatttttggtccgaattttgtccaatttaaagcgtttaatgttcaaatcagcttcatacatttcttcgtccaaagttttctgcggattcatttaaaagattaattttaaaattaaatagttaattaattaataatcaattaacactttttcgtcttctccaattgaatataaatagctcaaattcccctgctgctttttcttcattgctaaattgtctcttttatttgttgtgtccgggtaccctaaattaccttaattattttttgaaaattttaataacctattaatcaattttttgaatataaatttgttctcttacgctccatgccataaacaaaaataatcggcagaattgctgcaattcttatgaccataataatgcctttttaaaatgaatttaatagaattacaataatttaaaaattaattttatatgaatttgcttattaattgcaaaaaatatttatttctaattaatcaacgttttattacgcatattcttttcttgcattttcgtcagaaataatgacgtcagcaaaaattatttcacccgaaaattaattaacatgaaaattaataattaagcaataaaaacccaaacatactttccactttcttttgcatactttctattttcttctgttcttgatgacttaatcggaactttgggcgccataaacacaatgattcaatgccataaaactttaaaaggttcgattttcgaagtttgaccgttaatgatgcctaatttataagtgttgttttatgttttttgcaagtacatatgtaaataatttatttgtatttaattttataaattcatatttattttttttgtcatgaaaatggcgaagagggcaaagtgatcaatttttgttgctgcaaaaaggcagaattattcagcgaattgtcctccaaaagttgtcggtaacagtccaaaatgtgttcgatgtgttcaacgcatgccaaatgagcaaatgtcaagtggaaattcggcgcgcataaactgaaaatatttttgatttaaaaattgttttcccccaaaatgccacctcanacattgcaaaggcaatgtttgtgccgttgtctggtcaggcagcgaattggcattgttctcaccaattttttgtcgctgagcgcaacattttccaccgatgaaatggtgaaaagcggggaaagcattgatgacactgaa

SEQ ID NO: 10891 - DNA, 3708 bp, Heterodera glycines
aattaagagaacataagccaaagcgtaaaagagtataggaagaattaaatccggctctttgataggcttcgtcagaaaaattataacgatttcatcatttctacctcctccctacatggcgccaaatcgtcggcgccaaaacgttttggttgttttaatctattttagaaacaaaaagagaattttgaaattttttattttcgattttttgttcgaatttcggctccgagttccgaattggtcgaaatggatgcctggttcgtgagcagcgaccctgaaaaccattggaagcatgttttcatgacttttgaaaacaaaaaaattttcttcaaaaaaggggggcaaccaaccatcggcagtattaccttcgcgaaaaatacgtttttttttttgttttacaaaatttttaaatttgggtgtttttcttttttttattatagcttggcgccaaaacgtcggcgccaaaacgatacggacccgtctggtgtctcgtattctcgtgttttggcacgatacatttcagcacaagaatattatgatttaacggaaggatggaaggacacaaaaaataaaattgaagaagtataaatgtaaaaattttacaaaaaaataattaatatttatgattttagagaaaaattgaaaaattcatatatatttacgaaagcaaaagcttattgaagtgctggatattgatggattaagaaatcatttcacaaatttattgaaggaatatgtaaaacgtgtgtttatagcaacaaatacattgaacacataatttttataatatttattttattatttctttttttttgctaaaaaaattgcgaaatattagaaatttaaaataaataaatattattaatacgtcttaaaattttaagaaaatttttgcttttttttgcgacaatgaaattaatgtatttggtaattgccatttatgttttaatccaatttgtttcattccatgtgaaaaaattatcggcgcaaaataatgtataattttatttaatattttaaaatatttaaatagaaaaaattaaaaaatggaaaaatattcaataaatataaatgatttaggaggcttccattttgtattcacaattttgtgaaaatttggacaacgcgtacagatacagaaacacaaaagattggcaaaaatatgaaaggattgagcatcaaaaaatgccaactgataaatttgatgccatcaatttttcagagtggaaaattctctatgaaagcattcgtcaattttttgattattgcgattttctaaagtctaatgccgatgccgttttgttttatgaaggttaatgaattaaatcattttccaaaaaagcatgaaattaattattattaatattattattatgtatagttttttgcttaatgaaacacataaaaatattttaatatatgtaaaataagcccagaattcagaaaataattagataattatctatgcttatgtattaatgcctgctaatcctcctgtcccgacctaattgccaaacacgaaacccgaatttatggattttaaaagtctggtctctaactctattaatcatagccatattaacttataattataaaatattttattgatatgggctaatagcattagcatttattaatttttagatgattatagaagagaagaatttgaacattttgcatttaaaccgcagtttttttacccgaacggtgacacaatgccaatcagtgatgccatgcgcaaaattgttgaaggatttaatataattttaaagaaaggattggccaaaatcaattttttctccaaaaaagaattaccgcaaataaatttcatcaacagacaaatttgcacaaaggttaattatgtaattattattaatcaaattattggtgttaattattggtctaaataaaaaaaaaattatttttatttttaaaaatatttataggttaaaaaatatattttaataaaaattttcaaaatttacaataataaaaataaatttatttaaatttttattaaaaattataaatttttttgaggtccttgcttggacttactcaataaaaaaggctgaaaatatacaactcgcaaaatcaactttacacatcgttaaattgcatatattaattagcggatttcacaattttacatttgatctgccgtatccgccaatcgatgaaaatgaaatgggcgaatttggtgctgaattaaatttagagtttttaataacattttaattcaattagcttcgtaaaaatgtcagatctaaatatataatccttaaattttaatttttggtaattttcgacattattttattcaaaaaaaaaaaataagcagactattaggtgagtacttagcaaacctaatagttcaaataaattaaaaaacattatgagccttcgaaaatgaataaattttaatcacattatgaatctaatattattaaaatacttaattatatccaatcaaattaatcactttcagaaaatgatctcatttcaaatggttttattggaaatagacaaaataacactgaagacaacattgaagaaaatgatgaagatttatattggatttgggcctacaaaatgatgcttgatacaatagaggaaggaaatgataataaaggtaatgtaattaaaatattttaaataaatattgcgcttttttaaggaaatttcaaaaaaagaatgttaaattttttaaagagccaatggctttaatcgacaatggaattaggtattcgttggtgatggatgttctgaaaaaagaatggtttgatgaattaaatgattatgacaattagaaatgaataaagaaattattgttttttatttaatcataaagataatttattaaaagaattagagcgattcatttttgaattttatctatatattttaataggaaaataatattatttacttttttatattttttgttcgataaatgcagaggtggaaattcgggggatttacattaatttgaggattattttccatttgttaatattgacgataaacctaatctcaataaaatagttttgttttatttattggtcattttttcacgttcatcattttttaattttttccatccgtcgcggaatatttcattaaaatttggtcgaattttgtcggatttaatttggtaagcaattaaaaatataaaaaatatattaaatgtcgtaaataatttgctatacgaaaagatttttgtgcgaaaaataatatttgttttttgaactaattctttttccattttcgaaaagcaaatacagaaatgcccaaatccttcacaaattcttttggtttcttggcccaataaacatttaaattcatcaaatcgttcaatgaattctttctttttctgctcataaaaacatatattttttgtttttatttaaatttatttcgttttccgttatttccattttttcaaccaatttgatcaactgcagctgagttatctttttactcttttagtgaatttgtttagtttttatataaatttttctttcatttttataccatccgttgccaaatatttcatcaaaatttgtttgtgactattaatttattttgtatttcataggttcatttgaaaacgccgagagtaaaatgaaaaaaaattgcaatttttttggagtctttaattctgcaccgcaaatgtcgcatcacagctctcgcctcactctcctctca

SEQ ID NO: 10892 - DNA, 1105 bp, Heterodera glycines
attatgtaattatttattaataaaaattattggggttaaattattggtcaaataaaaaaaaaatttttttttatttttaaaaatatttataggttaaaaaatatattttaataaaaattttcaaaatttacaataataaaaataaatttatttaaatttttattaaaaattataaattttttttgaggtccttgcttggacttactcaataaaaaaggctgaaaatatacaactcgcaaaatcaactttacacatcgttaaattgcatatattaattagcggatttcacaattttacatttgatctgccgtatccgccaatcgatgaaaatgaaatgggcgaatttggtgctgaattaaatttagagtttttaataacattttaattcaattagcttcgtaaaaatgtcagatctaaatatataatccttaaattttaatttttggtaattttcgacattattttattcaaaaaaaaataagcagactattagttgagtacttagcaaacctaatagttcaaataaattaaaaaacattatgagccttcgaaaatgaataaattttaatcacattatgaatctaatattattaaaatacttaattatatccaatcaaattaatcactttcagaaaatgatctcatttcaaatggttttattggaaatagacaaaataacactgaagacaacattgaagaaaatgatgaagatttatattggatttgggcctacaaaatgatgcttgatacaatagaggaaggaaatgataataaaggtaatgtaattaaaatattttaaataaatattgcgcttttttaaggaaatttcaaaaaaagaatgttaaattttttaaagagccaatggctttaatcgacaatgaaattaggtattcgttggtgatggatgttctgaaaaaagaatggtttgatgaattaaatgattatgacaattagaaatgaataaagaaattattgttttttatttaatcataaagataatttattaaaaaaaagtttttaagatggaattagagcgattcatttttgaattttatctatatattttaataggaaaataatattatttacttttttatattttttg

SEQ ID NO: 10893 - DNA, 1756 bp, Heterodera glycines
aaacgttgattgttgctaacaaaagtttgtttgttgttttttaatgagattcttaaatttagaatttgttatgctggtcagtccatatttttggagaacgttttaaaagaacagtgaaaaataacggcgctatgtaatttcgacactgggtaaattcgacactgagtattttcgacactaagtaatttcgacactacattttcgacacaaagaaatttcgacactgaagtatttctaaatctttcactgttttcctgcattttcgagtttgtatttataataaatttcatatttcattttctaattttaaattaactacatctcattctaaacggttgaactaaagccatcggatttacatttaaaaaatattctaaacaccagccgtattgcccaggaagagctacagtccaaataccaaattttttagttcctgatataattcaatatgcaatcaaaaaggtttaagcattatctttcaagacaaatgttgcacaccgctatagaacattgttgaaattgttacgtacggcttgtatacaacaatcaatagtgcattttcacataaatgactgatgaggacagctacgaaatagatgaaattcttataacttttttctattgtcaaattgtttagcactcacttcttttcaaaaaattagataaaaatttgttttgtttagtttgaagatgttgcgagttatgaatgctcaaaacaaccaatgcgaaaaaggaattgatcactgatcagtatgttttttgattagcacccagaattacgctatttggcattatgaatcattttgtctaacacttggtttgacccatcgttataccatctaatcttttaaaaaacgaattggaaaatgaaataggaaaatttatcatacataaatactaacactttcaaaatttcatattaatttttaaaagttctcaatagtgtcgaatttactcaatgtcgaaatagtccagtgtcgaaaatgcaggaaaacagtgaaagttttagaaatacttcagtgtcgaaatttctttgtgtcgaaaatgtagtgtctaaattacttagtgtcgaaaatactcagtgtcgaatttaccagccacgaaaataacggattttatttgattacagttttcaatattcatagtttactaattatataatatgtataacacaaacataaatttttgaattcataactctatactcaaccatatttttataatggcacttttacgaaacgaccacagtggcacttttacgaaaagtcccaaggtggcacttttacgaaacgacttggcacttttacgaaacgacctggcaccgtttttttctgtgcgcgctccagccctagaaattttcggaaattttttttcggacgaaaatgggggtgaaaaatatttttctggggtaaaataaggtgctgagtacgaatataatgtctattttaagtttcataatttttggaattttttaaaaattctttattttttggcaattttttggccctcgggattttggcctaatatttgaaaattcataacaaatcgaagggttgatcgatttaacaagaataaagccttaaaaatagagaaaaatcaggagaattttatgggatttatttgagttttttatcacaaaaaaaaaaaagctattccagaatttctggaaatttttgatttttcagaaaaaaattcgtagctgccttctgaaaagctattcgggaaaagtaaaatactacaaaaatccgcaattttt

SEQ ID NO: 10894 - DNA, 695 bp, Heterodera glycines
caaacaaaatgaccttttctattatcagattccggaacaattgttgtttgtcggccaatggtccagatgttatcggcttatgcttttttgtaagttttagggctcattcttcatttgtacaataataataataataaaattatttctccttcgaagctctcctgggtccaagtcccaaactgtgactgcctgggggtctgtattcggcccgagatgtacaaacatcccttaatctgcgtgcccgaattctaggccgaaaatttcccaaattggctgacgcatttctcaattggggttaaagtgaaggtgctgctgtccaacccaaactaatggtcgagaggacgaggaaaagagggaaatggaattgggggggaaaggatgaaagagccaaagacccgggcccagggtggttggcctccccaagatcagtcccaggaatgcgcattcgattggcgactcaatgagtggaggagaagacaagagggagcagtactttattggccataaaataaatacatctttaaaagataaaacgccaaaaggaaaaggcttaatctctctctatcattcgacggatcatccccaactgctggttcgccgactcgactctccgaatcactgccgctctcggggaaaagggataaaacagcaaggggaaaagggggcggaacataacatcataataggggaacgat

SEQ ID NO: 10895 - DNA, 2213 bp, Heterodera glycines
atgacaggaaattaaaataatttaaatattaataaatatttaattgtattattttttttggttttttttattttcttgttttttattattttcttatgttatgaatttttttgaaatttttcaatttatgtaacgagttgttttaaaatcttatgtaaattttatggtgcaccccaaaatcacgccgccaaaatcccgccgccgaaatcacgccgaccgaaataacgccggccaaaatcacgccgggacaaatcacgccgctagaattttttttttaattttcaaacagaattttttcaagaaaaaaaggattttttcaagaaaaaatcttagaaaaattctttgacgaaaattttcaaggaaaataaaatttggaaaattttcgaaaaaacagtaatttatcataaaattccaaaaaaaatagcagaaaatatttcaacggcgtgatttcggcggcgcgaaacgaccttttccctttaaatggatacctaattttgtttatttgtcaaaaatttgtgctccagtaaaacggttataggtatgtattattcaacaaaaacacaaataaatagatgaacacaacaaatgaaattttaaaaattaataattacacatacacattataataatataagttcaaatcatgcaacatttttccatgaggcaataatttcagaaaaaataaaataaattttgctttttaaattttattttggaacgcctaattcttttaatcataattcctcgtgcttttcatcgtcatcaaatgctgtttcgtcgtcttgcggctttccaacagcacttctattgttgctgctgcttgtcaaaagccgctttatctcgttgtccaactcggtccattcggacacaatgcgaacagccgagtccaactttggctccttggtcagcggattgttgcactacaaaaaagcattttttaaataatggaatattcgagaatttgtgtgattttcgaaataatagtgtttacaagatcaatggtcttcgcactgtccttggacacgtcgtcacaccacgtctcgcaccacagccattcctggggcagcgagtggatgcgcacttggtgaatctgaaacattgaggaatggggataaaaatggaatgaattttctgtaaaaaatatgagaatttgattttttttcgcagaaaataaacgcttaaaaaatctagttcttgggatcagaaaggccgaagttggagagcataactttcccactcacgaaaatgaaaaaaaaattcaaacttagaaattaaaaaaaattttctagaaaatatttttacaagaaaattgcaagaaaaagatttagttgaaaaatttttctagggttttttcgaatctttgaaaaaattagtaatacaatataaaattttgaaaaatcgctttaagattttttctaaatgttcttacttgtaattttcttataaaaaattctctaatttcatttgaaaaattttggtttgcaatttttttttaatttcggggaagagaacgatggcggtgactgatgtcgccgtcagacacactaaactcaaaaatgcatagaattgacgaattttggtgtaaagtttgtcaacaaattgcttgccaactcaccatgttgttgggcaaatcctggtccaggtttgacaacgagttcgggtcggagctgagcccttggtattggccacggagacgatcgccggcggcaatttggctgaaaatatttaaaaagcatttaataatttgatgattaaaaaacatttttgaaaatcaacacaccgaaatttgaccaaatccacaacgtaaagagcactgatgtggtatttgcggcccgccaaatgctgggcccagtagccgctccgccagaaccgaaagccgtccatggacttgcgactgtcgcaaaacggcgtgtagctgcaaaagcaaatttcaatcatacatatacaaggggtgtctcgagacaccccccccccccctcgttcgtcgtagggggggggggggggtcgtgaggcgggagggaggggagcgagatctgtatggattgcgggttcggtgcagcggttactgagctgagcatttgccgtagcgcaaataaaacatcagtgatcattattccctggatttggtcaaatttcggtgtgttgattttctaaaatgttttttaatcatcaaattattaaatgcttattaaatattttcagccaaattgccg

SEQ ID NO: 10896 - DNA, 1368 bp, Heterodera glycines
gctccgcaatcactcaccagtacggggcgccctcgaggtcgtactccatcaactgcatcagatcggtgcgaacaatttggtcggcgtcaacgaaaatgattttcttcacgtccagcgggaacagcacgtcgagaaagaggattttgtagctagaaagaaatttctgaattaaaaaaaatccattttgaagtaaagaaattatcatttatgactgttttcaaaaacgttaaaaaatgcagagaacgccaaatttagaaaattgggggataaatgtcctaaattcttggaaaatagcaaattagcggtccgcatagtaaaagcctcccatgtcgcgagcgtaacactgacccccacatgacgcgctgcttctccgtctgttggtggagccaactcggccatttgtattcgatcagctgatagtcaaagccgtaatgagaagccatcacgggaagggattcctaaacaatcaaaaaaatgagggtagaaaatatcaacaaaaatttaaaaaaatgaacaatataggctccgatcgattcatggaaacaatgtttttcttgaaaatgttattctccaaaaattattccggcaatttcgctggggaattagaaccacaatttagtatgaagaaaagtcatggaaagtctttaacgcttaaatggaatgaaagtttgtcaaatttgcggagcgtgactcattaggaaaaaataataattaatgtttcagctggatcaccctgaattggggcgacaggtaattgttgagcagccagaatttgaccgggtgtttggtgttcttcagcacggacagcatcatgatgcgcaggaagcgctcgtagagatggccggaggccagcgagaagatgttaatccgatcgtacgattgaccggtgcccatcaatttgctaaaaatgggagtcgaaagtgatggctatttgtttaaaaaatggttttaaaaaatggcgttcaacaggattgattttttgtgatttatccattagaaaatgcaatatctttggattcccaggcgtaatgaaaaataaaaatttttcagaaaaatttgagtattatttttaaattttactcaatttacttaacgaatttggcccaccaccccgatggtgccaacgacaccacaggatcccaatttcaaaattttgtcttaaaatggtaaaaatttggctaaaaggaagagaatgaggaagaccccggctcttaaagtggcaattgcatgcttttcaagactgtcgggtgggcggggatcaatggcaacacgcataaaaaattaagtgtaagaggtgccgtaaaatttgatttatcacgataccggtgccagggcttaatttatgtgcctaacagggatggtatagta

SEQ ID NO: 10897 - DNA, 2493 bp, Heterodera glycines
gtggcgcaatggataacgcgtcagcctacggagctgaagattgcaggttcgatccctgcccaggtcgattactttttttccaattttaatttaataaaaagcaaagttcttttttcaaattttgaaatgattattttaaaattatttttattcaaagaaaatttttttttaatcccatcaaatcgattgacatggcaacccatctaattttttatttttaaattctcacgacccccaaattccatttacacacttaggcctatttttttaaattttctataaaaaatttcgattccattgcgcctacccgcagcaactggcattttttgaggtgaaatctagaaaaacaaacaaaaaaaacatttttaattggaaaatagttttttagtatttaatatttctcttcctttgcaaagcccggtggcgcaatggaaaacgcgtcagccaacgaagctgaagattccaggttcaactcctggtcgggttgattcttttttaattttaattaaaacgaattaatttgcaattttaaattgttttttaaataaattttctaaataaataaacaaatcccatccaattggattaccccagcatttttctcgcgcgcaatacaaattgttatttttaccccttaaattcagtagacactaaacgctatcttaggcctgagtattttcactaatttaaaaatgccaaaattttttccaaaaattagttcactccgctcaacccaaatgatgatggcaccacgccaatggacgttgtttttggcggctcttcgacaacaaatggtagtggcgccggtggcggcgcaactaaaattgggcgcaccggcgccggcgccgccgattgctcatcgggcgacgagtcaaatgaaagcgaacggagcgacgcgccgacaaacaccggcgccggcaccggcgcaggcgcagcgctaaccgaacgacggacaaagcgaaaacagcagaaaaagggagaggaaaatgagcatgaagaggggaagaacacgctcaaagcaatgttcccgacaattttgaggaggaaaagcggtgggaaaaaaagtgagcgaaagtcaaaatatttaattggcattttaaatgaataaattacaaaaaaaaaaacatttaatagtttaaaaaacacttttaatagactttaatttaataaaatttatttttatatcttaaaaaattctaaaatgcatttaaaaagccaaaaaggcatattgattcattcgaaaatgcaaaaatctgcaaatttcaagttaaatgccatttggtagagaattttttttttgccaatccttactattctaatcactagaccgaataacacaaggattttcccgcgaagccaggtctcgtccaaataatttttaaaagtgcgcccgggtcaggatcacctcaagcagggtttttaatctaaaatctgtttcggataaagatgacgaaacttgatccggaatttctcaaaaatttcaaggctctactaataattctcattaatttgtcagtattgcattctaaaataacctattttcagatgcttgttggtgtccttccgcttcatccctctcactgcctttcatccaccagcatccgcttaatcctcatccaatcacttttgccaaccacgaaagtgaggcagccgccatggtcatcagcaaaaacaacagtagacggcacaacacaatggcatcggcgcacccgggcgttaaaacggagccaaaaacacgcgctacggcggcggcttcatcaccttgttgcataaaacgggagagctgttgcggtggcgccgatatgccggaaaagagaagcaacaattctcggatggcaaggacggaaaatgccggcgctgacggcgcaggcgcagagcgaaagtgccgagtcagcgctggcttttcagtacaggaattacaactccaacggcacgagcaatgcatgttgcaacagcagaaacgcattgatcaactgttgctggagttgggccgatcccagtcggcactgaaccagcaccaaaaaatgttggaggatgccgagcgacggatggtcgaggagggcggccaaaccggcggcggaatggaggtgggaaaagaggcggatttactaatccagctaattaaaagcaattaccgtccttaaattgtccttaatcactcagggcctttcctttatcagtcaatcgttgatctttctgagcccttatgtcacaagatcgctccttgtttaacagtttttgttgattgaattcacgcattgatttgatcaatgcttcttcccatcactttcccaattttcatgtttttcagtattggcttagccaattggaaaatggtcgtcgcgaatttgcccaacagcagcagcaattggacaagcaaatggacgtccagaaagtgctgtgcaagcgggaccagcagatgaaggtcagtcccgggtgttaggaatgggaacatttaccactttttcggcatttttcggcaaagtttcgggc

SEQ ID NO: 10898 - DNA, 2281 bp, Heterodera glycines
tatcatgccatcagtgtcgtgccataaatttgatcacccccttcataactgtgtaaaacaaatttaaatggacgacgacactatgtaaaagtgcaagaaaagctcttttcctaaaagttggcacccatttttcattttatttcttttttatttaaaaaaaatattttattacaaaatttggtcgttaacccttttatttttaaattaattcccagtctctattaattaaacatccatttaaggatgaactgaagtccaaacatcttcaggttagctgagggctttttggcgttttcttatggctaattttgtcgaattgttggctaatttatccagtgccaaaattggctaagactaattggtcaaattcttgggtaaagttgtccaagccattatctatggttaattattggcctaattattgggtgaatttgtctatgccattgtttgtggccaattatctaattattgggccaatttttccaggaccaagccgtgcaggacattgtccgtctgatccgtcaggaaccaaaagcatcattgctgatcgtgcaattgttgaggaaatatcagttggaacgggacatgatgaacccgcaagaagaacagaacgaacaggcaagtccggaaggatcggcacaaaaaaaatgccaagaaattaatggctaaaattgtaggcatacttcactgtaatatgtcatacatgagtgagatacggtactgtaatttattatgccaattttcggacaatcgattgatgtcatagtgatcctgaaaatattttctctctgtccggtccaatgatcaagataatcctgaaaatttgcctgtaaacgcgtctcaaatgagataattggcaaaaatatttgctgagttccataaatttccgactagtatcattaatcggcaaaaaattattaatgttttctgtgggatatcactattttatttttaacagaatgacaatgatcaacaacaattacacccacaaagtgccaccactccgaccaattcggcaccatccgctgctgctgctgctgctgccgccgcatggaattcgctgtgtaccaccgccgcgcaaccgttagacaacggcggcgccaattcacaaaaaacgacggcatcatcgccagcgttggcaatgccaacaaacagtcgaaggacaaaaggcgttccaaagtcgggaaacgccaaaaaagcggtgaagaaggcatcatcttcggcggcagggaagaggaactcaacaagcgcaatggatcaaaagcaaaatcaagcaaacagaacaaatgtgagaggaaggaaatgaaaagtgatcgagaatctcgaattgggattctccgatcacaaatttgctgaaaaaggaggattcaaaatgatcgggaatctcgagttgggactctctggtcacgaaagaaataaaaatgattgagaatctcgagttgggattctccgattacaaatttgccataatgatcgagaatctcgcgttgggattttttgaacacaaatttgccaaaaaagattttggtcaactcagaacattggtatacaaatgcttcgtgtttcagcagcgagccaaaaatgggcggagcagttcagtgctggagggcatgttgggcagccaaccgtgccgatgtgccgccggtggtgaagcagcggttggagcaagtggcggcgacattcatcatcaacaatgtttgctgaaacagaggcccaaatcgtcattggacagcagcgcccaaatgggcggcatggcggtggacatggaagaggtgggcatgcataatgaatggttgattaattgccatgccgatttttggatgaatataactcagtttttagagtttttttaaatcatttttgggccggacaatttggcccccaccgtcgtttgggagtccatgagtcatttaggcagcattggcatttgaactccgctatttttgccacccaaacactcgggatttatttgggtgggtgcgatcgtttgcgccccgccccgttcgttcccagtagattgcctccatgccgaaaaatttagggacatggttacgggataaaaaagcaaattgtgttggatgccgtaccgcatgggtctctgatatccttcatttgccagattttccgctccgtattgaatgatcatgacgatgaaggagagcgacggcaccaacacgcgcatccgtcaataaaaatgccggaaggcactgccaccgtagcagatggcactcatttaccggctggcgaagagacgatgatgatgttgatgaatgacaacaac

SEQ ID NO: 10899 - DNA, 3908 bp, Heterodera glycines
tgtttttgttcgtttgtcagtcactcattgtcagcataagacgccccatttgtgatgctttgtcccgctttttctttcacttcttccggtggcggagacaatgaccttaattaagcgcaaaattcaaattcggataaaaatcaaatcccttttttaattgcttacccaatgcaattattggcacaaaaaagataaaagaacacacggttacaattgttgtcccaatttccgtctttccaatgaaacgccgccgtctctccaataattttgcatcgtttcattatccaatcgatgcgccaatcattttcatttgctttggccaatgtcagcttttcctttgtccattcgttcaccaattcaaatggcacaatttgcattgacggcacacgaatagtaaaacgaatttggtagctgaccgaagaaatggcattggcacggaaaaatgctaagcaatttgaaaacaaaaatagaggtaacaaaatcagtgatttgttgagattactgccacacctccttgaaactgttgacccaatcgaagttcgcttgtgcgttgtaatcatagcaatgaaattgtttgggttggccatcttttctcggcgtggtcaaccatttagacaacgcttggccagcagaaattgttgaattttgcgcatcaaaaacatcagcaatcgccttcgggaacagatcagaacagatcaaatgaatggattgaattcaattgattcagttcagtgagaattgttggcgaaatgagacgacgcaaattgtccaaatgatcaccactgttaaagcccaagtggcgaatgtttgccgaaaaaattggcaaaatttcatgggccaaaacatcccaaattggctgcacatccatggtgtgtgatgatggattccacaactctaaattgatgcctcttttgtcaaaaatttggtgattcaaacgaagaaaagcgatgacgtagtgatcaatgtacctaaaaattgaatgaatgcttttattgcgatatactcttatttataattactcaatctgaaggtgcttaaaacggattttgcaggagaacggacggtcgggcaacggaaattccacagctctgtcatcaaacactacagacagttttggtccagatcctttgtccttgtgatgaatttcgaccgttctccaaattgtcaattcgcgtttgccatcaaaatgtttgtccaccaacgcattgaaacgtggcgaaagcaatgccaatttgaggccgagttgggcatggtcaaatgatgggagaatgtccatcaaaacgtcgttgcaaatccaactgaaattatggaaaacagtttagtgaaataatgacgaatttgtgacttttaaaaattcattaccgtctattcatttttgtggcaattgctaggatttttatgtgctaaaatgctgaaataagtactaaaataggtgctaaaattcgaaaatgcaaaaatgggtgctaatcctccaggtttaggtttttatgtgctaaaaagtcgctctaaatcaaaaattaaaaattgtttaaattgatggggtttttttactatcataattagggccccaacaaaatatgtaactaaaatagtgacgaaaaagtgccaaaatagtaacaaaatagtgaaaaaagtccaaaatagtgacgaatagtgacataattttcagccaaaaattaagcaaaaaatttttcttattcactgattgcagttgcaaatcaagtaaatttactttctaataattgcttagccttgtatagttacagtagagatcggaatttttcgattatacgggtaagggtaagggttacgggcttgacatctataccagggatgggccaaattgaaaaataaaaagcgaaatgcgaaatttgcgaaactgaaaaatgcgaaatgaaaaaaaaagcgaaatgcgaaaagctaaaatatgcgaaaatgcgaaaggcgaaattttttctacaactttttaatagttaagatcataaagcaaaaatcatttttttaaatgttattccaaatttaaaaatcaataaaacgcttttttgaggcgcgctttttccaaaaaaactttttgggaagagggggcaggcggcgcctggaaaatttttgaaaatttgattaaaatttgttgacagattttcactttaaaaatgatcaaattttgtgatttttatcatttttctaatgagagaaataagagttttggggcgccgctgagaacagtttttcatcaaattaccaaattttgcgattttgggccattttctaagaaaaataggagttttgggggcgcggcggtgccgataggcgccgccgggggaaaaaattgtaaattttgatcatttataaataggttttcactgaaaattagccaatttataggtaaaattttgaaaaattttatgggaatttaatccgattcttaggggtgtaaaagtcgcttttcgcgccaaaaagcgaaatgcgaaacgccaaaaaatgcgaataatgcgaaatgcgaaacgccaaaaaatgcgaataatgcgaaaggcgaaacgcgaaaagcgaaacctaggcacatccctgatctatacgggttacgggcttacgggctaaaaacccgtaaaacccttaacccgtaaaaacccgtattcagaaattatacgggtccgtatacgggtaagggtttttttctttttgataaaaataggtttaataaatacaaattttgaatatttaaagctaaaagacattataataataattattataaattttaagaaataaaattcaaaaaacacaacaattcgcatccggcggtggccgttgggcgcctctagaaaaaattttaaaattttgattgcaatttgttaatagattttataaaaaaaactaattgtaagcaaattttcgattctggtgttactatcggtcactagaaatcactattttggcattttgtcactatttcgacattttttgggaaatttctcaacaaaaacgcaataaaaacgaaaaatacaccccctaagaatcgacttaaaaaatttcagaaaaataacctaaaaatcgaccgaaaattttcgaaaaatacactcctaacaaatgaaaaattttttcccaaaaatttactttcttggtaaaaatttaaattaaaaaattttttagataactattttgggtttttttgctcttaaaaatcccagtgctactcatttgcaactgcaatcagtgaataaaaattatttttgctcaatttttgactgaaaattatgtcactattcgtcactatttcgcactttttgacactattttgtcactattttggcatttttactcactattttagttactatctcgacatttttagtcactaaaagtatcatccctaataatcattttatgatcagatgttgaaatttttcgatattttaaagataaatagagaattcttagggctatcgaatctcatttttgtcttaatcaaaatatgtattttaggcaaaaaacagaacaaaataaataacattcccgtacagtttcaagttttaatttaaaattgatacataatgaattgtttggcgaattgactgcacaaaatttaaaaatttaatccatttcactttaaaaattgtataaaaaataacccgtaatccgtatcaagaattgtacgggtaagggtaagggttacgggtttgacatctatacgggttacgggcttacgggctaaaaacccgtaaaacccttaacccgtaaaaacccgtatcggccgaaaaaaatacgggttacgggttacgggccgtaaaaacccgtatacgggtccggcccgtatccgatctctagtttacaggctactttttacacatatttttagatgcctataaatgtattttagaaattaatgaaaataagttttaaagggttttcaa

SEQ ID NO: 10900 - DNA, 479 bp, Heterodera glycines
agtaccctgtaaactatacaagtaccttgcttagcaaatatttaactttttaaatcaaaaattttgtcaagaaaaaattttatggatgaatttttgagaaaattttacaaaaaattttttaggtcaattattaggggtgtaattttttttaacttttaggtcgattcttaggggtgtatttttcgtttttattgcatttttgttgaaaaattttcccaaaaatttcgaaaaagtgaaaaaattgacaaaacgccaaaatagtgaattttcaatatacccctaagaatcgaccctttacccatgaaaattttgaaatgtatcttatttgcaaagtattcaatgaataagattgtttgctttagcttttaacttatttacatagaaaaaaacagcaatttaaaaaattatagccctaaatttggaactttttcgccattattttcgcccttatttacgacattattttggactttttcgcc

SEQ ID NO: 10901 - DNA, 2717 bp, Heterodera glycines
atttttaaggcgatataatgatgatatttttaatatttcttaggctaattaacaaataatttttggcatgactttttttgctctccatccccccaaacaaaaattcaatacaaaaaggtacgtttatgtgtaggtatgtacatatgtattgtacacacatagatgattcacccatttttaaatgacaaatgtccccccccccgcccttttttcatttatttgcggaatcgtcggtttgttcccatcagcagcagcaggtgattttatctgctacaatagtgctgctgaggggataagagattagttaattgagacgattatcgtccgattggattatgcaatttattatttcccaaataaaatgaacaagcagccaaaaaatggataaacacatgaagaaaatagcatttgtaatgtgtgcatcatcatctcaacaaatataatttccctcatcaaaacaattcctcaaattaaatattcgtttcttccgtccgatcattcgctggaaccggcgccactcggcacggcatttccgttgctttggtccgccgtcgatggggacaatggcctatataaattcattcgttgaatagtttgaaaacagaaaatgccgttgctgggtgcttacccaatgcagttaatgccacgaatcagaaagcggacgttgttcaatttgttgccattttcgtctttgcgctgcgccgtctccccgccggcgattggccatcgcttcagcaaccaataactgatcaacacattgccctcaattttggccaagctcagcttttcctgggtttgctcgttcaccagctcaaacggcttttctggcattgagcataagtgcagcaagatgtagtaactggccggagtggtggaacggagaaattcctaaaaaatggaaaaaattgatcaccaagtataccgaaccagtagcaccaaacatattgctttagaaaccggacaggattttaccaaggacctgctggtggcccggttcttgtaagttttcgaaaaaaataaactacctgcatgcaaattcaaaaattttttttacaatttaaaaaaaaaaaccaaaaattgtaaaaaaatgtcttccataaactttttaaacaggatcaattttttgaaattttgctgtaaatagagttaaggtctatcaattataccaaaaaatgcttaatttaattgaagctgataaaagttatgacgatttacgggttggattttgtctgctgttggttcgaccaattgtttcaagaaaattttccgcccccatcacccacctctttgaacgttttgatccagtcgaatttgaagccccaaacatgatcactgcaatacaattccttcggctgtccatcgacggtaggcgtgtgcaaccatttggtgagtgcttgcccagcagttgcgttcggtccatcgtcagcaacaccagcgggaaacagttcaccggaatcaagcggattcagctggttgaggtcggtgagaattgtgggcgaaatgagacgacgcaaattgacgagatggtcaccgttgtagaagcccaactgacggatgttcggcgtaaaaatgggccaaatttcgcggcacaaaaattgccaaatggttctgccgtcttcttttccggacaaatacgatgacaatttgaacaccaagttggtgcctttgttgtcgaaaatttgcttgttggcacgcagaaattcgatgacagagtggtcgatgtacctgaaaaggaaggaaaatgcctttagtggggccaacgatgctttgaagcttttttaattatatggtttggattagagaccggacggcatcgggatcccgacctcgagatccgtaccgatggctttttcaaaattttcgagactgatcgggatccctccgaccccaggccgagcggaaccggtgaggggaaacgatgcaaccaacactctcacaatatttccaaggcttggaagcgaatttttctcggcaacggacgctcgggcagcggaaatggaaccgtattgttggcataaagttgcgctttccccgcctccgtgtccatgtgaacggagatcggacgccaaattgtcagttcggatttgccgtcaaaatatttgtccaccagcgcttcaaaacgtggtgaaagcagtgccaatttgaggccgagctgaggacggtcaaaatgagggaaaatgtccaccaaaatgtcgttgcaaatcctaaaaaaaacagtgagtaaaaaggtgtaaaaacgataggtattttaattcaaaattttaatgcacaaaaattttgctcacattttcttcaagtgatgagtcagcttttcttggccaatcaattgactttttgtcgtcgtcttctccaaagtcggaagcaaaaagaagagaaaattgaatgtggattcaaatgaacaaaaaaatcctgtccgaagaatgtgaagaagcgttatttagcacacaaaaattatgaaatttaattgatttgattgccgagacacttctatagagtaagggtcaacaaaaaatcagagtaggggtcgaaaatcgacaaaaaatgaaaaaaggggttgaaaatcgacaaaaaaatgagaaaaggggttgaaaaattagtttttttttgctctactgcattttacgcgtccaatcaaaagtttacgcgtccaatcgacttttacgcgtccaatcaaaattttcctaaatcgaacatccttttgacataaggtaccaacc

SEQ ID NO: 10902 - DNA, 988 bp, Heterodera glycines
gtttatgtaaatttgaaatttagtcccccgtttggtccgagtccatattgctcttacgccaaataaacgcatttggcgtaaatttttgcgcgctattcaaaaatttacactggaaaatgcctttttgtattttttattttgatctgccataactcgcttcattcccaactaaactgaacaaatttggtatctaaaaaaagtttttgaaaaggagaatctttttctaagcgaaaactaagcaattcgattttttagaaaaaagttgtgggagtttcaaatctttattacgttataactcaagtcttaaactgccgatttcaaccaaaatgcggaaagtaatcatttttctattgattctaaatgtccaacagattttgtaccgtatcaacaaaaattaatagaatttgcgaatttcatgatttttaatgtgttagagacatgaaaatagtacgccaaaaggagaggaaaagaaatactttttattattatttataatttttggaatggggagtataaacaaaattaaattcactatagaaggatgcagaatttttttctctataggtttgcaaattttggtgcaaattgtatggatagaaaaaaagttatatggagagaagttaatgttgtttttacataattaaaatgaagagatagtacgccaaagtgagagaaattacaaagaaaaagagtaacgacgagatagtactaggcttttctctgcacattggggcgtacgcatagtgcatattatctattccgattgtcaaatttaattccatcagatgcaacgcgcgcatatgtaacgaagataccatcatactcatactccccccaccctttccctctccaaccctctcctccctctcttgatagtttaaactgaaggcgggaaacgacaatctgatccccatcaagctagcttctgcaggtcctgctcgagcggtcgcccggggatcgatccccgatctagtaacatagatgacac

SEQ ID NO: 10903 - DNA, 2725 bp, Heterodera glycines
gtttcccgtcctagttccttctccgatggttttggctcatcttcacgttgtagttcaatgtcatgtgttgctggtaaaggcgcttcacgtatcagttccttatccggttctggtcgcgtttctggttcgaattctttgtctgcagaagcagccgccgctctttttacccttttttcttttggaaactttacatcataggccgattgaataatgctgtcaatgatttttgcatatgctctacactgtgaaactgtatgcttggaatttttaccttcagagttacagtagtcggacctgtaccgtctgatttatagtcgggattgagaagttttatgttgacaaagtcgtcctcatccacacccctacggaagggaacgagtgtggatagatgatggaggaaagcgcaacggaccagtttgagtctagctctaaggtatgtggaagtcttacggtaaaataggatgccgtatttcccggaaagggaacatttgatggcagtacaatataaaaatcgtccatgcctaacgaacgagatctgaatccttaatccacttattgtgattttctgaataacatatctaacgaacaaaatgttgcttaacaccgtttcgtaccctggatttcaaaatttctgctcgatgagttgtctgttcagcagcaacagtctttaccagttcctgatcgtaaaaaataccttttatattttcaccttctaaatcactgattcggtatgacggaggattggtcgggtttacccgaacaattttgaataattcgtcagtaaaatttggaaaatatcctttggagaagtctcccttctctttggtaattcttacgatatcatcaattttgaattttggaattcgcttttgttgttccacgtctttatatagacgatttctcagctctgttgcattacgaaaattcacatcaacaggacgcattcctgttgtacggttcactaaattgttcaggtttttaactattttatcaataatgtctacccatctgtgtgtgtttttttcgctaaaataacggtaaagtctttccttaattgtgcgatttgctctctccacaacacctgcatgcagatgagggctgtacattacatgtttaatgatatcttttgaacgccagtactcattcattcgtttggcttggaattctaggccactgtcgctgtacattttattaggcagcacttgtgcctttttgaaaactttttcaaacgcttcaatcatatgctcactcttcttcgactcagcttcggcgacataaatctgtctactaagaacatcaatacagacaagaatatacctgtatccatcgttgtgctccttcagcgagtccataatgcaaagatcacactgccaatccgtatgcaaaccacttgggacagtttttaaccgtgggaatttgtttcttttgggtttgaaaagtgtgtaagtcctttgtttatgaagaaacttctgtacatcgtgaagctttagattggggatacgttttcgcgcttctgctagcaccttttgcattcctgcgtagctggccggcgaatttaggttgtaataaacctgttcaagttgactttctacagttttgcccataacactggtttaaatagcggtttttctctatttaatccttgggtttttatagggttaacctggacaaggactagttttcttttagttcttctcttctttcctttaccctgttgtaaattaaataagtattttgtaatttccggttccctcttcaaacgttgaacaaaaaatgtatgacctcgaggcggagaaatatcttcacctgataataatttcagcgattcagtataattcgatccggtgactggcttattaaaattggtcaaaacctgtcctgattgcatatcgattccaaatttgtccggattttttccaataatattcataatttttgaaaaatttttctgacttaattttacgtcttgggaacgtattggcgtactactgctaccttctgtagccgaagaataatctgccgatgattcaaacacgttttcacttttctttttacgtgatgctcttattaatcgtaacggctgacgcttattctcttgttctacggctgtttctatttttggtattttatgaattcccatcaatgtattcggtttccggaaccatgaccattttctttgtgtgcttcattatgctgttattttttcaagcaaatgttgggctaagacactgagaacaggcacaagaatagcaccaagggcaattccgctcccttgttgaagtttttgccgagctgagttctcactgcgagcgcgtgctatggccctgtaatagtccgcgtattgtgacaaccgtcgcctctggctcggatttagacgaaaattaaattttaaaatatttgcgcaaatttccagctccctgcaatagatcgttttttcgtttatcagacctggtggccgcaagcttttttaagaaatctgtattttccctaacgtaaggactaaattgatacattttagtttttttctatattcatttctttatatagacaatgcggcggttagcgcgcatacattattcgctcggtaaatagattactctatgctcgtctggaaatatattattcgtaagacgttcagtttccggtgaatttggatgcatatttataaccaaatagctaaacggtttatttgttgcgtcattatatgattccataaaaaaaaatt

SEQ ID NO: 10904 - DNA, 993 bp, Heterodera glycines
  misc_feature (35)..(35): n is a, c, g, or t
tagtcctaagtattttctaaatcttatgcaaaatntcaaaaattcattatgtttaaaaattccaaaaatgtaaaacttagtccctgggtacttttggcataacttttctcaaatttgacgaaaatttttttctatgttttcaaaaattaatttttattttattttttttgttaatttcaatttattatcagtttttgtcaatttgggaattaattaaatattatatactaagtataggacttgtacgaatattttattcttataattttcacatttcactaattaatttattggatcactcaggtactttaaaatttttgcatttttgcgtcctacattttaaatttaagaacattcattaatcatataacacttatttttaataaattctttgagaattttagtcaataaattaaaatattcaagttttttattcattatgtttttaggttaaattaaaacaaataatttatgagttttttcatgtaaaaattcttagtgttaattattttctaccatttttatttaatgctttattttgtggaatccatgtttttttttggcaattgttccttcaggttttactcgtagaatggattacatacaatcgcattcgggtgcggagacccttttttggtttttatgctaattgatttattacttttaatttcattttctaattttttcaatcaaatattaaaaagttttttaaaaaatcatttgattttattatttttttttatttgtagaaactttctataagtaaaaacattataaatttatcatttcgtatttgttactgctgaggcgatatgttttattataattaatgattgttatcaaatttaatgcaatgataattgttattaattttttggtttaaaaaaaaatcaaatattacttaatcagtttgagtaagtgggcttaatatcgtttttttttttttggatatcgttttgtttagcttttcaatatttaaagtattttttaata

SEQ ID NO: 10905 - DNA, 3273 bp, Heterodera glycines
tttttatttagtcaattgagttggattgcaccttcgccttctcgcattgttcagtgctgcaaagattatggaattgatgaaagcaaatgcacatgccctcaatgatccaatttcaatttttgacaaatttataaaatatttattggcttaaaccaattattgaaaaaccacaaattgttataaataaataaatatgataaataattttcgtcttatcgctttttaaaataactcatcaacacatttagaaaatctcaacagttgttgcaaaaattgtgtttgacggttgaagcccgacgaacaaagcacgtaatcgtgcccattcttttgtaaaagcattgtgatattcagtgctaaaaattggcattttaatattataattaataaaataaagtaattaaataaattaataaggccttttaattttttagttggttattttaatttaaattattgtttaaaagaaaaattattaataacatttctgtctatcatcaatttttaattaattaattatttcttttaattaaaaaaaaataaaattatttttcattataagaataattaaattccaaatattaaaattcatttttatgcgatttttacctagtaaaaaacaaaagaggtgcaattgaaatggaactgatattcaacggaaccacacaaaatatgacgccgtgccaagtcataattagtgaattttgcattaaaattggcatcacaaaaatgccgaagacatagaaagccgccaatgtgcccaaaaattaccagcgaaagtgacttgaaaactttccaatgagtgcatgatgttgttgtggttgaacgtttgcctaattagggtaattaaaaatcaatatttttacatttattagtaaaataaattaattaccaattttgtctctgtacagaaataaaccagtgaaaacattgactagaatagtaacaataatcatcacaaaaattatattttttcgaatgaatgctaattggcccttaattaaattttaatggattaatttattactttttgttattaatatttatgccgaaaaatggaatcctcaataaataatctgagtacaaaaaataataaattgaatggtcaaatttattaaaatatttttaaaaaaacaataaaatgcattttagcgaaacgctaaattaattcttattgtcttaattgaatttaataaaatttgaatgaaattttaatttatttatattaattaattaaaaaatttggttacaaataagggaatatgacgcaaaagaggcgatcaattgcagtacaaagcattgcaggaatcacacattataaccaatgattgaaagtgtgccaattttgacggccattttatagtcaatgaatgtttggccggtcaaactgaggaacaaaaatgtgaaatacgatgattgatgcgcaatttcgagggccgcattaaatgccaataaacgatttgtcgggctaattaatgttctaaaattaaaaaataatttttattttgaaaaatattttataataaatgcaagaacataaaaacaagaaatttcatacaaaattaacaaattaaacaaaatttcacataaattaattgtcaaattatcgaaaattaacttcgaataaatttaaataatatttctaaaagatggttcagtgaatttataatattattttttaattggaaattttcgaattattatgatttcaatttatttttaattcaacaacatttttcagggctaagatctgagcaattaaataataattggctgtttctaattaagtgcctaattacgcataatcattattgaattataaaatattttcccggttttatttataccgcgctcgtactgtgacgtaaatgagtgccgtattgaatatcaaaccaaaaaatgcaattatgctcagcaacaatgcgcagcttatgattggccaacacggctgttcatccttatattgcaaaaatagctaaaaattgaaatttaaataatattaatttcatttttttgaaaaattaccgcaaatattattggattagcttcagaaaaatgcatttttattttctgcgaaaattaattcaaataacaattacctaaacttaataatgaattcattactacaattatatgtaattaataataataaaaaataaaaataataaaaaggaaattgagtaagaaaaaaattaaaaaattattaaaatataactaaaaataaagatatgtataagaagaaaattctttgaagcttttatgatggaattctcggtacttttcagtaaatgaggtcacatttttcaattaagaattaggccgcgcgtacattaaatttttcccaccaattttaaaatggcaaatttttctttgtccttttggcgcttgacatttttggtttgattttcattatggcactcatatacagccatttattatttaattaaagactttttttgatcagaatcaaaagttagcttagcagaaattgttttagaattttatctaaacttaaaattgagttttggtcgattaaacattttgatgcattacttttgcaaccggactgtaaaatatatatatatatatattttttaatataaatacaaattttgataaacagtttttcaaataaaatttcacggcaaatttatccaattttcttttaatcattcatttaaattctccaatatttcttctccaaattggttcttccatcttgaaatgctctttctatcaattttcaatgtttttgcaatttccttgtcactcatttttggattttcgcttttaatttgcagataaatttttattttttccaatttttcattctttgttaatttattgcaaatgccaaattttctcttccaattttcaattgtcccaatgccaactccaattttcttacaaatttcggcataattttgcttccattcttttggcgaatattttcttttttgcttatattcttttgacattttaatgaatttttgtacaatttcacctttttcttcatcagtttttgatttgtgacatttttgtttttgaagccccaattctttgatccattcataaatgtattggcgatttgtccccaatttttttgcaatttttcaattaattttatcccattcttttgctgaatattttcttcctttttgctttattttctcttttattttataatattttccaatttatttctctttttttgaagtcattttcgtttttcttcttctttttcttcccatttttctccaatatttcatcaaatga

SEQ ID NO: 10906 - DNA, 1426 bp, Heterodera glycines
tccggtttgacgacgacaaactgtgggaatgaataccgtacaaatggaatttcggagtgaaatttactattataaatgcttaaaattcattttaattgcctcacttcaaagccaaaagtgatggccattgtgctgatcagaacggcgaaaatgaactccaatttgcgaaagccgtagcgatcgatcagcagaaaagtgaacgtatccaccatggtgatcagaacgccagcaaagaggggaattcttggaagagggaaagttcaaaaggaaaagaatggaatttaaacaccgtccgttggagagcagggcaaaggcaatggcctgaagaatttgaggaaatagcaaaaaaaaacttcaatttaaaaaatatgatttaatacaataattattcaattaatgtttaattaaaatttaataaaaaaaattcctaccgttccgatcacttcttgcatgtcactgcctgtgaatgaattaattgttagcagaatcaaaaacagcaaatatttattgtattttatgatcaaaagccacagatgtggttccaaagggggcaaggtcgtttcgtaaaactgccatatttacagatttttcgagaaaaatccatcaaaacttttcttaaacataaccaaattaaaagatcttggtatctcgcgatagcacttggcttgctctataagattcagaaaatttcatagttctgaccaaaaatgttaaaaaaaaatagacataactttttgaaaacttaattaaatattctgaaatgtttcatgatgaagaagcaatctaagagctatcgtatgataccaagactatttttttaggatgtatttaagaaaagttatgacggattttttttcggaaaatgcgtaaatttgacagtttttgcgagacgaccgacccagcacggtgttatttttatttctaatcaacctactttttatcaatgattgaacatcaaaaattaacaaattaatatttctaatataaaaattggtgaataaaatgcaaatttgcctctttttttttcattgataggtatttaaaattttttagagtggtcaccggaaatgattaaaattaaatttaaatttctaactcctagttaatgcaaaaaagaaaaatatatatatatatttaaaaaggcggcgataaaggaaaaaatatgcaaaattttaaaacaactcttaaaaatttagtttttattactgataaaaaacgaaaattaataataaaaataaggaggactgaaaaataaaatactgaatgtcgtaaagtctccatatcgttgttcttgcattactcatttattccttctccaattatctgcttccatcgataaacgttaaagtgattaattttcataattttcgcaatttctttgacagtcattttcggatattctttttttgtttgcctaataaacttt

SEQ ID NO: 10907 - DNA, 2009 bp, Heterodera glycines
tttatttataatttcaaaaatttacataacaaaaaaaaggagataaataacaataaattatataaaatatgtttattgttataatcaaataaaaaaatttgaaaacttataaaagaattaaaaattaaaatatcaatttcacacaattgctttaataaggtatcaattgtagcaaataaacgccatataaaaacgaaacaacattttttgaggacgctagaaaaggaaaaacctcgaattatttaaaagcaactttagaaaacataattaagatataatatttgcaaaatcaacttatgcgatatattttgtttattgtattaagcatagttactattaataaataattaaaacatataaaaactatatgttaaataaggtagaaaatattaaaaaaaattattgggctttctaaaaaaataaataaataaataatacacaaagaataaaataaaattcatagtaaatgtgcttgagaaatccttattagatttattcatattaagaaataactttttaataattaccagaaatttaacaaaatagaaaaatcgaaaagagaatatatctgaaaatatactatagattgtgagacatgctgctcaaatgaaaaagattaattttatatttttttataatatgtttttttatggaaaaaaacaaaaattcgaacaaaaaattttacacaatataattaagagagatttagcaagaattaagagaattttgcatgaaataacaattgaaaaactatttcaaaaaaataatcgttaaaaagataattttataaattttgctaaaaatgcataaaaaatgagatcattatcaacactaaaaaggaaaataaaaataagtacattatttaaaataaatttaataaatgtttaacaattaattttttttcgttaacatttaatttatattccaattatcatgaattaaattagtatagtttgaaatgtagaaataatttttcttttattattattcttacgtattaaaaataaaaaccttaaatattgctatcatatatatttttctgttatgattatattaaaatttaatttaaaattaaatatagcaataactatgaataataaacaaaacaacttctgaagccaagaaattaaatgaataggaattttaataataaaattattaaaatacataattttcatattaattcataaatttcaacagttgaaaacaaaaaataaacaacttttataatgtttcaatgaaaaaccataaatcagtttggcaaaaaatattttttatcgaaatataatgtaaaaataataataaataatcgtcagatacttatttaatgaatttttttcaacaaagtttgtatttatattaaaataaataacttatattgcaatcagctgctgttgaatttttagtggcttttcacgataaaattaaattaattttttgtagcaaatttaattcgaattttatatatatatttaagagaattattaataaatattaaaataaatttattagcaaatgagtcagaaaaatgtaaaagattaacataaataaaatacaaaaaaaaatttacaagaaaatttgaaaatacaatttataaaaaataacaatgatgaaatataaaaataaaaattaactcaattattaaaaattcattaaaaaatattttttgccattgaaataatttcttttagaacctcatagaaaaggtaataaaagaatttgcttaacaaaataccccgacaaatgtttagaatgtcagagcgccggtatcattattgaaaaaaatgtttacatttgtttatgtgtacaatagattaataaatgtatgtaatacctaaatatttgaaaaaataaagtcataaaaattattatataacttgagagtaatagatgtaaaattaaaaagttagctattttcttatgaataatttcttctaacctgggtagttttattctataattattggcattccaccaacatttattgattcttatatctataaatcgtg

SEQ ID NO: 10908 - DNA, 2609 bp, Heterodera glycines
aattagttggttaggcaacatgacagttaaaatagtgttgggccaggagacttaacagaaaaggaacagaatatgagagaaaaaatgatcaaaaacatttcctttaatggcaaaaggtatcaatcaaaactgctttggattgaagaagaactgagaaattaccaactaattttgcaatgacatacagtcaattaaaagcaaatttaaaccgtttgcgatcaaaacccgatttactggaattgtatcacaaaacaattttggatcaggtcaatgatcagggatctgttgaaaaaaccgatcggttactggatccaaacaaaaggggcaaaaaatacattacttacctcatcatgcggtagtgaaagaaaccagtggacgtacaaaactaagaattgtttataatgctaatgcaaaaagtggtaataatccagcattaaatgagtgcatagaaaagggtgttaatgagtacaacgatttaacaagcattcaattatggagacgtttgaaaaatattttgattgggtctgatattgctaatgcttttcatcaaattgagttggcaccagaagacagatattgtgtacgttttttatgggttgaaaacccattcaatccttatagccctttagtgcattatcgatttaagcgagtaacttttggagttatttgtagcccagcccaattagcattaactattaaaatacatttagaaaaatatgaccatcctctcattaaacaattaatccaaaatatttacgttgataagttaatagtgagcattaccgacaaaaaggaatttaaaatagtttacaaaatgataaaacaaatattttgcgaagcaggtgtggatgtgagagaattcttgtcaaatgatttaaacaaaatacaaaaattacccaagtaagatcgtattgaaaaggaaactgtcaaattgtagggaatttggtggaatttccgagaagatgaatttattatcaaaatgccgaaatttgaaacgagtaacaaagttatcacaaattgctaagacatttgacccttgtgggattacagctccaattatattagctgcaaaacttttctgtcaagaaattgaaaatggaaaaaatttaaaatgggcaccaaattatcggaaaaagaagaacaaaaatggagagattttcaccgatgcttgttcaaaggcatttggtgctgtaatttacctaagaattgaaaataacgatcaaattgacaataatctgattttcgctaaaatttgcatcacaattgcatggaactatgctatgtggaaaatttttgaattttgtaaaaaatgaattagaaaaggaaacaaaaattcaaaagtgtaccatttggacagattcaaccaatgtacttgattttgttagaagtgaaatgaaatttgataaattattaaaaacagagtacaaaatatcaaaaaatggcatttaaaacatgtggacagcaaaaataatcctgctgacctagcatccagaggttcgtctgtggaagaattacaaaattctgaactttgctggaagggtccagaatttctttcaaaaatggaaatagattggcccaagacaattcgtgagcatgacccaatgaatccgcctgaggcaaaagaaaaacaaaatataatatactaaattaattcagcaattgaacaagaaatattttttaattctgaaaaattcttccaaagattttcaaaatggaatcgtctaagaaatacagtagcttatgtaattcgtgcatgggaaaaacaggaaaaagagcatctttagaaaagaacgaaaaagatcaaaaatttaagaaaaataattctgagggaaaaccaattaaagaattagttagtctaattcgacctttagaaatcagtgaaattgctaacgccgaaattttgattttaaaacaaactggtacaagaaaatcatccgcctacaaaatcactaataaaaagtttggatttgtttaaagatggcaatcaattatggcgtacaagaggaagaattttacaaagtggtctaaataaaatttggtcagaaattttcagagacgaaaaacgtgtcgaaatccaattgagagggttgtgtgatcaaattgggtgttctttgcgtccaattgatggagagagagtcccggtgaccaacgtcgtttggctgatagccgcgcacctgccaattctcactgatcagacccaaataaaatattcaccaacgatccgtcccttttccgtcctttctcagattttagacccccggtgagtcaatgattccagtaaataatccttggttaaatttgaccccctggtggatcaattcccaatttccggtaaattggtcggtccgttcccggtgatccaactcttgttattcccccttgttactgtattcgaccacactacagacttcaaatgcaaatgtcccgatgacacaaaagctgtttaatgtcgttcaagggcagaaaaggtgtgaaaataaaaaatattcagagatggaataaaaggtgatcgggaaaggatgaacgttgagaattgtgagaatgatgagaatggtgacaattttcccttttttccgtttttaagcttattcaaatgacagggaaaattg

SEQ ID NO: 10909 - DNA, 1306 bp, Heterodera glycines
catgccaatgtgatgatacgaaaagagagtggtgaaaagcagcagcagtgatcagctggagcaaaagaaagcaattaaaacggttgctaaacaaaattcatttctccaaattaaaatgaataattttcaattgtttacccaaaataatgtttttccctttcgcttcgtttgaattcatttcattttcttaataaatgcaactttctcttcttttgacaacttttgctatgcttttctcatgtttattgcctctctcaaaaacaggtccgcctttgtttctttatttgaaagtaattaaaattcaaaattttcacagctgccgacaaccgaccgccgcccgcgggatggtacaacggacgccatcacggaaaccacgagggatggcattggcacaacggcggaagacgatgagacagaggcactcacattaaaaaatggatttcattttgttaaataatatctactttataaattaataatttttacaaaaaaataagtttatcacaatttaaattctttatttttttaattatgtcatattttatatggagaaatgaattaatttttatttattattttaaaataataaaaattctttgtcgaagtaattgaggcgttttaccatagtaaattttcggcatgccaaaaacaattcgaggctttagcctggctgggtggtgtagtgatactctttcaaactcgtctctccacccgcctccgttaattatccctccacgcatttgtcttccattaatttattgcttttgttcctcatttgctacatgtttttcttatcagattgttttcacttaaagtgaccaatcgcgttttcactaacttttgcttaaatgcaaatttttgcttcctcatttatgtgctaattgtgtcgcatatttatattaaatgcgtttactcaattaatgcttttcattcccaaatttagcaatttccatgaatatttattattattaaataaagtgttgacatggaaattcttaatgattcgcgtgatcggattgtcgaaacgattcgcagtcacatcgaaaacaatgaaaaagcgcagcgctttttcaccgatttttcccttcgcctccgtttttgcctccgttggctgaacacgaaaaactcagtgctaaacaaaaaattcaatttctccacattgctcggcctctttttctgtgtttacgttgtccagcatttgctgcccttaattttgccaattcgtccgtcttcctcttttgtgaagccgatcacacgcgacgtgatcatttatgccaccttttcatacaaaaacagcacgaggtac

SEQ ID NO: 10910 - DNA, 1387 bp, Heterodera glycines
  misc_feature (1337)..(1337): n is a, c, g, or t
gtttttgttcgaatttggattcggggttcggaatttctcccatagaggtcatattcgtgatcagcgccaaaaattaccttagaaaaaatatttaaaatgtctttcgagtgctttttattagtgcagtcacttgagtcccagctgagtttggcactttttcagcctgaaaaagggcaagcgccctctaattctatttttccaacccatttcgaacctttttacatcgattctgaccgtttttaagcatttttgagtttggggccatgatcaatatttaccgaaatggtttgatattcaatttaataactatttttatcattttcaactccattaatagacatattttgttactatggctaagatttttaaatacagattattaaaaatggcaaatatatatatatatgcgcaatatatatgtaaaatcactaatagtacaaaatatgtaattaaaaattttattaatgattctttggaccaaaaattcttagaaaaacattaaatgaggcaaaaaaatatcaaaaaagacttaattagcttaaaaaataactctttttccttaacagtttcggcatttcctcccacgatacttttgtactgctaatgctcgccgatcgttccgacaatttcccatacatgcgttgcgcacggcaaaaggccgagatggagtccgtcttggcgcaggttgagcattacgattacaccggactgtgccatctgatcatgttcatcgccgtgtgcaatttcccctcgccgtccgcggcggacgaacgccgccgcgtcgacggcgcgggcgaccgaagcgatcagtggcaggaggaggccgtgctggtggacttgggcccgcaagtgttagccgaccagcagttgcgccaaacgtatttggacccgaactatcacgaggtgagcggagtaacgaaaagggagggatttgagaaattggaattcatttttgaaattaaaaatgcaaaaaaaaagaaagccgaaaagtaaacgaaagtcattaagctatcagttttaaacattaacccgatagaaatgaatgaaaatttgttgaataatgaaatatataaaataagaatgaataatttgtcattatttttccatttattttttatttttctcaagttattactttattttttcgcattttttccttcaccatttttcggcactttcttttttccttttccccctttcagctcgttgttcggaaggctgaccaaactccgcgcaattttctcatttgcgttagccgagtttttgcgtttgaaaaatggcagcttttgctcaccgcaatggaagtgtacaaatcgatgggcgtcatttttggtggntgttgcacattgtgtccgcacttaagtgccgttttcaaactgatcaaagc

SEQ ID NO: 10911 - DNA, 3700 bp, Heterodera glycines
  misc_feature (3695)..(3695): n is a, c, g, or t
aagtcattaaaataaaaaataaaagttgttttaaaattaaattttaatttattctttcaatttcagattttgtgcacaattttcgtgaattaattttcaccaagaaattttacaatagtgaaaaacttgtgctcagaccgccccaaattgacgcattttgggtgcattttacgcgtcattataaggggagggacaaaccggtgcaattgtccactgattacctgaccattttgcatctttcaaaggatgtaattaaaataattttgaattattaaaaaaagatggaattttctttatgacagatcgaagcaaattcaacaaaaggatacaatgacaaattgctaacacaatttgatggacaattgggcaacggaagtgcttttctgaacgactcgaagataataaaggtacagaaatgataaccaaaaacccaaacggaatggaaaattatgaatacaatataaaaaatttatttaatgttagccaattaaaattacaaaataccacttagataattgaccgcatgccgaaaaggttttattattttggcgccattcggcactgttcccgcttcatcaacaattatccaaatggcatttttactattccttcgccgtgcctttcatacaaactgtgcgatttgccgaaggcaaaagtggagtgtaccgtaaccaaaagcaaatattacagaagcacgattatgccaacaaaaatttacagggtaattagtgggaaatgattagttagttattgcgcatcattaaaacattcaggttcacgttttaaagaggaccatttttgtgaagaggaaaggcggatgctttgccagaaaactgatattttaactttattaaaatgtatttttttacaaaaaaaaaaaataaaatgcggaaaggaaaacatcgaaaaaatttgaaaaatgttaaaggaatgtgtctctgacacagttttaaaatgtttaagacacatttcaaatattttaaattttaaaatttaaaaaaatgaaaaaatttttaagaaatcaaaaaattaatggaaatatttttttattcttgtgtaataaaaataaataaataactaatgatttgacaagttaaattaatgaaattttcacagttcggttgtccatttttgccctttgcctggttggggaacagtctaaattataatttcactttaatttaatattaacacatcacattctaattatttttaaaaatataaaaatattatttttttaattttggcccactttttccaaaagtttgtcttcgcatgccaatcgaatgcgctcgggcgtcgccggactgtccagccgaaaatagcccaaatgtccattttgaattcgatagtttcggatcgcttcacgaattgcgaaaaaaggggccgacccgagaaaaagagggggctcaccgatagcctaaaaataaaacgtttaaaaagactaaagtaataaattcgaaaaaataaaataaatttaagcactttcgatgaaaaaatgccatttcgattggaggatccgtccaacaatttgacgttgaattggcgtggcgcatcgtccgcacttggaattttgtaagtgccggggccgcgggtcagccgaacgccgtccgggcgcactttcagttcctccattgtgaacagaccgtaaccctaacaaaaagtgatgtttttataaattttttaaggaattaaataatttaaataatttttttttaaatttaaatgggcaaagaaaattcacttggacaaatgctccctcaatttgaccaatgtcaatggccgggttaagcgattcgccgacatccatcacaatgtcaacgcgaataacctttatcaaataataaaacatttaaaaaatggaatattatttaaaaaatttaatttatttaatttttgaattaaaattgtacacgatggtcgcctgtcagacagtcgacttcgacctccgcacatccgaccccataaacacaataactgtacgattcggagccacgaccttctacgaaatcaggaggctcagaatgaatgcttaacatacaaattaaaagaaaaaataaaaacgaatttttaaaaattaaaatacatagcaaatccagtcgcagacaattgcactctgttggaataggcgtgcatcaccaaatcctggcattttgatttatttaatgacaggtgtaaaataaaagaaaaagataaatcattcaaaaatggaatccattcttggcctttatctttaaacgatcgtcaaatcctaaacatacggcatggaactcaaaaaagttaagatgccggatttacatgccaaaacattctattccctggcacatgtccatcccagtctctgaattaggccaagacctcagtaatcccgaatcctcaacacggcgtgacccatttagcataattaattccttttttggttttatttttaccttccaactggcttcttttggcagttcgcttctcaacggctccaatcgttttaataaaatttcgcatgcgtttttcacagccaacccattgacgtcacttccaacgctaacaaaaaaaacaacaacaacattgatattaaaacaaaaatgatgattttccttatcatggtccgcccacctggcagcggttgcgctcgcatttggcactttgtcggtggccgtgtcaatgatttgaatcgttgaaacgtcaattccaagacaccttgaagcaatctgaaggattttaattattattaattgatttaattattcacctttttattattattacttggagaatttttgtgtgcaatccttggcccatttccattccgccatgagaaattagcacggaaccatcagtgtacacattgacaagagctccagcctaagacaaaacaattaatttaaaattaaataatccctaaaaaatttaatttttattttttaatttcaaaatttaattcatttaaacttattgtgaaatacctggttaagtcgcttgaaaccaaaagctatgccaaactttgtcggaaccatgtaaatgcctcgtttcaaaaatttattcctggaattacattcttggagctgaaatagttgattaaaaatcaaatttaaaagcatatctcctccactaataccttcaattttcgctggtcataatttgccaatttttggcattctgtccaacaccggcgaatgttgcattggtgcaaatgcatcccgtaatgtgtaatgtccccctccgaatacatgttttgctcccgaagctgaatcaaaaagcaaaactgctcaggttttgtacccaataaatatcccgtttatacatatatgttttcgcaaaagtaaaaatggaataaaaccagcgaaaattggctttaatctgtttaaaaatatacaaatgccatccgaaactgacttttcccgagactctcgcacatctccccatatattattggccgcctattcgtcctcaccgtgtccacgtcgatgccaaattgttccgcggcatgcttcattatggtctcggtggcaaacattccttggggggctccgaagccacgaaaagcggtgttggaggccaagttggtcttgcacatgtacccgtacacgtcgagagcgccaaatttgtacacattgtcaatgtgtgccaaggcacgttctgttaataaaaataatattaaattgataaatggactatttgcccccacccatccactcctnttgct

SEQ ID NO: 10912 - DNA, 1168 bp, Heterodera glycines
ttacgtggccccgtggcccatgcgtcgccttttctgaactgatttcgactgattggtcgtcttgcgttgctgccacattttccgccggttttggcatttccgtagggtatgtcttttcctcatcccatcctaaaataacttaaatgaaaaaggtgaaaatattcaaattgccctctttttgctttgcctgaacagttccgtgctgtgagcgatcaccgaaaatggcacttcgattgggagaaggcaaagtttgtgggccctttgttggagcagcagcagagaggggacgggcgagttcaaagaccacagcaaattaattcgcgagggcgcacaatcggagacggacgaagagacggagagagagggcaactgagacggacagacagacaatcagagacaatgaaatttagagagaattggagagagaaagagaagagaatagtgggactgactgacttggccaagttggtcgggacgagcgagaacgaattggcaatcctaaatgatgggcaatttcaaattggcaattctaattgcattttgatcaaaataatcaaaatgaattgtgtgcctttgctttgagtgccctttttgttagttaaatttcaaaatttgccaatcaaaatgacctgagtgatggcgaagaagtgaattggagttgaatagtgaggcgatgtgccgttgggcggaggcgaacttcgcgactgacggaagagaggggagggacaacgcttttggggggacggaagggcgagggaaaaagggacgaagagaggaagagaaatgaatggggaaaggaagaggaggaggagggagagaagaaggcacatcagcgatggggaagagggatacggtggaagagcatacggtggccaaccaacatttactgtgggagagagtgcctgccgtggaggggacgactaattgggattggcttcacataacgatttttttttaaaagattttttgataatttttttttaattttaaaaaaattggtccatgccaaccgaaattggcacggaaaaaataaaattggaaaaaaacaataaagacataagcgaaaaactatgccaaaagaatggaaaattgggggtcatgtcgaggaagtcacacaatcagaaacaacctgctgtggatgacactttggttgggaatgtacgaagat

SEQ ID NO: 10913 - DNA, 3170 bp, Heterodera glycines
gccaacattttcgcttaaggcgctttaattgtgccgcggggtacgttcgtgtctccagtcgccttggctaccgggtacaccgacgacgccattcgcaagtcggagattcgcattctgatggccattggcttttgcatgagttcagcaaacactcccatcacttacgtcgaaagtctcctcaatttgacttgtaatgcgttaggaaatgtaattggtaacagtgtactttgtaccccccccccacccctttttttgaaaaagaaaattttcaaaatttaaaaagggggggggggtacaaattacactattaccatgcaatttatttctcgagttctcttttctttgtaaacagaccgagcgaatccgcacctgaagatgaacatcgactccctctgggagtactctgtgctcatcctcgactgcgtcttcctcagaatggacgatttttacagacgcattttgctgttggtgcacggagaccgaacggaatttgcgactcggtcaattcgcgcattcgcttcaaacgttgcattggaaatgtcttctttcagggaacgcattttgcaagttgaggccgactacgtactgctcgcctgcggcgtcatttgcatcgcctgcacttgcatccacggccgcgatttcatcaacagcgtcgtgttctccctccaacggttggattgactgatgacagactttggactgattgctttgctctttcagaatcactggcatcccatcggaacacataattcacatgtacacgggcatctttcagactgtctacgaccatttagtcggagtcagtttaatttgttttaggtaatattgtcataatttgagttattttcagcatccattgactgattctcatgcgtccgcgtctttgcttcagaatatccgactttcaaataataatcagtgattctgtttctgtgtttacatcattccctctccttctcctttaattatttaggccgttttcggaattgctcaatcattttttgttgttccttttacataatctttttcggcattataattttttcgtttccctattttctgtgttgcctttctgattctttctcgaatattgtttcttttcactaaaaatttttttgatctttacttttcggtgttatgacactcgtacaataatttttaccattttttaaatttttctaaaaaattaaatgaatattttaaaagttttttattagaaaaattatatgacttgccattgtacgagttgctctatttacccttgcttctcatcccatttcttctctgattaataaatttgtgtaattgttctttcttttcggcacttgtcctaacaaccgaccaaaacaccccacaaaagtcccatttgaccaaactccacgagtctatccgaggcaacagctgcaaaacgaaagccaagacctaaacaaccgctgataatccatcccatcatcacacggctgaaaccctcactaaaattacccgtggggatggtttttagaagaaatcgttgggaagtgatcaatgaaagtgtccacctaatgggactaattattagggagggattctcaagttgatttatggggcctttcttaaattgcaattttcgagaaaagccaaatgattgctcaatctgtgccgaacattggccattattatgatgaagaggaagtgatggaagacgaggaggaatattcatacgaagagattgacgaagaggaggaggaagaagaagaagaagtggagaaggaagagaagcgaacagtcgccgcaagggcactgccagcggcgcaattggcggaggacggcggacagaacggcactgcccaaggcaatgaaattggagggcaaattcagtggcgagacaagggactgtctgcactaattgcattggaactgatcatttggcactttctgatcagttgggactgaccaattggaactgtctgcactgatcactttcccatttttgtttctgttttgtcaccgattttccccaaagtgttacaccacccaatgtgaatttgcataaatttgtccgcatttcgcctattttgacgcaatgtcccgccggtgacttagttcactgtcccgaccgacggattgcaaactcttccggcaaaagtctgtcccaaaaatttaagtgtttggtttttctgtccgttgcccgtcaaaatcgatcatttgggcaggaaattaacttttctgttgataaagaagcactttggcagccaaaataatcactcaaatgagaatgaatacaaaaacggaactcaactcactccgtcgccatcggcgaattataaattaaaagaaggaaaacgaacaaaaaacaacggatcaaacgaatgattgatctctcaccacagccactttccctcgaaaaaacagaacacaaccccctcctttaaacctaagcctcattaagttcatacctcattaatgtcttttttatcattccaattcccctcccttccctgtctgatcagtctcaccctaacgatcactttgtcagtttggctccctaaatccgatcagtaggttagctttctccctcctcctctctctcccccaattgttcgtttggtcattcggccattcattttcattttttgggtaccataaattctgggctggtcaatcacagcctttattatgagaggggaggaaactgttgactttgtaccccgattagtcattcatcattttccgatcagtgcgcaattaattaatttactccccccgcacctttgacaattccacccccgcaaataaaaaaagaaagcgaaaatcgatcaaatggcaaatgcatcgatagtccatcaaaccccgaaaaaatgccgaatttacaatgttcagaaattgtaaaatgaaaaaggaccttttgctggtgctgacggtggagtcggtggtgatcggagttgtgctgggctttatgatacggccattgaaaccgaggtgaatgattagtggcaattaaagtactaattaattgtaatgagccaaaaaggcacaattaatttgggtgtttagtaacgacgcgattagtctgatcggattccccggagagattttcatgcaggtgaacaaatagctaacaataagcaaatgtaaaaggccaggagaatttgaacctttcacagattgtcgagatgatgtcctcccgctaa

SEQ ID NO: 10914 - DNA, 5027 bp, Heterodera glycines
  misc_feature (16)..(16): n is a, c, g, or t
ataatcttaatatttntgttttataaaatatagtcaatttttttatatatttttacacaactgaatatttttatgagtttaaagatacatatttgtgtttagaaatgttaataaatttttttgggtttaaaatatcaacaaatacagcctttactttgatcaattgagttttaagcaaaatacaaatacatttatcggtaagcggtctaaagtcgcttgcttaatttatatattaaaaatttaattttattcgtcttaaaaatgaattttcttatcttgaaatatctttttctgtatccttttatttagcattaaatttattatgtcaattctttataattttatttaaatttcagattttatgcaattaattttattttgaggtgacaatttagcgcatatgctcaaaaaacgcatttctgcgttaaaactttttatttgggcgtcatttttcgtcactagaaatcactattttggccactttgtcattaaaatagaaaaattcacttttttgcggtttgtcactattttatcactttttcgacatttttgggaaaatttctcaacaaaaaagcaataaaaacgaaaaattgcacccctaagaaacgacctaaaaattttttcaaaaaatgcattcctaagaatagacttaaaattttttcaaaaaataccactaacaattcggaaattttcttaaaaattcttcctcaaaattttttttcttagcaatttttaatttaaaaaggttgagtatttacttaggaaatagttcaaaggaaatgtacctcatttgcaactgcattcagtgaataaaaaattttttttgctcaatttttggctgaaaattatgtcactattcgtcgctatttgggactttttcactattttgtcacttttttggcactttttcttcactattttagttaactattttggatttttcgtcactaaaagttgcgaccctacttatgatatgtatttattgttttattcgctatttaaattttaatggtttttttcaagttaaattatttttttaactttttaatctatgagttttttgctatttgctttgaagctttcaaggataacttgcagcataagtgtttaattctaaataagactcaatttattaatttttgtgtgtgtagaaagaatttttagaatttcttattattttatgttatttaaaatatataattaaattacactttttaatttacaatttctacattataaggtggacaaggcgcaacaattgcgaatttaaaattattttatgtttaaattatatttaattatttaatgtataattttttattggtttacacatagtttaattcaaaatttcgcaaatgaatatttcttaagtctcactgttccaagtcccagaagcctcccattagagcaatttctcctgttttttaagtttaggtccgtattagtgattagattttataaaaattcatctagagaagctattcgtataccataatattatgtttatatattttgatataatttcaatttattatcaaataaattttatatgttaaaaacacatttaatatcattctatccattttaataatttttttgattaagttttatgtattgctacttaaaaataaaaatttttctatgcctttgcaatttttggtgcctttttttaacaatcaataattatcgagatgtctacaaatttattgttgtttgtatttaatttgcatttttttcgtcaaaattgttttctcaatttgaattatgcattcatttccataactattctcgccatcagttatacttttctgctttttttattttgctttgtatttttaattttctatttaattatttttgattttgaatgtttaaataagaattaattattattcttttctttccccatttctcgtcctggggtcattttttccaaagttttttttcgccggaaattcttcaaataatattaaaaaatattcttcaaataatgaaaaaatattcgtcaaataatatttaattatatttaaaaatcactccagaattttggataacccataatgagcctagaatttgtgaagaatatcaatttcgaccatgctcatcctcaacaatttttttgaatgccgaaaaatgttcacattctaatacaggacaaaaaaatcaatatcctatccctgactctaataatggccaatgctgattcaccgatactaatttctgatgaggagctaagcgaagacgagactcatttgaaaaaattattattgtctgaacaacaacaactacttgaacaacaatttaacccgatcggccctactcatacactctttgcccatcaaccaggtccaaattgtgaccccagcacaagcagaaaaactaaagagggaacagcagttagccttaattaatcagaagataaaagagatggaagccgccaaaaaacaaattgaagtagaagaaagtgctgaagaagaaggacgaattttaaaagaaaaggcacggaaaacggaagagcagaaaagagggcaaaaagctaagaaagacggggagaaatggggaagaacggaagaagaggggccaaagcgtgatggcaagcactgcctaatgagatcgtatgtggcatattataattacccgagggagggaagtgatcaatcgatggaatgccctgaggaggcgagaaaaagagaggaaaatttaaaaatgaaaacggtcgaagagcgagaccatgccttccggtcatttgtgaatgccgacacttcactcgacgggagagcgaaagtcgggcaacgcttcgctcgaaatttgttggccccggtggagagggatatcatccggaacccgggaattcccccagaaggacggggattttgccaaagtgccacaggttggcagggactccctcatcccgaaggacggaacaattggcacgccacggggtggcagggatcgagaaagagggcctggaatatgagccctattcggtcaagtccggtgggcgcaacgatggaagaaaagatcgaacgtgtgcgctcacttttatttgaatgtacgcacacattgagagacgtagtcgatgaaatgaacgcaaaaaagaagaaagaggaagagatgaacaaagagagaacgagagaaacagacgaaggaagagagcacggaaagaaagagggcagtgagaagagtgagggaacgaaagacaaatgaagagaaagaacagaggacgaaggaagggaacaacaaaaaaaataaaattaataaataataataatatacaattccataatcatatacctaatgttggaacattcaaatttaaaaaaatacataaaataaaataaaaacaataaaattttaaaatccaaaacaattaattaataatcaaaaaaaattttgaatgttccaaatattttcatttaaaagtgcttttgttcctccctccctttccacttatctccctttgtttcttattctttttctttttttttctctctctctctctgtctaatatcgctcctaatcttccaatactcaccaatcacggcggacggcacaacaaagcacggcacaatcaaaattccaaacaccaaaacaacggacgtcagaaatgcagcagccatttattcggaatttaaatctacaaaaattttgagagaaggaaaagccaaaaagatgaaaaatgacgaaaaagttggatgaacaaaaatgacggttcgctgctgcacatctgtcccaaaatcttccaatcttttcttattcattattcttcactaaattgcattttcaatttacgcaccattttccacaacatttaaatataattgaattgaacgccgggggcggcgttaagcagagagcagagaatattatgcggcgattttcgactctctttcctctccattctctctctcgctcgctcgttcatttctctttctctagtgcttccgccaccaatgttgccattttcctcacccccgcccattaactcaactgctctgatcagatttaaggggagagatttgggatttgagtcagttgttgatcacttcacctttttgatcactcaccaatttcccttggcttttctttaacttctggtcaataaagtgtagaaaaaggggggcagccttttgggggagggatgcgccttcccgcatctcaggctctgcctgaaatgctgggagggcccaacattcctcgcgtatttccccgcatattaataataattgaaatttcttccgaaaaaacgccaccgaaaaaggctaaacgttctccgatacaagcaataaaatttggagaaacaatggtgtaagcttttattttttattaaaaattattttattaatttaataaaacaaagtttatagactcataatacgatggtttttagtgacatagaactaacgtttgtcacggcggacgctgttcgtttggtccaagacaaaaaagtttggactgtcattggtacagacgggtgggttaccaaaaaacgaaaatgaattaaacgaattttctacagaaatgattttctcaacattaaattttgggaaaaaaatctggaacgtttgattcgtgacattggcactgatttcaaagtttaattattttgggaaataaaaatcttgatcttgcttaaggaaccgagcaatgaagaaaaagccttttttacatttttgagccacaagttttccatcgccggtgatttcagcccaataccaattaaaaaaattcggaaaggagaaaattttgtgtaattaaagccatttaaaataatattaaaaaattaaataatattaatatgttagtgcattgttattaaaacattttgttattccatttagcgatgttgaagctgaattatgcaatgtcagacaattacgtgtagtccctgttcaagggaacgaatcacgggttttggatgttttggttatttaagaaaaaaccaacacaaaaataactgcatggaatattttggcggtttttttgaattttttattgagtggcaaagaagtagaaaagcattaaaa

SEQ ID NO: 10915 - DNA, 978 bp, Heterodera glycines
  misc_feature (844)..(844): n is a, c, g, or t
  misc_feature (874)..(875): n is a, c, g, or t
  misc_feature (895)..(896): n is a, c, g, or t
  misc_feature (910)..(910): n is a, c, g, or t
  misc_feature (915)..(915): n is a, c, g, or t
  misc_feature (918)..(919): n is a, c, g, or t
tttgaagcttctaggatggatttctatatccatatttttccatatttcgcgatttatgtccatatttccatagttttccatattttggcattttggtccatattttatgtccatattttggcatttttcaaaaaaacctctattagaacggcccccatcagctaaattagcctttttgagcccaaaaaccgaaaatttttcaaaaaatcattttttcgccaaaatttctcgagaatattgaataaatttaaattttcttaaaaattaataaatttatgtcaaaaataagcaaaaaagcgaaaagttcgcttttgttgttgattttgcgctaaaaaaataataaattttagctttcatgttttttttcttctaaaatgattgcacagaattgccgaaaaaattcgagaccaatttccgaatgttgaccgactaccgtatatgctctaattatagcccagtctctattaataccgcagtctccaattatcccctgtattctgaggaggttgaaaaataatcccccatgggctataattagagcatatacggtaattgccaaaacgaaagccgtctttgtcaaagcgccttaccgagtcaaaaaatttggaaatgtatctcatatgcaatttcaaccaataaatttgaagaaattttacactcaattttgaaaaatttatgtccatattttgacgtttttgccatttatgtccatattttgagattttcgcaattttatgtccatattttgcgatttttggtccatattttatggccatatttcgcgattttatatccatatttttaccagccctactaattagatgtgaaaaattttataaataanatatcaaaaataacaatcataacaactgtnnaatacatatcactcaacaannatagttccctggancctancanncttctccacgagaaggaagttcctaatggcgcgacggaaaaatctatgccgatctttga

SEQ ID NO: 10916 - DNA, 3276 bp, Heterodera glycines
gtgtcaattagtcactgaccggggtactaattggtcagcggtcaagagggcactaattggtcagccgtaggggatgggtggtgtcaattaattaattaattggggaaacctaaacctattgaacggtttcaaattgtcttgtacttttttttttgacataaaatttgattgattctaaaaatgacagatgaggggatgaaattcaaatttctgatgggggtgggaggggtccggaattttgattggtcacccatgaagtgttgacgaatattcaaaaaaccgtcacaaataattaaaaataaattgtcaattcctttttggtctaagtaggtcagttaatcgatggcatagcagtggggaggagatgtaaaggacaccatcactgggtgcaatgggaacgcgacgccatcgcacaaaacattgcctcccaagcttatagcttacaataataaacatctttttgtattggtcatttttcatttttatccgtaaagatttcccaactcgtgtatatatttattattcatggcggaccaaaatttaccggtcaatgaatgtaattttatttattattttcaacgatctaatttttttctcaaaagggcctcatcacacaagcccaacggaccaacaatatgttttgttctatgaattaaataattaaaaaatcatcattttgtctctcattttaatctattccctactctggctgaccttcctttgtgttggtcgtccagagtagggatccttatgttctcacaatctttttaagttatggctgacctttttttcaaattggttgtcctctcttattaagattgtttcattaatctcataataataataataattttataaaattcgccggtatatgatgaaaacgttagacagacaacaacaacaacaacgacagaggaaggcgggacgaaaatgggaatgcaagaggaggggaaaaagacggagggaggacaggacgaaccaaatgatggaggtgaaaatgatggaagaagagagaacggaaaaggaggagcaaaacaacaacaatggaaagaggggagaaaaagagaaaatgaagggagataagatgaggaggacgaaggaagaggcgaagaagaaacagagaactgagagaaccattgaaaagaggcgaaaaaaaagaaggaagaaggggagagaaaggaggaggaaaagaaacaaatagagggaggcgaagcgaaaatggaagaaaagccaaagaaggacgaggaggaggagcaggcgagaagaaacaaccgccgcccgggtcaaaaatggtgggacaattgttttattttttatttttaaaatacgaaaacgcaaatgtgtattggccatcggaggtcaatcctttatgagtattggctaccgaagggccgggtccgtgggagtgttggtcgccggagggccgagtccttgggagtattggctactggagggccgagctcttcggagtattggctgccagtgggccgagctcttgggggttttggctaccggaggaccgaactcttagggatgctggctattggtgggccgagctcatagaggtctgattgccgaaggaccgagttctgggtttcaaagagaagggaatgttggggcttatgggggagaggtacaaatcagatacacgctcattcatttaaaaatatttatttattggctacaactaatgcgaaaaatttgatgaattattcggtggtttttggcttcttcttttgatcggcaatcatatcactgacacagcaattgattctggcacattcttcacacatctcgaatccaatcgccactcgcccatcttccagccgacgtgtcttgtctttgttgtgaaataaattgttccagtcctctgaaagttgtcaattaatttggtcgaaaaatttgattaacctgaacacagccgaatcgctagtacaaattggccccgcgtgattttccaaagaaatcgctcatcaacgcgtggcttcttagctttcacttgttgctcctccgcagtttcgggttgtacaaattgatctgccattgttgttgatgaaattttgcaagactgatttgattgtgcgagaaaatcttggcttaaatagctttaaaaagtgggcgtggcctaattttccggggagtataaaagccccggcaatttgtcagctatgtctcatttgttctgctacaatggtccttgccatcgaattttgtgcccaaattctcggctgttcccctaaatcactccgcgacaagctcaatcatcccgaggaccgagtgaaggcactgaaggagctggtcggaaaaaaggttcggacgacatacaaggaccggaatggaatgcagaaaacattttttgtcgacggaatatcggacaagggagcggctttgaccccggcgtatggcagactcagacaaccgtacaacatcaacattgctgcccatttctacgctcgccaccgtatcaagctgcatctcccgtacgtgccatgtgttgtggagaaatactccgggagtggcgaagacagatactacccaatggagctactcgaaattgtggacgaggactacaccatcaaagagcgatggcttggcaaactgtttaccgaaattgaggaaattcctgtcaaacgccttggtcgagttgaggaagtcgaagaaattgacgacaacgatgatgatgatggtggtcgctacgaatgcagtcaaccgtcttacgtttattggtaaacacattaattttccttaattatgcacttttctacctaaaaacgacaaattcttttttaactttatttataaaaattgtatcttccactccttaataatttacaaattgtgtcttcttgctcttaattctgcacttttctacctaaaaatgacgttcccaattgcttaataatttacaaattgtatcttccattgcttaattctgcatgtattttaactccttaattatgtacttttctacctaaaaacgacaagttcgtgcacataataaaaattgtatcttccttaattatttacaaattgtaacttctttcgcttaattctgcacttttctacctaaaaatgacattcccaaatgcttaataatttacaaattgtatctttcattgcttaattctgcatgtattttaactccttaattatgtacttttctatctaaaaacgacaagttcgtgcacataataaaattgtatcttccactccttaattatttacaaattgtaacttctttcgcttaattctgcacttttctacctaaaaatgaca

SEQ ID NO: 10917 - DNA, 907 bp, Heterodera glycines
  misc_feature (780)..(780): n is a, c, g, or t
  misc_feature (839)..(839): n is a, c, g, or t
  misc_feature (852)..(852): n is a, c, g, or t
  misc_feature (876)..(876): n is a, c, g, or t
cctgaagagagggcattttgagtggggaaatgccaaaatgaattaccactctccgatcaaagaattcgtggatcaaaaggacggagaagaaaagggcgagcagaaaaagcgcacaaatgacaaaaaaccaaaagaggcgcagaagcaaagactgacgctgaagcgaagtgccattttaaaagagttaatttagcatttttaatcatttttttgccatttgaaatttgttatttgtctcggctcaccaacaaaaagaaagaaaagccgtgcaactgatttcgcccgtgattgttgcacattgtgcagggttttgcctgacaaaacggcaccgtcggtgccggcgatcggcggatggaatcatttggagaaagccgacggattggcattggcggaggaagaagagacctttaggaaggtaaagccgaacgaatgaaccacgaaacgaatcatttaaatctttggagagagtgggctggcaaacatccgaaaagcattcgatttcctcccttttccatggcccctttaaatttgccatttgccaaaaataaaattcatttgatacaaaaaatgagagaaattgactgtgagcaaattgaaaattggcaatacgtaaagtgatgggatgacattcattataaaatcaaccggtacctttaactcatattcttttcaaccttctgctgctgctcaccctcgccctttgctttaccttttaagattttacgcctcctttttctcttcttcccttattttcatttcctctccctcctcttcctcttncatttccctccacctctaattcgccaaccttttcttcttcttcttcttcctcctgcgtnttctccctcctgntctcttcttttcatccacctctanatcttcctcctttttcctttcttcctctttg

SEQ ID NO: 10918 - DNA, 4588 bp, Heterodera glycines
  misc_feature (84)..(84): n is a, c, g, or t
ggacgagaaggaagcggatgcacactgatgtgacacaacaccggtcaatactgactctggttattagaggaaagagctgctttntaaaaaagattcatttatggtcggtcatatgttcatctacatcaatttaattgttttgtttaattgtaaattataaaattaaattaagttttaaataatttatgttatttggaagcagaaatctgaaaaaaaattcttgttatcttttcgatagctcataattttgaaataataatttaaatgtttggtcattattcttcttgttataacaatttaaaagtggtgaaatttttaaaaattacatatccaaatagagaattagagctattttctaatcatttggcggattataaaaagcccaccagaaacagcataacattttctaccgaatttcttttcagttcattcgccgaccgggaaaagagttgacaaattagcatatttctttattcatttttaagctttagcttatcaaacacaaccaaatgcacaaaatgcaatgaaaaagacaaaatgaatggaaatgtgtgaagattggcagaaaagggaaaggacaacaaatcggacaaataaatcataaaatgaaaaaatgtaaaattaataaaataaaaaagtgaaaaaattcaaaattaaataaaaaaatatatgtataaataataaatgaaaagcaaaaggattttacgttatgaagaaggcgtttcaatgaatgttaatgaaagattttgaagaaattccggcgataaaaaagggaaaagagtgagcaatatgagagaaagttagagaagaagacagacgcgaaaagagaattgagaaaacagagaaagtaaaaagagggaaaagggtgaaaaagagagagccatggcaagaagagagaaagagagaaatcaaaaatggaggacaatggacaaaaattgacggagatggcactgccacacccaatggtcgtcgtatcaccgcacaaacgaagtttcggtgccacccgacgccgccgaaccattggaaggccaccgcaccttaaaggggggggggggtgagaagatgtcagaagatggccaaattacattgggactcgacgtgttcgagtgctgtccaccaactgcccctccgttcccatggccatgggttcccgtgactattcgggccgagtctaaggactccaatgaaagagttgactgcgtgtccccctccacgttgtacatcctcaactcgtcgtatggccccgtgttcgggtcggtctccaagtcgttcacttgtgcattcagtccatcatctgttgaagaatgttgtgcagaattggtcgtcccgtcccttcttcgttccctaccaatttgcctccctcccctgggggtacactttggtggtgcccccgccgagtccgtttgtgtccaatggcatcaccggcttcctcaggttggataggttgtgccgtgtgttgtccgcctcgccgccgccctccacgtcgtaggggcgcagactgtccggcttcatctcttcggggcggaccgactcaaatggcggcttttgtcttctcgtgtaaacaaccattagcatgacaatgactgaagtgggaaatgaatgaccaattagaaggggagggattaattacgagtgagcagcagcagagaggccaagatcatgagcatggccgagttgctgatgcccagactggccacggcttcgcgctgattgcacctgctcagcctaccattcacgtccaaagacgcgtggttcccctccggacacacacaaaacgcacctttcatttgattatttatttattaattaattaatatttgttaatccgtccgtacctttccacgtgtccgcgcaaatttgcccaaggggacaaaactgagcgccgagtttatcgcaggtggccaactaaacaaaaagcagttgaggagtgcgtgggttcatcaccgactgcacctgtgagcatccctggacgacgcctttgacggtgtccaaacggacaatccccgggtttggcggttccctgcggtgtctgtgctggtgcgggcggtacctccgcactcgcccctcgctgtcctcctccctgtgcggtcgcgtgggtgccgccggtcccccgcccggagccatgttcagctgcagttcgttccctgccgccacgttcagagttccctcgacggtgctttcgtcgaggcgaaggcccatctcgaaactgttgtagcggaatttgccgatgcagccttggaagccctgctggccttgctgactgccggcaaagaaagtcctcgcgacaaaaagtgccgtttctttgtccggcaccaattctctcagcagtcggtactgaccatcgaccaaaagttggacacttaaaaaacgcccttttgacaattgcctttctcaatttcacctgctgggggttcggtgaaagtcgaccaaataagggacggagtgattcagccgaggctccgccaattccatttccattggcgccgaattcgccccaattgtcgacggcaccaaatcaaaggagccgcgggtggtgaaactaaacagagtttgaagggctaaaaggacggtaagtaccggttaatgtctagtttcatgtaagccggaggctgattttgcccaattgccgatgccaactgtcccattccggtagagccgggcaaaaacaacactcgcaggcgagactcttggtaagcgggttggacttggagaatgtacttgagaaaggagtcgcgggaagtgaactccacccaattgatcgggcgatcgcaccttaagaggtggtaataaagtgggtgtgtaattaaagaggggataattgaggtgtgggtaattaggggcggggtaatattatatagccagagagccttttcgactagccgcttacctttccccttcccagccgggctcgcattcgcacttcgccacctgctgatccatcgattccacaaaacactcgccatgtccattacaaaatgtgcttgctaattggactgacgcgctttccgtcaaatgattggcgcggccatcggccgacgaggaagccgagtcgccggcacaggaagagccccaaaacattgagcagtcgggcgaactctgttcggcatggattggacgatacaaatcgtagtgctaaaagggcaagggcttaagggaagtgccgaagtgttggcactcacgtcgttgttgaccaccaactcccgagtgcagcccacaaaattgcccaacgcgtgttctctgactgcgctcggatagtcctccgctcccgacagcggcgccagtccgcccaactgaagcggggcggcgatgttcagtcgctcgtcgtcgtccggcgcgtcccgactcgtcaagcagaaggccgtgttcggcttttgctgctgctgctgtgcaccgacctccatcgttgtgcagtcgtccaacactaagcgcaactttttgtgctgttggctgagcgttgcgcggtgaaatcggccgtccgcgaccatttgctcgacgaaaaggtccaccggctctttgccattgaattgaagcatcgcgtgcagcatgcccttctcaacgtacatcagcaaatagtcgttgtaactcaatgcgtccaaatgcgggtcgcccatcggtccgttgtacagaaggacgccgtcctgcttggtcatgaagcggagagaaatgttgagcgaagtgcaagctgaaagaacgaatcggtctcgaaaactgtgaaaaaaagggggggggtggcggaccgggcaacggtttgaaccatgcgaagccgcggccgtcgaaactgcgcgtgtttccctggcaacggaagccggtcagctgcgcattgcgacattcgcagctgagaaaaaggaggggggatttgttataattggcattttaacgaggataatactcacaaagttcctggccgagtgtcgtgacagacgcccccgttgaagcaaacagtccgatcgcactcactcttcggagaataggcgggacattcgcacacatcagccgccgaggcgttcagcccgacgatcacagttcggttggcttggaccacaacgccactcttaaaaaaatgatcagcaaccaatttaatgatgaaatgtccgcctcttacaatctttgatcagtcgaccctcctgatcaccattcagatgatgctaggggtcgtttcgtaaaagtgtcaattttaacagattttccgaaatgatcccccagcatgccatctgatcagtgatcacattctcccccctccctccctattcccattttctccctattcccccctccccttttttcccctttgccaatttctcttcgtccgtgcccttcacccttttccgtccgctcacattgtccgccctattctccgtacggcatccgttgtcgcatgtcgtccacttgcacatgtccacgcccaccgtcaaaatgcgcgccctcaacaccgcggacagcctctccctgtttcgcattgcgagtccgggcaaatgcgtgggggcgaggaattcgtcaccgatccgagcggagaagcgaagggccaccacttttgtggaaagacgttggagcagctgctcgtcgggcttcatcaaaatcacttccacaa

SEQ ID NO: 10919 - DNA, 1230 bp, Heterodera glycines
  misc_feature (1100)..(1100): n is a, c, g, or t
tggtggagatgtgatggatgatggaacaagtcttccttttactcttccctcttctcttacttctttagcacaatctttcattttagtttttctctctctctctctctttgtctttctctgctacctctctctctctctctcaccatttctctctgtctttctctgttacctctctctctcaccttttctcactcttctctaactttgatttgtccacacttactcgagtccagcatttccagctcgtcatcatccgactccgtcccactgtcgcacgtcggctgcgcttgcggcaccgccgactccgtttgggcatttgaccgcgtgcatcggtcgcttgcggcgatgtttttacggatgtcctccatcagagacagttgagctctacgagatctctaaatgaataaaaaaatgaaaagaatcgccgccattcattcggaattagccaaaactgacagtgttcggcggagagtgtgaagagaaaccgccgcttccgtccgccgttcgttccgctgccgccttttcgttcaaccgcgcacttcgccgcatcggtccgtctccccttccgccgctcagtggcggcgacgatttgccggggggcgattcgctgccgtcctgcagagtctgtcgtttgaatttgctgaccaatttgccgagcatttcctccaaaacagcggacaaaaaaggttttgaacgcaaacattttgcaacagcactcactaaattctgtgctccaacggatcacttattcttttcggaatattcgcccgtcggttttctgatcggctcagaataattgtggcggacaatcgttgtcaatttaaaaatgagtttaagtagtgaatggaatgagttgggattgatggaagcaaagcaataaatgaagaaaaaggggcagcaaaagggcggacagagagaaacggagggaagtgacggaagaggaagaagaagaggaagagcgcttaggtggtgactgttggagaatgatgctgaaagcgatgggatgagaagcaacaacgcgcagcacagaaatgggagcggcgagtgacggcgggcgggcacttttatgccccccccccccccgccactcattgtcaggngatgtgccgacacggaaattaatttcgcaaatattccggggagaagaaaaagttgagttcgtcaggggggggggggggttgtctcctcatataggaggggatttcagaattgttagctgacactatgcaa

SEQ ID NO: 10920 - DNA, 3149 bp, Heterodera glycines
tggaaagagcccgaggatccttcccatctttcttaccctcgtacagtctcagttctttgtttctctgcccctctagtatttttaatatactgctgcactcaattggcgtgaagctagcacatgggtgtgggcggggactaatgcactctactctcatccccctctccctgtctcattcttgccttctcctcatctctcccctatctctctctctttcctctctctctcctctctctgtctcactctccccctcctttctcctccctctctctatcctcctctctttctcccctttctctctccaaattctttctctgtctctctcacactctcccctccttctatcattggatactttgtgcaaatgcctgacagttgtcccccctccccccccctcctttccccaacaaaatctcgggttctcccgaagctcggcctttggcctctgttgaattggcaaattgccactttgactgcgtctggccggccgctcttcgccccgtgcccttcgaatttcccgccccttcccccggcccgcatccccccccccccccgtccatctcattcaattcgttctctgccgattagcgtttcagcgacaataaaatgacgcgagaagaggcgaacggcggtggggggggggggaaggcctttcgtcgcgttgttaacacttcgcaagcggacggacgacgagaaaagggggcggagcaaaaacagtttttatcagcagcggaaaacgcgacaaagtcaaaacactccgtcaatggtcgccccttttgccctccttctcattttgcttcgttctgttcgttctgcgccacattttacccttcacaaataaatgcattttgaaagtgggaatttaagagcaaaagggcaaagagcagcagaagaagcaaaaggttggaaaagcgagctgatgagaatgggcaagaacgactgacccccgggggaggagggacaaatggacgacggaaggggggacaaatggacgacgggaggggacaaatggacgacgggaggggacaaatggacgacgggaggggacaaatggacgacgggagggggagggggacaaatagattacggacgaagagcccacgcgaggaatggcaaacgacgaaacaatgcatctctctctctctcttcccctttcttatcagttgaataaaagagttactttttagaatcggtgagccgaggaagggaatcgtcaaagaagggaaacggctgtatgctaatatagtgatttaaaatgtttggcgttttgttgttttatcttgtgttatttttgtttgtgattttgtgtgatagttagttgtcagttttatgcagtcggcagtttccctattgattgtcctcgccctatttttatttggaattaaacttaaattgtcttcggcattgggctgtattgttttgtgcttgctttgggctgttgtacttttgctgtgagctgttcaacatattaaagccacaacaacaatccctcttttttatgactgctgtactttgtttctttcaagcttatccctttctttgaaatatgccatagtcgtggggaatggcaaatggaaagtgccgggactgagatggacggaccattgtgaaaaaccgttaatttccgctgcaaattactccacctcttatttttcctcattaaaaccctttccttcggccatttctaacctaaacaagctctaacgagtatgcacaccaaatttgggccctgttttcagcttgacactttccctgcggttgccaaattattataaattgcgccgtcatttgcgtgctaagcgctaatacggccaaaaacgtaaaaagagaagaagcaggactaaattgggaatgggtgggcaagggcggaaaaatgccaatgccaatggcaaacttaatagaagagacgcgcgaatagattcaatgagataaacatagacacaggaaaatgttaaagaagatattcttttttgaattggcagaaggataccaatttattgtgttttaaaaatacaaaaaataaaattttctttaaataaccgattaaaatcaaatttatttccaaaaagcaaaattcattaaagtgaatgaaagaatccttttatatgacatattaataatttacacattttttggtataattatacaaatgtaatttatttttctataattccaattttccgatcactgctcacattgctttcctttctttgcaaattataaagggaaggaaaaaaggaaaagccgcataactcggcgcacatatccattcagcaaaaacggtaaaaaattcacataacaaaccgaggtcaatctacccacccaccaagtttcatcccgaaactccacattcacttgggggcccctcctttgtgagggggtgagggatttgatattcgtaaaggtaaattctgaagccctctacacaccgatgagattttatgcaaattaacggccgttaaaatcacttcccttgggctcattatttgggccaaataatgacaatttttgaggattttccctaaaaaccataaaaaggctcattttgaaaatttagactcatcagcctctcaaaaaccacataatgaggttaaagcctcacatctgggaaccctggtaataaatttataaaaatgtaaaaaaaaattagaaattatgttattcacaagtacaatagccccaccgtctgaggccgcgaagcgaccgaatgactcaaaaaaatttaaaaattccaaatcgcttctgcacccaatggaatactatgtagcgaagctccaaaaacacgcagcgctttatcccagctaaagacccgactttctcacgcaccgatagttggaatttaatttttcgggcacaattgcgtcagtgatacaaataattttaaaaagataatgggttaaaaaataaaattttgaaaaattaccaaaagccgtaaataatttgtaagatgcttatgtatttctcaaacaaattgtgaagaaaaggcccagcggcggctccaacatagtaaatttggaaacttaaccaaaacaaaagttttcaaaagcaaaaacatatttctgaaattaaataatttctgtttttcgttaaaaattcttatatttttttattcaaaattttaaaaaatggatttttgctgtgcattgagg

SEQ ID NO: 10921 - DNA, 1309 bp, Heterodera glycines
tttcttcccaattttgttgtttgcaaataattgcaataaattgagagaacgaccaccgtgacccaactttctttgctccatttttgaatccgctccatccaattattaggccggcccttccgttggccaattttccttctctctgtgcgcaaaatttgtggcatggcactccaccgcaaattcactttggccaatgccaatgccattgagacggacgcggaaaagagccgaccgaaagtgtgccaattgcgccaattggaaagcatagaaccgacgcattggaataaatgaaaaaaggataattaaaaatcgaatgcctaaaaattaaaacaaagaaaaaaggttggccttcgcttcggaatccatcccaacacgaccatttttcctttttttctctccccatttgggttttgaaaaagaaaggagccgtagggtcaagaactttgattggaattgaatgaccaaatttgcattttgagtcatttttacggctgtgccgccgttaaacgaattgttcagaaaaatgacaatttttctaaaattattcgataagaaaaataagcaaaacttagaaataagttcagttgtagccctaattatttttattttaagcttaaaagatttttcatttattggaatttttattttattaatagaatttttgtttttggtttagaagttatcattaagaaatttgagatcatttgaactataaatttcatttatttttaaaaatctctgatttattttagataaccgaaaatttggaaaaaattcaaaagattacttttgaagcaaaaaagttgcgaagaaagagggcatttttcaacagaaccagtcttatttatggtgctgcttttggggatttgtgtgaaaagacggagacaaacaaagatttatggcctttgtcataaatattttataaactgaaaatggccaaatatatttttattcgaaggtttttcttttaaaataaaaacgataaatttcatttatttttaaaaatctctgattaggcaaactttaattgttaaaactaaatttgtcaaaaagtattaagagttcagcattatttcttattgcatcaattccttatttaatgtttactaaattaattttctttaaaaatgccaatcaaattgttccaagaaagatttctgagaatttctcattttatcgaaagtgtaatttaattttcattgttaatttggcgtgagtatggcttttgtacataaaaaatgaattaaaataattggtcataaaatgtaatttctaacgataaaagtaatttaataatcaactttaagaa

SEQ ID NO: 10922 - DNA, 3600 bp, Heterodera glycines
tggtttagaagttatcattaagaaatttgagatcatttgaactataaatttcatttatttttaaaaatctctgatttattttagataaccgaaaatttggaaaaaattcaaaagattacttttgaagcaaaaaagttgcgaagaaagagggcatttttcaacagaaccagtcttatttatggtgctgcttttggagatttgtgtgaaaagacggagacaaacaaagatttatggcctttgtcataaatattttataaactgaaaatggccaaatatatttttattcgaagttttttcttttaaaataaaaacgataaattttttattttttaaagatttattaggcaaactttaattgttaaaactaaatttgtcaaaaagtattaagagtttagcattatttcttattgcatcaattcattatttaatgttactaaattaattttctttaaaaatgccaatcaaattgttccaagaaagatttctgagaatttctcattttatcgaaagtgtaatttaattttcattgttaatttggcgtgagtatggcttttgtacataaaaaatgaattaaaataattggtcataaaatgtaatttctaacgataaaagtaatttattaatcaactttaagaactttgtcatcaaaaatggacaccaatgacagcaacataaataatacggtaaaatttcagaaatattctccgaaaaattttattgccgtacaaatgatggctttaaataagtaattggtttagatgtacctcaagttccacaatgtgtacccgtgttggaatttcatcattgccgcattggccataaatgcggtggcaatgttcggaatggtcagcaacttttccgtcatttgggtgacctataggacaaagtgggtattcgctttaaaatacataattcataaaaataaaatgactattcatttgctaattaatgaacaattactcaattgatcattctaaaatgccttttttaggactctccgcggcactgccaattttctgatcgctctttgctccttcttcgatatgcttcacgagcatggccatttgctgttcctttacactgcgctatctggccaaaatttccttcccatctcttctgcggttcgcttttgctccgtttccctttttggcgttggcggaattgccgtgtccattgccttcactgggctcgatcgtcttttgtgcgtcctctttccggcattgtaaattttaaactaatttaaattcattaatttatcaaatatttttcagtccaagacgagtgaaaccgttgccctatctcagtgcgatcactttgctctgtttggcttcttccgtctgcactttgattggttactacaaaaaaaacaatgaaacgccagagtttatggtcactggcacattctccgatttagtctcggttggcatttttttgtaaatttattttccaatttatcaatgccaatgccacaggatccgtcgcttcttctgtatgggttcattttgtactcggttactgtcctcatttatctgatcactgggtttgtgatcagaaagagagcgagtaaatccgtttttaaaatattttaatttgaattttaaatttcattttctgtcatttttttatcagaaaattcctccaattcgtcgtcctcttctgctgagctgataaatcgtcgcattttccgctctcttctggtcattgttctgctgaatgttggcggctcttatgtgaacctcggttttctccttttcatttacccattttttgacacggaaaacccaattttggcgtggaaagttgccatgtttatgggcattctgacggtcaatgtcagctcggcgtccagtgggcccattttgtactttacaaggtaacaaaaatatataaaataataaatttaattttgaaatcagacatgttaaccaaaatttccgtatggttgagtctcagacaattttcctaataataaataactttttaagtcagctaatttccaaaaagagttcaatttcatcctaacccgttaaatttgcatgatttgttgacattaaaaattttttttgatgagtttgagtatttgggacttagaaaatatagtgccaaataattgaaaatgtttaaatcaattttaattatattttttcaattataaattattttcctagaaattataagcaaataactgaaaatgttgaattcattaaaattacggtattagcaattcagcgtactgtagtaaccagccgacaaacggtgcttcaaaaatgaatggaagtgcggcacggtacttcaccgtaaaaactaatcccacaaaagaaaactacggtaattaacccacagaaaaaaaatcgctgccgcaatttatgcgaaacttttatagactttatttaattttaattgaaaatttggcattttatagactttatttaatttgaattgaaaatttgacatttgtttgcttttgttataatcaataaattattgacaaatatttttatgcattttaaatgaataggcatgtacatatacatattaaaagatgattttaataagcaaaattgccaacaggtcttcatatttttttttgtataaatgaaaagcattttgttttttctcttttttcttcaaattaacttttcattttgtcaaatcattcggccaatgaatgaattcggcagtcaatcaacccattcgtatcatatcacacaggtaattaattatttgtattattagagacaaatatcgaaatgccaacttttatcactgttaaaatttaattagcaattagagcccgggagggtccgtcgaatttttccaatgcaaatcaaataaattttttaaataatttttttccgattttctttcgaatttcgacccccccccccccctccgctttctgtcgccgctccaaaacgatcatttgcacagatttctccgcccggcacttaccgtgtggtgatgtggtctcaacttttgctcggcgcaaatttcttcggcacacaaacaaacgaatgcaaagaaagtgaaatatttgccaaaatttggatggggcgacgggaaaagaagatggttttccgcctggacattcttcagaaagaaaactttgatgagttggcaaaatgttttgctcacttttactcggtcataacagacgaaaatgggaaatttttgttggcaaaaaatggaacattgaacaaaaaattgggacttttctcaatgctaatggatggcacaataaatttgcatttgataccaatgaaaaaggaaggggcaagtgatcctgattattttttaccaaattttgtcgggtttaaattaaactatttaaattaattaaattttaaatattgaaattttaatccttcgctttttaccattccatgcccttttgaagatggcaattgattttggtgattattggccaacctttcccttccaacaagtgtattccttggccaacagaacaccaattgacactttgtgcacttttgacaatttggacagtcggcattgtcttttgaaatactttaaagcatttaatgagaaaaaagaaatattcgcaaatacacttaggcattggctgttcgggattcaatt

SEQ ID NO: 10923 - DNA, 981 bp, Heterodera glycines
agaaaaactgcattaatgaaacgactgcgtttggcgacgacacaaatggtcgacttaatttgggaattttgccggattaatcggtactttttatacgctcatcagtcagtggaagatcaaactcaggtgaatttcattttttaattattgtttggcattgaaaatgtgaatgttttcttttaaaagaagtcaagtgagtttgactactccttttgtgaccaatggcctaccgtatacaaaaaatcgttacaatacacacaatttcctgtcgttttggatgcgttttcaaaatggcttcaactctcatatgatcattcacatgggaaaatcaccgaattgtaaggcccaaaatggaacaaatggcaaaaattaagcctaaaaagtttccaaacttgaaagaaataataataaatagagaccagatttatttccataaaatagtgttaaaattacgaaaaattttcaactttctaatcgaaaagcgaaaaatcattttaattcacgaaaaactaaaatagatataaaattagtatttaaaatttaatggtaattgtgagaaaataacttttattttcgatgaaaaattatttaaatagaaattttgaacatgaaattttttttagacaatttttgtattttttttaaatttaatattttttaaggtttcttgaaatttttgatttttcatattaggtggaaaaaagaaataagaaataaaaatgcatcatagaagctttaaaccagctaaaatactatttaattgatttttagtaataaaaaaataataataataataataatatggaaattcatacaaatccgatctttaacataaataatttgaaaaacattctttccttttaacattgggagtatttcaaacattaaattatttgaaattttaatttaaactttgactaaattcttcgtccatttacgttttgacagaattcttcctccactacaaaattgtgaagaaat

SEQ ID NO: 10924 - DNA, 2252 bp, Heterodera glycines
ttttatttcccttaaaattgaaaaattatacacaagttatgaaaaatagtcaatattactttgcgcaacatgtccgggttatatccgcgtttgaacaattcgcggaacaccagcaccatatcgaagcggccgccaaagtgagagaaggcataggtgtcgtaggccaaaggcaagtcgtttatcagccagctgacaaacgcttccaatgggttttccgccaccacttgcttgttgactgttgtttcagtgaagcggcgttgacaaaaggcgactgtacgacttggaccgcacacttcacagcctcccgatgcctctcgccagctctcattttcaatgcagtcggggcaagcgactcgtgctgcgatgaaattcggcaaatgctcacgcttctcaggctttacagatggcgtgtgctgcatggtttccaagtcaaatgccacgatgcggtaggggtcgcgttccttgggctcaatgggttggatgtagcatccccgctcggtgttgtggtagttgttgcacatcttacagaagcgttcaccacacacatgtccttttctgcccttctgagtgttgtcgtgcacatcccaaacagcaccacaatctttgcattttttcgaccgcttgcagtagcctgactgcagatgatgctggtagcagccgttgttggtgaattttttgttgcactctttacactttttgatgaagccggtggatgatggacatggaaaagctggtccaacacgtgagcacagcacacagcgcgctttacatgttttgttgtgtgttgacattttgtcgtatggccgttcacactccaaacagtacggtttgccgaacagaccaccctgcttctggacaccatcgaaatggtcctcattgaagtacaacagcagcggagtgtcgtagatgttgtcaatgtacttgtacagcggcttatactgtcccaacgatccaaagatgaacacagcaaagcggtgttgtcgctgcgtattgttccaatggtcaacgacgtgaggcacaaaagtgtccgcgtcgtacccatccaagtccattggtgcattaacctgctgcatgagctcaaccgcatcatgatgaagttgtccctgctgtccttttctgtcgttcacatagtcgaaaaacttccagcgaggccaattgcatgttttgtcgaccattgttgcctgcagcgcgtagaaaaggcagaagtggttgtcgttattgcgaattttaatcaggcactggtcattaattcggtggtgaacggccgttttgacagggcgacgagctcccccattgacacgacgtttggatggcagtccattacggtcgagagtcgtgatggtgacggtaaacggctcaccccataacgatacatttttctgttgtttggactgcgccacttttttgaactggttgagaatggtgtcgagagtgttgtttgtcatttgtcgtatcgggattgggatatctccgccttccagcagaggactgctgatcatacagccgaggtgtgtaggttcgatgtttcgctcacggctttcaacaattgcttcgtcgatgcagtgttggaaaatcccagccaacaatgcctcaggcgtgctcggcaaatccgtaatggtgaactttgacttgactttgacgtaatggaatttggccatgtgctcgatgctgttctccaattttttaacgtagtcctttgcctgttttgatgttccttcgccttgctgcaccgatccaaggaagtgtacgacacccaagagttcattgatcaggaagccttgacgtggctttttgggcgcggagagaatatgatcaatggaaaagttagaggagcgttttcgtggttccatttttttttaatctgagagtggagtgaggaggaatgagtaaaatctcggtatttatatgcgagcgccggcatggaaatggcgtgaaatcgtgaatgaataataaatatttgggcatggaaaatagtcaaaaaacttaaacaaactatggcctgaagagcagcacaccgccacccatgaagcacaagacgacagggcacctaaacgactcgggaaattagtcaagtcaagcgaaagacctcaagccctaaaaggcaaattgctgccaggataaacggagctttttgtaatttaagctaccgccctggttaacagcaaaaaatatttattttaattatacggtccccaaaatcccaattaaatgatacggcccccataaagcacaagacaagtgagaggaggaga

SEQ ID NO: 10925 - DNA, 3358 bp, Heterodera glycines
  misc_feature (107)..(107): n is a, c, g, or t
gaaaaaatcgatttttttgttttcggggcagtccccccgacccgattgcgcccagatgtatggggagaccgaatccttcgggaatagcttccctatagcctgtactntaattctgcgttggatttttgctccccataaatgtttgagtaccccaaacggacacttgaaaaaatcgatttttttgttttcggggcagtccccccgaaccgatgcgcccagatttatggggagaccgaaaaaatcgggaatagcttccctatagcctgtactttaattctgcgttggatttttgctccccataatccacgcccacttttgggtcaaaattattcctagcaagaaatcgaaatcattctttattcaaattctagaaaatgaaacgcaccaatttcaacaatgctcttccaatgagtgagaaaaagcccaaacttcgtcgacgcctgccggctgaattgaacagcgagctgatcagtttcgtgcctttgatctgcctatttgccaatgtgaagcggactccaattggtcctgtgtgctaccaattcgagtgttttcgtagtcgacgccaaaagaattttgaatatttggtaatttcccctttttttattttattacataaattattatagaagggtgttattgcattattcgatgtgatgtttgaggagaaaaggacaccgaagaagaagaaagtggggagactgcatctacaggaagaactgccgcatgacctcagccgaaatgagctcctgcactacctgtgctacggacgactgggaacgaatttgttcgagacttattttgtgatgagccaagcaacaaatgtaagcgaaaagttttaaatttttaataacaacacaaaatttttagtcaattgccattgggaatttgtttgggcttctgctcgattttgcaatgagctcaccaactccttggcacatgaagcgaccaatttgctgtggaattttcttccgtcaacatttgccgtggattctgcaacaaccgatgaacgtaatgctttctcatggcttttttccggaggtccgaagtgatggttttgaatttttttggctgttcaacccacacttgaaaaagtatgctgggtatgtccgaattctccctgagcttagtcaacctgacaatttgcattttttccttagcattttctaagcatttatttgatcattttattcatcattatcattacatacagatcggaatttgtcgatttttccattttctcaataaattgttgaaatgaatgaccttgtgacatatgatacacaaaaacaatacagtgtggggcacacgttgacactaattgggattgatagggacgtatattttttcttagacccatcggaaacttattcaggaatgatgacacaatgacagatggtattttttgggctaagctgtcataataaatcactggttcttccattcccttcgcataaattgcacaccaatgagaccctcccttgttatgtgggtcccggttcacaattagcgctgcgggatactgtagagtgaccggaggcggtaattgatcactggcgaagcagccccgaaagactcgcgcggtcccccggttttcgttcaagattgatgtgatttgcacgctgtccattcttcatccaaaaaatagagcaaagttgatggagaaccaggctgacaataagcatcaagtacaatgcaaacaccgcccagcaaacggcttgttggaataaatttccctcttctggtcggtctttgcacaattggatgagtggcgtgagaccagctgatacttgctcttcaattaacttgtcactttttgggggagaggaggtggtggttgttgttggtgtgattgtagacggaattgttttagttgttgtcgatgtaagcattgcctttcttcttatatattcagaatactcaggaatttcctctcggcatgacactacgggaagagaaatccgaagaaggaataaaataacgccaacttttttggaatacatgtttattattgcaaaaaatgaaaacaaaagtgccttaaatagtgatgtcagtgctgatcgatcgatttttatccaacatcaccagcgagtcgcactcgcccatcaccaccagcattattcctccaacgggcaccgcctgattaaatttgatgctcactgctgtggtcccgttccttatcagatcaaaaagcgccgcttggtcgtctccactgctcgtcaagttgaacacgtaaatgcaatgcgtagtgccgaattgtgctagtgtaatcccgttgctttccgatgagttggagaatcccaccgcttcgttcatgtcgttgaaggggcgcacatactttccgtttgggtagtccaagtcgtaggctgcttgagggtaggagcgcccattggcaattatagaaatttcacgcacattaaatggctgaaagttgaaggggctgcgtgaaacggtgccaacatagtcagcattggccaccaatcccattgtgatacgccggggaatttgatccatgaacaaattagacgtaaattcaaaacgcccatgactgatgaacagcgacttcatcagcgttttcctcactgcatatcgtgccggcttcaactcaagttttcgtgcaatgtccaacgccaatccgtccatcagggacaccttcttcacatacattttcagaccgacaacttcgaaatggtagcgagtggctgcagcaacaccgggtggtgcgattaggacaaagtcgttgtcgttgggcaaaatttcaatgtccagctcacaaaagttgatcaagtagagaggctggttaaacaaatcggcgtcaattttggccatgaattgtgctgttctgctgcctacaaacaggttgcgtcgtgcagtgcatccgtctcccacctcaagcacaccaccagtgtcacggtagtaaccggcagcattcaaatgcgagtccttggccgctgttgaataggagagttcgtgtgaaaaatacgatttgtaggccatcagagaatttgcgttgaacacttcacggccattgatgctcattttgatgtttcgaatgaatgtgtgtccaatcagttgaatcggagcaacctcatcagctgcaaggtcaaccagttgaccatttgcattttccttacgaattcgaaactcggataacaaatagcatttggagagatcaatataattttgactggagtgaagcttgaagtgatagggggtgtcggtcagggggttacttgggagcagctcaaacactttggaggatgagacactgacgttagaaggggggatgcggaaaaagtccaaggcattatgataaagggagggctgtcattgtcaattttgtggaatgccatttagtaaa

SEQ ID NO: 10926 - DNA, 739 bp, Heterodera glycines
atgaatagggccgcaacttttagtgactaaaaatctcgaaatagttaactaaaatagtgagtaaaaatgccaaaatagtgaaaaaatagtgtcaaaaagtccggaatagtgacgaatagtgacataattttcagccaaaaattgagcaaaaattcaactagttgcagttgaaaatgagtaggacagagattttgaagggcaaaaaacccaaaattagtaccgaaaaaataattttttaaattaaaattcttgccaggaaaatgaaaattttttcatttcttacgagtgtattttcaaaaattttcgaccgtttcttaggggtgtatttatttgaaaattttgaggtcgattcttaggggtgtattttccgtttttattgcatttttgttgagaaattttcccaaaaaatgtcgaaatagtgacaaaatagtgacgaaacgccaaaatagtgatttttaactattttagtgacgaaacgccaaaatagtgatttttaactattttagtgacgaaacgccaaaatagtgatttctagtgacgaaaagtgacgtccaaatgaaaaaattttaatgcagaaatgcgttttttgagctcctttcttcaaatcaatcgagcaaaaaaaaaagttttttcactagaaatcgcggccctatttatgtctatgttggaattaattcattaattgtgacgaatcgatgatttaagttctggtgatataatggaggggagttaactgtgc

SEQ ID NO: 10927 - DNA, 2025 bp, Heterodera glycines
ataaaaatgtttgttttttcgattgcctcgcatttgaaacaaagtaaattttctaacgcaataattctgcaattattcttccctttgtgacgacatcattcggaactcggccaaattgtgctaattgctgccaaaaatgaaccgacggtaaagaattttaaaagtcaaaattcatcatttatttaactaaactgttttccataatttcagttggatttgcaacgacgtttggatggacattttcccatcctttgaccgtcctcaacttggcctcaaaatggcattgctttcgccacgtttcaatgcgttggtggacaaacatttcaatggcaaaagcgaattgacaatttggagatcaattgaaattcacaagggcaaaggacctgaaccgaaactatctgtgtggatggatgacgaatctaacaatgttgtggaatttccattgcccgaccgtccgttgcccagcaaaattcgctttgattccattctgattaggtaagtaaaatcagagctatgacaataaaagcattccttccattttcacagttacatcgatcacttcgcatttttgttcgtgaaatttggcccattttttcgacaaacattcaccacttgggcttttacgatgatgatcatttggacaatttgtgtcgtcgcacttcgccgacaattctcaccgatcttaaccaattgatttcaatcgattcatttggtctgttgcccgctgtaattggtgatggttttgatgtgccaaattcaacaatttctgctggccaagcattgtccaaatggttgcattctccgagaaaagatggccaacccaagctattgcattgcaaagacattaaagaacaagcgaacttcgattggatcaacaatttcaaggaggtgtgtggtccggggggggggagcttcaagttttttattttctgaaatcggaattccgaccccaaaaacgtcgtaagtcggaaatttttgaaaatttccgaattttatcaaaatttcggaaatccgaattctgtgccatccctgctggtgtggctccacatttttggcaaatgactgatttttgttttccaatcaaattgcttagcattttctccgtgccaatgccatttcttccgtcagttaccaaattcatttttatgttcgtgcgccgtcaatgccaatggtgccatttgaattgcttaacgaatggacaaaggaaaagctgacattgaccaaagcaaatgaattggacaacagttggataatgaagcgatgtaaaattattggggagtccgcggcggttcagcagcagaagaaagatgataattgggacaacaattgtaacaatgtgttcatttggcttgttgctggcactaattgcattgggtgagcaattaaaaaaagcatttgatttttatccgaatttgaattttgcgcttaatttaggccattgtctccgccaccggaagaagtggaagaacaaacgggacaaagcatcacaaaagggacgtcttctgctgacaatgagtgacggacaaacgaacaaaatcaatgagcagacgcagaagaaatgaatattaattgaaaatgaccggacgatcataattcatcagtgatcaagtgcattttatgaagaaaaacctctgaatttcggtaaataaatcggacgcataaaaatggcaaaaaatgtacgaaaacataacaacttagagctttaccaaattcatttttctgttcatgtgccgtcaatgccaatggtgccattcgaattggtgaacgaatggacaaaggaaaagctgacatttgccaaagcaaaggaattggacaacatttggataatgaaacgatgcaaaattattggggagaccgcggcggttcattgggaagacggaaattggggcaacaattggaacactgtgatcatttggcttgatagtgacactaattgcattgggtgagcaataaaaaaaggcatttaattttgtttaaataattaaaatttcgcttaatttaggccattgtctccgccaccagaag

SEQ ID NO: 10928 - DNA, 2153 bp, Heterodera glycines
  misc_feature (33)..(33): n is a, c, g, or t
  misc_feature (2089)..(2089): n is a, c, g, or t
ttttgtgatttttgttttccaatcaaattgttnagcatttctcgtgccaaatgccatttcttccgtcacttacgaaattcatttttctgttcatgtgccgtcaatgccaatggtgccatttgaattggtaaacgaatggacaaaggaaaagctgacattggccaaagcaaatgaattggacaacatttggataatgaaacgatgcaaaattattggggagacagcggcggttgattggaaagacggaaatttggacaacaattgtaaccgtgtgttcatttggctttcttatggcattaaatccattgggtgagcaattaaaaaatggcatttaattttgtttaaatagttcaaattgtgcttaattaaggccattgtctccgccaccggaagaagtggaagaagaagcgggacaaagcatcacaaaagggccttctgctgacaaatgagtgacggacaaaagaacaaaaacagtggtgattagtggaagaagaaatgaacataattcatcagtgatcaaatgcattttatgaagaaaaacctcaattggtaaataaatcgaatgaatgaccgctgatcacttgggctgggacaaatatttgttaaaaaatgcagaaatatttaaataaacatttacgaaaaaatatttttctgaaaatttaatgtcgaatcttaggggtgtatttttcgtttttattggatttttgttaataaattttgggcataaagccaattaggcaaaaatagggatttggggaatatgtacagtttgtgctccgatacaaattttttagatcgtttaacaacccacgcagaacacaaattttgtcgaatgaatgaattttccctaaaaaaatttgacaattatttttcgggattttgacgggggatttccgacatcaattagcaatattagcaccagcaaaattaaacagtttcgatttgctgctgtttctctctcttttctcctcctcatttttgcgccgaattttccttttcctctctttctcttccgtctctcctcctccttccccaatgctatttccctccatcttttccacctctttccttgtttctccatttttgctgttgtctatcttcatctctattcccatcaaaatttgctgctgttgttgtactgcttgaacttcttgtttttgttgctgttgtttttgatgatattcgtaattgagttcgaaaattagcatatgcacttataacggaaaattgaattcagaaaaggcggggaaaagtgtcaaagcaaaggaattgggcagttggataatgaagcgatgcaaaattgggacaacaactgtaacttgtgttcttttggcttttagtagcactaattgcattgggtgagcaattaaaaaaaagcatttaatagttagtttttaagttataaaaaaaccgcaaaatggggcaaatttaattgcattgcaaatatttatttagtgggcgccgccggggggggggggaggaacagcgccactcagcagagatattcagcagcaggtggacgacggcgttaatgccattgtcaaaatgtgcaatttgtccattaaatgatcccgaaacaaatactgctgaaaatccctgaatgattttggtgccaaagcaaatagtatatgatggaagattaattatcaccgaatcgcggaaccaattagggaggtcattagagtgtttttggattttgacgcatatttcgcattttgtcaatttctggattacctaattgaattgttagagtaaataattttgaatttttttattaaagaaatttcttaatggaaaaataaaatggttaaacttaaattgttttcgttttgtctaactgactaaaatttccgattaaatgtgaaaaagtgattaagaaaaaaggtaaataaaattgagaagaattttgagatttattagcagatattttgcctggaattaccaattttaaaacataaaaaaataatttctcaaaagattttataagctttagctgattctgatcactttcggcctcagaagagcataaatcaaatcaattcatttttgcttttcactttttggttgaggattaggttgctttttcccnaaagtgccgttgtgcgagcaaagaaaatgccgtccgttcccattcactggcagaggagggcatt

SEQ ID NO: 10929 - DNA, 1035 bp, Heterodera glycines
ttgtcttagtctcattaaaacggaaaagggccattttttccacaaaaatgcaaatgaccaaacgaagaactgcactttcaactccaaaacaaggtaagaacccataaaaaagataacgcgaagaacggcgaatgcaaatatagtaattattctcgagtttcgctattatcacaaatgtttggctattgcatatcaccaattttttgttaaggaaatgattggactttccgctcaaactgcttaaaaatttatacaaatttgaatttttaaccatctttgacaaattttttatgaaataaagtaaattttgctgttaccgtaaatccgctatttgaaggcccggccttctaatggacccatcaattgaatatggcaattcaactaatttagtaaagcctcgtttcttattcatttgttcgaataaaattatggcatgaaaaaaagtaatgatttgcggaaaagttttcacgcatattctaattttagttacactagtgtctttgcgtgcgatgagacagctgtttgagtgttttaaggcggacggagccataccaaattttcatgaaaattgataaaattggcaattatttacaagatgagagagaaaaagagaagagagcgaaagaagtcaaaaataacaaaaaaaaagaggtctggtagcaatttatacaaatttgaatttttaaccatctttgacaaatttttttatgaaataaagtaaattttgctgttaccgtaaatccgctatttgaaggcccgggccttctattgttcaacccctccaaaaaggggcttttaattggagggggccttctaccagagaggggccttcaaatagcggatttacggtaattaccaatatatttgtggtttaatggttagtgcttcaacactaacagtatttcttgttaggagttcgacaccggttgacgttttcatttgaatttatttttatctgattaatgcagggtttctttatgttcttatttctgagaaatgttctgattttagggctaatttcatccaaaagaatga

SEQ ID NO: 10930 - DNA, 2832 bp, Heterodera glycines
  misc_feature (2809)..(2809): n is a, c, g, or t
gtcgctgatcacgaatctgatattcgttttgaccaatttcgaatcccggattcgaacaaaaagtcgaaaattcaaaattcacttatgttcgaatctgtatagaaaatttcttttggcggaatcgaaaaaaatgttattcacttccttatttgctgctcaaaataacatttctaaaataccctgatttttagtggctctcaaatgttgacggtggaccatctgcgaaatttctcgtttccaatgtgcacacgatgagcgagctgaatatggtcggaaattgcttgaaagggtcgaggccaattctctcctttgacccggaatttgatggaaaatcgcacttgaggctcattaaagaacttctcgtcaacgtaacatttcattaacaaatgcagaagtaattgctgtaatttagacattcaaaacaccgaatcatcacccgcgaagtcagccgttcattgaccatgtgattaatttcgcagtgaccgaagatggaaatatttggtaattgggctctgctacactagcagtccatccatcaattcgcttggtttcgtggaccataacttttcttcgaatgtcgagaaccattcattctaactttcatatcagaccaacactcgaatgatgtcaaaaacataagggttgtaaaaatatggtccacgaaactcagagtgcttggatgattggacagtaaactgcaatagagccggatttacttgcgatgtaaataacaagaattgattccacaggttccgaaattatcaagttgccgaaaataatgaactaatggaaattggtaatctttctattgctagaaaaaaagaaaaaaaaaatctagttgaaaaattgtgtacgaattttcatgacaccatttttaaggcccgcgatttgtgcttcaactgatccgtttgtttgacaattctttttgcggagccgtcctttatgacaacccgaattaccaaacgccaaatgcgatcagaagacaaatcaaattgcaaaaggccgctgaatttaaacaaagacaagggcaaagggaagaggggaaagtcaaagaacggatgatcaaagaagtggaaatggaagacccactgggggaagtgtttgacacggaagaaaaaatggaggaggaagagaaaacggaggaaaaagagggaagaagaagaagagggtgaacgcagcaaaagcactggagaagagaattctgaagaagaacaaaaagaaacggaaaagcacggggacaaagtgatgcaaacattggagcatttgtcacctttttgttatttgttttactaaagcaatacaaaacggtcccccctttccgtaaatttcaaaaaaattttcaatataatgacgttaaatttaattttacatgaaaaaatttaaggacctacatttaacgaaaatggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgtaaggcttcaaaagccgagcgaagggcgcgtctctttccatcttaaggagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatccgtaagcattttttagtcattgaaagtgcccattttcgcctcccagcagccccgtgccttttctgtgctcgatgccttgtccgcttctggtctgcgcgccattcgcttcgcgttggaagtgccaaatgtgacgcgagtggtggccaatgacttctccgagaaggcattcgaagcaatccgtcggaatgtgcagctgaacggcgtccaggacaaagtcgaggcggtcttttccgacgcaatgtttgagagacgacttttcggcttaaatttcgcttggatttgtgtccctttcagcgatttgatgatggcacatcgcaaattcggcaaaaggttccacgccgtcgacttggacccctacgggtcggcgtccgcctttttggacgcggcggtgcaggcggtgatggacggaggtgagcaaaatggaccacaatacacttggaatgagctttttaaaggcttactgatggtcacttgcacggacacggccattctctgcggcaacactcccgaggcgtgcttcaacaagtacggctcggtcccgctgcggcacaaatcgtgccatgaattggttcccccggccctcgctgcccttcccatgccctcccttaaggcccttcgcattttgctccgtgccatcgacgcccatgcgaaccgtcacaagcgttacattgtgccgctcctttcggtcagcgtcgacttttacgtccgatgtttcgtccgaattcggtcgggcgctgcgatggccaaagacagcgtgacgtgggcatttctttgtttgtcttttagggacgtttagggaaaaatgaggacaaatttaggggattttgactgactcattttttgtagcactaattaagtgatgaaatagttggggtcgatccgagtccatacgaacgaagttcatgggggagaagcccccccccccccgctttcggcccctcaaatctgggatggtccccggatttataaaatttagttttaattgtccataaaattgctaattatgggaaaatttgggtacacgagantattggaagatgtaccccaataa

SEQ ID NO: 10931 - DNA, 4990 bp, Heterodera glycines
aaagcttattatacttcttatggcatgagaggggaaccctttggccaattttattaataataataattattattattattcgtattagataatcccttaaaatttattatttttttgatgaactaacgtaattgctttctatttaaataattaatgactaaaagtattattttctgcgaaatcatacatatttttaacatatttttaattaatacatttttattattttatctttatttttattccttgttatcgttaccttacccatttagaaatttaattcattttattattattattattttgcaaaagcaattttttacttttaaacaattttctatattaattgtgttgaaaataaatttttaaaatttgcttaaaaattttttctgaattctgtaagttcaattcattgctataatttcttaaattattatttttttgtttaatttattaaagagcaaggacattatcttaaattacatgcattaaaatctttattttcaataattatgatctatttaaacatgcgaagactcatcagagttgtgcgactttttgcctgcaatttagatttaaggataaatagttaaaatgttaatacggtattaattaattttcaatttaaaaggctttacataaatataaaattttctttttttattgccttattcgcattcttcttacgtctaattaacaaatccctttccatgcgttgaaataccaaattttagaacatggatacttactgatttttgtgttttacaatataagttgcgactaaaaatagaatatttgcataatttaattaaaaaagccattcattaaaattattattatataattttctttgaaaatatcgaataaattattaggactatcaagatatgtggctctacacgataaatattttcaaattttggatgaataggagtaaagtttcgcaccctaataacaaataatatttatcaaataaaaaatatattgtaaaaatcgcaactaatcacaagcttcaatatattacaaagccttatttttgaaaatatattaataatcagaaataattaaattatcaaggaagccaaatttcaaaaatcagcacacaaaaatcaagagattaacaaaataaaaatttaatttatttaaattgataaaagaagagaattaattttaataattattatgaacacaaagaaaaaatttatttttcaatgcaagaaaatttaaaaaaaaacttaatttcattgaaaagatgacaaatgtttaaattactcaattgaaaataatttgcagagctgaaagcataattttattattttaatatatttcgaataaataattctatggacttattcaagaaaaatagatttcctgttaaaacacacaagtgagcttgctcaacatttcgtcgattttctgctttttgagaaaacatgtatttgaatgtataatctggaatttaacctaataattcatggtggtttaatagatttttgtgaaaaaaaataaagaaaaagataatatttgaataataccatacaaataaatacgatattgagttgataaataatgaaaaaaaaagttttttaaaaaaggaattgaatacttaaaagataatttaataattacataaaataaatgtttaaggacagaattacaaattaataattaaccaaataatatttatcttgtttcaaaattatcctaatacaataaaaacaagaaataaacattaatataaaaaacttaatttaaaacaatttgaataaaattattcaaaaaccaaagtttttctgcttaaaatgtaacaaactcctatataagacgagatttttttttgtaagaatatgaacgcgaaaagtatttggtattatattaaactaatatataaaaataaatataactccaacatccttgagaaaggatcagctctatagttttataactaaaatactgaacaaaatattaaagattaataaatttataataattattaagtacttttaaaacaataatattttcttttctaaaataatcattaaataaaaattatttatttcgaaagagataaaagcagaaaaataaattactttcacagatactacaactaatagaaaaaaaattaaaaaattaaaataaaaggtgaaaaaatcagtttaatactctgcaacaacgaacaatgactcaacaacaagatagaaatgctggttcggatgaagttaaataatataaatatataaagtcaaattacatagctaaaaatgggaaactactaaagattgtttggacattttcaaacatgttttaacttaaataaattttaaattattttacttataatagggtatttacacacttttgggtattaaaataaataaataattaatcaaccaatcacatacctctaaatataagtaaattttctataaattattaaataaaggtattaaaaataggaacacttataatttttttggtttttcttaattttcatcaaattgattgaattagatttgatagtaaatgagggagaaagttggtaagtggttatttttttaaatatataaccaataaataataaaaaaatttcgtattgtataaaatattattaatcaaaaagtgaatattttacgtcttcacattatgtcattaaaataatataaaaattaataatatggaaaataaaaaataataaaataatttccatattaggtttgaggcttttaagtccaaattcttcatcttacttgattccttgtcagaaatggcctcaacaagcaaatcttttggtaatttttaaaagatttcttttattattcaaacaaaatttaaagtgcaaatcgattcgacatttgacgaagaattcaaaaaatattgttcggttgatttgattggacacgaattggaccctttggattggtggaaaattaacgaatgactatttcccattctcgctgcgctttcaaaacgatatctttcagcccaggcaacaacgattggaagcgagcaacttttcagtgttgcgctgatgtgtttgactatcgtcgatcaaaatttaaggctgaacatgccgaaatgctcatttttttgaataaatcaattccaaaaattcaatattattgataaaaaattttgttttgttattttttctttaataaacgtattgccgctcaaaatttgtgcattaaaaatatttttgtgagttttaatttaattttcgaattactcccgctcccgcccgggactcccgttaaaaatggacgggatttgaacgtgagcgggatttttacgggattcccgttcgggactccagtcccgtaaaattttgaactcctgatcccgctcccggaaattttttttaccggactctaaacaaaataaataaaatatttgctaaataaaatttaaaatttactaccaaagtttaagggtgactaaaatgaaaaaataaaaacaacttcataattttcgcttcattttaataatttgtttttgtattggatgttgggcccattaattttttgtaaataaaaaattttacattaatcaattaaaatgataaactatgaattaattaatatattgaaaaacaagaggaatacagaacttttattaaaaattataaaaataaattttgtaaaataaaacaaattattttaacaataaatttataacatttcgaaagaaaaaatcatacgcattctttctaataatatttatcaaataaaacaaagtaacattgaaaacattcattttatatctttaaaagaaaaagttataattgcgataatgtgtctcacacggtcccattggttcgtaactccttcgattgttagacttaacttttgatctgaaatgctaaaatttcaaaaatggtaaaatttcagctaccttataaatccttcatttggcccactccaaatgtctgatgtacaagaaaatgcttcacattttcgtaattcctctttgatctttcccttaactagttcacttgcaaccagggctggacgcaagtggatttacaattacggaaatccgcaatccacaattgcggcgattttctcagttgcggaaatccgcaattacgggtgtccaaaaaccccgcaatttccgtaatttccgtaatccgcaatccgcaattgaaaaaattttttttttttaataattttaaattttattttaaaaaatcctataaatcttttaaagcaatttaaaagcatattaaaaagcaaatttataaaagcaaaatcattcaattgaaaatccggttagaagcaagttatggtgaagaaacaaaagctttgccagatttgccgcctgtaaactttttctcaagtcatctgaaatcaggccggccgttgagaaaagcctctcactttctgaacttgttgcaggcggagaaagaaatttccgtacaacggcaccaatcaatggccatttttgtgaattaacttcccagtataatgctggatcggccctggatttgattttttggtcccgtaaatattcattcacttcaacttcggctttttgtcgtgtctccaatgcagatggactgggggatgttgccttaaattaattaatttgaggggaatataaagtttatttacagtattcattaattgatcaaattccgcgtccttttcaaaacgagaaaaaatatcccccgaacttgaaccactgcagtctcttaggtcaatttgtaaatcaatttcctaaaaaaataagttacaaaaatagaaaaaataatatgacatctgtctttgcgtggtaactctccacttcacttatcagccagtctttgtactgattcagtcgactgctgtcaaggtaaatggtcttgaatcgagggtccaaaatagtggcaagaactaagtttttttgttcttcggcttgtttaagccgcaattcgatggcgttcgcaattgttttcttaatattgaaaaacgattgtccttgtcctcacgtagaccgaaagaaattgcctaaa

SEQ ID NO: 10932 - DNA, 2578 bp, Heterodera glycines
cggcggctgccgaacagcaccagcgtttggccaccgactttcgcgagttggccgaggaccggggacgcattgaacagatggccaaggaatcgctgcgggcaatgcaggagcaggtgcaggaaacggcgatgaagctgcacgacgcggaaatgaggtgggccgcgggcgcgctttttactatacaaaacacaacggcacattatttggaattggcacttttacatgggtgcagctcgacccccccccccccccccctctccccaaaaaaatttccaaaggattttttacgaattttttttaaaaaaatctatttcttttttttttggaaatttctgtttaggggaaacgataccgagggggggggcatccattattttgtatgggggttttctcggcagttgccactcgccgtttcaaattttactcaatttcccatcaccaaattgaaaaaaaaaatttttttttgtcatgtgattgtgtgtcgtaaattgaaaattttgttcaaaaaataacataaaaggttaattgggaaagcaaattctgaaaattattttcggatgtcgctaaatcaacatcaaacaccgtccgccaaccattttcgtgcttaattcccatattccttcttttttgttacagtttgatcaacgtggaggaagagtgctcttttttgcgacaacgttgcgccgattttgagactcaaatgggccgtcagcgtgacgactacgacgcactgctcgtcaagtacaattcttccaaaactgcaccaccaccgccaccatcaccgtcgccgccgtttgcattggatgcacagaaagaagagtcttcggaggaaagcaagcggaagcggtggtggtgggcgaaccggaacaacatcacagcagccagtgctggagacgatgccgacgacgacggcatcgaaacaggaggtggcaacgcaaatgccgggcgaagacgatgacgaaccgccaccgccgccgccgatgccgaagaaaacagcatccaaggaggcagagacgcaagtgccggatggcggtggtgatgggccatcaccgctgctgccgcaagtgccgccgaacaccacagtgaagatggaagcggcaacccaaatgccgccggacggaccgccggcagcggaagaaatgacggcggtggtggtggcgattgtggcgatgattttgatgtttttgttcgaattcgtgtctgcagttcattagaatttacgtttctacattttttaacaaacattattttgtaaacactccgacacaaaaaacgagacatgcgtcaataaagagaagaatgcagagaaaaaaaacatatctcattttggcgtactttttcttgtatcctctctctgttaacagagaaatttcaatttttttcctatttatccaatttgcactaatttttgcatacaggaagattttcttcttcgatttctatgttgtttttttaaatttatctgttcgttaatggaccaggacggtatcccgtgaccggaactcctgttttctctactgtttacacaaacacaaaaagcatttgtgacgaattgaattagcgcgaaaataaatttggcgttatgtttattcttttgtccgtacaaaaaaaactaatttacaagatttcgaagttcgaactcccgttagagtttatgtggaatggattcagtgtttaatcatattcaactttttttctccatttgcaattaatctattttttaaatggaagcttgtttatggttgaatgatgtcgtccagggaaagttttggataaacaaaattattttcccagtaattttcacaattttcttttagaatgaataataacaaatttttctatttttaatttgtaattcctatctttttcgcactgttctctgtgtaaaaatttcaatttcttcaacttaattttattcatattcattatccaattaattggcatcaaaatttgttccaacatgcaattaaaaccaattaattaaataccccatacaatacccattattctctgtattctcttggacaaattcgctggtctcctattaattaattacacactccaaaattcacaccaaaaaattgatgatgatgagttattatccatcgtatccattgcaactgttttattattgcgttactaaattcatcaccatttacctcaattacatcatcggctttatagagtgcaacaagggcaagcagttgttgcagtacaaccgcacgcgccgtgtaacacaacacaaactacaacagcaacatcgccatggctcgtggtacaagctcatcacgcaatggtggaggcgccgaacgcggcgagcgcacttcccaccgcagttcaaccgaggcccgagactcgcgcatttcacgctcctaccgttcaccaccaccaccctcaaggttttgccgtcgttttgtatggcatttggttaactctcaatttacactactgacaaatgagtccaatctgtcagcgaaaatgcttaacaattaagttgttgaaccttagtgtttgtggatcaattgataatgctttaactagaggcaggcatgagcggatttccgttctggaaaattac

SEQ ID NO: 10933 - DNA, 2272 bp, Heterodera glycines
tcagtcaacactttagcaaattcgatgggctattgaaatacaataaatttggaccaaaaaaaaaattttttttttccgagtttgtcggaaaatgtccaaatttgtcgcatccatttcctgatttgattttgtttctggttgcgcatgacaatggcggtaacattaagatttcttttacaatcattgctaggtcggttcaaaaaaaaagcttcaaacgaagttgtgatcaatttcctcctcgccactaaaattaaaaaaaaaaattttgtttaaagtcgatttttttaatatattttaaacatgcattcaacttttttcaaaaaaaacaattcatatatactcttaaaattgccgagtttcaatcgttatccacaagtttgtccatttttgagtcctggtaaacccataaaattttttgtccgacttttatttccacggtcctggtggtgctgcctgctgttgtgcttccccatctctgaggtgttatgtctgtgtttgtggtcccggttttcagatcaaaattgtgcgcaacccggaggacgacgaacggctcgcctatgtgaactttgagcggcccgagtgcgcgaagagtgtgcgccgctcgctgctcccacgcttacagaaaatgttgggccgaaacattggcgttgacccggccggtgtcatccgggaccaagaaggtggtgatggtgtacaaggcaggcccgtagccagaaaaaaagaaatttttgggtcgaattttcgaaaataaattgtaaatgaaggtccgacggtgctgtcagatgcaggaaaaaaacaattttttttttgaaattttaatacatttcgtaagaaatttatgaaagtttcaaaaaatttgccatttttcttcaaattttttcatttcatgggtgggtggggaattacccctcctccccctggctacgggcctgatggtgtaatccgctaattttcggtgggcctttattttaggttttccagcccctccccggagatatttttgccattttttgggtatgtttcctttatttttgggggttaccagcccccccccccagacatccaccatggtaccaacaaatgtttgcccattttcagggtttcttgatacccgtatttatcggcccttgcccttggaaattatgttatttttcgcctagctcaatcaggagaaccctattaatttttttaggcaaattcatcccggaccgttacaatcgtgccgtcatggctgctgccgaccgttcaccaccgcccggtgggcccagtgccgcgggtccggtgccgttgcgacgtgccgcgacccctccaatgcagcagccacgtcgtccgccaccgcgccgcatggaaatgcccgttttccgtaagccaactgttttttgtcaccaattaattcaaaataatttttagggggcgggggttggaaaatttgttcgacgagaccttaggaaaataaaatttctttgtcagacttgaaccaagacgacgcacaagcgggacgtacaatttttgtgggcaatttgccgggcgatgttcgcgacacggaattgcgtcggttgttcgaagcatttggcactgttgacgatgtgggaccaaaaaatttgaaatttgttgttgtttttttcccattacaattttaccccctttaaataggtggacatcaaattgttggccgattcaaacgcagcctatgcctttgtgctttttgaggtttctgtcaaattttaattagggcattgcaataatgaaaaaaaaatcaaattcgttattttgaatttttgagttcggtttttgttgaattttgctttcaaaaaaaattttcattttcaaaaaaatcctggaaacgacctgctgccaaacataagcacattgtaatattattacttttttagacggttgaacaggcactttccgcccgcgaaggccaacacaacaaaccgatgcgtcccggtgaataccgttgtcaattgggttggtttttccccacggtatatctaccgtatactccctccacaccgtgttttaaggttatggtaaaacgcagccgtgcaccagcctaatcatcggtggattgggcccttgggcttcggaagatttgctggagaaggcattctgcgactatggcgaaattgcgtccatccaatacgacggtggcactcatgggttcatttggtgagcacccaaattaactatcgaatattgttcttggtaccagaaatttgtgattgaaacgggaattcggttccgttgtacagtaagatttgaattacag

SEQ ID NO: 10934 - DNA, 5435 bp, Heterodera glycines
  misc_feature (37)..(37): n is a, c, g, or t
ttataaaaaccattgctttgatccatcaattccttanttaataataattatgccaattaaggaattatgtacaattgacactcaacaccacgtttaaacagctgtaagaattgactaaataataaaattgtcacttttccatattttaattttgtagtaaatataaatttttaagcgcatcttggattattaaagaatgaaatcatagcgtaattagtaatagtttttcaatttttaatttaataagcccaaacttcccggttcccaaatttctggtcccaaaaaattctgcttaaataaaaggaaaaaatgatcagtcaattaggaatggtttcaattttaaaaaaaaagtttaaaaaaatgtttacgtaaatcctaacaaaattaatgcaataaatccaagtccaaaaattgtaaacattgacctaaaatggtaaaatttgaattgggtttatgactaaaatgtttatcattgaaattcggtactcaaaaatgagagtctgctaaagcagctccgacaattaattaattcatatatcagcagttttgaaagtataatcaagaaaaattaataaataaaaaaacaggttcatcataggatggaggatattcaatggcatttttccccaaatcatattgggcatttatgtttcgtcctccgttttgcttctttcactgtgacatcaatggccaatgtcactttgtcctcgctttggtcgtaaaagcctttgcttgggttcatcagttccttaattgatcataaataattggaacaattaagggaatgtttaattgtcactcacagcaaatgaaatgaaattgaatccccagcctctgtttttattgtcaaaaacatggtcatcgagttttcttctgaaatccgacactccgctctttagagagacaattcgaagagttgccgaacatttgcaactccaagtttctgctcaatatcaattaattaattgtcgttaatatatatattaattattagtaattttgcaccttcttttggagcatcacacaaaagataaaagcccaaccatttctcatttttgtcagtgcttcctttttctttccaatttgtgccaaaattttccatggaaatcctccgatgtgaacagtttcacttttacgttcactccaaaagatttctcgcgcaaattccgacactttttcaatttccataaagagtgcgcctttcgaattgctttgatccaaattgaatttgtccacttttggttcatcaacagttgtgagatcaataatcaatttcactttgtcttcttccctgtcgtaaaaaccattgctttggtccatcaattccttaatttaaatcatctaatttaatttttgtttatgcgtcgtcaattggttatgttttagaaattaatttattttgttatgatttctttacaccaggcaaataaataaatgaacttcaatattggctggtccacgaatgtcaaatttaaatatttgtttgaattggcacttaccgcaaacgaaacgaaattagtgaatcccaaattggtcaatttgttgtcaaaaacataatcacacaatgtcccaatggaattcttagacacgttgttttgcgagataattcgaaaagttgccgaacgaacgcagcagcgccaattcgaatcttaatgattattactcatcgttgttaattagcatttaataacagttaatttgcacctttttcagtagcatatatttttaaaatagtaattaaaattggaccttcttttgcatcgtaccataagtaaaatcccaaatatttcttctcatcaatgcctttcgtaatttctgcttgaatttcccatggaaatccatttatatacacggcatcactgtatctgcttctcccgacagactctcccgcaaattccgacattttttcaatttccatcgaaagtgtccctcttcggttgcccctggctttgttccaattaaaaattcgtccatggcttgggaatttcaacgagtacagcccgggcactccacgaagatacagaaacggatgggaattgaactgataaacgccgagcacttcttccactgttaacacaccggatggaactgtaaaatttcaaaatttattattctgtatgcatcagttctctttgtccagttttcccataaattttatgtaaaaatttctgaccctccttgtccatgtatgaaattcaagcattaaaggtaaaataccttatcgaccaaaacaatttctatttaatttccgatttcaaaaattttaccgacgcattttgcaaaatcctcctcatggatattaggaaaacgaattttgaacagtgcaggaccaagtacggaacgacgatttcccgaggagcattcaatgccattttcacggcatttttcatcggcccaacggagtgcctttaaaaaaacaattaaaattaatgcaatatttaaaaaaatgaaattaatttatttttaagtagaattactgcattccaaattgaaatttctccactgatttgcaattggtcacgtcccaaaatttcacacaacaatttttggtcaatttgcaaaaattcctccgttttaagcaaagcgtccgcatttttgtcaatataatccaaacaatcattgcaatattcctaaaattaaaaatgttttgaataataattgcatttaaaattctctttaattcatttttaattatttctctcccacctcaaagtcgaaaagacgagcctgggcataagcaaggaaaacattgcgcaattcggaaattggaatttgcgaagatggaaggaccaaatcagggatattgtatttatcggctaattagtaaatccaataattaaagcatttattttagaaaaaaaaattcaccggcgcaaagcactcccattgcattgtctccattcaattcgcttaaatcgtccgcgtaaatgaagctcaatatcactttgaacgctgctgcttcaacgtcagggatttccacaacaacagggcaatttgcaaaggctaattgaaacaaattaaatcgagctcaaatttttgaaaaatcgttaaaccattaaattttttagatgaatgcaaaaaattatttaatttactaaaaatatattaaaatttcaataggaatatctatttcttgaaaaaatttcatctttggagtgtatttttattttttatttttttgtaaaaatgaaaatgtcaaaatatggatttaaatcgaaacataggcaaaatgtgaaaatatgtaaataaaagacaacctagaagcttaaaattaagccaaaaatattattatttaattttaaatcgaaataaattggaaaaaaaagcaaatcctataaaatgccggtttatattaatttctaattaatatattaattttccataatagttaacctttaccattatccgcttttgcattctttgaatcaaagcggaacattgcctcaaatactttggaagcagatttcaaaacgatttgatgggccaaaataatctaaaaggattaaaataattaaagatttaaaaaaatcagtacaaaaattcagaggaatttatagcgggtatatactgttcatccctgacactcggggagagcaaattcgggaatcgggagaggaaagtccagtgacaaattttgtcaggaaattgttggagaaatttgtaaaatttagagcaaaaacaccctcctcagggagtaaatttcataaaaggtaaaaaaaaagaaaacaatacattttctaataaaaaaatcctagaactcattgtctagtcgcaatttgatggtgtatttttggactaattactctaaataattgtctaataaactaatcaacaaaaaatgcaacaaaaattatattaataagaatttttaaatttacttgaaatctaatttatgcatttaaataaagtggtcttaaattatgcaccgtactgtaccatacaaattttaaataattaattaaaaattaaaactcgcctcttttgcgtctccgtccccaaccaaaaatttcacatccgcgtactctcccgtgctcaacaaatgcttcatccgaacactaatcgattggatcgaattggacatggcaactcaataataagaatgaaaatgttgggacaaattaaattttatttctcgattgaaatgtgatacagttcatttttaaacaaattaatgcgagacgcaaaaatgggaggcgcaaatggggagttattccctatcatattcaaaaatttggtggtgaaaacgcccattaagccgtgaccaaagaattgttatgagtgagcactgcaaaatatgataaatcgttggaaaaaatgaagggaatttctacaaactctcaaaagaattttttttttattctccataagaatttgggaaacataggaaattccttaacaattcgaactcattaagaattcgagtaatgaacatatatgcattgtaatgagaacggataaaatgaacaatttgctggtgatggttcacttttaaatattaatgattaaggtcataaaacattacggcaaagtaatgacctaaaaaagatgagtaacaaagagttaataattattattattttttgaatttttagttaatattaataatttgatttagatttaaataattattttttcatttattttaatatttgatttaaagattcgaattcttttctgctgacgcacgcacatcaattgacaaatttatgcattttctttgagcctctccgtatatgagaaaaatattttagttcatattttgcctaattttattgtgcattattctcataaatgtagaagaaccttcagcaaatcttattttcattttattaaaacatcataaattatttgaacttttttattttgtgtcccttattaaattattaatattttttaaaatatttatcgctatttttagttaattattgtatataattttctaataactatggatgctattttgctatgtagaatcttactgatgctctaatgttgtataaccgtagtaacagtggccaatatttagtgaatcattgattttgatattataatcaattaaaaaataggtgattatgctatatagaatcctatctgatgctctatgttgtaaaatagttaataacagtgactattatttagtgaaacattgattgattatatgataattaataaaaataaaaattggtaattccgtggctgctatagaattattgtatataatctcgcgtggtaaattgacttatgaagtagaaattttggaataaaagacaaaacaaaatctgaataaaatcacatttattttatcttatttttaaacagaatccattaattcatttcttgtttaataaaatttgctaaaatgtcttttttctccatcatttccaatcaaagaacaattcaatttttattgcttatggttttattaaaaatgactt

SEQ ID NO: 10935 - DNA, 1559 bp, Heterodera glycines
tatatatttttcacaaattttaaatgattttccgtttttacgaaaatttaaacccgatttttccgtattttcggatccgttcacaaatatcggttgaccgtatgatctgtaccgccttttctcaccactaagctcttcaaatttgaccaaaaattggtcatcttttatgaaaatctgttaaccgatcaaactaattttcaaaacttttagccaataaatatcatctttctggactgatcgatgcgtgccgcaattttccaattctgaaattacccaatgttttctacgcgtttcggcaagcttcatttcttgaagagacggtattttaaaatttaatttcatatacatatatggccaattctttttttccactgcctttttccgtgaaactgatgaaaagccaagaaaagattttcaaaagtttgacatatttttactggcccaatattttcaaaggcaaagaaatcgtttccagatttagaaccagggaacggatttatatgtgataaaatgccaaatatgtacatatatatatgtgtcaaaaaacccccaaaatatgtactaaaacccaaaatatgtgtcaaaaattaaaaaaactgctcaaaataagtgaatttctcaaaaaaagtctcattttttatcaatttcgctagcacaatgctaaccaaaaatatgaaaaaagtcatgaaaagcgtcaaaaaagtgcaaaaaattgtacatttttggggacattttgccaataatttgagatttgagagtcaaaaaaatggaaatttttttaaaaaaattcaaattttctcaaaaaatcgccaaaagcctaaaatatgattgaaaggaaaacaaccaaaaatgctatttttgagctttttatgctatagcatatgctcaaaaaatatatgtaaaaacaaataaatccgttccctgtttagaactaataaaaaattgttttgcacaattagaaaataaatataattattttttaaaggaaattgcttctctgctgatacttttagttatacggtgttaccgtcctcccattagtactcccatccctctattgatcggtgttaccttatcttacgtcatactgtgcagagggggtggtcatggatggcgtttagcaatgacttcccccttccctagaagggggggggggggggggggggggggggaatacagttctcgcgccattgtgtggccatcattatccttaccgttttttggcttcacatttcatttttcctcacattgctcgccgatgcgctggtggtcaatgccgaacacgactcgcccttgatacagacgaaccagttacagtacgagattttgtagccgtccaaaaaggaccaccattcgatcatggagctggtcgcaattgagccgtcgccggacgattcgcacgcgacgaaatcagtcagaaaaatgggcagacctgggcaatactggcaaaaatagtttttttaaatattatgaccccaaaaaccactttttgagtaggccgccttgaagtttgccccgaggccaaaaactgtgtgagggccggttaaaaggggaaagtg

SEQ ID NO: 10936 - DNA, 1518 bp, Heterodera glycines
aggaattgatggctgatgccacgggatgtacaataaggagaagaatgtgctgacggcaaaagccaatgtgacgtgaaaggagcgtaccaagtttaggaagaagacaaaaagacggaaggaaaacgaacgaaacggggataaattggccatttttgtcaattatcaaattttgacttagtaatcacttattgagtgcttttatagtataaggaggttttttcttatatttttattcaaatacaatttattttaaatcccgtttgaacaaggcttggcgccggagcgggcaggaggggaatcctcgcggaaaaaatttagctaggctagtagaaatttgcaaatatatatatacgaaaaaatttcataattaaaatcgatattattggaattttaataaaatgaagctatattattttgtaattagaaactgttgtatgtaacgcagttgggggcaacgcccaggtgacccttccttcagtcggcattgacccgcttttccctcattccacccaaaaatgtcatcgtcagacaaatattcctttttttctttccaccatttgtctctttcgctcattttctctcattcttactgtttccatcccttctcattattttgccattgattcactcatttgcttgcccatctttggcaccaatggaataatcataagtagggatgggaattttagtgacttaaaatctcgaaatagttaactaaaatagtgagtaaaaatgctgaaatagtgacaaaatagtgccaaaaagtccaaaatagtgacgaatagtgacataattttcagccaaaaattgagcaaaataatttttattcactgattgcagttgcaaatgagtaggactggaatttttaagatcaaaaaacccaaaatagttacctacaaaaatttttaaaattaaaaatttttgtcaagaaagtaaatttttgagaaatttttttttcatttcataggagtatattttgaaaaattttagctcgattcttaggggtgtatttttttgaaatttttttaggccgattcttaggggtgtattttttggttttattgctgcatttttgttaaggaattttccaaaaaatgtcgaaatagtggcaaaacgccaaaatagtgatttgtaactattttagagacgaagtcatcaaaatagtgatttctagtgaccgatagtgacatcagaatcgaaaattttaatgcagaaatgcgttttttgagctcctttcttcaaatcaattgagcaaaaaatttagttaaaacctaaaattcccatccctaatcataagttgtgtctaaagggtcgtggtcgttttcgcgccggccgttttcgcgccagcgcagtttttgaactataacttttttcattgtcaaccaaatccaacttttattattcgatagccctaagtgtcctctattagcctgcaaaagtgcgaaaaatttggttaaggttcaaaaaagttatggccggaaaaattcaaaaaactggttttctaaacattttggccgg

SEQ ID NO: 10937 - DNA, 1720 bp, Heterodera glycines
  misc_feature (1451)..(1451): n is a, c, g, or t
  misc_feature (1690)..(1690): n is a, c, g, or t
gttttaagacacttaaagaatgccaaaaccaaaattgttggttgatcagttggaacttttgttgagcaccggcaatggcgcggatgttcactttttggttggggaagacgaagaaaaggaggcgagtgactgacaatttaatagaaatcgagggcatttaaaaactttaaaatattgaccagttaattttgacatatcctgtagtaatttaaagcaaatatatgtggtgtatttgtctactaagaccaagaaatccatttagccataaaagaaaattatggcacgtgacaaaggaaagaaaaagtcgattttgtttttggccatacttttttataaccgaaaaaatattttgaagttttgtgtgtctagattaatgctctcaagcatcattgctcttaatttattgcgcttatttgctggcgcaaaaacaaattccatgccgcaaaagttagcatttcctgtataagtctttaatgagcaactatgcttatgtattgtaaattgtctaaaatgattataatgttttatccaaagggtataatggctaaataaaaaagaattttatttttaagcaaattccggcacataaagcccttttgatggccgcctcggatgtgttcgaagcgatgttcgcttatgactcccagaatgggacaatggcggggaattgtacgaaaatcggacaattaaattaaattaaattattaagcttttttcattttaagctccttctaaccctgtggaggtcattgacatttgtgccgtgccatttaaggcgatgttacgctttatttacaccaacaaattgagtgttttggacggacaaaatgcaatggctgtgttttatgcgggtcaaaaattgaaattgatttcattaatggattaattattatttatttattatttagcaaaaaaatatgccatcatcggtctgatcgaagcattcgctgactttcccattgcaaaattgccaaatgttttccttgcctttgcccaagctcgtctcctgcaagaaaatgtacaaaaattaaatttcgatttattaaataataatttcacttttgttttgggactttgctgatcgatgcttggcttgcattaaccaaaaagcacaaatactgatcagatcggatgattttttacctattgatcaacaatcattctgtgagattctgagccgtgatcagttaaaagttggagaagaaagtgctatttggcaagccgtaagaaattgataatgttaaaacaatataatggaattaactcacttaaatttgattttggaattttattaaattaattaattttcaaatctcattaaagtctgacaattacgaaaaagtttcgggcactttttaatttcgtaattttattttgacataattaagaattttgttgtatatcctaacaaatctaggaattcaatgcttttgttaatttgaaaaatttanattgtaggcactgcgttgggctgacgaacggtgccgtcaaaatggcatcgaatgttcgggggaaaatcgtcggaaaatgcttggcccaattttgatggctattcgattcccactaatggcacaggatgaatttctgaaaatcattggtgagtgtgtgtaaagggtggttccggagactcaaaaaattcctgaaattttgcacaaacgctccgaaattgcgaaatcgatactactcctgntactgtagtcaattatccataataattatt

SEQ ID NO: 10938 - DNA, 3302 bp, Heterodera glycines
atctctttcaatccgcccattcgataattgctaagttctttaatgtgattaattaattgtctattagcataaaaaaaatataattttcttccgccgtttagcccctcccattcgaaatgtccaaccaaaacgaagtgccacaactccgtgcaaaacgagagaatcacggacagagcggactttccgtccaagcactcgttgaacttctgctctgtttctttctccccgttcgtctttcaaaatgactttcttttaaatgttgcccttggcgttctgtctccccctcaaaataatttcacattttttagcccgcggcggttgccatccacggcggccccagcttcaaaatgcacattttgctcaatgttctgctgtgtattctcggtttggcctgtcctccttcattcgcattgactcccctctttaggatggatccccggcattctccacgccgtttggtactgtttcatcagcaccaactgattttaaacggagggtgatacattattttatcagcaaataattggaccaaagacaatgatagtcatatttttgatccgaaaaatgattaatatcataaatataaaattatttcaagaaattctggttgctaaattcggaaacaaaataaataaaagtactaggcaattttactttataaatgtaacattatttaaaactgctaaaatcgcaagaatagataccaatattagcttttttcgtgtgcggaatattaaaattgcattttaattcaagttttaacgcgttttgcatgcatgattttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattcaggttgctaaattcggaaacaaaataaataaaagtaataggcaattttactttataaatgtaacattatttaaaactgctaatattgtcgggaccaaacagaggcaaattcggcccggcaaaaattttggcaaaatagaaattgggacaaacagtagacaagcaggggaatgatgttttattccgactgaaccgatttcaataacaattccacgacttaaatagggtgtcattcgctgaataatacatttttgtgtgagaaatgaataagaattgaatgtaaacaaacaaatattttttgaatagaacgacgaagagggggaacatttccaattaaattaaggttttcccatttttaatgaaattgcatcatgctttaaaatttatcttttccattttatttctcgtgacgtgagtcgcgacactccccacagcaaagttgtcggggggttcagttgctgcaagtctgcctgtatgttgttgttttatttcatgcctcattccgggttgtctgtgctgagaaaggcgggcggttgattttggttaatcgtaaaatctgtgaggtgatcagttgcccaggctgatcccttgttgcttgtgaagatccgctccgcggcggtggacagcgatcagttgaccagactgactcctctccgtcctgtcgcccttgtaccagcgtctgccacccgctgatcacaagcattcatcagtgcagaggttcccggccgttgcaccacttgtcgggaccaaacagaggcaaattcggcccggcaaaaattttggcaaaatagaaattgggacaaacagtagacaagcaggggaatgatgttttattccgactgaacccatttcaataacaattccacgacttaaatagggtgtcattcgctgattaatacatttttgtgtgagaaatgaataagaattgaatgtaaacaaacaaatattttttgaatagaacgacgaagagggggaacatttccaattaaattaaggttttccccatttttaatgaaattgcatcatgcttataaaatttatcatttccattttatttctcgtgacgtgagtcgcgacacccaacacaagggtaatttttctaaaaaataattttaaattatttatttggttcatgaatttatggaattgttcccctggtttttccatatatttatttaaaaagcctctatttcggaatacaaattttagtacccaacacaagggtaatttttctaaaaaataattttaaattatttatttggttcatgaatttatggaattgttcctctggtttttccatatatttatttaaaaagcctctatttcggaatacaaattttagtacccaacacaagggtaatttttctaaaaaataattttaaattatttatttggttcatgaatttatggaattgttcccctggtttttccatatatttatttaaaaagcctctatttcggaatacaaattttagtacccaacacaagggtaatttttctaaaaaataattttaaattatttatttggttcatgaatttatggaattgttcccctggtttttccatatatttatttaaaaagcctctatttcggaatacaaattttagtacccaacacaagggtaatttttctaaaaaataattttaaattatttatttggttcatgaatttatggaattgttcccctggtttttccatatatttatttaaaaagcctctatttcggaatacaaattttagtacccaacacaagggtaatttttctaaaaaataattttaaattatttatttggttcatgaatttatggaattgttcccctggtttttccactatatttagataaaaagcctctatttcggaatacaaattttagta

SEQ ID NO: 10939 - DNA, 1353 bp, Heterodera glycines
  misc_feature (14)..(14): n is a, c, g, or t
  misc_feature (37)..(37): n is a, c, g, or t
  misc_feature (49)..(50): n is a, c, g, or t
  misc_feature (145)..(145): n is a, c, g, or t
ggttttcccatttntaatgaaattgcatcatgcttanaaattatctttnnccattttatttctcgtgacgtgagtcgcgacaaatatcgcaagaatagatacgaatattagcttttttcgtgtgcggaatattaaaattgcattntaattcaagttttaacgcgttttgcatgcatgattttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagtaattctggttgctaaactcggaaacaaaataaataaaagtaataagcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattcgggttgctaaatacggaaacaaaataaataaaagtaataggcaattttactttatatatgtaacattatttaaaactgctaaaatcgcaagaatagatacgaatattagcttttttcgtgtgcggaatataaaaattgcattttaattcaagttttaacgcgttttgcatgcatgaatttaataaaattaataattggttttattttactagctgtgcaccaacaagttttggtatgtattgagaataataaaaattttaattcttttaaatataaaattatttcaagaaattcgggttgctaaatacagaaacaaaataaataaaagtaataggcaattttactttatatatgtaacattatttaaaactgctaaaatcgcaagaatagatacgaatattagcttttttcgtgtgcggaatataaaaattgcattttaattcaagtttttaacgcgttttgcatgcatgaatttaataaaattaataattggttttattttactagctgtgcaccaacaagttttggt

SEQ ID NO: 10940 - DNA, 1296 bp, Heterodera glycines
tcttaaaaattggctcaaaatcacaaagtttgtacaatttttggacaaaatctgttaacaaattctactcaaatttaaaaaaaaaattcccggcggagcttatcgacactgccggccttacgccccgccccgcttattctattctgatttttgaccccacaatctgattttttgggctcgatgttctgagtttgaaaaatttttgatccgcaccctggttaaaacgcatctgctgtttattttaagataacatgcaaacagcagatgccttttcagtgcctaaaattacccaagaaaaaaaatttaaaacatttttttgaggagggggtcacaaaagggataagtaccacaaaattgaacgaatacaacccacaaaaatggtgggaaaacacgtaagaatgttccgttttcagaatctttgtataaaaatgagagcattgaaaaacaaattcatttttcaacagaaaatttaaattttaaaatttgtcatttcgtttctttggataaaacagccaatttaaattcacttttaaatggatgatgccgaaaataacatttgcgactacttgaacatcaccacggcaacaaaaagtgatgttgataatctaacgggaaaatttgctgctttagacgcatcaaaaaaattgacactttttgaatggcttttcagttcaatgattcaccaattaattgtcgcaaaatgcgcatatcagtccaaagtagcgcaagttgcggtaaaaatggctatttttatttaaaaatgacaaaataaattataaaattggcaatttaagtccgatcagtaccgtgacactgtgctcatgctgattggccgacatttgcggcgctgacacttgcggcgcagacatttgcggcgcccagtcaaagcgacacttgcggcgcagacacttgcggcgaggacatttgcggcgccgacacttgcggcgcgacacttgcggcgccgacacttgcggcgcccagtcaaaaggacatttgcggcggcgcaaaattcaacgaccccaaaaatatttcaacaatttattaaagttaacagaattgttattttaatagtttattttttaacaatgcctaatttaacaaaaaataacttatttatttttggtttttttggagtcttaaatttgttaatctttatttgactaaagcttatcttattcatttttattaataattaatttcttaggtggcataacagcttcagaaaacgtttcacttcgccccacccagcattttcaaagtataaatgggtactgtaataaaataatttcaataagg

SEQ ID NO: 10941 - DNA, 1255 bp, Heterodera glycines
tatttttcagcaccgattatcggactgcctacaaaaaaacgatggggcgaagaaacaattcgccgggagttgggccgctttttagcaccaaagttgttgtggttcccaatgtgaaggcaaattgaaactctgagaattattctaaattgttttgtgaaaataaaatttcgaaattttcgactgtctttatgcaattttaccattataaaagaaattattcttaatttggcaaaatgagtttttaacggggatcgttttcattctttaaaaaagcatcacaatccccggaccgagataacgattttctttttagaaattcaagtttcaattctcattttaattgcgggattagtctctcgagtgaaatttatttctcgatcccttccgctgacaagggaacatgtcgaactctaagtgttcaaaatcacttgtagagcatggtcgatttgctattgtaaattttcggcttttttggccatgacccccaaactgatcagaaaaaaaaaatataaatgaacaaaattcgtaaaattgaaatatttttgctggcatttttattgggtcatttttgaacctttttgtctttttatttaggtttttgattttttttttgtcatggaaacctaatgggatgccttataacattggcccaagatccctatataagaagattaagttgcaaaattatgacattgttttccagacgcataatttctcttttttcaaaaccagggccctatgggccctgttaaagcgccgggggcgctttcaacactggggccagcaggagccatcgcgttttcccgcgctgaaggcactcactcggccgcttcgcggctttcaaggggcccttcgggccccttccaaggcgatggctcgtgctggtcatagtgttgagagcgtaaaagggggaaggagagggctggtctcagggttgtaagcgcccacggcgccttaacagggctaatagggccctgttttgtaaaaagagaaattatgcgtcaggaaaacaatgtcataattttgcaacttaatcttcttatatagggatcatgggccaatggtataaggcatcacatcacggttacatgacaaaaaaagaatcaaaagcctatataaaaagacaaaaaggtttagaaatgacccaataaaaaatgtcagctaaaatatatcaattgtacgaatgcagctaatttataattatttattctgatgagtttgcgggtcatggccaaaaaagccgaaaatttacaat

SEQ ID NO: 10942 - DNA, 2462 bp, Heterodera glycines
agaagtttcgatgatggcaaatcaggaggtatataattttctattatatttcttataaagttaaatttcatcttttaaggaggttattattcagtaaatcgtccggcaattggatatgaagaccatgaagcaccaccatccaaacaaaagaagtggtgtgtttgtctaagttttctttgtgcttttaaattttttgcatattttatgaattggcagtagggccgagtaaaaaatgaattaacaagtgaatctttggtgattgattgttagcttaaatttagggagtctggcccacttactgtggaagtaaaagcgaaggtcaatggccaagtatccaagcttacaatcaaagtacctttttataaaaaattttagttttataattttcttaatctaggaaggcatttcttcagtttcggacctttatgagatcatcgtaatagcctccccccggcctcccctctcccccctccccacgcttgcaatttgtttgtcttttttcttcattcctttctttttcaatttatgttcaacatttgctttgacttgtttcaaaaattcgggggggggggggctgaagtaaaaaaattcaatttttaggggtgtatttttctttttttcagtcgatttttaggggtgttttcgttttttgaaatcccgaattcggggggcgggtgtattttacaaatttttagccgtttttcgccaaaaaattactataacctagtcatatttgcattttaggatttattttatactaaaattctgtaataaaaatttctacaaaaacaaaaaaatatacacattaaaatggaattttttaaactaaaattttttactattggaaaagaaagataaatttaggtcataattttcaattttcaaatgataaaaattcaaaactaactcattgtcaggatgccagttgctatcattgatcaattttgcttgtgattcaaattataatgaggaaaattattcataaataaattttcgaattagatttatttaataatatatttaaataataattttgattttcgactaaaacctaatttttaatttgaaattttcataacaagtgcgatttgtatccaattttttcaaaatttttaccgttgtttcctatcgtaatcgtctaccaaaattttatttttttaaacgcaaaattttgtcattatcgaataaaatctgaacgaatttcacagaatgaaatttcaaaaaaaaaaattttctaatattctgattttcgaccccaaaaaatatgcttttaatttgatacaacgattaattaaaaaaatcaggcaaaactttaccatatctagatgactcggcactaattgaaaccgtattaaaatccgtgagctcgtcaaaaaactcattaattgctagttggaactttttcgccactattttggatttacctgaatttctcaattttttgaggaaaattccaaatcccaggcatgtatacagccttaaaatgtggtcgggatctgatcccgtcaaaatcgggattttaatgccggtacgtacagaaaacataatttcggcaaagtcgagatttaaattactgtagaccagtcgcgggatattttatcattttttagattaatttgaataaggtttggttaaaaacaaaatatataaaaatcttaaaatttgaaaatagttttaaaaatatagtcagttctgatctaatctattgttgaacatatcacaaaattgatcatttttgtcctataaatttttgtcacagtcatgagtttatcgccaaattttctgacaaatcgtcataataattcgccggggagagccttttggaggacattcattcacacttcgatgggttcaatgggaaataagtgaatgggcggggatttatttttaggatttatttgctggaggatttaagagggcgaaagtcgatttttacaacaaaaaaagacgagaattaatctaattttttgagatttttgtctcaaaatttatgaaaatagagttattataagaattaagtcgacctttaactaagattggaatgatcgataaagttaagcagggtcataggaaatcttgggagtgatcagaaccataccgatttggaatgacttggactcaccggaaggtttaaatcgaggtcaagttttagggaatttatctggatgattgaaagcctctagtgatccgaatagtgcgctcaggtatgaatttggattaatcaacaagttgaaccctataaaaaaaatgcctcaagattgatcattacgataaatagtgcgaataattgaattgatcaatgatcgctgcggcaattagacaaaatgtaattgggtcacgatggtggatttatgatggtcattagaaaaaatgatctgccattcgcttttctatattctgctgctgatttaaacgaattggatcataaaaagactaaaaattgaacgataagtaagctctct

SEQ ID NO: 10943 - DNA, 1691 bp, Heterodera glycines
attgtatcgatgcgagcgttgattttgtctatgtttgtcatggcattgtgttgaacttttgttattttcgcaccgtaaattgattttttttaaattttaattttcgactttttgttcgaattcgggtccggagttcgaaattggtcgcaatggatgtcagattcgtgatcagcgaccccgaaaaccccctagaaatgtgttaaaaaaaatttttttttatggtctgtaaaccacataagtaccaattttgctttcttttcctctcttttatgcgcgctattatcatgtctctaataactgtaaatttgaaatgatcattacttttttcaaactgatcaaattgatttcgtttgcgtagaaaagctttcgaatgacaccaaaagtgtccaatttggttgccaaaaagctttaaaataatttttgaaaatcgctttttttttttttttgaatttttatataaaaaagagaccgagattttccgaatctgccgagccaggctgattttttcagaagcaatggcccgggcctctcaaaaactagtcaaaccggattttttccaaaaaacgccggccacccggcccggctcggtggtctctaataaaaaaacaaaaatattcatgttgcacaaccattgccttacaatttaattagtgtatattaatgcacattttggttttttatagatacgtattttagggcaagcaatgaattaccaacaatcagtccagcagcaattaggaggtggtatgagcgcacaacagcagcagcaacaagcagtgagacacatggcaagcagaaatttatggcacttacgaaccaaacatttgactttttttgtaaatgaattcacctttttttaattgttcttatatttttcataaaaccccccatttagcagcgaccacaaaatcctgcatcagctgcagtgccacaaaatatgtcgccgaatgtggcgccctctccacaacaacaacaacaaatgtaccaggtgaagtgctaactgacgaggctcaaattatttttcgtctgctcagatgcctatgtacaaccacacgaacgcaggcggaactccattcagtccccacaacgtttacaaccagcagatgatgacgccacaaatggcctcgcagcagcaattccctccaaacgcacctgcaacaccagcgacaccccaaatgtcgcagtcaattgggacgccattgtccgtgcacaacattcaacaacccggtgggataaagagcatttcgttatggttttttaagaaattttaatgtttatccatttttgagttcaaatcaattctcatattccaaataagctaaaactgttacattggattatacaatttctaatttttttttgcaatctcaatggtagtaattcctcgaatgatttttagtcatcattaaaatgtatggagctgggtcgttcccccccccccttacctcatcgtttcccccggaaaatttaaaaaaaaaatctcaaacctagaaatttttcataaaaaaattcttgggaaaattcttagtaacaaaattccaaaaaaaattttaaaaaatttttcagcgttcgaaaatttatgataaaatactaagttttttgaaaaattttccaaaaaatcgctgaaattttttcaaaaattttttttcaaattttcttgctaagaaattcctaagattttttttatgaaa

SEQ ID NO: 10944 - DNA, 3066 bp, Heterodera glycines
  misc_feature (3009)..(3009): n is a, c, g, or t
aatacgggagaacatcgatagcctgaacacgcttgctgacgaagttgggtggtgtagaacaaacaacggacgagcagcaaaaggtgggatggggagcaccttggaacacgttgaaccaccacatctacccaaaaatattgcagacaattaggctatatcatatccagttcaaactgcaaatgtttaacatcgacgtggttttcatacatcaatttaattccttttttaaggttgaaccaatggactcatgaataaaggaaagaaatatcgcgggtttaatattgctcttctttttccgtctcattttttattcagttatataaaaaagttcgcaaataaaatttttaaaaagccttttgactacccgctttttggttattcgtcaggtcacaaaccgctaaaacgaaattcataatacaaatagaccctgcttttttccaaattacggttcgcatcacagatgttgatcatttcatttttagggtcgctgaccacgaatacggcatcttgttggcttttagaatgtttccatgcaaataaatcgattttgaaccaaaaaatgcaaaatttgaaatttcgcaaagaattaatttagattaaaatgtgaaaataattgatttcgagtgttatttgaaattttgagaatgaaaaaaattcaaaattttctgtaaaattttttcatgttttagggttcgtttcgtgtccatattttattttcgtgttttgtttccgattgcacttttcccttatcaaatctgcgagcccttaaatcaaaatgccttcagagatatttatcggacattcgaataaaatttatttggaatatttgatccgaaaaacaatagatctcgttaatgcttcatccgctacaagcagttcgctatcctcggtgacatgaagttctaaaagcttcaattacaacaaaaacttttaaggataaaaaatatagacggtaagtgtgctatataactattcgctttattcgaaaaatatttaaagattgttttaactaacccttgagcgtcttacacaaattcttccgacttgctgtctccatttctggcataagagtgttgatttcatacaggaaagtgctacccgctcgaatggaaggattctgaagttggctgcaaaagcagtattcacattctccataagtattttttagccttactatttgtctttcaagtcatctaaaaagcctgagagtgtacagtcctcgcgcacggaatacatttggacagatttctgaccgcagaccaaacattcgggatcacgttccaatgcaacaacgttgaaacagataccttccacgttagcaaagttcaagtaattgttcagagaacatgagatgcttaaataagtttgatagtgcgttttagttttcacggtttttgaaactatttttagggaaatgagtagacgaaccccagtataaaaaaacaaataaacaccaacaattgtgagtcaaacagttattctaatgtgaaattgctgccactgaatgcttactttgatgccagtttcaatgcctcaagagcacagcttcctgagatatataacgttagctttaaaaaacaaaaataaaacccgctatgatggcattggttgaagccactgccgggattatacgtttgagcacgccttgggtgagtcgcaaatcgacatcctttatttcatactcattcgcgcgttgttgagcagcacggaaagcccattcgacatgagcagggtcatcagcatccaatttaacgtctatggaaatggaaaatggtgatggagttatttaccattttcaccttgcccaaaaggcttctccttttcccaaagcacaacttttacatattccacacaatgctcaggaagccgaggtgtgtgagcaattgtacacaacggaaagttgacctgaaatagattcaaataaattttttttagatcgtattaatatatgatttcttatatgaattgcatttcgtgataagaaacacacaaaaacaaaacctaacctggggagtgtaaagatctatcgtgcactgaatacacggcgtcatgaaaggaataatcacccgtgaatttcctttgaatccctctgttccaccatcgatcaacggcactatggtgttggattttgggttatttccgtcatcaaattcaaccaaagaacacttaatgcattactatggtagacttgttggtaagttttaagaaccaaccacagtcgcattaagccaacggcgagcttcaatggagtcaagtccgcaaataataatgaaaaatttacgataaaattcgagagatttgtcctggattttgcaattatggctaaataaatctgatcaatttcgaattttatttagaagttagatttcattataatgaaaatctgttaacaaaactagtagcaaatatggtaattttttggacaaaatctgctaataaattacgtcataattgaaaatcctgacgggccaatcggcaccgtcgggctccctcccttagaaaaaccgtgctgcaaaaaaagtgggtgaaagaaaaagtcgtcagaaaagttttgagcgttttttcaattactaaaaattttggcctctgaggaagggggggggggtatttcgtattttgaccccctgcctctcgtccatgtatggatacatgcctgaatttttcatacaggtccagctagccatttttcggcaacctggatttggtcaagcaatactggtttaaaattagcccaggttcaaattagaaaagataaaaacaatcatacggagtaactttacagccaaacacccttttctcgataaaggcagccgccacctcagcttttgagcgtccaatgtcattttcactaaaaaatacacacaataataataataaatacacacaataataataataatagagatcaaaaccgaaagagaaattgtcggttttaatttgagagatcgattgtgtccatatcaataatatgaatgtcatggaaaccagataaagcctaaaactgagacngtaaattaaactaaaaaatagatgcagaaacatgccaagtctttaaggatttcacag

SEQ ID NO: 10945 - DNA, 3123 bp, Heterodera glycines
  misc_feature (19)..(19): n is a, c, g, or t
  misc_feature (50)..(50): n is a, c, g, or t
  misc_feature (97)..(97): n is a, c, g, or t
cacgaaatttatgaattanttgggttttaaaattattggcttccttgggnttacaattaaatagacaaattttctcgagcgcttgacctgctccggnatttaatgcccagctcgcctaaactcaagaaaaaaaaagcaaaatttctttggcttgaattccatccgccaaaaattggaagaaatatttttttacttctccgttgcaaccctgcccacaaaaggtggccatgaaaattgtggacaaacggtcgttggacgaggaaaatttggccaaaattgagcgcgaaattcgaatcctgcaacagctcagtcacccgtacattgtgcgactgtacgaagtgataagaacggaacggtacctgtacattgtgacggaatatgtcagcaatggcgaactgttcggtgtgttcaagaaaaaaaatgaaaaaaaaaaagttttttcaccgccgaggtctgaacctgggccaggattaaagtgcgaacaaggaaaagcaccactgcgccattaattttaagtcagctaattcttgctaaagaaccaaatcgaaaatgcaaattaaaaaacaacagtatttgctgagaatgttcggtttggtgccccctccgtgacctcctccctcacgcaaattttccaaaaaaaaaaattactaaatttttcttaaaagccacaaaattaacaatttcttggtgcgaatttctttaaaaaatggaaataaaaattgcaattttccggcggcgcctgtcggcctctctggacctctcctgttgcagaaatgttttttttaaaccgcgtcacaaaaaatggcttgaaaaaggccttctctcataaaaccctgagcctgctggaaacaaaagctttcaaaaccaacagatatgttgatggatcgcggacgccaaaccgaggccgagtcccgacgactctttcaacaaattgtgtctgcaggtagaggtggtcgtcgcgtcgtcccaaagatgcaaaaaaaaaaaaaaatttttttttgtttgaatttttcatttctttaagtggcctattgtcatgcgcatggcattgtgcaccgggatttaaaggccgagaatctattgttggacaagcgtggaaacatcaaaattattggtgtgttggtgttttctgttttgctgacagaccgacaaatggtcgacatcaatcaattggacaaaatgcctacttctttggcttgacacaaacaaaatcttgcccaattaatcagttttttagcgtgagaatattgccatattcaacacttcctctcatttgtcaaactgctcgctttagacctcatttgtccactttttggtgacatagtagtcaccagccaattatttttggtattttgtccctttttggagcaacatttcatttgtccacctttttggtgacattttgtccaggcaatgtttttttttttgcattttgtcttctcaatttggctacaaattcatgccaattgtccttttctgtatattatcctattaaaaaaaacaatatttcatttgtccatctttttggtgacattttgtcccagccaattatttttggcattttatccatttttggttagaaatttcgtgccaattgtccttttccatctattttttgttatttttcagattttggcttctccaactaccatcagcctggccaactgttgtccacctggtgcggctcacccccatacgcggcacctgagctgttgctggcccaagagtatgacggtcgccagtccgacgtgtggtcattgggcgtcatactgtacattttggtgggtctttttttcgaaaaaaataatggacagaatgccaaaaatgccattattataaaacaggtcactgccggcttccccttccctggcgattcggtagacaagctgaagcgcgcggtgctcagcgatcacttgaaaataccgttttgggtctctgtcggtgagttcaatgaccgcataataccgtaccgttttgtgcatgtcgattatactataaagctttgacaatatacagtatgcctccgattttactctgtttttttttggtttcggtcaaatatcatttcctcaattttttgtgacttgttaaagttgatgatgaagccttgtagctctgttatggtgcagtaaaattttattcctaaaattctaccgtagcttgacttattaaaatacaaaatacggttgtaaacccatctatcacggtaccagccaacttttcttgcatcactcactactgtgactgtactgtaccgaattttttccaaattgctcaccaagtcatcctaccgtatcctggcatcatggtgtgccactgtaaacatattttcttacagaatgtgctgatctgatccgcaaaatgctcatcgtgcagccggccaagcggtgcacattgcagtacatcacccagcacaaatggttcacctgcgacatgcccgagcacatcaagcagcagttgctggtgccgcagttgtcatcatcagcagcggcaactacagtagacaaccaacaagaaaaccgcgcgccgtatacggtaggaggaggaggaggacgagcagtacagcagcaacaacaacagttggacccgacaggtggttgcgctcattcccccccccccctcccgtcgtttccacacgaaaaattaaaaaaaaaaaattttttttaacatagaaatttgtcaaaaaatcttaggaaatttttcataataaaactcccaagaattataatttatatttttttattattttccaaatatagtgttgatcttcatgcaacagcacacgggctggtcagatgagcaaatcattgaggtgagtcatcaatcaataaacaatcaatcgcatcataagatatgttatttaattcacgattgtattattatttcatcaaaatttttacaaaagcctaataatgtatttaaaaaaaattatggcaccttaaaatattcatttattaaattaaatctgtagtttataaatttatttatattttatttgaattttataaaattttgatcaaataattagggctgtcaattttatgtaaatacatatttttttcctggattctccatgctctaattagtaggaaaaacactttcttttttgtgtttgcgagcaaa

SEQ ID NO: 10946 - DNA, 3018 bp, Heterodera glycines
  misc_feature (43)..(44): n is a, c, g, or t
  misc_feature (85)..(85): n is a, c, g, or t
  misc_feature (167)..(167): n is a, c, g, or t
aaatgtaccattaaaaaataccaaaaatatttttttaatgtannaaaaggtgatctaaacctatctaggtcatttttctgccatnttgtgccaatttaacacttcaccttacgaagatttatttccaaaaaataaccattaaaaaaaatttatttacatacatattntcgtacatattttggatttttatacatatttcgggatttttcttatatatttatgtacatattatgaccactttttgcacatttttttgacagccctacaaataatatatacctatggttattttttaaattttgatgatatatgccaatagttttgaatgtttaaaatacagggatatgttgcttagatagtaaaatcttgttcaatatttaatttgcattttttggttcatttttaaaacaacgactccgctctatcaattcgtttaaccaatgtgccaacgtagcgcagtggtgttttgttgtgtacatagcaaaacaaaatgtgataagggttcgagtcccaccagcggttttaccatttattgtaccatcatttggttcacaatgatgaaagtgtgcctgccgagaatggaaagcttgcggcttttaaataaagcaaaggcgcttttcactcaaagacgacctgaggcacaggggccatctgagtgaactaaatgaatgcggtacttttttgtgtgtgtgtgtgtgtgccgcgatttttccaaaaaacttttgggcagtagaaaggggtccgggattgtgccgaaaaatctttacccatttttgtctaaaacatttttttatgttattaattcctgtggaatggttgtgctatgaattacaagctattcgggctagatttttaaaacgttgaaagcatcctttgaaaaaaagtgaagcagaatgccttggtagttcagtggtaaagctgtccaaggacatggtttagtcgtgggttcgattccctccggcgccccccaaaagtcgccgacagaaaattcgcgtgaagatttttttggagcataacttgcaaacatttttattataatttaactaattattaaatattaaaacaggaagtgttgggccacaactacgagtcgtccgtgtttggcacgtacgcactgctgttgagccgtctgtccgacattcgcgaggcggaagcggttgcagccgccgccgcggctgcttccgcctccggcaccggcattattaccaccaccggtggcaccagcagtggtagtaatagtaatagtagtagtaacggtggaattgcggccgccatgatggcatctccgcttgtcttcggtggcggcggcgccgcacgcgcaacagcgacggccatggcgctgaacacaattgtgggcggcagttgcaccaatttgcagttggacagcgagtacgcgcggcgcggctcgcgcggctccatcatctccggccgtgccaatgtggagccggccgagcagcaacaccatgccaccatccccgcccatcacctggccaaactgagcctgtccaccagcccggactatgtaatacacacgatgcggcagggtacaataggcgcatggccttaagagagatatccacaaataaagatcggcgcgggcccgcatctcggcgcgggatgcactacgcccccccccccccctgtcgttatagaaattttacgaaaaaattttaaaaattttctagcgatttttcaaaaatttgatgatgctttttcaaaaacatcgctttaaaattttaatttttttttcttgaattttaaaaaaattttcaatttttttcgaaaagtttcaattttgcaattaaaaaatattccggaggaaatgaactgctccggcccaacgataatgattgtttagctttaacaaatttttcaaaaaattcattgcttaatatgtcttttttacaaggccaccgatttttgcaaggacattaaaaaggcaattattatcttaaaatttggcacccatttaaaaaaaaatttttttttttttgtattaattaatttttaaaatttttcaatttttcttttactatatgatttttaaaattttttagcttcttttttttgttgttgcaaaatcttggcattcataaatttcagcaagagacggatgacagcgacagtgccagcgactggagcatggtgccgaactcgtccgcgggcgcttcgtcggcagatgacgcggcggctgcggttgtgccaccgccaccaccaccctcaacgacgtcggtgtcgccaacccaaccgcaacaccaccacaaccatcaccataccgcgtcatgtgtcgctcctcctgccgcttcctcctcctcctcctcctattacaagtcaaagcggcaccaccactgtgccggccgacgaggcgttgcggcggcggcgccacgcgcgaccgcgacaccagcggcaacaacccaatttgatcagcaacaacaacagcgtgcggcctatgtggcgttggaacaacagtaccaccagttgaacccgttgctgaacgctggtgggtggcataatttgggggcaactaattaattgcctaattacacaatttttactaattcttattgacagccgcccaacaatttgcggtggacacgtcgcgggccgcgtgggcaaacgcagcagccggttggtgtgccaaaattggattttttttaaatacacaccatcccaaaaaaaaacgagaaatcaccaataattaggagagatacacacacctcttatatcggcgtactattttctttttctctgctaacagagaaaaacagattttcttatttccaaataactttttattttttcataacttttttttccgacgcattaaaaatgcatggaatttgtttagcgaaagcttttccgttccagtaactttcaaataataccaaaatcatccaattttgttgaaaaaaccttcaaaaacagtcattttttaataaaaatagtatgtcatggagcgggctcgaacctccgaaatattgaaaaaactttggcactacaaattgagggccaaattga

SEQ ID NO: 10947 - DNA, 5115 bp, Heterodera glycines
  misc_feature (2056)..(2056): n is a, c, g, or t
cgctgatcacgaataagtgatcagattttacttctgaccttcttaagacctcagaatccctgtgtgattggggattatgaggcatcattttgagggggcggggggcaagttcgaatccgggcggtaacacattatttttctttgtatttttggcttattttacaatgcttttaattaatttgaagattggttgtaaattttaaattttttttaaataaataatttcattattattttttatctgtaaaaaataatatcatttcaaattaaatgaatattcaataaataatttacaacgttgtttttaattaataactaccatttttttcattgttttatttatttaaaatattttttattttattaataataaattatatttttttatttgaattaaatttttttttataaataaatgttttgttttaaaattaattatttatttattttaattaatttaatattgtttgttatattaaatgatttaatataaaattaatttcttatttatttttaaataaaagaaggaatttattttataatttttaaaaaattattaacacattcgattttaaattatatttttttataaaaccatttgcttatttatttaattttgaaaccatattttacccttttaaactattattgtaccattcctacaattttagtacctactaataactgttgtactcttctaatcactgttttgcctcttctaatcactgttgaacctcttctaatcactcttctaatcgctgttgtacctcttctatttactgttgtacctcttctaatcactgttgaacctcttctaatcactcttataatcgctgttatacctcttctaatcactgttgtaccacttctaatcactgttgaacctcttctaatcactcttctaatcgatgttgtacctcttctaatcactgttgaacctcttctaataactgttgtacctcttctaatcactgttgtaccacttctaatcactgttgaacctcttgaacctcttctaatcactcttctaatcgatgttgtacctcttctaatcactgttgaacctcttctaatcgctgttgtacctcttctaagcactgtcaaaaattatgtatttaaggccttttaatgacgctgatcacggatacgtgattagttttcacttttgacatcgttaaggcctcagaatccccgtgtgattggggattctgaggcatcattttaagggggggcagattcgaatccggacagtgtacattatttgatttatttatttttttggtaattttcactgcatttaataaattaaaatagtttggttgtaaattatttaaattaatttttaaaatgcattcgatttttaagttctgaggccgcgaagcggccgaatgattactacaaaattaaaaaacgggcgcgaagcgcccgtttggccccaacaaaatttaaatgggcgcgaaacgcccgtttggccccacaaagtctaaaaacggtcgcgaagcgcccgttctgaggccgcgaagcggcagaatgttccccacaaaattaaaaaacgggcgcaagcgcccgtcctaaggccacgaagctgccgaaaattcccaaaaattaaaaaacgggcgcgaagggccggtttgaccccagcaaaatttaaatcgggcgcgaagcgccgtccaagcccaacaaaattaagaaacggacgcaaaagcgcccgtctgaggccgcgaagcggccgaatgttccccacaaagtttaaaaaccggcgcggagcaccctttgaggccgcgaagcggccgaaagtcctccacaaaattatgaatgcgtcctcgcgatgcctgtagaccaaaatcccttatcacatccataaattcatttcaaaaccgcgcatgcactagcaacgaagtcctttgcgcgaagcgctcatgtcagcgcccgcccatatataccaaaagcatactgtctacaccgagcaactactgcgccacacgctagttactatatacgttatattgacaaggagtttcgtttgcaaaaacaaaatctcccggccgaaggccgngagcgccctgaaagtggtggaagggtcttacaactttttgaggcgcatctgggaaaactataggttttttgatccgagggccaactgagtaccagggactgaattctcacttttgtttgcatttgaaggcccctaactttttttgtaaaactcgaatcaaaaagtgcccgctgaaagggcactccgcctaagggtcctctacaaggtggtattttttaaaaatttttttgagcaaacccctggcctgtaaaaaatggcaactgaagcgtgctcaaaaagtacacttcagtaccagatgaatgccacgccagggtttgatctgaccgaagggctgccagcggacttattgtagagttttggaagctcgattttctgaaatttaaaaatttcgaaaattttcaaaatttttcgagttaggcctaaaaaatggttttcgggtttttgaattttatgattttttaacgaattttcctggcaaaacggagaccacttccaaaacatagtttttcgagctctatcgaatggtatttttttcggaaaaatttcgatttttttccggaaatagaaaaaatttttggcctaagcgggacatttgagtcccgggcccataactcgtcaggggtcggttttagccaaaaaatgccttagaacatttttgtagagcattttaaatgctatcgaatggtgtactatatgaaaggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaatattttaaaaattctttattttttggcaattttttggccctcgggattttggcctaatatttgaaaattcataacaaatcgaagggttgatcaattttacaggaataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattaggaaaaataaaatactacaaaaatccgcagttttttgctctattatataaattttatttggcatttttatcacttttttaagaatttttataaaaataaaagtgattttgagattcgggaccaaagggggtgcacatggtttttgagtgaaaaaattttttcgacaaaaatcttccaaaaacatgtctttaggggttatttgggccgctgatcacgaatacgtgatcagattttacgtttgacatcgttaagccctcagaatccctgtgtgattggggattctgggacatgttctgaggggggggggggcagcaggttcgaatccggacggtgtaacattatttttctttgtatttttggcttattttacaatgtttttaattaatttttgaagatttcttttaaattatttaaatttattttttttaaattaaagaatttcattatttatttttgaatttgtaaaaaaaaattcatttaatttcaaattaaataaatattcaattaataatttccaaggttgtttttaattaatcactaccattttttcgtgttttcattgttttattcatttaaaatattttttattttattaataataaattacatttttttgaattaaatttatataaaaacttttcattatttatttaattttaaaccatgttgtacctcttctaatcactgttgtacctcttctgattactgttggactcatcttaagacctcagaatccctgtgtgattggggattctgagacatcattttgaagggggggggagttcggatccgggcggtgtacattaatttactatgcattttttgcttacttttacattttttaattaatttgttttgtttgtattattaataataaataaaaatttttaatttaaattaaattattttggtgaacaaatgttttaatttaaattatttaattttttatttaatttaatattgttttattaattattttaaattattttctgatgaataaatgttttatttaatttgaattttcgagaaattaattcctttcaatttcaataaatattctatattataaatttctaactttatttttaataagtaaaaggatttttttaatttgataaatttataatacatccaataatacaattttcttatttatttcattttaaaccatgattctacctcttctaatcactgttgtacctcttctaatcacttttgtatcactttttcactgttgtacctcttctaatcactgttgtacctcttctaatcacttttgtaccacttctaatcactgttgtacctcatctaatcactgttgtacctcttctaatcacttttgtacgtcttctaatcgctgttgtacctcttttatcacttttgtacctcatctaatcactgttgtccctcttctaatcacttttgtacctcttctaatcacttttgtacctcttctaatcacttttgtacctcttttatcacttttgtacctcatctaatcactgttgtccctcttctaatcacttttgtacctcttttatcacttttgtacctcatctaatcactgttgtccctcttctaatcacttttgtacctcttctaatcacttttgtacctcttttatcacttttgtacctcatctaatcactgttgtccctcttctaatcacttttgtacctcttctaatcacttttgtacctcttttatcacttttgtacctcatctaatcactgttgtccctcttctaatcacttttgtacctcttctaatcacttttgtacctcttctaatcacttttgtacctcttttatcacttttgtacctcatctaatcactgttgtccctcttctaatcacttttgtacctcttttatcacttttgtacctcatctaatcactgttgtccctcttctagaagcttttgtacctcttctaatcacttttgtacctcttcta

SEQ ID NO: 10948 - DNA, 1492 bp, Heterodera glycines
acttttttcgaattttccttggaaaataacctgtttgtcgtcgcttgctgtttgcatcatcatgcgcagtttgccggcggaatgtacgcaccgccggcctttgtcagccgctcacttggattggcattggaagcgccaatcgtttcggccgtccgttcaacaaaagcgtctttgtcggcggtacccattgacaatttttaaaatcaaatctaattgtaagatagttttagattagaaataatgtcattggaagcaaaccgatccacttttagggactcaaaccaaccgaacattcttggccataaatttttttgcttagcaaaatctttaatggtactaaaatcaaaggtacgctcagaaagaaaaagtgaaatttaagcctgagaaatcgagagtaatctatcagttattgaatcttaaaaataaagcccgtgtgggatttagccgggccgccagacgtagatccgtcagagaaatcgttcaaaattaatttggcgaaatgtttaaggattaaatattctgacagttaaatcggtagtcagaggaaaaacaaaaaaaacaagatatttattttacacaaaattaaaaatttgagaaaatgaaatcggcgaaggtgaatcatctcctcgcttaaacgcagcccgggtcagtcgccaccgccttgcgctttctctccgctttcatcagtgtgcgccactccctccgttttcgttggattcgcgcgtgcttcttcagtcccggacatgtcccttgcgctggctctacaatctgtggaacgcgtccctcagcgaattcgtcctccacgcgttcatcgtccgccataaacgcattctgtcgctcatgcagcagccgttcaatttgggcgccttcgttccaaacgtccggctgaaagccgtaataaatgcgttccgtctgcggcatgtgcacctttttcgccgcaattgagccgaactatggggcagaaaagcattaatagtaaaataaattgatcaaaaaaagtggctttctttactcgatccctcgggtccaccggtgaattgcgacgtcgcaataactcctggatttgttcagcttcctggtcaacagttcgtagtgattttgccacattgtttggtgcgtctgttcgtccccgtgtttggcacagtccgccgaggccattgggaggaaacagaaaaggcgccatcaacggagaagggaaggaacggcaaagtgccagcggcatcgaagaaaataattgaaacattgtaaaataataaaactaatttagtttgtaaaaacaataaattaaattaaataaaaaaaagttcaatttaaatttaaaatgtgtggaaaatgggcaaaaccatttaatattattttttttactgacccaatgagcaaaacaagccattatttattatacataaaatatgctcaaaaaacaaaaatggcaaaaaaaaaaaaagtgtaattttgatgattgttttggcgatcattttccgtctggcagtcg

SEQ ID NO: 10949 - DNA, 1367 bp, Heterodera glycines
tctggcagtcgcccttcccaggtgccccgtcgtatctccgtcgtcggaatcgccgttggccgataaagccgttcgatggcccattcgtcgtccacctcctcgccctcctccactgtcatctgctgggctttctcatcgtcctcttcctcttccacgacgatagaaatgtcctctctctcaactccgcccaaaaggtccacgagtttggccaacaacggacccatcgaagcgatgtgacgctgtccaatcagcaaaatggtggaggtaagcagacgaccctctttctaacgagaaaaacagttatgtgtcaatgttttttttgtgcattggtttacggaagtgagcgcgtccattcgattcggagacggcggaggcatcggacgaacatcggacgaatgaagcgacgttggagaggaagacatggagaagagggactgaaaattgggaaaaaagtaaaatttaagagaagtgtgccaattcaccttcaaaaagttccacaagtcacgcattaacacagccatttcgtgatttgtcgtctcggggagcatttcaacgcaaatgtcgatcagatcggggaaaaaatcagcctgcaattgtggaaatattatagaaacaattaatttaaaaagatattttaccgaaatgagaagtgcaaagagttgcctgcatcgctgcctaattgcgacggaaatgggcaaatctttgagaggagtgcactccaattgagaaagtctgcagaagaaaagcgaattattgtaggaaacagctgaatatgttattacacattggcaaattgcgctttgatgagcggcaaacaaaaggaaaggccatggaaacccaaatcggagagcaaaagcagcaaatcgaagaggagcggacaacggtcaatttgttgagaaacaatcaaatacctaaaaagaaattctgttttaacaatttaagacaaatttgtaagaaaatggtgggaggaggggaaaagtaggaactacgcaaaatgaatgatggtgaaccagtggatagtcgtcactcactcactgtgggctcaactcccgctcgtgttcatcccaatcgagccaagtgtaatgggcggtgagtccgtcgccagcaaaccgatcgacgagcaattggccctattttcaattgggaacaatagttactgggtcactgacagtttcaattaacaaagtaccaaaaactggcacatttccgtgtcgtacggcccatttccgacagggccgggaagtgacgcacacaaattttcgaccatgttcaaaaagaggagccggcggacaatgacactttcgactcggttcaattcattctcctcttttttgtggccttctcccatccacgctgttttgctgctg

SEQ ID NO: 10950 - DNA, 1843 bp, Heterodera glycines
tcgacacgtcgcctccgacgcggaagagtgccgttgtgcgccacttcggcggccgaacgccattccatggccaaatggcgaatatcgcggaggagagagtgctggaggggaagaaatgaatgacctatgcattgggaaactgggctcgattctattaaaaatcccacctctttctttttgtcggtattcaaaaaatccaagcatcgaaaagcgtcgaaattgaaccgggcaccgacatcgcggcacccgcccaccgacgggttgaaacagtgtttgtcaccactcccacaatcggtggagaataatttgtcataggacttaatttgaaaatgataatattttttagactggcacttaccccaaacacttcgtccatcaacgcggccaacaaatgcgttttgctggccccaatttgggcagtgaaaattttgccggaaatggcgaagcagcggcacacaaagtccaccccatcggcgggagtgccccagtggcctaaaatattttaaaaatataattaagtagatgatgcaaattgaattcacttctgtccacaagccgaagcattgagacaataagcgcacaaattttagtgagcaatttgttgtggtaacgaagtggaagttgcacttggggcacaataatacacatcaaacttaaaaagataggagggaggggaattaaagaaagcaattaacaaagcattaattatttaattggcaagccaacaaacctgtaaaaggtgtccaaaacgcgtaaagaaggggcaccaacactggaaccattttgggactccaaaaagatgtcttcagtgccaccactttgctgaagaagcgagtcaacgtagtcgagggtccagccgagcagtgcgtcttgcaattggccacgaaggtcgggcaaagaaatgctaagcaaagaaattataaaacatctcattttggttgtggaatcccactgattgttgtgagtttcacaagttcacatctcatgggtcgtcctcccatgctcaccccaagtgccgaattggactgtcttccggcgcggtttgttgccatcggattaatgtcagcacattctccaccactttgctgccattttttgggtcggtgcttccactggcatcggtggccatcacaaattggtcccattcggtgccaaagcgacgggcatcggccaaagcaagcaaaatggcagcactcatcagaccaagttcacccgacgactgttgtcggtgttggcaaagttggggcaacacagcaatgacgagggagaccaggttggccagctgaaatgggagtcaaaagcaatttgttggaaaagttgaattttcatcgtaatgttcccgcccgtttgtcctgcctctttgtcgtcttttgccgcataaatgagtcgggcaaccgttcgtttttgccattcctcgcgatccgacacagtccaaaaaaggatggacaacagtttggcatttaatttcccactgaaattcaaaaaatgcctgaaatgatagtgggagaatttcaccgattgcccccgacgagcaccgatcggagcagagtccattggaattggagatcgctgcggaactgctcgaagaatgggatgtcatgccaacgagctgagggcgccaaaggcgaggaaaaatcgggactgcacatacgacgcagcaaatcagcgatgagcacgtcctaactaggaaaaacacggcttaaaatcacccaagtaaacgttaaacaccccaaattcaatgcccaattcatgggaccaattctgaattggcatcggcaaaattgtcggctgcgaatgagtggcggtaggaggaggttggacattcattctaaaggaatttgct

SEQ ID NO: 10951 - DNA, 3377 bp, Heterodera glycines
gggttatggttttgtttgtacacttggcagccgtacgttgctcctgttttatggaagttaagggtgggatgtctgagcaaatgatgctcctctcaaaagtgataaaaattaaatgtggtcattaatttatatattatatgacatgaaaagagtattttttcaaaattttcccggttttaagtatattttggacgatcaagatcacaatgaagtgaatgatctgattaagttaatgctaatgactttttaatcatcataaaaagatatataaatttgtttgaccataaaatattcagttttttaataatttataatgctaattgtaaacattagaccactcaaaaaactcgaaacaattgtccattttcaatttaaaaaatgttatcagaaatatgtgaaaagctgtgccggaagtaatcaccgagttggggacgaaatgagcagggaaacggcggccaattgccaacggcaccaacaaaacggcaccgatcagcggagaccaccgctgccccagcagaaggggtcggtgatcggactgacggatatgagaggaaatgcgatggcactgagccaaaaccaggcagcttactttgatcagctgagaaagtattggaactgaattgggtggcagaagcaggcggcacgggacgaattgggagagagttttattcttcttttcccttaaaattgattattatcccctcattatgctgctgtaattattttttcactgaaaacactttccttggttttcgggtcgtgaactcgaatcggatacccgttttgacgaattccgaacctctgacccgaattcggacaaaaagtcggaagactcaaaattatcgaaatatgccgtttttgaaccaaaaatgctaaattcgaagatttggactttagattttttgttcgagtccgggttcggaattagcggaaatagataccgggttcgtggtcagtaccatctaaaacgcaaggagcttgttttatgacaaaaaaatttcactgacgcattttccattgacgcattttccgggcgccctcccgccgcctcggcttttaggatttataaaacccccattttcatttcgttttttgagcgataatcacatcaaaaattttaagcaacttcatatttctgtgtatgattgaattttgaatttccatttcaaaattaattagtgattgctagggctgctaattttatgtaaaaaaatttgcgaaatatgtaaataaaatatgtatgaaatatgtacaaaaacccccaaatatgtactaaaatatgtaaataaattttttttagtggtaatcttttggataaaaattcttcgtaaaaagtaaaacaggcacaaaatgccatgaaaatgagggcttagaatcacattttagtacattaaatactcatttttatttcccattttgaaaaaaaaattgattttttagggatacattttcaaaaaaaaaatttgaatttttcgcaaaaaatttctataaattctaaaaatatgaaaaaaaaatgaaaatgtgtaataaaaaattgcaaaattttggatttttttgggggatctaaaaaattttccttaaaaaatccttaaaaattgcaaaatatgtacaaaaaaatgcgaaaaagtccaaaatatgtataaaaatatgtacatatgtaatatgtagaaaaaccccgaaatatgtaaaaatatgtaaataaaagtcccaacttttgttcacaaacacaaaaaagaaagtgtttttcctactaattaggctatggagaatccaggaaaaaatatgtatttacataaaattagcagccctagtgattgctgaacagaagaaaaagaaatatttatgtattatctttgaaatgatgaaaagctgaaggtgatcgcccttaaataggctcgaagtctcatttaactcaacatttggccaacaaataaaattggcagacaaattgaaaggcaaagggaattcgttttgttgtgttttttgcgttggattgccaatgagagtgaatttcgcaacggcagtaaaacaaacattccgaaaaatcaaacaccattcattcatcaattaaaaagtcacctttcggcttttttttgaatttctatggcataaaaacgaagccaaaaacgccgccgccgcttctgctgaagtttaaactgcttttgcccattctgtgctgtgacgttagtcaaaaaaccatcaaatgaataatttttgacataaaattattcataatttcgtctaaaatggatcaaattttataatattgatatttttcgatagccctaagtgttttctattatcctgcaaaatttttaaaaaattctttaagtttaaaaaaagttatgatctgagaagctcaaaaacccaagttttttttgaacatttttagtcataactttcttgaaacttaacgaaactttttggaattttgtaggctaatagaaaacacttagtgctatttaatgatatcaagaattaaaaatttagatgctcttgaacaaagttatatcaaaaaatattttcatttgatggttttttgactaacgcccattatgatggtttttgactaacgtcatagcaccattttgactatattcgcatcaacaatttcatcagcaacaattggaaaacagattttgaaattttttcatttaaattcaatggaaaaaacactaacgaatttaattaataaatttaataatagttaaatattccaattggcattttcctacaatttcttctttcccaaattgagggggcgttggccaacgacagtatcccacggcacatacggtacttttgaccatcggatggaatctcatcgctctgcttctgttttgtgtaatgttttggacactcttttcacaactttcctgccacttgtgcaccaccagcaacaaaatgtttctttatcagcacgagtgagttgagaaatgagacaatttttgagttttttaaagcgtaaattgactacacagtacggtcggtcactaatcgtcgtgccgttttggttggttcatctgcttgctgatcagtcagtctttaccaattattgcttctgctacgctccgccgtcctccgtcgtctttcaaaattgcggtcagaacatgccgccaccaccgccaccattgcctcccattccttggccttgttgcattcttctaatgctgccaccaccgcctcccattcctggtcccatgccgttgcttcccatttggccccttcccccgctcatttgtctgcctctcccattgcttccaaacattccatgaatttgaattggtgccacgaggagaagcattaggaaggaaattgccagcagcggaaaggaaagcgcattttgcctttaaacgaaaaaaggagaaatatttcaa

SEQ ID NO: 10952 - DNA, 1221 bp, Heterodera glycines
  misc_feature (1125)..(1125): n is a, c, g, or t
  misc_feature (1146)..(1146): n is a, c, g, or t
  misc_feature (1156)..(1157): n is a, c, g, or t
aaaaatttcaaaaattgtataaaatttttgcttttattccattaatattccattctttaggggtgtattttcgtcccccgcgggggagaaaggtcaccgggggcggggggttttcggggggtcttaagtcccgggggcggggggtgaaggccaaaaaacctatcccgtccccggggacgggggcggggctcgacccctacattagaatgttgaatctgttaagataaaaatgccatacattaatggcatacaaacaagcgataaatgaattgataaaacaaaattgtctaactctcgaaaataaagatagccattaaaataatgacaacatttgcgagaaatttgataaaaatgcatccaatcaaaaagtttttggtctacaacacggttaatgggttaattaatggtgggcccgtttaaaacaacccgtattgctccgggccgccccccgtaaataattattttaaaatgatcgcaattcaatgagtaatcctttcattgatcagagcgttcggttcagcaacatcagttcagcagtttctgttgccagagttgtgtcggcattgcccagcagcagttgttgctcaaccacttgaaacatggcatctcaattgcaagcagtgaataatcataaaaatgactgaatttactaatttagaaataaaaaattaatttttcaaaaaaattttttgctaattttcaaattcaaatatcaatcattagctggtagcactctcctccccgcgatgatcagttttgtcgaatgaaaaaaggattaattaatatttgaaattgtttatttattcattctcttatcggttgggtcatccctttgcccaaagcgaagtggacgaatcccacaacactcggataataaagtgaaaagaacgcataagacacacccaatggtcctatttatggaatgccattcaattacctttcacttatgccctttgtccacagttttacgattggaagagttatgccattctgcgagaataaagcaattggcacagatataaagcataaatgtacataattgctgattatggacagcaaaaaatgagcgttcaaattgttcattaccaattgtccatcattaatcattcactaattgttctttanaggcgccttaattactctctnaatggcattnngttgtgttctcatttgacacagagcacaggcagtgccaaagaaatatttgtgcttaactcagca

SEQ ID NO: 10953 - DNA, 3295 bp, Heterodera glycines
  misc_feature (73)..(73): n is a, c, g, or t
aagtgtacttctgcactgatttcgtaatgcgacggcaggcccatgcactgaaagaatgttgaaactcattttngggaaaaaatttctaaaattcgggtcacgattggttttgaggggtcgatggccatttttgaacaccctgagaccccgggcaattgccaaacctttccctcttctttcgtctggcataaaatcggatgatcgggaagagtcccaaagacagggctaataaaaatcgagaagaaaattgtcataattgccgtggtaaagaaaaggctattgatttttccaacaccacgcgattcccaattcgaggttttcggtttaactttgtctgtattttgcccgcaggccaagccgatttctggtctctcgtcggcattctcaatttcggttttcacggcagtttgctcgttgttcgagtccacatgcgcgattaagttcatactaccaggattacctcttccattgtccattggagggtgattggatgaccctcgaatattcattgtgattagcgatttgaccaattcttccataaatccttgcgatgatgaggaagttgatggttgcatcacgttcacttcatgtgcctgttcacgccaattttgtcgcgattggtgctgtcgttggttccatccaacatttgtgccacgttggttccagctattgtttcctctttggttccaatttgaatttcctccacgtcggttttggaattgggcttttcttgcattgcagttgttggccaaatgcccgactctattgcagaaatagcaaaccgggttgttagaccaatttctctggctcatgtgctcctgtctccctcttgcccagccacgattgctgttgcctcggcctcccctgttgctagcacgttggcgctgaacatcatcagccgtgaagggcctgaacccccaagtgttattgcgttgctgtcttccaaagttgcgatcattttcggcatttggatttgaatttgattgctcattttcggatttgtccttcagcgcattaatcagatgagagaggcgagtgacatcatctcctttagaggcaagaaatagagcctcaagctcttctgcttgggctttgaccaattccaaattcttggcttgcgtaaggtcaacaagacgaatgaggaagctcatgtttggcttgagtctgtccaaaaattcctcacaaactttctctttgcgctgatcaccagacaatgatggatttgatgactcaactagcggagtcatacgccttaaaaattggccaaccgtttcatcctcacgctgtcggcacagtgcaagggttcgcttcgccaattcccgtcgttgaggcgagtccaatttggctctcagggcatccaaggcgctggtaagagttacgatttggtcagcctcgagttccttgaacagggtcctcggcgtgtccttgagcgctaatttgagacgcgtgactttctctccttcagtcagatttttcccggacaccgataagtagtccttgaatcgctcggcccaatcatcgaaagcgtataccgattcttctccaaataactccaaatttgaatttatcgataatgagttgctcaacatgttgatgccaaagaaagatcgggttgggccagcaggattgttggaagaggtcccgacgcctttctgtgtctgcgttgtcgtgccgccacctgtgcttaacaagccacggtttgtgcccttgttatccttcaacggcatttcaaattgtgaggagtcgtcctgctcgcgcactgtgctgttggcatctgttccatcatttgctcgttcgagatcgtcgatttggtcaaccaatgtttcaatttgggccttgactatctcaaaatttgagttggcatttgagacaacctccgagacccattttgtctttttgtccatgcaacggttaagagccctaatggaacggttcattccgtcttccaatttgaccaattcgttatgggcggcctctaagtcagagactttcactgccgtctttcccgaccaaaatttcctattaatgaccgaaattgtcatttcactcatgtcctcctcatttctcaactcatatactgtattgtgcccgcaggcggaagtggtgcgacgaacccctttagggttgtcgggaatatccattgctttagttggggagagagtacaattaattgttttcgattgcttaacaacaaaaaaaaatattagtttctaattgaaaatgtggtaaatcataaaatgaatgaccaataaaaacagtggaaaaatttccgcgaatgtcgctctatttgaatgaatgtgtaatgaacatcgccaatgttctcacgtaaattatgtgaactgatcgcatctccgctaaatgaagagcgctgccgcggcctccgttctcacggccaagtaatgaatggcgaataacaagaaaatttttcgcaatctttgaactttgaaatgggcactaattggacgaacattgaactcattaaaaataactcaaaaaatcattgaaatttaattttgccgtaatgtaaattaataaacatccgctagtatttaattcatagagcacttatttcacaattttctgaattatcatgtttctctaatgacgcattttgaactttggcacactgctcataagttatgtaaattttctgctgattaactcaaattaaaattctgatcattagcacttttaaagtatttgtaaattgttctttattttcaacttaaattcaaattctgatctgtctcatttaaaagtgatcactaagcgcttgactgtattgtgcccgcaggcgggtacccaaaacattctctcctccggcgccattactttgcccgcaggcactgcggctgctgtcgtcgtcgatcactcctcattgtcgtcgtcgatgaaccgtttgccggaatggcaaaacaaaccatccggtgctaccagtgagggaggcgcgtgggtcccccagacgactcaccgcttccgaataattagggaggacgatttgggaggatggatcccgggccctgggatcgatgttaaatcccccaaattgcctcgatgttaaagactaatttattctccggataaaatatgtgatcgaaatattccatggacggacgatatgagaaaagtgaattaattgatcgatggtaaatccgatgactccgacgactaactgatcgctggggaaaggaaaagtgtgaagggaacggaaaaggggcggggatgaaagagataagaaaagcgataatggaaagtggaaagtccgactgctgagggaaaatgaaaattgttttta

SEQ ID NO: 10954 - DNA, 1258 bp, Heterodera glycines
tattattcccaaacatttgccatcacaggatttggagaacagaagggccaaaatctattggacaatttgccaatcgctgacggacgctttggtcagtggcggcgtcgtcggcgcacagagtcaaaaaacgccgtacaaaacgacactgaaagaggtcggtcgatgcagtttattgtacattttaggggataggtatgcagcactttattttccttctgcaaaaaccaaaacataaatttataaattaaaagaaattttttgaaaataattgaaaccgctttcctgcattgtcacgtaaccgaacttattgacattgcgggaccaatttgaattttcaaaaattaattctcaaaagttccaccgttttaaaaaaaatttaaactatttggtttggtctaatttaatgtaattccaaatgtcgacataaggcgaaaatgcccagaccaaaaaactcatacagacaactgtaattttattgtaagataattagagatcggcctggacctggattcaggcctggatttttccaggtctaggtcatttttcggcaacctggatttttcctggacctggattttcctggatttttgtccaggaaatccaggtccaatgtgaaaaaaaatccaggtccaggcaaaacacgaaaaacctggattttcctggacaaaattttagaatttattatttcaagtgaccgatgtttttttcacgttttcaaaaagtgattaaataaattcaaaactcattattattgtaaattagatatttttagatgttcccaagcaattaattgattttttcaaacatttgttttggttttaaaacaaatttcaaaaaatccaggtccaggcctggatccaggtcccgaggagcctggatttttcctggatctggatttttgtccaggaaatccaggtccaacatggaatccaggtccaggtccaggcttttttcaaaatgtcgatctctactaatcacatgttttagctgttttctgcgcttccctttgagcatgccgctcgtctgcttttactttccaaagcgattgccaaaaattgcaattccctcgtgcaagaacaagcaaaagggtggaaggtgaaaaagggaattagtctttttttccttttttgaatttattttactcgtaattagctttttaataggtgttttccgaagagagagtcgacaaacttatgaaattctttcacccttccgtcctccgaacattggagagaatgaagaggtgagttgtgttatt

SEQ ID NO: 10955 - DNA, 1568 bp, Heterodera glycines
  misc_feature (1365)..(1365): n is a, c, g, or t
cttataaacaacatataggcagattaagataaagatcttttaggccaagccaaaatttttgtttagtaatttattttgtttattttcatttttatttacaacagtgtccaattttctggtgtccaatttaccgggagccagtaaataaggcaaaaaattgattaatgtgacttttatcagaaataataatttttttcgtcatattttattattaaatttttttaaattaaatttatcaaattttttgctaatttaattatctcttcgtcccctgcgccggccatgccaatccccgcttcgtcgtccccgtcgtttggcaaaagtggtccccgctcccccgcccccgtctcctctccccgcgtgtatgacatcatttgcaattgttgttggttgtggttgtactgctgagtactgcttgatgaggtcggagccatgctcatcagtatggacatcgcactttgactactgaatttgacaataataaattgccatttattagttcggaattataattaattcaattttatttaaaaattattttatattcattttatctaaatgtaattttaaacattttaaataaaaattcattttaataaatgattattattattgtttagtaattaaaaagagaatgtgcatcaactattgtaattaattattaatattttttatttaataaaatattgagataattatttattttttattaaccaaaattcgatatgcattttaaaataaaattttttttagaaattgatgttgttaattaatcaattaattaattaccccgatggatgttgagcatttttcatcagaagcgtttccttcatttcgtacacttcttccgacgcgtttgttccgctgcaaattcgtccattgctcagtgccaacactcgctcaatgccaatccgatcgggcattgccggcggcgtttcttcaaaattattattttggaaaatttactaaaataatactttcctaaaaaataaatgtaaaaaaattaagaggaatttgtaatgctatttggcttaatgatcggggacccattttccggctttttgttttaaattttttttatcaatttaaattttcaaaatatgagtttttgtgcaaaattttattttcaatacattgcccttattttaccaaaaaaaccccaaaaatttttaaatattattttttaatttaaaatcgcaaaatcaatctccccgcgggggaaatggacccacgaaataatcgttttacaaattaatgagtgagtaccacccgctgctgctgctgatgaattgcgtgcacatttggcattggacaaattgccaaactcataaattttaaagggtctggatcgatttcgtgcccganattcgcttaagccatcgaatttttttattcttttttttcgcagtgagcgcatttttagggtggcgcttcaaatgccgccttaagtgtgacatggaaagcagcgccgacggcgacaaatttgtgacccggcggcatggcacacaacattattagctgtgctttatccgatgccctccctcccctcgggaaacgaatctctgggg

SEQ ID NO: 10956 - DNA, 1206 bp, Heterodera glycines
tctgggggaagaacatttcagctgattcgaatttatgccttggccgtttttcggaaaatccaaaattagaacgccttaaaccgttaaaatcctacaaaattcgggcatcttttgaattttaaaaatgcgattttaattaaaaaggaattatttacctacccagatctaataaatatttaatttttgaagattttcgagaatcgaggaaaataaaaccttctcttaatcacttagatttgccaggatatatttgagaaattactttgtatttattagagacgactgaccggacgagatcgggatcccacaagattaaatttggtatcccaacttttgggatccgcaccgagcgttttttaacttcaccgggataggataggggacctagggattgtctcggcgatttggacaagatcccgacctcgggattcgtctagagccttttttagcttcatcgggattgatcgggatcgggattttggcaggatctcgacctcgggattcgtgtcgattttttagcttcaccgggattaatcgggtcctcccgactcgggatccctcctacccgagttgtccggcctctagtatttattgcttctgactatgcttaaactaattgatgtgactttaattgccccaggacaaccttctccaaaaatttatgccaaaaaatttacctttttgtaaaacgaaaagagttttgttaaacaatggttttaaatcaagaaatcgttttccaaaattcttggctctaatgcctaagaagcatttgtttattttttttaattttgaaattcacaaagatgataactgcacataatatatccgcctcccctgtgtgcatttgtggatcgaaaggagaaaagcgaagaagaaaaatgcactccggatagggcccgaggggggggggaaagggatatatcccctgaggggatgtgccacgagaaagagggggaggctaactcaatttcctgtcggctttatgtgtgcgccgtgggccatgttttgtagtgggaggggcgggggtggtgaaaaacgagccggggcaacgaaagaaattaccagcccattgcctgaggcaatgagggggagggcacggcgtgcccgaggctgggggagggctgggaggctaagtgctgctcggagaggtgggcacggggacgacgggccaacccccggggacggcggacacacattttgccaaaa

SEQ ID NO: 10957 - DNA, 1803 bp, Heterodera glycines
aggcttggaaatctcgctaagatttgttcgataattattcctaaaatgggaaaataattttaggaatcaaaggcccaacgctaataaaatattcccatttttttaggggaggcgaaagccaacaaaaatgaatgaatatgtaatgattgttcagattccgttttcccacacaacaattttggatggcaaataaagtaaaatggcaataattaatttgcataaataataaatgtttttgtcggtgctcgagagtcgagattctgtgggtgccgcaagtttatcgccggaagcgaagggtcaggggagaaaatggtgaaaaaattatgtcaagaattacatttggactcaaatttgtgtccattaaattttctaatttaaaaataaaatcttattctatcattatcatcaattttgaaagtttgcgggaaattaatttaaatttgctgggattttgttaataaatttgctcaaatgcggcaaaaaattgccataatttttctcaaaagtaaagcaaattcatcattcgacagctcgggaatggatatgtcaaatgaaaagtgcaaaaaaatagtttcaagaataattttccgtaaattttccaattatttaccttcaaaaacaaaaataattttcaataaattttcaaattttttaccatttcttcttcaaaatttccaaaaatttctcccttggttttttgaaatgctaaattttagtcaattggagacgaaatttccaaaaaaaaaaatagactctacaaaattttacgatttcctccgttttcctttttttgaatccctccattacatttaacttaccatcgccatggttgcccttcatgtgcatgttgttcatcgtcgccgtgtccgtctcctgctgcaacaccaccacctcaacattgtgctgctctccatgctgcggttgccgttgttctcctactactgcttcgttttctcggcatttccaactgccaatgctttcgttgttattgttattgttgttgttgctatgataatgattatgatgccgccgattgttgtaagaatggccatcaccaaactgttgctgcttttcctgttggtactggttcgacagctgttgatgatgattttggtgcgtccaccgctgtttctgttcatgcttcaacttctgcggcggcggttggccattgtgccgttggttgttattgtggcccttttcaatgcccaaccgataagcggtggtgtcgtggtcggcatcggcaacaccaaagcaatgcctttgtgccattgtgcagttattgccgacgatggcactgttggtgctcttgaacgtgctcatcggcattgcaacactacctccagcatcgccactgctgctgcaaatgttgtgattctgctgttggccaacacccatgtactgttgatggccaagtacggtagatgccgtaaggcggccatgtctactgtaattgttggaatatggttgaaaagttgcactagtaaaaactccgaattttaattagctgggaactgggaacccactgagtttggctcccggaaaattggacactaaattgactgacaaataaccaatattaaataaatcatactttcgtgaccaaattaccgtaattagtgaaatagaaccctgtcccctgaaataaagccccccttttgatgggttccaattcagtaaatacggtaggtcattaagccactatttccaaccccttggattaaggccaagataaagcaggataatgctagtatataattaaaaaattttagtgggccgtgaaattcaaaaaaaaaatgcccaaca

SEQ ID NO: 10958 - DNA, 1423 bp, Heterodera glycines
tccgtttgaaaacaattgtaaaacaaataaaatttacaattgaaagaaaaatattaaattaatcaattattaaatatttaaattaaaaaaacctgctttttgctggataatgttgaaaattttgtggatttcaattagcaaaaataacatttaaaaatattttcaaaatatacatatatttaaaagttcaaatcgagtaattaatatgatttggcacggtaactttatcggttaaaaacggctaaatttaaccgatttttttttaatttgttagtaatttagccatttattttctcatttttaaattatttcttaattatgcattttcaaaataaaaattgattccaaaatttaacacagtccgggatcatttgctggcgattttttggccaaaaattgttgaaaaatggtgccgctgcccgcgggcatttcaaaattatgcccttggcaattcggcagcacttacactttctttgagcggcacattttccccatgagctgttgtgcccccccccccccgctttggcccattcataaaattttgggcgcccaaaatcgcccatttccggccaatttatggcaaaaacacagcgccaatttttgaaaagcggggaaaaattgcgaattgttttaatgtgcttatataaaaaaaaatgctttttggatttaataataaaatattttgattggcaaaatattttttcaagtaacgaaaaaatattttttctcttttttgtttaattaatatttttttaaagtgactagacactaatttaataaaattagattaaagaacattttttaatgaatatatgcaaatgatttcgactgaattttattaaatgaaaattttttaaaaattaatttaatattttgcttttaaaatttatttttcatacgaattggcattttaacgaaaaattattaatgaaattggcataagcaaattaaatattttgattaacttttacgaattcactgcaaacaattaaaacaaatattaatgaaaaaacaattttgtcaaaaattagatttaaaaattatttccatttttatagtatttgttggctttttatttaaaaaaagaaaattatttactcttactaaattggcattttggtagatttttactttttttttaaatttgggttttgagtgggcgaaaagaattcccccaaatttttgctcggatgccttcacattctttcggtggccaagtaacaatggccaaataacaaatgaatttgggcgctcattgtcggtgaaaattgaatgtctgaaatccaatttgctttttggggaaggcaaatcaatgccaaaaaaagccaagaaaattcatcgtacaacccaaaattggggggatttggggggggggggaagtgtgacggcattttgtattagcgtatgtggaaataaattgaga

SEQ ID NO: 10959 - DNA, 3057 bp, Heterodera glycines
cagtaattccgagtcgtcacgcgtgcggcaacaaaagtgttgcaatgtttcagcaaccaccaattcaaaattgtttggtgaaacacgaattgcggggaacaacaacgacaaaatgtgtggcgcttctcagagcgtcttcaaaacatgcagttcaactgctgcccatttgctaccgaaacaacaaaatgttcgctatcgcgtcccaatgtcgaaccattcacatactgttgaccagaaccaagtgattcatttctctttgtgcaaacaaagcccttaacatattaatccatgtccaagggttgctaaattttccacttttcgtaccccttggatatgtgttaaccattatttaaaacaattctgattttaaaatttagttgactcgaatggtttttaccgatgctgatgaattcaaattttggcgttctgtcatcgtcaattggtgagtgagtaatgattaggaattagagtttaaatgcatttcttggcgttaagaatttatgcaattcacaaaaattcaagctctattatttttaagattttcgtttaggtttactaattttgcttccttcaataaactcggatatttttttcatgccaacttttctggagccgatgttcgttggaattgcaaaagaatcaacgaaaacactgggattgttcaacgacttcgtgaacagaacggtcctcaaatgagcgcggatctatattccaaaagacataaaaataaacattttacgaaatgattattttcaatattatccaaacaaatagatttaggtgaattgcatcgcgatttgctcttctctctgcgtcggcttgggcaatggggcgggacggaccaatcgcaagagacatttcccccctccaatggtcctcttttgtcagtctctttgactgcccttttccctctctttcgttagatgcctttgctcacttcgttttggtaaaaaaacatttgacttcgatggcgcctataatcccccgagaacaagctcaatgtctgcaaaatgtcttcaaacatttcgcacactttgaaattaatagcgcaaccaaagattggactcaggaaggtggacattactgtagtataattataattacagtccattcactgtaaacattactgtcattttcagaattgcgtctttacaaacgcttgtttctcggcctgcggctttgcactttgacttttcctcctcaattgttacgcaatttgcaaattcttttcaaatgcatccgccaattttgtttcaatgccaaattaatgcgagaaaattgttggtcagcaaatttaaggatctcaaatgaggagaattcactctcaatctgtgaaattaatgaccagcgcattgagagagttcgagaataagtattgtgtttaaacctaaactttaaattaaggttcttcgagaattattcgttttattttttccgcaaaaaaatttggaatgtccaaaatcattttcgctgtttaaacttttggtggaacatgttacgccgtgtcttatccaaacgccaaaatggttggccgatgaagtgcaaaaagaaatgaaagaatttgttaatagtgggcaggtgaagaactgtttctaaaaaatattttttcttgtctctttaattcatttttcagactcataataaacaaaggacaaatgagaccattttgcctgccaattggtattgcgaccgcattaacagaactgaatatgaagcgcaatcaaaagactcggatcgtcatttgctcgaccttttggatcagattctgagtaatcaccatccaaattctttgcaacgatatgaccagcttaaaaaggtccatcccggcacattccgccgattgattctcccaattcattttcagttccgactcgcttatccttcaatttatgagaagcgtttcccaacacattcgtctcatttggttgtgggcactaaccttaatcattcttgaaactgaccggaactctgattgtgagaaggaaatctcattcataaataaatgttcttttatttttatggactcgaaaataactatttttgtaatataaaaaattaaattattttttacataattgattaaatgcaccgtaaaactctcgtcctaaaccgaccatccaaagcaattctgtgatccgtttcttttgcagttccttttgcgttctccgaattttaaatatttttgacaatgaaaatggaaagcgaaatgtctttttgcttgatccactgatcattggatgtggcctctccttcgaaactgtcagttcaaattggaaatgtccgggtcggcaaagtaacactcgcgttcgatgcccaaattgtattggtcgccccttcctcccctgtaaatgctggtcacaattcggaaccatcccgtttctccctaaatgctcgaatgattgttgtgttgaaggagtgcaactcaatgcttacccacgcgtccccccaactgttgcgcacaatccaaaactccgtgttcgacacgtcgtcccaaccccaacccgacaccgacacaatgtgattggtctgcaattggagaattaattagtggcgccgcgggagtccgagattaattagtctcggccaacagccaaaagcaaagggcaactcaagagtgacttttatcggtttcgagacaagcaattgacaccgacacccaaaaacccgaactattttcgactcggtgtcgagactctcgtgcagcccttcagagtaataaaaaacaaattgtttaccggggcatccgaagtttgttggaagatgcccccggtgtaattgaggtcgaattgctccgtggctccaattgcgcaagcgattggtcctctgttgtgtatttcggacatcatttgcagtctgattaaaaacaacagcaaatccagctcaattttattctttttcttttttaccgtcccgaaagttttccgtagtctttgacgtaataacgcgtataattttggagggcaaaacaatctgtgcttttaaaaatgtacacatttttatgttaagttctcgttgaaaaaccaacagtcgggccaacacgaaccgcagcgagagaac

SEQ ID NO: 10960 - DNA, 2591 bp, Heterodera glycines
gcaataatttcctccaatttgtttataaaaaagcatttatttgtttccaaaacctgcggtgaaagcatagtcattggccaacgatttttccgtgccacgttaaaccggtcctggagagagccttcgaacggagagcgacagtccttccgattgtcccccctccccccggcctttgttttgcccacccaaagtgccaaacacccaacagcctccacagtagaccgggatgtgctggttacggttgggcgaacaaaagttggttccggaccttcagtgctcgtgcgattaatttgacgtatgatattgtacaaatgaatttacgcacacatttcgccagtcccactggcggggaatggttgcctcaaagccaggcatttcccaactgcgcgggtacgtccgatgttctcggaatggtctgtccatcggtcgaaggcacgggggtttgtcccttggaatgttatgggcacggcgacggacgacattcggcggagggatggcattgttcggatttggatttgggaaggcggtcgaagggaaggcaattcgcttggagacggaaggcactttctgagagaatgattggactgctaaagacgacgcaagtgcggaccaaagaaggacgcagatgaagcattcgctgcgagatggagccgaatttgtcagccccagcgaccatccgatgccattcccaaaaagcacccaacggaccatcggcggattcatccgccgtccctgacaaacaatccaacatttaatttgcacaatccgaatgcatatttgaaattcacaaaaatagactttgaaaaaagcattaagttttaccaagacccaccggtgttttccatcaattctaattcatcttcaaactgtacaattgtgcctaaacatctggccaaaagaacagtgctgattgtaagcagcaacaaaacattaaaatccccgaatggaaattgcagaatcatcggacaatggaaagacgcgttttaagtgaaaaaaggggggggggggaattcggttgtaaaaaaaagtaccgataaatggaaaatgaagaaagggctggctcttaataataaattaatttgtcggtcaccgcaccttatcagtggcgggacatttttatcagtgaaaaagacaaaagagagaactgcgagagaacgttagggaagcaaagcaatgaccgaagaaacgccgacggattcattgggtttaaactttaaagtttaaagtcagtaagcatcagctaaatccacatgcgaatgaacaattttaaggctcaatgacttttaccactcaataaatgaagaatgcttttgtaacaagccaaagatggtgaataggtcgcgataaaaagcgacaaaagtaaaaataaaaactaaacttttgctgtgtgtggaccatcccttagttttattcgactttcaacgcctcatcgtgtcaaccaacattcatctatactcattaattaatttattttgcagctgttttgatgtactaaataggtatatgtatggacattgaatgtattacgaaattaattgagttatcaaaattcaaactgagaacgagaatgaaacacagacttgtcaatgctatttatcacagcgtccgggaaatgagctgctgtaccagaaaagatttgcatgtgtggcgaagtggtctgtgagaaggtcaccaaagggagggtcccaggttcgagtccagttcatgctgtagctgtatttcgatgattttaatgaataaataaaaggacaagtgaccaaaatgacttgaaaattgtttacgaatttttaacatttttttttgtcacgtgtaatgaaaatgaaaaccatcaatcctcgatcagtcaacgacatcgatgttggcctcttgatcactttcttcgttcgttttttcttcggccgcttgttcccgcatttcctcctccctcttaatttgtttgatcaaattttaatgccttccatgaactcaccagcttcaattcgtcgagtctgccggtgtccagaagccaattcgagacgaaatgatgctcaagctgttgacgcatttgttcagcgtccggcatcgtcttccaaagttgctcaagtcgtcgccaaacggaatgcaacgcttcatctcctgaaaatttagcaccttccaaattgaatcccaaatgtccattggtgcagtgggtgtcgacgggaacggcaccaaatcgccgattggcgtcgctgatgtcgacggcagcgaatcgccaaattccaacatttactcgtccatctccaccgttggcactggtgctggagttggtggtggcggctccatcgcttcttcgacggatgcagcagatgttgacggccctgcttagtcctgctgtggcgtttcggcattggggttcggctgtggagcgtctgaaatttgaaaaatggaatttttatgttaaaaattggtgaaaaactcacttttgttggcccatcgggcttttgtcgcctttgccattttggttcgtctctcctcccgcttgtcccatcttttctgcacgggtttcttcacgtcagacttttgttttaattttttttttactcattaattcctgaaaaaaataattttattat

SEQ ID NO: 10961 - DNA, 3032 bp, Heterodera glycines
tttggccgttggtttcatcattcttggttccgttttccaggttggaagcaatgcttccgaatccgcttccgtttggtgccgggatgatggttcggttgaagctgttttggctttggtctaaagcatttgaaccaaatcaacgaacccccacattcagcaaaacaaattcaaaaattcctagcttatatctttaaaagcgcatttttgtgcgcatttctttttgactacatgttggacaaagctctttttgatcaattcaaatttaattccaaaaaaaaattctttcctgtctctaaaatcttttgtcccatggaaaaattttttttgttttttttcacttactattcaaagtggcatgcgatgccgcagccataaagatggcgaattggacaaagagcttgaggcattgggccatttggagttttgatggtcggctttggggattaaaagggagttgaagaggttaattgatattcctaaagggatttgaaatctattaatgattttgataagggatttgaaatcggttagtgatcttcctaaagggatttgaagtcagttatgattttgctgggcctatcagcggctatttatgcagctcattttgggcggagtttgggcttaaagccgaccgatccgtcgatggccgtcagtcgcgtccgtacgttagcggcggctccgccccaatttcccagcgatttgtccgccgctttttacacaaaaattggcattggaattccaatgccaaaagtgatgaatcacttttatgcccatccccaactgctgctgatagcctcacaatctgtccaatttgcccacataagcacaaattagcatcggaattttctgcttttcccaaagctaaaagtggcggtgattcatcatcattttgcccatttgtggataatttgtccatcaaaacagtgatcagaaaaatttgctttcccagagatgaacggaagtggcaaaaaatggaataaattaaaaacgattgcacaaaaataatttttgtctactttacgatttggtaaaaaaaaataattaaaaattaattgagaattttcaactgtatttttaggatacggtatcagtaaaattacgaaaattgacaaattaacgtgaaaatataaagcatttgctaaaactgccaaaaaagcaacaaaaaaagaagcagaattggtcacactgagaattacatatttgacattttcctaattgatcaaggttactaacgatctgatgctgatcagctgtacagacagagattggaaagaagacattctctcgtgcgacacttccactcacgacaacagagattggcactgattcaattcaaaaactataattttttctttttgattacatttaatcagacatcaaatctcttgaataatttaatagaattgtagaatatataaaaattcttgaaaaaagagtgatttgaaaattaaaacttatgctctcgtgaagcacaacaactcgccgtagactcagaacaagaagtggacacaaataattgcattattcataaatattttatttcattatttggcaaataattaattaattgaaggaagactcatgttaaatttaatagaattaacataagtgattgaaaattaaagcttatgctctctagcaactcgccgtagactcagaacaagcagtgaacaaatcaaataataaaattaaagggcttaattaatacaatttcgtccggctgttttgtctttgaaattggatgctcgtacatgaaaatctgaaattatcttgaatttggaccatttttggttaattatgataagagattcaagccggatttaatgatcagtagaaaaaatattgatctggcaaaaaatacaaacatttgaataaaaaattaaccatttttcattgtaaatggagaaaattgttaagtgtccttgaattcaattaaaaaaatatcgtgatttcctaggaaatcaatacactcgtccttagaaagcgtgtttttccaagaccagtatcctggattaaagccttccttggcttggatctaagacttgtacttacttttaagttcatcgtaaaagttctcaaactaaagaagcagcagggcttcgatttgtccttatttataaatgatgtttctgatgagaagaatagaaaacttaccaatttaaaatgtcctcgttttcaagatttatccttattttgggtaccgatcaaaaattccttaaaagatgatattttcagagaacttcttttcaaaaagcatttattaattaaccatttctttcaaaaattctttgaaaatttgaaaaataattaagaaatttaaagaatgctttttgccgcactataacttttttcctcattgacaattaaattaggtaaagtttgctccttttaaaaacgcttgcttaatatgttctgttagcctgcaaaagagctctctcccgccgactatttcggtaatccagcgggatcccgcggggttggggttactgtaatttttctaacaatttgcattttcttattactagggctgggacttttagtgacgaaaaatctcgaaataattaactaaaatagtgagtaaaaatgccaaaatagtgacaaaatagtggcaaaaagtccaaaatagtgagaatagtgacataattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttttttcatttcttaggagtgctttttgaaatttttttgtcgattcttaggagtgtattttttgaaaaaatttttaggtcgattcttatgggtgtattttttggttttattgcatttttgttaaggaatttcccaaaaaatgtcgaaatagtgaaaagagcaaaaaaaatagttaaaacctaaaattcccagccctacttattacgctcttgcaacattcaaatataaaaa

SEQ ID NO: 10962 - DNA, 1534 bp, Heterodera glycines
tgaactgtgcacagaatgcgctcttccgtgtagaaaacggtggtcagaaacagtccccgctggatgtgtttgacgaatttggagctggccgagaaaagatggcgaaggcccacgcggcgtttcttttcgcgttcggcgggtccaacggcacaattttggaacactgaaaagggcgcggagggatgtgtttactcgtccctttgtcccttcccttttgtccattggtttgtcgtccctttgtcccttcccttttgtccattggtttgtcgtccctttgtcccttcccttttgtccattggtttgtcgtccctttgtcccttcccttttgtccattggtttgtcgtccctttgtgtcccttcccttttgtccattggtttgtcgtccctttgtcccttcccttttgtccattggtttgtcgtccctttgtcccttcccttttgtccattggtttgtcgtccctttgtcccttcccttttgtccattggtttgtcgtccctttgtgtcccttcccttttgtccattggtttgtcgtccctttgtcccttcccttttgtccattggtttgtcgtccttgtcccttcccttttgtccattggtttgtcgtccctttgtcccttcccttttgtccattggtttgtcgtccctttgtcccttcccttttgtccattggtttgttgtccctttgtcccccccgctcacttttcgacaaaattgcgctttttctgtactgctccacgtgctcaactaattcggccaattctgacaattattctttgaaatgttcatcaaattcatcgcactcacttttcgagtcgggccttcccctgtcccaataatcctcctcttttccctcttcgtcctccaattggtcccaacctaaaaatgtgtgccgttcgtccattgcttatcatcaatcctttttttgttcttttcttgcttgagattcgtagcattgtcggcactgccattgccggagggccccacccccaaattgaggcgaaggaaacgcgaaaggcgaacgcatggcccaagggaaggccatcaacgataaacgattgggaacggacattgtccgcctctaaaaagccatcgaccgaagaaaattgggcggaacggctccattgaacttagaaacaattaagacagtaattaaatgtgaaagaccgcaaaccgcggagacgcacaacgatggacgacgaatcggagaagaaacgcaaacggaggagagcggcggagggggaaacgcactcggccgaaacactttcggggggaggggggaggcgggggacggagacggacaaatgggcgaccatttgtcggaggatagccagctgagaattgagtagctgcagacgcttctcatcgtcctaccgatcaaagaaatttgtcattttttatctgagaaaaagatcgaaccggaaaatgcagattttttttgcatcacaacctcaaaagctattggtaaaattaaaaaaaaaaattcgctttttcgcatatttcgctttttatttttctattgccccatccctggta

SEQ ID NO: 10963 - DNA, 3220 bp, Heterodera glycines
  misc_feature (3203)..(3203): n is a, c, g, or t
atccctcgccccaaattccataagcatttccgccgcttctttcctccccaacattaaagcaacatccaaaagagtcattttttgtgggaacagtgcgtaaatgcccgtgctcagcacttccgtcgttttgatgccttccgtgtgttcgccgttgccgcggcttcggctcaaaacggcactcaatgcccccaaatcgccctgttccaacgcactgagtgcgcctttttgggagaaatattaaatagccacgcttaaccggcagcggaaaacgcaccgaccaaaccgaccatcccggccttcagctttttcctgggcccgtcccagtcggcaccccttccatttttggcagatttaccgcccgattcgacgcttccctgccgatggactaacgaaaagaaattttggaaatgtaaaagaaaattgcaaaaactcacaaaattttacggacaattcagtggccgtgctgagaataaaaaagaaataaagagaaaagaaaagaaatactaaagagataatgtgatggatggaagatttaatttgaattttcaaaatttgttaattaaatcaaagcgaatccaagcggaaatgcgcagggaaagggcccaattaatgggaattccacgaaagagcaatcgatcgatcaatttgaccatccctcgggggaacgacggacattccatcgatcggacaccttcacagattcagtcgcggatccctcaatgagaagaggcggaggaaacaagcaaatgtaaatggaattaaccgaaagggggggggggggtaaagtcggagggaagggaaagaaattcgagattttgccaatttacgtctggtcaatggcgatccgtcccacctgctgactgcgttcccatcacttcgagagtcgtccaggcttcttccggtgccccatacgcttttgtgccgaaacaatgaccgagcggccaaatgatgggcagccgatggatggacagaaatttggttggatttgtccattttgaattggtacggcggaagcattccgagaaaagagtctaagagaaaaggagagatttgttaaaaaggaaatggtcaaaaaagaaaaattaatgggagaaaaaaataaaaaagggaaaaaaagtgaaacggacaaaagggaaaaggcggaagaaattcacacaatgcgcgaaatttcgtgtaaacacaaaaagattggcgcattatgaaaaaggcgaggaaattactcaattagtctcaggcacgccccgggggaaattgtattggacacatggggagagaaaccaacggggggggggggaaatgccgtggagagggacggacgggcgaaggcattgggttggttttgttggggagcgcagatggttgggcaccgggggagcgataaatggccaaagggagaggacggaaacgaaaatggcaaatttggccaaaggacggcataaatcactgtccgccaaaatgccttcctcaacggtccctcagaagcagctgcactcaatcgggcataaagacaacaatgaaacaatggcagatgcaaagcgcaaatcaatttttgcggattgccgcagaatcatagccaaattgccttagggtgggccaatgcgattgaattggcaactgccaatggcacgcaaatttaatcgccatcccttcccttgaccttcctcatttaattcctttccacctcaaactgaccgaaatcgatgcttttctctcccgcgctctgttctccgttcgcccctctgtcgtccagtgactgtgccgaccccgaaaagctttgtggctgtggggttggcgagcgcaggaaaagcattgatggtgcgctgttgcggtgccgttggtggcgactgagttcgcgaccgattcgtgtgccaatcagtttggctcgctgctggtgacttgactcgcaccttcaagagacaaagtgagtcatttcggcatattcgctgcacctcttcaatttggccgcgtcccttccgcgtgccgtttttgcgtcgtttttcactaaatgcatagtcccccgcccctggggtgccatccccgccgtttgtaccaacgcacccatccgtcggcgcattgtcttccttcgattttgttcctgcacatcgtgacgaagacggacaatgaaaagaatggcacggatcaaaggacgaccctttcgagcgaccatcgaattaccgacaaacaattgggaatactttaattcacttgcgcaagaacggaaactaagtgagaaattcggcagagattgtgcccttccgaaaattactcaatccgtcgtcagtcactgcgcccggagaaagatgagaaaagggttgtcaccggcacaattaaatttgcgcgccgatgagcggagttggcgacggaaaatgaagcggatggaaatggactcggaaaaggggggggggggggggatttctacgacccatcaacgtcaaagtcaataaatcaccgcatgggccaaaatgaatgttttggggaaataacggggaatttcgcccgggttttacggcctacgtctgccgacagaaggcgaaaagcgatgagaaacgatggtttatccgaatggaataacaactcacgaaagatattattacaacaaaggaaaatacaacaaaatacccaatattctattctaaaaatcaaaatagttaatcaaataatagaagaagggcgcgccccactacttactccgccatcgaatgatcgctatggcgggccgcttcgcggtcttcaggattctttttttttctgaatttctagaaatcttagacatgttttgggttttttcaaaaaagatattttgttttttcaaaaatttcgcaaaatcaaatgataaaaatcatagataaaataaaagattgctgcagtgttgatgccagattctttatagcgcctaaaactatcatagaaaagtgctttcctttgtcaagatcatgacaatttttaagtgctgggtggcggtcccgataggctccgccgggataatttttacaaattttgtatgaaattcgcaatgaaagtggtttttaacccatcagtaagtcattcattattcattcatctttggccgttattttggtcaaatatttcttcctcacttccatttcctcaacgtttgcgtcacttcggttaaacggtgtccaaatgggttctccgcggaacagtcgtacagcttcgacgaaatcctcaagaggaggggcggnggggggggggggggggg

SEQ ID NO: 10964 - DNA, 956 bp, Heterodera glycines
aaaatccatggttaaatggtaattgaaaagcattatttgcctgtctgctgaggtcacccacgggctccgaggaaaaggagcacaaatcgtccggtgccaatttgacctccttgacaaattcgctgagatccgtgcccaattcatcgctgctgactccgtccgcaaaggcaatgaccttgacgtacgaactgtcgctggactgtccgccctccacttcctcttcgtcttcctcctcctccccccgacttatggcttctccttcattttccaaccgttggtcctgttcgccacaagcaaaatgaactttctcggctaaaaaaggtcaaatttgcattttaaaatagaataattgaaaaaggaaaaaaaattaagaatgggatgagtcaacaatttctattattgttttgcattgtttaataaatgcctagttttaccactttgagttgaagcgattttggtgcttaaatccccgaaagtgtccatggaaagggatgagttccgccgcattgtcaattcctgggccgaatgcactttcgtgtgcaaaaaattggcccctcttttggagagattgtcactttcgccggttttccccgaaacggtgtctgcgaaaaaagaaaagaactgttagaatattatcacaattaccgttctccggcacccttggcaatgtttgactggacgaactttgtgactcaagcaaaagtgaagcaaaaggaaaggaattgttgcgcatccgattctaaaataacaaatggtagcttaatgagcatctgattttttttatcaaaggcataaataaagcttctggttttcaggcaacaaaaatcttaaagataggcatttaaatggaagcccgtagccagaaaaaaaaaatttcgaagggcggaatcctaagaccttttttgctggcgaaaaatatttggctctaatgcactttatgagtccaatcagagttt

SEQ ID NO: 10965 - DNA, 3001 bp, Heterodera glycines
ttttacaggaaaaaataaataagataacaaaatacaatattaaaatgatgaataatttattttatgcaagataaatattaataaacaattcttaaataataagtaaatgttgttatcatattacttagcaaaacatacattttttgaaacgaacgagcaatgcactgatatacatttgggctcgagataaatataaaatatttaatacgtaaatatttatttacaaaaataacaaaaaatatatggaacattttgtttgaatatattttcagaaaactgtaaattcattaatacgtttgaaaaaattgtgtgaattctgaaggcgagttcgcgcatgtcaatgtgcgggtcggacttggttatgacggtgctacgtcatttcgcgacaagtgcaaaaagggcacttcgcgacagtgcaaaaattgggcacttcgcgaaaaatgcaaaaattgggcacttcgcgacagtgcaaaaatggtgtaaaaatggggcgtttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaactaaatattttatattggtttttaatttaatcttttaactaattatatttgaatatgattaatcaacgtaatttgttagtagcatttttttaatttattttgagtttgcaaggcttcaacatttgcattattctgtgtagaatcatttacacaaatacaagtctaaacgttttccattggctaaacaatatagcaagataaggggaaggttttcttggactttgtggatttctttctgctttccgtttgcatcctgaaaacagatcttattaacgtggtgatgttttgttagtcgttcaaaaagatcgaagatatattcggttttaaaatcttcttcctgtataagcatttcaccgccgctaatggaaaatgtcaaggggaacaatgccgataataaatcgttatcttaacgcagcttttaaaaagttacataattttcaaaaccttccgataacatctccaaaaattcatccaaaattagggcaaatgaggcccctccggcagctccgatgagagtggataatacggtttttgcagttttaagggtttttaaggaattttaaatttgttgaattgggacatttccaagcaattatagatcctgcggagttaaagcaaaactagcttattataaaattaaaagcatttgcataaattttttaaaataataacaaaaatttgctctttaaataatcaagtataattttattaaaatagtaaattgatttgctttttaattggttgattaatcatattcaaatataattagttaaaagattaaattaaaaaccaatataaaatatttagtttgcttaataaaatttattttgctttgcttgattgctgtggctttgtgtgtatgcggtttagggccgaaacacaaataataattaatttaaataaataacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaatttttgcatttttcgcgaagtgcccaatttttgcactgtcgcgaagtgccctttttgcacttgtcgcgaaatgacgtagcacccatattttgaccattttttgtacatatttttgacatccctaggcataataaagagaaaaaaaaataataatttgtttgtttgcttatttaaatttagattatgggaaaaattcacttcgcaactcaaagttgaatttttttttaagccctgatagcctaaacagcattaaatctaaggaaattcgttcttcagtttataggatcaataattaagttgtttaaaagattaatttattttttcaaaaatttgttaacgatcaaatgatcggacacaatcactttcaatcgcttatttaaaggattggccgacatttgcggcgctgacacttgcggcgcagacatttgcggcgcccagtaaaagcttgaatgtgattaattattagagcccgccgggtcgggactcccgcgggatttttacgggattcccggtcccgcttttttcggtgaacgggattttaaagggagcgggatttttacggaattcccgttcgggactcccatcccggaaaactttgaactcccgatcccgctcccggaaattttttttaccgggctatatcatcatctttttgttttccttattgtcaaaaatttttattacagtatcccatttatagtttgaaaatgctgggtggggcgaagtgaaacgttttctgaatatgttacaacggcaaacgactcaacctttatctttgattaggttgcaagaattattgttaaattagtcattattaaaaaataaacttaaaataacaattctgttaacttaaataaattgttgaaatatttttggggtcatttaattctgcgccgcatatgtcgcatcacccaagggcgtagccagacccttggctttggggggggggggggggctgaagtcaaaaattcgatttttaggggtgtatttttcctttttacgtcgatttttaggggtgtattttaggttttttgaaatcccgaattatggggtgtattttacaaaatttttcgccgttttttgtcaaaaaattaatattttttgccattttggcctccatttttcaaaaatatggtaaaaaggggtccggcggggccgataggcgccgccgggaaaattttgactattttaacgcaattttgttaagaaaattgcttaaaatttcaaaaaaatttactgaaaatttttacttttttgggtttcgggggggggtgggtc

SEQ ID NO: 10966 - DNA, 735 bp, Heterodera glycines
tagaatttttggttaattaaatactcaaaagagattaaatgcactaacaaatcatgaatcagaagaaacgctaataagttaagcataagaatgtttaaaaaattattttcgaagtttaatttttttaaaagctaattaaaaacattaaaaaaacatgggcgacgcagctcggtcttgatccattggacagaaggtaagcggaattgaactcataagtttcatcgaggcataagcagaagctttaccaactgcgacaccccgccactaaaagtgaatgtgtagaaatgaatgaaaaggaaatattttgtatgttttgtgttaagtcgaataccgtatatgctctaattatcccccaccccagatgaaccactttgcgacctcttcaggaagcgggggaccataccggaaacaaaatgtttggttttctaagtagtttgaagtataattcacctagaaaattcaaaattaggtttatactagagaccggacaagagggtcggtcgaacggtttcggttaaaaaccgaaaaaaaaccgaaaccgaaaaaaaccgaaaaactcaaaaaattctcggtcgaacggtttcggttaaaaacccgaaaaaaaccgaaatcaaaaaaccgaagaaaatttttcggtttatttcgatttttcggtttttttttgaatttgtttattttttccaaaaaagcaataaaccatttttattaacagaaaaagcgaaaaatctgggcgcc

SEQ ID NO: 10967 - DNA, 5657 bp, Heterodera glycines
  misc_feature (76)..(76): n is a, c, g, or t
atcagccgatagctttcggtggtcttagcgtctggcacaaccccagccgtggccatatcgccactcctgcggcaanggggccattcacaatttcgttaaaaaaccttattttttggaccatctacaaaaaaaaaaaaaaaaaaaccgctccaatgccggcatcagtctcgtcggtgaatggcagcacctccttgccatcccgaaagatggttgtgacctttcggtcaactcccttgccatccatgaggtaagagagtgcgccgttggccctcgacgccttcattttatccaccggaatggtggacacagcaatttcggctggcaacgtcgacgcatcggcacctccgctcatgaagcaccggcttccgccaggttggcacccacccaaggtttgcccactctcccgccctgtagtccgtcttgcttcggatgaaataggctgccattgctcatggcgcagctttatggccaaaccacccaccaccgaaacctttttccaattgttgtcgttgcgaaggaatgccaataattcattgaaaaagttgagcttataccaaaagtcgaacacttcaatcattttggattaggacgggacgtaatcacaattttctacaagtcaataattatttgtatacttctgagcttatcaggaactctctatatgtaagttgccgactctctacggtttagaaatctcacaaactgtttacattttcacatatttttatttttttttagtgtcaaatcattgcctaaaagaaaccatcaattgcaaattcaatatataatttcaatttatttaattcctcgcctgggggcctaaaaatatttaacaataaaatagtagaaaaaataataatacaaaatgtaaaaattaaaaaaaaaatttttttttttttgatcattattggctcatctttgtctttggcaacaatttggcacatcaatcggtcatggtccaaaatgtgagcacactccgaacacgctcgaacacttgcgacgtcagccaatagcaatgcgcaacttcagatcgctgcatcaacaaatgtcaaacagcacagtgccttgcctgagggcatgaacccgtagtttgaacccgtgtgccttcttctaactccgtcaggttaacgcttgaatcgaattggtgggggaaaaaacgctgattagtttcttccccatacaaaaagacatcaatggccataatttctgaggtgattttattttggatcacttccctaattattccacagcagctcgaagggacaatttgacttactgattgtcccagttttggaggagaagtcatttgcttcaaatcaattgttttgacccgagttcctaatagagattgtttgttccaattcaacgaaatttgtgtgaaatgtggccagttattgttagggtccaatgtaattgtcgtcacataacttggtgtactttggaagacaaattgatctgattctaagcttaaatttttccggtccaatagctcattttgttcgcccaaaatgtccggctgtaccagtgcccacagtatggggtgtgagatgaacacaaaccccaaaactgagctttcaatcggtggcagatcagctggcggtgggtgtggtgtcagaaaatattttctcaatttccatatgactaggcaatttttcagaatccgtcagttccaaattctcaaacaagttcatgaaattaacagaattttcgtcatcttctgtttccactaattcatttccatttccgaccatattttctgtttcttgcccgcgggcgaaggagttaaaagaattgttagaattcatcttcttttgttaaatctaagagagaagggaagaaaagaatgttcataaaatgagcaaggtgaaaaacagaaaatgaatggctaaggagagaaggatttattgaccgatgggtgcgaagaaggcggggcaatgtacatgacgcatacattaaactaagtgctagtgctagcataaatggatgcaagagacaacgatttgagagaaatgaaaagagggtcaataagttgggctattaatgaatttcacttaagtttagctttaatctatgaaaattttatccaaatttatttatttttttttaaattatttctcttattaggctaatgctaattgtaagccaaaacggttgaataaggtcattttgagatttctcggccgacatggtgtttgaatttgttgagttgtataggcattggcgaagtgtttaataaatgccataaacaattgagactcagtgctggcttttatttatgttattctgtccaaaataaatattgatggcccatgaattataattaatttattaaaataatagttttgtatcataaaggtcgaaactagcagcataaataacgcttagagccttattttgcgtaatttagatcaaaatctcggccgacaagggtttaaatttcgattgtcataccgctacctatgtgccgccatggactctctacaatcacccaaacgcagataaattagttaatttttttaaattttttttttctctcctttttctgtttcggttctcattggcattctttggtcattttttttttttttttgtctccttttttttttgtttttaaggcaattctctttttgttgccattcatttcccatgggactttggtggaaggcgccgttctttttgcacaaccaatcccattttttttcttcttcttttctctccaaggccaaagaattccttttttcccttgcacattttccttacgtttttgtccattttcgcaatttccttgtgccggcatgtttgcgaatgttccattccaccccgcctcttatttttggcaatcataggctccaaagaccaaaattcattccgaattattcctgaaatattttgcctttctttcaaccaaacgcaaaatcatattaaatgccaaaaaccaaaagtttttctttaattattttttcccatgcctgcgggccggacaaaagaattgcttgcatgaaattgctaatgatctttctgctattgagtttgaacgttcaaatcgtagagtccccacaagaaaatcaaactaaaggaatttcagtggataaagaaatttgtgaccatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcatcatttttactattgccggcatttccttttgtgtaattcgcgcatatttgtggtcaattgaacccgattcaattgaaattaatgtttgaaatttcttttcaaaatttgcaatttccccgcttttgactgcgtttttaattaattccatatgaccaaagttttgcagtgcccccccccccccattttttttctctccgtgccaaatatggcagccgacggaaagcaattcatctcccgtcccctctcccgttttttgctcttccccgtcgcgacattagctttttgcggcgatgaatctcccctgccgctcgggagaaaaacgttttttgccttttttttcccattagctcgccgctgttgtaacatttgaaaaaataaattgcatttttgctgtaacgcccatcgtccactcggacccgtcgttatttaaggccggctcatccttcagaaaagccatttcttgccttcattctcacttttcctccgctccatcattttttttcatttttccatttcctttttcaattttcaatttttctttttttagatgcaaaaacctactccttctaaccgccccaattcctctgtctccaaaacccttgcctgcgggcttgaaaaaattgtgaatttgagtggaaatgagccactctcggtgccggtgctggcggatcggagtgatccgctggggctcaagtcggtccaacccgacccggtgccaatggaaagtgccgaggctggcacaaaagaattggaagtgatggaagtggatgaaatgagcggagaaaaagggaaaaagggagaaatgggtaaagaaaaggtgaaaagtggtggaattgaagaggaggaagaaagtgagtgcagtgagggtgaactgctaggagacggtggatttggcaatttgcaactaaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaataacgaaacaggatgggaagagcgcggagattggctgtatgaagcaaccggacggctgaactaccaagccacggcaacggacgtgagccaattgcgccagcgcatccccactcaggccgtcggaattttggtcgatgtgcaaagagcccgtgaccgacacgtcaaagtggccatggtgtcagcacctgagctgagctgcgtgatgcgcgcctaccgtcgccacttcccggccgatttcacggataacgacatccgctaccgctccgttgtccgtcttcaacttcggcagatcaacagtccgccatgggtgctgtattcacagcagtttgcgtatgttttgccatctgattttggtaaaaaaaggggcgatgaactgctcgttcatcacgcaaacgtcattgctggcgttgagcctgagccaatgggctatgagttccctttcagtgccgaattgagctgggcgaaggtccagctgggcgagaaagtcatggccgcggctgttgcggcacaggcattcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcaaccaaggcaaagccttgcgcgcatgggtatgtgctgagcatcgaaaaaagggcgttatgtcgggggtacgaaattgatgttaaagtgatcctttcctaccaagaagcgaaggatcaggacgcgcaggaggaattcgatcagatgcgctgcggcgaactcgacggatgcgttgaactcattccgcagacgtcagtcagggcactgcaggaacggatgttcaccttgcgatccaatgactgctcgaaagtggcgatggacgaaggaaaaggaaaggtgggccgaattatgtcgattttattgggccgaccggtaaaaccggaaagcccaaagggcaacaacccattaatgacttttggggctctttcaaaattgaaagagggacaggtcgacaccgcgctgtgcatgctcgacgaggtgccgcgcctggtctttcaacaggccgggcccggcaccgggaagacgttcagcgcagcgtcgatcgtggccactatcctggccacggatcccacggctcgtgtgttggcgctggccccgccaaatgtcgccgtcgtcaagctggtgctggagatgcag

SEQ ID NO: 10968 - DNA, 946 bp, Heterodera glycines
  misc_feature (780)..(780): n is a, c, g, or t
  misc_feature (929)..(929): n is a, c, g, or t
aaatgtcaacggcggaaatgcgtttcttgagctcctttgttcaatacaattgataaaaaaattagtaaatcattaaatatagcggtcctaatcctcccctaacccaaaaaaccgttaaaaatttttaattacaatcaatataaaaaattttaaaaaaggcttcttggagatcgtgtcttggtccatttttgaccattaaaacttgagtatgtatatgcatataaatagttagaaattgtacgaagaaactttcaaaaatttaaaatgactaatttaagcattcttgattaggttatatttaaaaaataaatacttatacacaatattttaaatataaattattcccataccctccggcactggtcctccgccttggctattatatccatcagagccgaactcagtgactgccactcgattgccaagtagtgctaaacaagttttaaagaacgaattagacacaaattaaataagcaaaatttaatttaaaattttttctaaaatttatttttaaattaaaaattttcactttacccaattcttggaaaattttctcgctaaaaattatataaattgttgattttaatttttcaggcgctaagttttcttgagaaagtcatttgcgcccacctttggcggactgtccaatgggcggcgccggcggcgcctccactcgattcgaagcagcagaaccaattggactcagcggaaggtttggcgccgcgcgtgctgcgctcagcacggcgccgccactgccgccgcctgcgcttgggctactgnaaagcgccggccgatggggcggacgcaaacgagccggacatggatgtgcaggctagaactgaagtgcagcaatgagaatttttgaaatccccgggtttttaattgggggaggggtagtaagtactcagacgggaggacctattttttgngggtcggagtcgtttgg

SEQ ID NO: 10969 - DNA, 3365 bp, Heterodera glycines
  misc_feature (3315)..(3315): n is a, c, g, or t
cctagtcccattttttggacaataattccgacatttgggctaaaaactaataaattatttgaaatcaaaaaccaccctccccaccctataaataagcactaaaataaatatttcttatgcgagtaatttatgttaagaatccgctgttttcagagaagcctagaaaatctgctggaaaaatagggaaaccctaaaaatccttcccataataatgaagctcgagactcgtcggtcttggtcaaaggaacctctcggattttttccgtttttatgtctaagttttttttagctccctttctggcgccgctctctttaggttttcccaatttggcgccaacctccgttgtcgacccattggaccaccagcaacagtaacaatgacagtaggaaaaatggaatggttactgtacaacttgtgaccccaaaataatgttgttttcctgttgatgtccgtcgtctatttcgttctctcattttgttttgtgtgctattttaaaatggccgaaacaaaaattatttaattttttattttttaaattcgttcaaattagggaatggaattttataaaattaaggatttcgggggttcgggaattgcgccggatcggattcggggattaaaattatgtgtttacggaatattggtcctggtgtatttcgtgtcctgcagagactctgggaaaccccgaacagaaggaccccgggaaaaccctgacaggatcccaggaagattctgacatgacaccgggaaaaccctgacaggatccctggaaagccagagagtcactaaaatgggacctgtccaggtctctaccagaaattatttaattggaatgcggatgaagcaaatggaggcaatcaattaattcataaattagtgtgtatgtatgatttggatttggtttggattttcaatgctgattatgataatgatgatgagatgatctgcaagatcagtatgatgacaaatggagacaaagaaaggattgggaaaaaatgagttttcttcgggagtcaaaagctggtttctcggcagtttgtgtgcgtaggatgatgcccttttttgtcgagagtcttgggattagcttttgcgtggaaccggtcatcattagccgggctaattgatccgccccgccggggggcaaaattttgggcttttataaatgatgagtcacggcgttttctaattttaattaatttgccagtccgaattaccaccgaaaaattatttgattaaaatcattattattatattaattttgtcaaattccgagattcttaagcccgaaaatcccaaaatccttcaaataataaaataaaattaatttgtacaaaaatttaatgataatttattaataacccaataaatatttataatttttgggaaagaaataaatggtttaaacacaaacaattaaagtattaaatttgttatgaaaaatattttaaaatttcccaaaaaataataaaaaaattaattgaaaaattataatttgttgcaaatcatattttcttaaacctaaaatattaataaatttttcgaaagcaaatcactaataaacccaaattaaatgcaaaatttatttaaattaaatttgtttaaaaatatattgagaaaaatttgaaaaaaatccataacttgtgtgtttttagaagaaattggaatttttcgcgtaatagcgcgatctcaacaatggggggagggcgatttgttgtgctattcttggacgacaaacaaaccgcgaccaaacccattagaaaacccgaaacggcgcccgcggcttcgacaccgatcggagccgtttggcgacgatttgtttgcgtttgtttccgcttcgcttcgcgcaccgtttttcatcgtcgttttttttttcattttttgtttgctgtacggtgccccgcggcgcgggcggacaattacaccaccgcgcgatcaccgcaccacaaaaacaacaaaaaaatgggctatcaataatttttttttattggaagagcaactacctatttttttgggtgagcgggattgttgcaagatgtgaaggcgaagtgatcggagtaccaccccgcccccgccctccttttggattgatcagtttgaaattcgggattgttgcaagatgggaaaggtaaagtgaagtgatcggagcacccaccccctttttggattgattggtttgaaaatggtcgctgatcaggaaattgaagaaaaactaactgatctcagatgcgtttaaagaaagcgaaatgccttgcaaagaatgaatggcataatgagaataagaagtatcattttgaagctgatcaaaaatccaaccagtgggaacaactgatcgggaatctctttatttctaagtcttcggaaacgtaattgttttaattgaaaatctaaatgttataagcaccgatcagcaatgaggcttcgattgagaacaaattttcataaggaaactgatcgagagttaatgtcagaagaaattgattaggacagcattagctgatcggaagtttgccgtcattaattttttaatttcttgagtcccaaaattaatcattggcataaatgccaaatgatgacactgcattcatagaatattttgcatattttatgtatgaataacgaagttggatggtttcagatttctcggatcgctgatttaagcgagcatttggtcacaatgttcgtgcgcgccattttgaccgaaattttgccgtgagaaaaatccaattagagagaccaaacaaattaattaatcattcatttcccatccataaatggtagtgtgccaccggcacaatccctcaaaatgattttggcgggatgatcagcagtcaaaacgggatttttgtggtggtcatccgccgcgccagactttcactgtttgattaatttataataaatactatttatttgttattactggaatgttctttcttgccgagctggatttcggaagtgagtaattagtgatcaatccaatccattcattaaaacagagaacggaatgggatcaggaattcgtcaaaatttcgcaggatttagagtgattagtttacgcgatttgttttgaaatccgagaatgggaaaattgcgagtcgagagtttcaggatttggggtgccgaaaatttccgaagtaagatcagaatacggggataaaccatgaatttcaggggatcataaaattgaaaattcgtcggtaaagaatttttgtatattgaatgtagaaaatgtaaatttatccaaatttatcgggacatttatggaatgaatttgaaatagtgaatttttaaatttataattaaaattgtggaccaanatattgcagatttattttaagtctaaatcgggagcagaattaatggaaat

SEQ ID NO: 10970 - DNA, 2610 bp, Heterodera glycines
  misc_feature (21)..(21): n is a, c, g, or t
  misc_feature (2500)..(2500): n is a, c, g, or t
  misc_feature (2568)..(2568): n is a, c, g, or t
ccccccccccctttctcctcntgggatacacacgcttatattctggtaaattaagaacgtaacaaatggctcagttggtaacgctttgcgtttttgaatatttaaggcaatgatgaaaaaattgatttgtttaggagctaaacaatgacaacatcagctgtaatgatttgagcctttcaattgccattttcttatttttattgtttttcattttttgatcagaatttggtgatcattgcctcactttgcgtcgcgtggttcgaactttggctgatgcccttcagagttttgcaacgcgaacagcagagagaagtgtaaacaaagaataaattaatgaatcgagaattgaataaataaaaggatcactcagataatgccaaaacgaactgccgggattaaatgccaaattaatcactaattacataatttccgatcattattttttcgtttaagaatttccagaaaaatttcagcgaaattgaagcgaatggtgtcaatggaacggacgaagcggggcgaattgcggcacagtctttgatccgccaaattataaacaatgaggaggagcttttccaaacggcgatggaggccgattcaagcggtgaatgatgccaaagatttgtattcatttcgaaatgattttagacgaaaacgaagacagatgcaaaaatgtgagtcgaattggcagaatttcgcgtcgtaaatgcaaagaagcgattgcacgtgctcaaaatgtggcggaccatctgagcagcacagttcacgcgtggaaagtgctgcaaaagggcggcgcattggaagtaaaaaggcgaaattagcaaattaattaataattaatgagtggtaattaattggaaaaggtccgcttccacgacgagacgaacagttattatgtgaagacgaatttcgaacacaatgcccaaggtgggaagggattaaaggggattttgaactaattgagggggattgaaagcaataagcgatttgaaactaattgaggcggattgaaaacaataagcgattaattaagcgatttggaatgcgatttggaaggaaagccataaatggaacacgcagttgttggagtcacgaataattgcaggtaaagtgtggaaaaaggggaatggacatattttttcaatgaattaaattgggataataattttaaattatggcatcagcaaatgccaactttcataccgtatgcctttcagtgattgacagtaccacggacatcatcattagtgtgacgaaggccgccggcggcggatacattgcgccaaggcatttcattgatatcaggtggattttgaaaaattgtgcttaattaaaatggaataattacttatttaaattaaagtataattaataaaactttagacgctttgtcactgacgaggcgggcattgtttttgtgggtgtttatgtttcggtcgaatcggccgaggacacaattcggccgcaccaaccgccggagaaacggcgcggcggagggggcgggggactcgaagttcggttggcactttcgaatttgacaaatgctttaaagacagcttcaaaagcataagcattgttttttccctttcagcggtcgtaacggtgtgaatatgatccgaatttctcagctgggaccgaacaaatcccttttcgaatggattatgaacacggatttgcgagtacaaaaaacaaacaaacaaatgttgtttgattaatttctcacttttcagctctcaatccctcgcatgctgataagaagggtcccattattattgaattaattattttaattaattaaattatttttattaatttgcaatattttttcagacattgaccactttcttcgccgactattgtcgaatgattgcgaactttttacatgaaaatcccagcggaatcaaatgaagaatgtgactttcaaaatcaatggaaaaccaaaaaagtgatcgctcgcttctccaaacattggcatctgatcagtccgcgttggtttggaaaggcccaaaaatcattcctttgccattccttccaaatttttgatacagacaaattattttataaatggctatgtctcttttattgtgtatttcttttgtatcatattaaatttttgtacggaaaatattcgcttaaaatgccattgtttggcatttcgtcaataatttctgacaattgccggatggaatttgcttggccttggaaattgcgcttcctttttgccgttttcgcatcgctttcggttgcatcggtgcagcaaatagcaaatgccccagcagaagaaaatcaaattgacaaaagcgactaccaaagcgatgttcactaaaaaggtggaaatttaaattatactaaaaatagaaaataattatttgccaattaaatatgtcattaattaattgcttttgcattcgcttttgccaacctcggctcattcgttctgcttcttcgtcatttttttcggccgatgacaaagcaaacaaaaaagtgagaataaaacaattanatggaattaatactttggacaaaactttgtgttgcatttccttaaatattttaatattaaattgactncaaataatacaaattacaaatataaaaatctgaattaatgcc

SEQ ID NO: 10971 - DNA, 2547 bp, Heterodera glycines
  misc_feature (107)..(107): n is a, c, g, or t
  misc_feature (2531)..(2531): n is a, c, g, or t
agtgctttgtgatcagtgaaagactcaaaaaatcaaaaaaagattgatcagagtgaactaatagtgaatttaatattttgattttccagtcggcttttgctcgtttncaagcgagactgtaaccgagcgaattgccatcccggctttttgcctgttgggccgttgtactgctggctgaacaatcgactgaataatgcctcctttaccgttacacgtttatttgctgattttgttggctgttctttgatttcttatgcaattgatttactctttttttgtctttattaaatgtaaatgactacggtagtaaattcaacaacagttttaacatttattacaaaatgattaaactaggtaattttattcactagctacgctgtatacgatatttgaccccgagagtcgaaacatagactcaaaaaacacgggaattgctcaaaatccagccctactgataaggtgttagttaacaaattcaaatatgtcatgttggccttttgcctttttggttgtggcaaatggaaatggaaggatcgcatcactcattcattctcttgtcatttgtcagttgttgcatttccatgtgtaaatatttaaaccgagttttgttttgtttttctgtgtttctctttgcctttgctaatttctgttcaatttcagcagcagtcaaacggcgcgtcggtcccatgagctgtttgttgctcatgtccaaattcgcagcgagtaaactgcagctgttgcgcaacgatgtgctctttggggcccgtatttgtttcatttgcttcctctggtggacttcaagttcgggttggtcttcttctgccggtgtttcacggaatggacgagaaccgttttcagaattcaggtctcagcattgtcaacaagttgacccttcaggtggccattatttctaaatgtttaacatacgcttttaatttttcaaaattaaaaccgtaatgaatgaaaaacatgtccttctttggtttgttttccctattaaatcctaccattaattggtttggctttaattcccctcccctccattgcgtgtccctccaattttaaatttttcctccctccattttatccgtttttctctaatcccccactttagaggtatcccttccctctgaccattgctctgtcctcctgccttaacaatgtgctctattccctgcccctactccgctttttgtccatctcttccgtctccgtgcccaccgattatttgcttcgcattgttttgcccatttccgtcggtcgcgcggtggccaccgtcagcgcatattttgcgctgtggaaaatcagtgtcagctacacgcagacaagtcaaattgggaagggatttgtaaaagcagaaaaatgttgggggtttgggattagcctcttttttgcagccttcacggaccttaaaaaattacacagccaaaaatatgacacaaaaaaataacacaattaaaacaaaagttattttgagtacgtagctcatcttaaaaaggctagcactttcgcaaaatcaggcgcccaaaatcatattttttccccaactaggccgggccttgatttttatgtgacccaattgggcaaatttccaaattttaacagactttgataagccattaaatgcgctttttgctgtctttttatctgtccattttgccctttcagttaaatccacaatgcctttgttcactgtgctcatttctcgtcttttgcttggcgaacgtcagcccatgcgaatttacttgtctttgttgcccattatcacaggtgttttttcactggttttcactaaattttcaattctcatttatttttaatttttcggtgtttttattacgactgcgaccgaattgcaattcgattccttcggcctttgcttctcattactttcgacgggaattcttgcttttttgaatgttcttgccaaaaaggtgggcttaagattaccattttcaacagattttagagagaagtcaattcgaacaaagttcgaatgctcggtttgggaggggaacatagaaaccctctacgattttaaattgctttttccttcccatcccacggctttgtaattttaattttgcaggtgctcgatgagacgcgaatgcatccgataaatttgctctctctgaactcccaattggcttctctgctgctgttccccttttggctgttcaccgatgctctcaaaatgtggtcgaacattcattcgacaaatgttcgtcgtgtaacatttcattcattccaatggattcattttgtgcttttgtttcagcgacacaatcagtcgcccgacccgcgctttctctttatgcttctcctttccggcctttgctccttttctcaaagtgcttgcgcatttgttttgatacatcaggtggatggacgcacaaaaggacgacaaatgcatttcattagagataaaatttttttaaattttccttgtatggcaatcattttaaatagagtagagcgggaccgggaattttgggcttaaccgggaccttttcaggttgaaaaaccggganatttttggcggggaaa

SEQ ID NO: 10972 - DNA, 1545 bp, Heterodera glycines
ccaccacctcgctcctccctcctcgtcttcatcttactccttctgcctcatcctcctccaccagctcactcttccctcatcctcctccaccacctcactcctccctcatcctcctccaccgcctcactcctccctcatcctcctctctctactacctcactcctactcctcctcaatcctcctcaatcctcctcaatcatccttctcctcctcatcctcctcccacctcctctttcatctatcttactcgtttattttatcgctactccatccactataaaaaataattaattaattattaatgaattataaatttcaaatattttttttaggaactttatcctcgttttttaaaaaacttttttttaaaattttttttattagattattttttaacaatcaattctcaatttccattctttgttctttcgttgtttgttgacgagttgtgttctgcgcacccatcattccacaacttaaattaaatttaaaaaaaaataccctaaataaattagcaagaaaaaaaaaataataataaataaatgtaaataggcggataagccctatgcttaaattactcgcctcttagtttaaatttggttaacacacctaaaactcccaacctcccaaagagcggttgtggaagtgcaaccacccgtcgtaccacccctcccccgccctatcatcctccttctcctcctggcaatcgtaatagggcggaggagggaagtaaggcggcggcgatgaaggcattggcaacagaaaaggaagaggcatgacaggaggggccagatagtctaattttagaaaaaaaataattaccattaacattccaaaaaaatgtcattaaaatttaaaaaaaaaaattgcatttatatttgaattaaggatgataatttaattaatttcaaaaacaaaagaacatttattgaaatggaaaaatgggccaagaaatgaacaggaatgggtacagttgtggtaattaaatgacttaaaacacaaagtttaattaaaaaaggcatttaattattaaaaaaaataaaataatctttcattaaaagtactcgttaaatgaacccaaaaaaatagtttagtatcccgaaaaattaggtaagaaaaatgttatctaatgttctaaaaatgggagttgaaataattcgaaaaaaattatttaaacaaaaattaattaattaattttaaaaaagggcattcatttattgaattagtaatttagtgaatcaaaaaaagaccatttaaagtatatagaatgttaattaaagagcctaaaaagacacaatttaataaagaacgtcatttaattattttttaaaaatattcaagaacaataatccatttaccagtcaaaaaaaaacattttaatacccaaaataatccatttaccagtcaaaaaaaacatttcgagccctaaaaaaatggacaaaagtggtcaataaataatcatttaattattttttgaaaaatcttttcaaaaatttaccaaaagtggtcatgggcattagcaaatccactcccgcctcctcctcc

SEQ ID NO: 10973 - DNA, 2346 bp, Heterodera glycines
  misc_feature (2259)..(2259): n is a, c, g, or t
gcaaacgttccacttaacataccggaaggaagagggaggggattaacaacacaaggaaggggggttaaaggccgctaatagcgggcgtaagcatttggggggggggggaaagcgattaaggtactggggagagtactgtatccattgatcagcccgtccgctctctctctcgcgcattctctctctctctcattctttgcaataagtttgggatttatggatcgggagagggagaggaagggatccccaaacaggtcaataggtttgggctcatgattggatgaccaatcaaatcatcgaaatcaatcgataatttgattgggaatattatctacttgccaggcgggtgccactcattttgacaattaaattaaccggggaatacgggaatgtgctccatatccgtttgttgttgtaccccacctttaactggcccagtgaattagggagttttgagaggggatttgccatcgccgtttctacgtaatatcgccccggcaattacacttaacgacagctgcgtcatgatgtgtatagcatgagtgacacacttcctgatctaaggtgcaattcagaaggcgtgtggcagcggatttggtcgggcaccataagtgagtgaaccagtccggggctaaggccgcgtgggtgctgtttgccacaaaattattccccaaaagcgggagcggcggaagcccactgggggaaaaagtgattgataagttagcagtgggccaatggtgggtgattcccggggacaatttgacttcttcggattgggacaagccttcgcgttcaagagtcaatcccaaccgtaaacgaaactgccaagtgggacatttaaacaactcgtagacgaaaggtgaggtgggtgcgacaaatatgcggtaaaacaagcacgcatattccggagaaagacaccccctacggatgaacccggatgcctccctacaataatttaatcccggaaaatctccccctaactcgggtaccgaatgaggggtatgaaagacaagctctactcgttggccaactggcagcaacgttagagaagtgacgctgtcaaagtgacacgtcgtcccaccataatcggtggtgcactcttctgtgccggcagtgaccgataccacttcaagcccagcatttactaccgtaacccaaaaaatggcaacaaaaaacgcaattattggtggggccaaggcgtatcccaaacggctcagacgtcggggtctgggcgactcattcccttggcccaagctacctcccattaattggccctggtgaataaaatttcactttcttcgtccgatccttcctctcttacagtgggtccacgtctccatcttacggtagactcagggatttctcgccgagtattagccctgaagaaattggcaaaaaagcggctcggtggacatcaaaaccggcccgccttagtacccaacaaacacaaatgagaaataagaccgcaattgccacggcaagtgttccgaggacaaaaggtaataagaagggagcacagtgcgggttaaggatctgttcccaacaaaaattacacttaattaaattacacccctccaccgggtcacattgcactaatgaggaaactcgctcccccgctaaagaataggtaacatggcattcataaccgctagccagcaaatcaggtgggagtgggagtaaataaggggtcgagtgtcctctgctgctgcatacaccctcacaacagacaagtccattttcagcctgggggttcaaaaacacccaaaccccttcttcggcacacgaaaggacacgtgccgcggaatgtactccgcttgcccaaaacaacaccaaagccaaaatagtcatgagcggggggcgaagtgcccacttaaaactggatggtttcaattttctcccttcgggggcctgcccaattggtggcggagggcggtcagcccatttgaattgccccggggccgttttcctcccctttttggcccttaaatccgttactctttcgcctatcccttctttgtcggtgatcgtgggcgggggtgggacttcattccattctgcggtgccttctaacggtaccaattgattaatcggccgttcccattctctccccgttcccagtaaaattttagcgctccgtggcttctccgcgggaaacagagcgaggattcgccccaagggccagtgattcctcgggaattcctcctgttccacaagtacaacatccccaattttgggaggaccaggagcggagatccttgngccggaatgggtgtcctgggtgcggcccctcaaattaaaaggtactcccggctccaaaccttcccaaaacgccggagggactcatta

SEQ ID NO: 10974 - DNA, 2465 bp, Heterodera glycines
  misc_feature (2395)..(2395): n is a, c, g, or t
aaattcacaaatggatgataaaaatttataaaagagaaaagccggatgttttttttaaattaattatttttttattaaaattttatcccatttattccgacttttgcgtagcaattcggctgacacgaatggttgatgaaccgcgcgaaattgccctttttggtggcgtcaattacctgcgaaaaaaaatgtgaaaatagattagaattaaaacacttttaagcttcaaactgcaaatgaattgaaagatcgtaatattaaagcgaaagcgtaagaaattaatttttcatgaaaaattccaaaatatttgatttggaattaaatttttaaaatttgacaaaaatttgtaagttccgattcaacacaaaagtagacgtacattgtggtcgtcaatgcggaacaggtaggaggagccgatgccctgccgctcgtaggccaactcgcgcacgttggccacctctggccggattttgtcgcccacatactccacgatcatttcgtcctgcgcaatcggttccagcgcgaacaggccccagccgtggatgcgcgagcgggcaaacttgatcatcttggagcggtactgaaaacgggaggaaattatggaatgtttttaaggaatcttttaaaattcatatttttaacgcctcccgagcccccacccatttatttattgttgtgcagaaaattcaacagatactgtaatcatgatgactgtacaagggtgttaaaatttcacgtgaaaaaagcgatgagtgcaaataattttttgaagaccgaaagagaggaaaaaaaacaaatcacgaaaaaataatagagggatgcgacagcaatacaataaaaaaaaaaatttaggatgagggcacatcattttcgaattttgatgccaattttacaggagagggaaaggaatgtttgaatagggatttaatccggaattttttgcaaaatatagtggcacaccattttcgaagtatgattccaatttaacaaaaaaaaaagattaattcatgatctgaatacctaagtgggaaaaaaagattaaattaagccatgtgcatgaatgagccaaatacgtaaacaagtgctgaacagacaaacaaagttaattaatacgtacgaagaacaaggacaaatggaaaaacattttgaagcaaagcaaaacaacaattttagagaaaaaataaataaatttgaatttaagggataaaagaaaaacgggagggtgataagttagtagacagacacaataataacaaaaataaattggacaaccacaaaagaatctaaaagaaaatggaaaagccaaaagttttaacaaaaaacaacaacaaaatttttgcagatttttgggttaaactttaaaaaattcaaggtacttttagcgtttggggtaggcggattttttttttgcttcctcagaaaaccataaaaaattgaatcgcccacatcccccaacagcaaaagtgccaaatagtaatgaaaaatgatggatggcacataaaaaagcaaaaagcgaaaaaaaagaagcaacaaaaaagcggggacaacaaacaacaaatagccaggccatgttgtccatgacaccaccaccagacgcaccttcgattgcgccgtgctcctcgcagacgtggtggacaacaatgatgacgatgtgccaccagccggttgaacagtgccatcacggcactgcgacgacggaggcggtgaaacaaagttaccaccacgacaatcagcaccaacagcatggttaattgtaacggaggcattagccgccaaagcggaggcggcggcggtaacaacaaagggttttttatgcgatggcagcaacatgggacagcgagtcttaagcattacaccaccaccaccaccaccaaagccataaccgccagcaacaccaccacaaattgccggcaacatgaaaggcaatgatgatgatgaggacgacgaggataaaggcacgccattcgtctcttcttcctcctcctcttcttcttcttcctccatgcctgccactgggttcttcttcctcttcttcggcgcggtcaccatttccttttcctctcctcctcttccatcaccatcatcatcatgattatcatccatcatcatggtcaccttgagctggttggcacgggcaaacagcgtcgtggtcgtcaaggaggaggtggacgcggcggcaacggtgtcgccaccaccagcagcaacggtgccatcggcgcctatttccatgccattggtgtttgttgttgttgctgcggtggaggcggacgagggcgacgcggttgatgaaacggtgccgcacgcagcgggcggcccgggcacaaccccacaggcggctgcagcagcagcagcagcggcggcagccaacgaccgagcaatggcacgctcgctcttncacgcctggctgacatggcgtgccaccgtctcgtccttttttggggggcaaatttgatttggttgatttt
